United States Patent 6,812,339 (POLYMORPHISMS IN KNOWN GENES ASSOCIATED WITH HUMAN DISEASE, METHODS OF DETECTION AND USES THEREOF) - sequence listing, part 109

SEQ ID NO: 190265 - DNA, 601 bp, Human
tctagacccatctctaagataattatttctgactgtgactcattttaaaacatgtggaagggtctgctgggttttatcatttaaaaagttaaaaggtaaaatgtaatactttaaaatagtaattaaatatgattattcagtggttggctacatgtatctttataagtaagatgttaaatgcattctcatgaaaatctcttccttggcaaaagaactaaaatgtcaagcttgtgtacttattagttcaagaagcacttactgagtatctgctaagttcaacacactctgctaggagtgcaaygtttaaaagagctgagtctatcactgcctacaacttagagtgggtgaggagacagatatgaagtcaataaactagattattaatgatctaaattattgtacctgggaaaatatttgctgctgaaatattgagggatcgatagaaaagacaataaatgggcatccatcattgaacaacagaccagagttctgttattaacaaggactgcttgccaggtgtggtggctcattcccataatcccagcactttgggaggccgaggcaggaggatagcttgagcttgggagttcaagatcagcca

SEQ ID NO: 190266 - DNA, 601 bp, Human
ggagacagatatgaagtcaataaactagattattaatgatctaaattattgtacctgggaaaatatttgctgctgaaatattgagggatcgatagaaaagacaataaatgggcatccatcattgaacaacagaccagagttctgttattaacaaggactgcttgccaggtgtggtggctcattcccataatcccagcactttgggaggccgaggcaggaggatagcttgagcttgggagttcaagatcagccagggtaacctagtgagacccctgtctctataaacaaaatttaaaaattrtctgggcatggtggtgcatgcctgtattcccaactactaaggaggctgagatgggagtgttgcttgagcctgggaggtcaaggctgcagtgatccgtgactgtgccactgcactctagcatgacagacagagcaaggccctgtctctaaaaaataataataaaaaaggagggtactgctgggctatattactttagagacagtattttataccaaactctatctgaataatgtagagcatgatatatttttcatcacgcagctcagtggtcctacattcagttacgtttgatgcttgcta

SEQ ID NO: 190267 - DNA, 601 bp, Human
tgcccctaaggatttcttagtttgttatggacaggagacaatacaagcaactcatgtcaaggtagagattgctaagtgccagaggaaagtaaagctgtaaagagcagaaattctgatcaccatttgtatttgaaagctcaggaaatagcctggtcacttgaaagaggtggggagaggttatactaggaagacgaactgtgtttaaggtagttaggaaataggctgccagcttaaatgtgtgaaacactcagtctgacatgaaatggtgatgcttagagctaaaaaatacttgactcatcgraagtatttaaattaatttttaaaagtgtactagacgtgcagaacatatatatggccatcagtgtgacaacccttacttaagtgtaaacatgactttgacagaatgtgcaatgggaggagagtcagcttggtttgatgtgaaccctacagcaagataaattatatgggaataaacaaacagctgagggtcaattaaagaaaaataggaatactctataacctggtgctcttgctgagctgactgtggtaattagaggatgggtggctggggatgtgcaggtccctgtgcatgcatatgacc

SEQ ID NO: 190268 - DNA, 601 bp, Human
ctagacgtgcagaacatatatatggccatcagtgtgacaacccttacttaagtgtaaacatgactttgacagaatgtgcaatgggaggagagtcagcttggtttgatgtgaaccctacagcaagataaattatatgggaataaacaaacagctgagggtcaattaaagaaaaataggaatactctataacctggtgctcttgctgagctgactgtggtaattagaggatgggtggctggggatgtgcaggtccctgtgcatgcatatgacctcaaactctgcacccttgtatgctcattgwcaaaagaggtgggtgtcttgggattatgattaagtccctctggcacactgttctttgcagataaggccctatgaattgtctactttttctgtcccaatatccattcagaatagactacatgctatttcttggagtaagaatagaggaaaatgagagtctctttagttttcagtctaacgaggaatacaggtgcatatcccactacctaggaaacaagaaccatgttgataaaatgccagaatacaaacagagctgataaaaccaatagctggatggcttatttctgactgggaggattac

SEQ ID NO: 190269 - DNA, 601 bp, Human
gaacatatatatggccatcagtgtgacaacccttacttaagtgtaaacatgactttgacagaatgtgcaatgggaggagagtcagcttggtttgatgtgaaccctacagcaagataaattatatgggaataaacaaacagctgagggtcaattaaagaaaaataggaatactctataacctggtgctcttgctgagctgactgtggtaattagaggatgggtggctggggatgtgcaggtccctgtgcatgcatatgacctcaaactctgcacccttgtatgctcattgacaaaagaggtrggtgtcttgggattatgattaagtccctctggcacactgttctttgcagataaggccctatgaattgtctactttttctgtcccaatatccattcagaatagactacatgctatttcttggagtaagaatagaggaaaatgagagtctctttagttttcagtctaacgaggaatacaggtgcatatcccactacctaggaaacaagaaccatgttgataaaatgccagaatacaaacagagctgataaaaccaatagctggatggcttatttctgactgggaggattacaggtgtcttca

SEQ ID NO: 190270 - DNA, 601 bp, Human
cacccacgcacacacacataggtcatactcttagtgtgtgcagtataagctttttactgggagctattttgaagatgttcccttggctgtctactttgtggacataggttggctgactggggtgctcatcaggagtatattgtctgcagtgatgtaagcttaattctagtctcttttgtctactaaagttatccattgtgtttaggaaagacatacaattcacttgtagattaaaaaaaatagttctaacttcattgtgtttacttatcatcctcccaagaagctgggagctcctaatggmtattattcaagtcatttctcaccacacactcttgaagaggtagaaagagcccaggtattttaaaatctcatttttgtacttcggcggcacagcgtaatgaatcagaaaataaactagaaataagacccatgctttgtcctggaatggagcgcactttgttctagtaaatgttcctacctgcttttcttaaaattagaactagatggcttataaaatgtggcttttaaaaaagaactcttttagatgtctgggtggggtatcagatgatttttctgtaatcaaagctttattggagcgttg

SEQ ID NO: 190271 - DNA, 601 bp, Human
agtagcctcatctcttgaactaaattgttagtgcctttagaaaagtggtacaatctgaatcttctaaatgctgcatattgccttgatctaagttttgaaaaccagacacaatccttatcattggggcaccatccttgttagaattttttatctgttgctttctattcatctggaatgtgtaaatattaaattaaaattattttgggccgggtatggtgactcatgcctgcaatcccagcactttgggaggccgaggcaggtggattacctgagatcagcctggccaacatggtgaaacccygtctctactaaaaatacaaaaattagcctggcatggtggcacatgcccataatcccagctgctcggggggctgaggcaggaggattgctggagcccgggagacagaggttgcagtgagccgagatcgttccactgcactccagcctggccaacagagcaagactccgtctcaaaaaaaaaaaaattactttgacatctattaagaaatttgcagcaaagttaagcagcaacaatttacgcctttggggaattattgaatattattatgcctagaaggctgtcccttctttttcattttaa

SEQ ID NO: 190272 - DNA, 601 bp, Human
attaaattaaaattattttgggccgggtatggtgactcatgcctgcaatcccagcactttgggaggccgaggcaggtggattacctgagatcagcctggccaacatggtgaaaccccgtctctactaaaaatacaaaaattagcctggcatggtggcacatgcccataatcccagctgctcggggggctgaggcaggaggattgctggagcccgggagacagaggttgcagtgagccgagatcgttccactgcactccagcctggccaacagagcaagactccgtctcaaaaaaaaaaaaattactttgacatctattaagaaatttgcagcaaagttaagcagcaacaatttacgcctttggggaattattgaatattattatgcctagaaggctgtcccttctttttcattttaaagaacatttttctctgaatttatgcaaatttgaggaggctaatccaagtcatctctacagatagttaggcaagacaaaatgtttgatactgcaaattttctcttgaaatgtatcagtcacttccactgtataaatcatgtaatatgtcagaggtttttgtttggatgaagtaaagctaattgca

SEQ ID NO: 190273 - DNA, 440 bp, Human
acgcccggccgtattctgtcttttgaagatcagaaaatattgctgaatatgaaacaaaaacaaaaacaaaaaaaccaagttcttagcttcatatttatagtttgtctaaagaaaaaattgctttcttccaacgaactgcrtttcctgtagaacacaaattttatacttggaagaattatgtgtagcgattttgcaaccatctttccttatgaccaaatacttttgtgagctgagaagtctcaggttgacataattaaagataaaatgtgacaggaattgtatgtgcacctgtgtttgaagggggccttgcagtaagtagaacataaagatatatgcatcgctgttttggtcatctcaatatagtattgactataatctcatatttttcccactttataatttataaacatttcaactcatttgacaacccttacagttac

SEQ ID NO: 190274 - DNA, 601 bp, Human
gagcaatggcacgatctcggctcactccaatctccgcctcccaggttcaagcaattttcctgcctcagcctcctgagtagctgggattacaggcacccgccaccatgctcagctaatttttgtatttttagtagagatgggatttcaccatgttggtcaggctggtctcaaactcctgacctcaggtgatccacccgcctccgtctcccaaaatgctgggattacaggtgtgagccaccatgcctggcctcaccctgttattctgaatgcataatttcatgtctctgtcttttgtcctatrctgtttcttaattagattcctaaatgtcgatttcctcttcctcttctatttcctttttaccttaaggattcaactccttatctcttcatgaagaattaatcactcctttctctctgttcccatagaactatgtctgtaactttacacttacttagtcttcactttagttactatttcacatgtatttcacccgactttgtaaacatattttttttttttcttttaagtgtatgtctcctatactagatgaggaagtctttggacagatgctgagtcttcttcttcttcttcttcttcttt

SEQ ID NO: 190275 - DNA, 601 bp, Human
aactgactgcctagaaaagacaagaaattacaaaaaaaagcaagaagacagatcctagcaagcacaagctaagtacatagaagacactcaaccagtgtggagtaaaatggaagtagcagttatgtgggtgttaaagaatgtgtttgagtttgcctgttggagataacagaggaactagggtctacagagctgccaaattgtgaaatataagagatgtatgctttgtaagctgcaatgcaggatacatatccttaagctcttattacccagccccaaatcactgtacccttctttgcccacyaataagacttttccaaaagaagtactcaagttagatcatcctagacagaaatgtagaatactttaaagctagaactgatcattaggttcttatcaaaatattttcttgcactcttgaagttggatttggtttttcactttggaaaacagtttcctccatagattacttataggcccctatttcctaattctatgtacacttcactctctcctgtactcagggtcactgggacaaaaatgacacaaggaaggcacttgtttttatgtctttattattgttttggaccaagatctcctacac

SEQ ID NO: 190276 - DNA, 601 bp, Human
cagagctgccaaattgtgaaatataagagatgtatgctttgtaagctgcaatgcaggatacatatccttaagctcttattacccagccccaaatcactgtacccttctttgcccaccaataagacttttccaaaagaagtactcaagttagatcatcctagacagaaatgtagaatactttaaagctagaactgatcattaggttcttatcaaaatattttcttgcactcttgaagttggatttggtttttcactttggaaaacagtttcctccatagattacttataggcccctatttcytaattctatgtacacttcactctctcctgtactcagggtcactgggacaaaaatgacacaaggaaggcacttgtttttatgtctttattattgttttggaccaagatctcctacaccccacacttagagtgagtggaaattgttttcagagacaggtgctttttctcccatggcttagtgtcacagaaggaagatgacaccagcctggtgacatttgtgcctgggagagctgccagtccatgctgcttccccagttttaagaaacactatggtttgtcatacctaaattacttccacctc

SEQ ID NO: 190277 - DNA, 601 bp, Human
agctgccaaattgtgaaatataagagatgtatgctttgtaagctgcaatgcaggatacatatccttaagctcttattacccagccccaaatcactgtacccttctttgcccaccaataagacttttccaaaagaagtactcaagttagatcatcctagacagaaatgtagaatactttaaagctagaactgatcattaggttcttatcaaaatattttcttgcactcttgaagttggatttggtttttcactttggaaaacagtttcctccatagattacttataggcccctatttcctaattctatgtacacttcactctctcctgtactcagggtcactgggacaaaaatgacacaaggaaggcacttgtttttatgtctttattattgttttggaccaagatctcctacaccccacacttagagtgagtggaaattgttttcagagacaggtgctttttctcccatggcttagtgtcacagaaggaagatgacaccagcctggtgacatttgtgcctgggagagctgccagtccatgctgcttccccagttttaagaaacactatggtttgtcatacctaaattacttccacctctct

SEQ ID NO: 190278 - DNA, 601 bp, Human
gtcacagaaggaagatgacaccagcctggtgacatttgtgcctgggagagctgccagtccatgctgcttccccagttttaagaaacactatggtttgtcatacctaaattacttccacctctctgctggcggtgacagtgatgtcagttatcctgggtccagctaaggtttcagtctgtgtgttttccggatcatgttgattctcttcttcttcttaaaatgcaatttttctcattttgtgtttgtggtaagggctattttctgccaaaacagacattatcaaagcagttgcatagtgagkgactggtgtcctttataagcgtagagaaaatccgagaacgtcaggcccagaaaggactttagaaatcccacaggatttggccaactctttgtcgtacttgcaagaggctgagaaacagacagactagatagctatgtcaaggccttgtagcaagtcacagcatgagaaaagtggaactttaaaaaatatagatagctacagataccacatttacatataccatttctgtatacttaggatttaagggtaatgtaatcctgaacagtgtagcagagaggattagtgaaaacggggttcttg

SEQ ID NO: 190279 - DNA, 601 bp, Human
cagcctggtgacatttgtgcctgggagagctgccagtccatgctgcttccccagttttaagaaacactatggtttgtcatacctaaattacttccacctctctgctggcggtgacagtgatgtcagttatcctgggtccagctaaggtttcagtctgtgtgttttccggatcatgttgattctcttcttcttcttaaaatgcaatttttctcattttgtgtttgtggtaagggctattttctgccaaaacagacattatcaaagcagttgcatagtgagggactggtgtcctttataagcrtagagaaaatccgagaacgtcaggcccagaaaggactttagaaatcccacaggatttggccaactctttgtcgtacttgcaagaggctgagaaacagacagactagatagctatgtcaaggccttgtagcaagtcacagcatgagaaaagtggaactttaaaaaatatagatagctacagataccacatttacatataccatttctgtatacttaggatttaagggtaatgtaatcctgaacagtgtagcagagaggattagtgaaaacggggttcttggagtgacttatccaccctcgt

SEQ ID NO: 190280 - DNA, 601 bp, Human
cctgggagagctgccagtccatgctgcttccccagttttaagaaacactatggtttgtcatacctaaattacttccacctctctgctggcggtgacagtgatgtcagttatcctgggtccagctaaggtttcagtctgtgtgttttccggatcatgttgattctcttcttcttcttaaaatgcaatttttctcattttgtgtttgtggtaagggctattttctgccaaaacagacattatcaaagcagttgcatagtgagggactggtgtcctttataagcgtagagaaaatccgagaacrtcaggcccagaaaggactttagaaatcccacaggatttggccaactctttgtcgtacttgcaagaggctgagaaacagacagactagatagctatgtcaaggccttgtagcaagtcacagcatgagaaaagtggaactttaaaaaatatagatagctacagataccacatttacatataccatttctgtatacttaggatttaagggtaatgtaatcctgaacagtgtagcagagaggattagtgaaaacggggttcttggagtgacttatccaccctcgtggttcatgatgcaaaggtg

SEQ ID NO: 190281 - DNA, 601 bp, Human
ttatcctgggtccagctaaggtttcagtctgtgtgttttccggatcatgttgattctcttcttcttcttaaaatgcaatttttctcattttgtgtttgtggtaagggctattttctgccaaaacagacattatcaaagcagttgcatagtgagggactggtgtcctttataagcgtagagaaaatccgagaacgtcaggcccagaaaggactttagaaatcccacaggatttggccaactctttgtcgtacttgcaagaggctgagaaacagacagactagatagctatgtcaaggccttrtagcaagtcacagcatgagaaaagtggaactttaaaaaatatagatagctacagataccacatttacatataccatttctgtatacttaggatttaagggtaatgtaatcctgaacagtgtagcagagaggattagtgaaaacggggttcttggagtgacttatccaccctcgtggttcatgatgcaaaggtggtgtgcatactggatgggagattcacaggtgggattatccacggattcctgatgtcacaaacctgtgacttctcctattttctaaaactgaactgtggctactagcg

SEQ ID NO: 190282 - DNA, 601 bp, Human
cctggagttcatctaggattccaaagtaaatacacctcctttctgttttgcctagggatttttttttttcctggaaagggtggagaagatttacgtaagaaagctgagttgcctcaaaatacagcctccagaaagaatgaggcatctcctgcccaacctattattcctgctgaggagagagaaattgaggaactaaaagtgaagcctaaaattgccagggctgaaatcttggtagaaatcaactagtctataaaattagctgcctcactggccctttagggtggaaataccataaggagcrgacatctgatgtaaagttgagagggaagttgtctgtcttcatcaatagtaaatcaaatctaggttaaatagacaaatgccatctccaaggagagtaggatcacaattatataggatgccgaatatataatgacactaaatccagttaacaggttgaaaacctgaggcatgggcaggggaagtgtcttgcttcaagtaatgtaatgaatttactggcagatgcagaacttaacccaaaattcatgactcttagaacagtgccctttcatgcatgatcctgaaatgcaagaggggtttcatt

SEQ ID NO: 190283 - DNA, 601 bp, Human
tctcctgcccaacctattattcctgctgaggagagagaaattgaggaactaaaagtgaagcctaaaattgccagggctgaaatcttggtagaaatcaactagtctataaaattagctgcctcactggccctttagggtggaaataccataaggagcagacatctgatgtaaagttgagagggaagttgtctgtcttcatcaatagtaaatcaaatctaggttaaatagacaaatgccatctccaaggagagtaggatcacaattatataggatgccgaatatataatgacactaaatccarttaacaggttgaaaacctgaggcatgggcaggggaagtgtcttgcttcaagtaatgtaatgaatttactggcagatgcagaacttaacccaaaattcatgactcttagaacagtgccctttcatgcatgatcctgaaatgcaagaggggtttcatttttatggtttcaaggtagaatgaattatgaaaatctgggcttgtattataatatatcccagtgtggaatcagaaggaaaagtgatgtgttatgcagtgaacttgagtgaatacttattcattatccattcagcagaagagacta

SEQ ID NO: 190284 - DNA, 601 bp, Human
gtgatgtgttatgcagtgaacttgagtgaatacttattcattatccattcagcagaagagactaactcaaaatcaaagaggtgaaacccgaagcccaggtttcctgatgttgattccagagttctttccactattccttgctggcagttgactgcgtctatgaccatttgccatggtggcagctgtatggaggatatggcagtaagtaggggggccagggactggaatatatagttttaatccggctattcaaacataagacaatacagtgctttaaaaaataagaatttataggagatayttagtagccatcttcagaaatacatatattgataaatacaacaataaaagatactgaaatttatttggaatctatcataaactaaatagtgccatagggctgattagggaagttaaatattataatgtaaggtgatattttaccttttagagatgaaagttcaaagaaactaaacacatcactattcaaacacaatttagtttgatttaagaccttctctttccaaagtagaccagtcaatgggagtacagatgaatatgtttattttaatgaataacgtataatagcaataggaggaac

SEQ ID NO: 190285 - DNA, 601 bp, Human
ataacatttgacccagtacttttagttgtaggagtacttaacaggggaaaatactcaaaatataatgataactaaaaaaaaattatattgcatatgatctcaatcttgtttatatacataaacacgggaggaagaccatagaaacttttaatgtaattctgagagttgcgcttatagttgactttcattttttatttgtattttacttttttcttctaaatttcacactatttttgtaacctaaaatttttaaatccataatacaaaacaatatgaggagagattatcttatctctgtacmtttgtatatctatttacttgaactgtaagtaaggcactatctaaatccaggtaagtggtaaaatactgttattacaatcatagcatgggctatatggtaaatgaactgtaggacatacatgacattgaagaaggataaatacaggagtagggggaaaagtaaatattaagatgtaattaaacaatgaagcagtgtttgtagattccagtctcaaaatacacagattcggatctcaattccaatgtttaatatctatctgcatttcagtgtcttcatctgtgcaataacaatgaacatagt

SEQ ID NO: 190286 - DNA, 601 bp, Human
tcaatcttgtttatatacataaacacgggaggaagaccatagaaacttttaatgtaattctgagagttgcgcttatagttgactttcattttttatttgtattttacttttttcttctaaatttcacactatttttgtaacctaaaatttttaaatccataatacaaaacaatatgaggagagattatcttatctctgtacatttgtatatctatttacttgaactgtaagtaaggcactatctaaatccaggtaagtggtaaaatactgttattacaatcatagcatgggctatatggtmaatgaactgtaggacatacatgacattgaagaaggataaatacaggagtagggggaaaagtaaatattaagatgtaattaaacaatgaagcagtgtttgtagattccagtctcaaaatacacagattcggatctcaattccaatgtttaatatctatctgcatttcagtgtcttcatctgtgcaataacaatgaacatagtatctaaggcataattttgtgagtattaaatgagtttgttatatgtaaagtgctttgagtaccttaaccataaaaagtgcagaatctaaattctgtctac

SEQ ID NO: 190287 - DNA, 601 bp, Human
aggtttttcatgctgacaactgtcccttttcacaaataattatcaagggcttgagatacggagcttgaattgaaagcgatattttttctctcttctattttagatactatactttgatttttacaagatcaaaaggcatctctctgtaaaatctctctgtaaaaaggcatctctctgtgtccgtctcataataaatgctttgggtaaatactcttctaattctagttctttcttatagaattatagaactgtttaattgagctgatactcaccgagcttttggagtactaaatgtgacatratgaacataaatgtattctgacttcaaaaacttcacaatcttgttgaggagagcgttaagtatacaactttttgcattgaaagatagaattttattactgcttttatttatattcatataaaataagagaaggtttaacttcaactagggtttagagaaattctcacatcggtaggctttaaagaatctaaaagtatttgaatatatcgggaaagcaaatgaaggcattctaaactgagggaccggaatgaacagaaggacaaaaatagccagctggggtccacatttgctaagcaaagt

SEQ ID NO: 190288 - DNA, 601 bp, Human
actttgatttttacaagatcaaaaggcatctctctgtaaaatctctctgtaaaaaggcatctctctgtgtccgtctcataataaatgctttgggtaaatactcttctaattctagttctttcttatagaattatagaactgtttaattgagctgatactcaccgagcttttggagtactaaatgtgacatgatgaacataaatgtattctgacttcaaaaacttcacaatcttgttgaggagagcgttaagtatacaactttttgcattgaaagatagaattttattactgcttttatttrtattcatataaaataagagaaggtttaacttcaactagggtttagagaaattctcacatcggtaggctttaaagaatctaaaagtatttgaatatatcgggaaagcaaatgaaggcattctaaactgagggaccggaatgaacagaaggacaaaaatagccagctggggtccacatttgctaagcaaagtggattataaggaaagtgaagctgaaatggtagtttggggccagattttaaagggccttgaatgccattctaagtaatttatctggtcctgttggcactgggacaccctga

SEQ ID NO: 190289 - DNA, 601 bp, Human
ataaatgctttgggtaaatactcttctaattctagttctttcttatagaattatagaactgtttaattgagctgatactcaccgagcttttggagtactaaatgtgacatgatgaacataaatgtattctgacttcaaaaacttcacaatcttgttgaggagagcgttaagtatacaactttttgcattgaaagatagaattttattactgcttttatttatattcatataaaataagagaaggtttaacttcaactagggtttagagaaattctcacatcggtaggctttaaagaatctraaagtatttgaatatatcgggaaagcaaatgaaggcattctaaactgagggaccggaatgaacagaaggacaaaaatagccagctggggtccacatttgctaagcaaagtggattataaggaaagtgaagctgaaatggtagtttggggccagattttaaagggccttgaatgccattctaagtaatttatctggtcctgttggcactgggacaccctgaggagtgacatgatcagagttgcactttaggaaagatgaagttatatagtgagggagctctagcagggaggaaagaaagtg

SEQ ID NO: 190290 - DNA, 601 bp, Human
ctcaaacaaccatggatcataaatattcagggaaaaaattaaaaataaaaatacaacaaaccaaaaaaatccagtataactatttaactttttcacatagggatgtcaaatggagccattgacatcggtattttatgaaaatggcatttcaaatctgagaaaaatatatattattcgataaataataaagatcagttttcgattgatgagagtggattttcctttgtttttcatacagacatacattctggaaagttaaaagacttgcatgtgaaaacattcaaaaatcctaatattgtartatggttgcaaaattttacattgggctgggaaaggcctttcacgctgtgtctgaaacacagtaagtcataaaacaaaaaaggataagttgactatggaaaaattagaattttcctacaccaaaaagcaaaccataatactgtatgcaaatttgaaagaccagacatacctaaacacacacacacacacacacacacacacacacacgcatgcacaaatacatatacaaacacaaacacaggaaaatatagcacttataataaaaagttggatgttaaaaaagatagtcaacaaaatgtta

SEQ ID NO: 190291 - DNA, 601 bp, Human
gcatttctttatttatctgaaaaatgtagataataatactaacttacaccactaggtggttagaaaattaatgcatgttactaaacatttagtacatttgagatccacatataagcattgttgttgagtgcagagaattgttacttctttgtaacctgcttaaatcaatgcatgatatttacatcagctactcactaattctgaaaccaaacattatcaggtatactttaattagctcttttatggaaatgtttgtgctgagttcaaatctacatgaactattagcgaatttttcattgtraggataccttaaagcaaaaaatatggattttccaccaatatgttccttttcctttatgtcatttaagtatcttaagtagctgtgcagcttgactacttcacttgtacaatatgaagatgagcaaactgagggacaaataaatatccgagtaaaatcagaggaatatcctctaaatcacttctctgattctggacaaaaacaggctcttatctttgtaattgtctttagaaatcatttagctctgccctcatttcacaaatgaggaatctgaatccagagtggttaagtaacttgccccaa

SEQ ID NO: 190292 - DNA, 601 bp, Human
tgtagataataatactaacttacaccactaggtggttagaaaattaatgcatgttactaaacatttagtacatttgagatccacatataagcattgttgttgagtgcagagaattgttacttctttgtaacctgcttaaatcaatgcatgatatttacatcagctactcactaattctgaaaccaaacattatcaggtatactttaattagctcttttatggaaatgtttgtgctgagttcaaatctacatgaactattagcgaatttttcattgtgaggataccttaaagcaaaaaatatggattttccaccaatatgttccttttcctttatgtcatttaagtatcttaagtagctgtgcagcttgactacttcacttgtacaatatgaagatgagcaaactgagggacaaataaatatccgagtaaaatcagaggaatatcctctaaatcacttctctgattctggacaaaaacaggctcttatctttgtaattgtctttagaaatcatttagctctgccctcatttcacaaatgaggaatctgaatccagagtggttaagtaacttgccccaagggcacggagctcctgtctcctaa

SEQ ID NO: 190293 - DNA, 601 bp, Human
taaatcaatgcatgatatttacatcagctactcactaattctgaaaccaaacattatcaggtatactttaattagctcttttatggaaatgtttgtgctgagttcaaatctacatgaactattagcgaatttttcattgtgaggataccttaaagcaaaaaatatggattttccaccaatatgttccttttcctttatgtcatttaagtatcttaagtagctgtgcagcttgactacttcacttgtacaatatgaagatgagcaaactgagggacaaataaatatccgagtaaaatcagargaatatcctctaaatcacttctctgattctggacaaaaacaggctcttatctttgtaattgtctttagaaatcatttagctctgccctcatttcacaaatgaggaatctgaatccagagtggttaagtaacttgccccaagggcacggagctcctgtctcctaactcccagtccagtgctcttttcttccaacatactcaaagttctcaagtagccatagtggatatattgtcttagattttgtccagaatctttgtagatatgttagacagagaccgtatttggattcatgctgatagc

SEQ ID NO: 190294 - DNA, 601 bp, Human
gctgatagctgaggtggcacatggaaggaatctgactttttcatctttcaaatcttgctgggaatcttttgacttcgtgaaaggtgaagtttgtttacatttttagtggatatcaatacttgggaccctgagccttagatttaggtgttcaaatggctacatgatcccattagtgtaaaaaacaatttaataatgactttggtaggcagttgtgctaacagcatttcctctagatcattgattcccaagcgtgactcatccagaaccgcctagcaggctgtataaaatccagttgttgggkctgtaaccctgcagagtctgattcaggaggtctggggccacgtccagaaatctgtttttaaaaagcaccctggatgattttcaggatcatccaagtttttgggccacaggaattatgcatacctttaaggaagtaaccatctgctttctactgttgactcttaagctgtcagtaggtgtagaatttagacacattgtacaaaaaattatactgtattttgtaagtaggttttttttttttttgccttctaggcagtgctcatttggttaattataggtagaaagagagatcattcttccc

SEQ ID NO: 190295 - DNA, 601 bp, Human
actgtcatattcttgcatactcaagatcaaattatattatgggagttttttggtttttgtgtataaaagaaggaagcattattaccagtaacctatgggtcttatatatcagccaatgaccacgtcatcctttaagtgcataaattttatggatgcaaaagtagaagtaaaggggaggcaaatccgaagtcgtgaacgtatttgcaaactttgtttctgaaatgtatgttctaatctcttctggcttccaattctcttctaaactttgtgtcttctaaattttagaagaaatcacaattttcacttatagttatcttggccacttacaacctttcaagcaaaatagaggaaattgggtccctgagtggggggtgggggtgtaggatgatgtcaagaaataaatctaactgaattacaaatactcagcagtaaagagagtattttaatgaatcagatgataaccatcagggtgcatttcatctccactaaatcttcgtaccaaggccagattctacatgaatgttggtaagtatttatgtaaatgtatttttaaaacaaaagccaattgatatcttatgctttaatacttattccactaatc

SEQ ID NO: 190296 - DNA, 601 bp, Human
ttattaccagtaacctatgggtcttatatatcagccaatgaccacgtcatcctttaagtgcataaattttatggatgcaaaagtagaagtaaaggggaggcaaatccgaagtcgtgaacgtatttgcaaactttgtttctgaaatgtatgttctaatctcttctggcttccaattctcttctaaactttgtgtcttctaaattttagaagaaatcacaattttcacttatagttatcttggccacttacaacctttcaagcaaaatagaggaaattgggtccctgagtggggggtgggggygtaggatgatgtcaagaaataaatctaactgaattacaaatactcagcagtaaagagagtattttaatgaatcagatgataaccatcagggtgcatttcatctccactaaatcttcgtaccaaggccagattctacatgaatgttggtaagtatttatgtaaatgtatttttaaaacaaaagccaattgatatcttatgctttaatacttattccactaatcatttacatagatgcatcacgtgcagtaatcatttttattacctattcacaagcaaaaatattagtataaactgggtac

SEQ ID NO: 190297 - DNA, 601 bp, Human
ttctaatctcttctggcttccaattctcttctaaactttgtgtcttctaaattttagaagaaatcacaattttcacttatagttatcttggccacttacaacctttcaagcaaaatagaggaaattgggtccctgagtggggggtgggggtgtaggatgatgtcaagaaataaatctaactgaattacaaatactcagcagtaaagagagtattttaatgaatcagatgataaccatcagggtgcatttcatctccactaaatcttcgtaccaaggccagattctacatgaatgttggtamgtatttatgtaaatgtatttttaaaacaaaagccaattgatatcttatgctttaatacttattccactaatcatttacatagatgcatcacgtgcagtaatcatttttattacctattcacaagcaaaaatattagtataaactgggtacaataaaatagagaaaagaaatattcaaatagataagcgttttgttaaaaaaaaaaaaaagaagaaagaaaggacacatttatcaggattcctatttcccgtacataatatggatgtttgtttgtttttgtaagttaacgggaccggtggt

SEQ ID NO: 190298 - DNA, 601 bp, Human
gtattttaatgaatcagatgataaccatcagggtgcatttcatctccactaaatcttcgtaccaaggccagattctacatgaatgttggtaagtatttatgtaaatgtatttttaaaacaaaagccaattgatatcttatgctttaatacttattccactaatcatttacatagatgcatcacgtgcagtaatcatttttattacctattcacaagcaaaaatattagtataaactgggtacaataaaatagagaaaagaaatattcaaatagataagcgttttgttaaaaaaaaaaaaaagaagaaagaaaggacacatttatcaggattcctatttcccgtacataatatggatgtttgtttgtttttgtaagttaacgggaccggtggtttaacttgttattgaaacatgctcgaaaaaatcaggtagcttattttgtaattgcttgttatgaaaccactggcatttctctggggaaaataagttaaaaactctttagctatcaggcagtgggttttaattttttatattggttaaatgtaacagtggatttgcgtactctctcctaatttctaactttgtgtaatcattcttgaaac

SEQ ID NO: 190299 - DNA, 601 bp, Human
ctgtcgtctggagggtgacttgtactttcacgtgtgatgacaaataaagttattttggagggatgcattgttaaatatttatacatgcatacatgtaaatgtgtattatagcatacaggattttatttaagaaactgattatttgcatttctgatctcttctcagcaagtttgtcttaggtatttaaacctgtgcaaagggataaaaaaaaaaatcctgaagagactgtaaggctttgaggaagtttcctaaggttgagggaggtctaacaacaatattagtttacattcctcagaatggrgcagctgtgttgacactaatcagattgggttgtggtggggagtgttgtggagagagagagttcggtgtttcagataaaaatgcttgcaggtgagtgcttggaaaagtggactagagtactcaaattgagctccttaaaaatcaaaacaaaatgcatagtattccggtgcagaccgcaagaggaagagtagagcagagggctgcgaagcagggcctgtgctatcgtattgaccacgctattgtctagactcctgaactgtgtaaatacaacaggggaaatatcgagttatctaaagaagga

SEQ ID NO: 190300 - DNA, 601 bp, Human
taaatgtgtattatagcatacaggattttatttaagaaactgattatttgcatttctgatctcttctcagcaagtttgtcttaggtatttaaacctgtgcaaagggataaaaaaaaaaatcctgaagagactgtaaggctttgaggaagtttcctaaggttgagggaggtctaacaacaatattagtttacattcctcagaatggggcagctgtgttgacactaatcagattgggttgtggtggggagtgttgtggagagagagagttcggtgtttcagataaaaatgcttgcaggtgagygcttggaaaagtggactagagtactcaaattgagctccttaaaaatcaaaacaaaatgcatagtattccggtgcagaccgcaagaggaagagtagagcagagggctgcgaagcagggcctgtgctatcgtattgaccacgctattgtctagactcctgaactgtgtaaatacaacaggggaaatatcgagttatctaaagaaggaaaaggaagtgcctatttttctttaaaacattcaagcaggcttgcttgtcctcagtagagaaacttgagtttcttgttttgcagttatattgaaag

SEQ ID NO: 190301 - DNA, 601 bp, Human
aaatattggtttctttttcattatacgtacattttctgaatgcaaagttgctaaaacattcctcaatgactatggacagaatttagattctgcgttctgctataaagggagtatatatctaatgtcatgagattttaaaaagggatttggatcaaacagttgagaaatatgttaccacaaatacaccctggttttctttgatgtgcatatgattgctctgggtggaatctgagctggtagaatagaggggcacaggtaaaaatccttccttcctagtataacttttctctccccttgaatwtttttaaatttctaattgttttatgtcaacaaatagaatgaatacaggtaacaaaaagatacttctgtgaaaaacaacttgatgatttccataatttataagttttactattttgaagataaaaaattgttaaacccaagtgggcgctcaattttctttagatgtatgttgaggaaaatgtcagttgactaatatagcattattgtccagtgccaatttagtggaacctacaaatggtatccaatagagtactacattttgggtctggaagagcatggattcaagtgtcaaggtgaaaca

SEQ ID NO: 190302 - DNA, 601 bp, Human
ggcccaagaaaatagtgaaatgtggcttattaatgggccaccactctaaacattttataatttttacttatactttttgattaagttctatgttgacaatattcatgaaaagtagtattgagaaagagaaacaggttagaagaagaactgactgactcttaaaaaaatgtttactgagcatcaattatatgtaaaatggtatataggatctaaaaataattaagaaataattcctacactaagaagtttatagttctttgggggaatgagctaagtatgcatgcaattataatacaggagrgattttaagtgtgtgagcaagataatataaagcatcaaagggaaagagagtccatgatgtaggaagatcaagaaagtctatatgcatatgtaagatgaagctgcacttggaaggacagatggaaatttccaagttctagaaatataagaaggaatgaggattttaggtgaagaaataagcatcagcaaagggaaggggggtgaggagtgaatgctggtacactcagaagcatcaaatagttcaaatgcaattgaaattatgagacgatcaggaaataaagttggaaatgcaagatagagt

SEQ ID NO: 190303 - DNA, 601 bp, Human
aatgctggtacactcagaagcatcaaatagttcaaatgcaattgaaattatgagacgatcaggaaataaagttggaaatgcaagatagagtggctcagagatgaccataacactgagaggagagtacatttatcatagtgacaatgaaaagccatggaaggatttcgaacagaagaatggtgtaattgtgtaattggagctctactagagagcacagggagaataaatggctttgcttgagattgcctagaagtatgaaaatgcatctctctgcattgcacattggctgcctgttttgcakaaatatctatcagttctcttggatctttggaaggatacgcatggattgtttctaaagtctcatacaacctgtgtattttctgcccagtgctctttttaatagctatggtccctgccatagacaaattgggaactactggtcttggtttgtctttatttatgcctgctattctagcataattactaatagcacaccttttcactttcaaaactgtcccatttagaagataaattatatagtcactctgtaaagaccccattctttatttcattctcttccacacactaacactccacccca

SEQ ID NO: 190304 - DNA, 601 bp, Human
aaacttatcaaagctaggaacaaaattcaaactgactctctgtgtttattatgagttaattttatttattaaatagtcgtcttagaaataggaccagaagtcttttctctggtcactgctctaaatgcaaatagtaatcctgaagctgaatataagacatttattcagaatgagaatcccagctgggaaataaataacagagcagagggaaatatgaatatcccatttaaaagccaaccccaccaaataaaaaatttaagatattatctttgccataaaatttttaaatttgactttgggrcaaggatacatgtgtaagatgtaatatgtaaagataaatattgggagaagacatgtcttttcccacatcaatatcctccctttccacagcctccttcatcacttccatctcacccaagaagaccacgtgggcaattgaagagataataacagggcaggggagggtaggccatggtgggaggaaggagtgaaccagtgacttgatttaaagccaaagggagtggataagagaactgggcttcaagataaataaggagacatctaagctagtactcatttctttctcttttttttaccaacc

SEQ ID NO: 190305 - DNA, 601 bp, Human
aaaacacccaaaggggccatttcccacccagccagtgatctttctcaagtttattctttctcagatcacagagacaatggggaatatgccctgtttactcaaatcagtctggattagtgtcactctattgatggagtcagaattaaaaggaaaaccattaccctctcaaagggcaacatcagatgtttggggaatggcgtgattacttttaaatagaccgtgtgagactctgtcaccagactgaggttgaggactccacaagacacacttgaagagaaacagtaacactgggtgaggcagraagctcttcataagccttaggcctgggaaattatttcaacagacaatcccaaaatgcttgaaaggctgaaaatcagaatggtgagacttcagagaagagggcttttctgccttctttctttgctccaacacctcacccccatatatttatctccaggtcaaatcctttccagtcattaagccctgctggggagaaacttaaccctgaaaaagctctcagattcccccattcaggataacacttccatcctctgaactcttttactctgtttcttcctcattgctctctgtgtacaccaga

SEQ ID NO: 190306 - DNA, 601 bp, Human
tgctggggagaaacttaaccctgaaaaagctctcagattcccccattcaggataacacttccatcctctgaactcttttactctgtttcttcctcattgctctctgtgtacaccagatccttcctccctatcctttgactgaagaccctgggagggtagaggatgtgttatgcttatctctgtatcccctacagggccactcagtaatgttccctgaatgtgatgaggacatgcatctgttgctgttgcttgaagggatatcttcacctaggaatatatggtgtattgtatatacttaaarggctgtttgtaattgacttgtgcacaaaaataaataaagcgagccgacatattatacaagcctcttctatctatatgttctgcaggtaaaccaaattgtgtcattttccttcacatcttgcaggtcatttgtttttgctgtttgtttgttttaataagcccaatattatttccattatcttttaaatagcaagaaagtttttgaaagacagggcagatgatttgtttggtatcaagtaattagtgtaaagtatgtgctgctttcacataattgattactcacaaggacagagaatgtgtt

SEQ ID NO: 190307 - DNA, 601 bp, Human
aatttggacacagactcaggataaaataaatgatcagttgtattagaataaaagagatactttctgcaagtaattttcatgttgaagtgttttgcatttattcttttaagaactgtctcctgagcatctattatgtttcagccattatcccaggtattggggattcagtactaaacaggccagatatattctctcattaacttattgcctagcagagaagaccaacatttttaaaagtttatacatatagttaatttctattatgattatatgatacaaatggaaagtgctatgaaaatgyggaacaaaagagaataatctgtctgaacagtcaaagaagacttctgggagatgacatctgagctaaaggttgaacaaggaattggaaaacagctggcatgtgcaaaagacttgaagactgaaggagttagcctttaaaaaaatgaagaaagttctatttggccagagcagagtttcaaatagtgcctcacaggccacgttaaagacctgaggcctttattctaggagaatagggagctgctcaaggaatttaagcttgagagtgacaagatcagatttgcaatgcctttcaagtggtagt

SEQ ID NO: 190308 - DNA, 601 bp, Human
atgtgctgcctaaaatgttttagatttctaagtttggtcagggacatctgtatagagagagaacagttaccttagaaaactgttttgaatgtggtcttatagcattgttttaacgtagcttcacagatgaggatggccataagtcacagaatgttagaactggagatccctctcattgaatcctcaaattcagtctcctcaattttacacagactttggattatggtaaactaaggtccacaagttgttcagctaccttgcccagaggtacacagcacactagtggcagtgttgggacttrgactccatgtaaagaagtttaagttcagaattcttttgcatcactaggatccatacaggagtgtaaggagtactgaagcgtgttcaatcccctagcctcatccaccagtcactcatggattataaatacaatttcttccaagtgaaatttgggaatactgttgtatcttgtaacaaaggtctggttgaatcgagataagttatgattatatatcccaacagtaatctcttctacccctgatttggtccctatcccatttttttaataacctcttactatatattgttgactattgttgct

SEQ ID NO: 190309 - DNA, 601 bp, Human
ctggagatccctctcattgaatcctcaaattcagtctcctcaattttacacagactttggattatggtaaactaaggtccacaagttgttcagctaccttgcccagaggtacacagcacactagtggcagtgttgggacttagactccatgtaaagaagtttaagttcagaattcttttgcatcactaggatccatacaggagtgtaaggagtactgaagcgtgttcaatcccctagcctcatccaccagtcactcatggattataaatacaatttcttccaagtgaaatttgggaatacygttgtatcttgtaacaaaggtctggttgaatcgagataagttatgattatatatcccaacagtaatctcttctacccctgatttggtccctatcccatttttttaataacctcttactatatattgttgactattgttgctatagtgtcataaatttactattatagatagtaatatctgaaaaaggggacattttaaaaaattctcttggccaggtgtggtgtctcacacctttaatcccaacactttgggaggctgaggcaggtggatcacctgaggtcgggagtttgagaccagccc

SEQ ID NO: 190310 - DNA, 601 bp, Human
agcccgaccaacatggagaaaccacatctctactaaaaatacaaaatcagccgggcatggtggcacctgcctgtaatcctagctactcaggaggctgagggaggagaatctcttgaacctgggaggcagaggttgtggtgacccaagatcgtgccattgcactccagcctgggcaacaagagtgaaactccatctcaaagaaaaaaaattatcttttacagataaattggtggagagagattttcaaaaacacaaattataggtaaatacctatttctattgcattggtcaaatagcttcrttggaatctctttttgatgttaaatacttttataggaaaataattacgtcatcaactttaagtaaatataaatccaattatttaatattgagttatagcaatatatattgacacagttttgtttcttcatggtgaaaacagtttgagattcagctcctgggtatctttatacctaccatgcaagctgtatgtttcagaatgccctcagggtgttctatgattgcagggaatatgtcgagtccatgtgaccaaggcgtacttcatcctttctgtgatcagatcagctagtttgtgaggaac

SEQ ID NO: 190311 - DNA, 601 bp, Human
tgaagagctaggcctatttcctttataaaatatgtacgaataggactgccttaatcttgcttttgatttttttttctcattcattaggttgatgaaacaagatttctatgtgtcggaaggttttacaaaggaaaagcaactgtaccataagctggttgcccctttgttcattttggctcaggtttagaaatgatgataggctgatttgcctactcaggctgacagttttgatggcatggacagagccctgaagtcagaaccagaagattcagcaccgaaagccccagtcattgtgttagcrgatgctagggcaaatgctctacctctccgatagtaatatagtcaagttttttgtagagtaaatgaggcaaaattaatttattctttcataaatatgttcttgagtacttttactctgtgcttgggcccattcacatagaagacataaaaacgtttggcagaaggaaatacatgagctaatgtatttttgaattatattgaccatagaattttcttcataagtagttggtatttctcttacaaatgttctactctagaaaagaataaatttctattaagaaaatgaaagaacaaataaaaa

SEQ ID NO: 190312 - DNA, 601 bp, Human
atttatcagtgaattataatttattgatatgtatatatttatttaatttggaaacattcttttcgaaaagaaagcctttaaatagacatatcagagccctgaattagtccaaagaaattgttaaagaaaaatctttctgcatataagttttctaaggaagcatggaattttcttttcataaattaggaagatacaagaattagtccaaagaaattgttttaaaaaatctttctgtatataacttttctaaggaagcatggaattttctttttcataactagatccaagaatattttatttygaagtgtattttgaaatgtattataacaagaataaagctcaagtataaaagaggacacctacaaagttggttttaactggttgatcaaagaatgttcaagaccaaagtggtatgtttgtcaaacaacttaatcaagaccaaagtggtatgtttgtcaaacaacttaatgtttacatggattatagaaatgcttccaaatatcatcatcttaataaaaagtagctttagaattgttttgacagttttttccctctttgacaaatggatttctttggaaagcatttctatgtttatgttata

SEQ ID NO: 190313 - DNA, 601 bp, Human
gatctctaccaaaatgttaggttcaaaagaaaagaaaatattctggtacactggtaaaatttccttacatgtgacagcagtaatatcagtgccctgaaaaaagggatacactgtggtgatgagaaaaaggcactgactgagagacagaaaacctggattatggtcttgatcatttatgcaaacttagccaagtcacttgatctttctaaaattcagtctgtgcctcagatgagaaagaggatgagaatggagaaacctactctgttttcttaaggtgagatgatagtattaataattaacrtagaaagtttttagaagggctttggttcgcatcgatatattgtctgccattcatgagtgtccttggttaagtgattttgcttctcttggatttttgttcacttttctgcattctacctataaattttacaatcaggtttctactcacatatcacatggtaattatatttttattaaatttctttcttgttcacaaccaggcttatttcaggcccagttcatttcttctaaattagggcacttgaacccttatctgagcagctactgagatcacctaaaaagatgtaagttcttcgtcatg

SEQ ID NO: 190314 - DNA, 601 bp, Human
acttagccaagtcacttgatctttctaaaattcagtctgtgcctcagatgagaaagaggatgagaatggagaaacctactctgttttcttaaggtgagatgatagtattaataattaacgtagaaagtttttagaagggctttggttcgcatcgatatattgtctgccattcatgagtgtccttggttaagtgattttgcttctcttggatttttgttcacttttctgcattctacctataaattttacaatcaggtttctactcacatatcacatggtaattatatttttattaaatttmtttcttgttcacaaccaggcttatttcaggcccagttcatttcttctaaattagggcacttgaacccttatctgagcagctactgagatcacctaaaaagatgtaagttcttcgtcatggatacctgcatcttagcttctaattctttgagccaaattatatatcctcatgtttatacacagacttcccattttaaaaagtattttttcatatatttatcttagttgagcctcataaccaagtttgtaatccccagttttatagatgaggaaacttgaagatgtaaaggtcacatggcta

SEQ ID NO: 190315 - DNA, 601 bp, Human
acttgaagatgtaaaggtcacatggctaataaccagccaaggatggggaagaatccaggcctccctcaccctaattcaagtctctccaccatcctagttagactgtttctcctctggtttgagaccagggaggggcatacaggagcaggcagtgcctgtgtagtttggagcttgcctcttatgtcccagagtccaactggtaaagaaattttttgtgccttattatacaacacctatttcttaggcatttgtgcattttagagcaatttttcaaaataaaatgctgcattttagaactgcycacaaactgaaagaaacagaagctgctgtcattagggggagatcatgcttatcgcatagtcttctggtaattctttaataaaaatatttttagtaccattttatcacttgcaatccttttatgtcaagttttcttttttaacttttctggttttaccctcaggattactgtcaaaatatagctaatatatttaaagtatatgtgcatttttcctttgcgtttctgtgttttaaataacaaatgtgattatgtttccagttctacaaaaatatggtatttattttaaacttctttcaatga

SEQ ID NO: 190316 - DNA, 601 bp, Human
ccatacggccattagaaagaattctctgtactgataaggaaagctttgggagttgctggtgagggaaaaagaaagctttctgtggcacctgcttgagaattgagagtcctggtaaggaaccccacttgtaggggcggtgtttctttgtgctcccctctagtgatgaggcttcttggtgaacatagttcagtctgtcttgattattggcctcacacacctttgccagttggagagctatttttcaccgctcatgacacgagagtactctctgtgtgcatacgccatgaaaatcctcaggttgtttttttttttgcattgttttgttttttaaattgtgttcagactgaagtaaggaccctacccttgggacataggatcactttttgctgttgtatctttctcctgtcattgacctcaaggtcttgtatggcagactccctgatctagtgcccagcacaatgtccagcacacagtaaacctttaataaatgggaaggaactttttttctctcataattaaaggaaacaattgtagttcccagcaggagccctcaattctgactctgattgttaactgcccgtgaatttgttccctgtagcct

SEQ ID NO: 190317 - DNA, 601 bp, Human
cctactacaaagagtaacagcaaaaatcctctgcttttcccttttcttctttctccctattcttctcctcttcccgcatttcttctcccccttctttctactccctccttctctttttttcttcatttatgttattattgttagttaatttggttttgtaggtatcatcagctacatggtatctttctttatttttttttactatagcttcactcttctccataaattaatatggagaacatgatatatatcaatcaccgtggaaatttttatcaggattaaattatcacaaccttttcaygtaacaaatcactttggtgaataataatgggctgctttagaggtagcaaacccaaatgtcattggggtcagggaggtagcataaatgagccgaatgataagtacagaaactgtggcaaaagagcttatatactgtatctacaaggacatctgctttacaatcccagactgttgtcacaggggaaagtagacctagtattaaaatatttaaaatattaaattcattatcacaatattaactcttaaatattaatttttaaaagagtaactagaaacctgggtttgcatgtaatatcttcat

SEQ ID NO: 190318 - DNA, 601 bp, Human
cctcttcccgcatttcttctcccccttctttctactccctccttctctttttttcttcatttatgttattattgttagttaatttggttttgtaggtatcatcagctacatggtatctttctttatttttttttactatagcttcactcttctccataaattaatatggagaacatgatatatatcaatcaccgtggaaatttttatcaggattaaattatcacaaccttttcatgtaacaaatcactttggtgaataataatgggctgctttagaggtagcaaacccaaatgtcattggrgtcagggaggtagcataaatgagccgaatgataagtacagaaactgtggcaaaagagcttatatactgtatctacaaggacatctgctttacaatcccagactgttgtcacaggggaaagtagacctagtattaaaatatttaaaatattaaattcattatcacaatattaactcttaaatattaatttttaaaagagtaactagaaacctgggtttgcatgtaatatcttcatatcttaaaatgatgatactaattcaaaaaaaagttgtaaaacactgcaggccaaacaaaacagtac

SEQ ID NO: 190319 - DNA, 601 bp, Human
ttctctttttttcttcatttatgttattattgttagttaatttggttttgtaggtatcatcagctacatggtatctttctttatttttttttactatagcttcactcttctccataaattaatatggagaacatgatatatatcaatcaccgtggaaatttttatcaggattaaattatcacaaccttttcatgtaacaaatcactttggtgaataataatgggctgctttagaggtagcaaacccaaatgtcattggggtcagggaggtagcataaatgagccgaatgataagtacagaractgtggcaaaagagcttatatactgtatctacaaggacatctgctttacaatcccagactgttgtcacaggggaaagtagacctagtattaaaatatttaaaatattaaattcattatcacaatattaactcttaaatattaatttttaaaagagtaactagaaacctgggtttgcatgtaatatcttcatatcttaaaatgatgatactaattcaaaaaaaagttgtaaaacactgcaggccaaacaaaacagtacacaggctgcatgccatcctgtgcaaggtgttaatggtaacaa

SEQ ID NO: 190320 - DNA, 601 bp, Human
taaattaatatggagaacatgatatatatcaatcaccgtggaaatttttatcaggattaaattatcacaaccttttcatgtaacaaatcactttggtgaataataatgggctgctttagaggtagcaaacccaaatgtcattggggtcagggaggtagcataaatgagccgaatgataagtacagaaactgtggcaaaagagcttatatactgtatctacaaggacatctgctttacaatcccagactgttgtcacaggggaaagtagacctagtattaaaatatttaaaatattaaattmattatcacaatattaactcttaaatattaatttttaaaagagtaactagaaacctgggtttgcatgtaatatcttcatatcttaaaatgatgatactaattcaaaaaaaagttgtaaaacactgcaggccaaacaaaacagtacacaggctgcatgccatcctgtgcaaggtgttaatggtaacaaggggagattactaaatgtttaaataaattaattggaagttagttattaaaataactaaaataactggaatcagcatctaagagaaaggttactagtgggtatattttattcaca

SEQ ID NO: 190321 - DNA, 601 bp, Human
gcaaacccaaatgtcattggggtcagggaggtagcataaatgagccgaatgataagtacagaaactgtggcaaaagagcttatatactgtatctacaaggacatctgctttacaatcccagactgttgtcacaggggaaagtagacctagtattaaaatatttaaaatattaaattcattatcacaatattaactcttaaatattaatttttaaaagagtaactagaaacctgggtttgcatgtaatatcttcatatcttaaaatgatgatactaattcaaaaaaaagttgtaaaacactrcaggccaaacaaaacagtacacaggctgcatgccatcctgtgcaaggtgttaatggtaacaaggggagattactaaatgtttaaataaattaattggaagttagttattaaaataactaaaataactggaatcagcatctaagagaaaggttactagtgggtatattttattcacaagtaataattctttattcctttacaaagtcatatagattaatctcttgctgcatttaactaagcaatacattatcagaacatatttttctcaacttgttttcttacagcaaatgacctttctgc

SEQ ID NO: 190322 - DNA, 601 bp, Human
atctgcattgaatcttataaaaactataatgaataagttggggagactatttctaaagacttttcctttgagtggtttccaagttgtattaaataagaagactaatgattacttaagggttctcatttgaatttgagaagacatctgacaggctcctgaggagtgtgactcattaagtagaatacgggactcagaaggacaactttggggtactaacaagctatatgaactggggcaggtcttttgtctctgtctgtatgttaaatgagtattataatttttacttggcaagattgctgtraggcttaattaaagtttataaagtgctttgggagcctgagagatgaagctctaaaaacataatatgttattatctcatcctggatttttgtttttagatttacttgcttgaatctgtatcataacgatgcttacaattcaggcagttttctgaggttttttatttctacaaagacatgaaataaaataacataaatatataagtccctagacattcatatgggatgaaaaaattacacataatttttttctgatgtaaaagagtttcttcttaaaaaatgtttaattgaatcttatatct

SEQ ID NO: 190323 - DNA, 601 bp, Human
ggatgaaaaaattacacataatttttttctgatgtaaaagagtttcttcttaaaaaatgtttaattgaatcttatatctgttaaccagctttatttttttaaaagcatttcagtgttttattcgtaacatttttgcagaaccagtaaaaagttttaaaatgcagtcatctttactgggtcatgagaagaaaaatttactccatttaaaaaatgtaaatacttatttaaatgtaaataaatatgcgcatttagatatatataaatataaatatattactccaattgaataacaatggaattratttacagtaattagaatttgataatttgggcttgaaagatattcctttcttctatctttctgccttacttttttcttctactgtgtgttcatttgagattttcatatttataaaatataaaaatgtatatagagccctggagttaatataaattgccttgaaaattctttttattcctactttgtattcttgaaagaaaaatcatgttttcccataagaacagtgtcataattatggataaaatttctgaccaagctattgtcatcaagtaagtaatagatatgtttaactctatgtca

SEQ ID NO: 190324 - DNA, 601 bp, Human
attttcgtaggaaaattagaatggatacttgtataatatattcctgttactaggaatgatgcttaaaaaaattctatagtgtaggtcagtcttcattttaagcaattgaatccatttttaatgatattacttaagaattttgcttgtaagaaaaaaaactgtatctgattgaatttgaaaatgtagttttggagtgtatttactcttcctgcctgataccccactccccaaaacagagtagtcttgaggaaataaaaggtcctcaaaggcagctagatatgagaagagtttgaattgctartggggaaacttctagacctttgccttgatgttagaaaaggaatttgagaacatgatttatgtgttagacccagagtttgtctttaaacacaattcaagtttatcacctttcttataacctttctatacaaaaccatggatttagtgaataaagcatttggaagacggtggatagttgatagataaagcagattgaccaacatgtaaaaatagaaagtgttttcatagtaggaatttggaataactttttctatattcccatagttagaatggatgcctagaaaatgtatccttattgtga

SEQ ID NO: 190325 - DNA, 601 bp, Human
tctatacaaaaccatggatttagtgaataaagcatttggaagacggtggatagttgatagataaagcagattgaccaacatgtaaaaatagaaagtgttttcatagtaggaatttggaataactttttctatattcccatagttagaatggatgcctagaaaatgtatccttattgtgatgattaaaaatctctttttgaactaagacacgtaagatagtaacctctttctgctttgcttattctcccacccaggctgtgttgaagttatataagtataagcaaatgtgcacttttttttwaaattttattattattatactttaagttctagggtacatgtgcacaatgtgcaggtttgttacatatgtatacgtgtgccatgttggtgtgctgcacccattaacttgtcatttagcattaggtatatctcctaatgctatccctccccccttccctcaccccacaacagtccccagtgtgtgatgttccccttcctgtgtccaggtgttctcattgttcaattcctacctatgagtgagaacatgcggtgtttacactgttttataaaatgcttttgtctaattttgttacctttaagt

SEQ ID NO: 190326 - DNA, 601 bp, Human
ggatagttgatagataaagcagattgaccaacatgtaaaaatagaaagtgttttcatagtaggaatttggaataactttttctatattcccatagttagaatggatgcctagaaaatgtatccttattgtgatgattaaaaatctctttttgaactaagacacgtaagatagtaacctctttctgctttgcttattctcccacccaggctgtgttgaagttatataagtataagcaaatgtgcactttttttttaaattttattattattatactttaagttctagggtacatgtgcacartgtgcaggtttgttacatatgtatacgtgtgccatgttggtgtgctgcacccattaacttgtcatttagcattaggtatatctcctaatgctatccctccccccttccctcaccccacaacagtccccagtgtgtgatgttccccttcctgtgtccaggtgttctcattgttcaattcctacctatgagtgagaacatgcggtgtttacactgttttataaaatgcttttgtctaattttgttacctttaagtttagctacttggcaaataaacatttttaatactgcttaagtcaagtc

SEQ ID NO: 190327 - DNA, 601 bp, Human
ccaacatgtaaaaatagaaagtgttttcatagtaggaatttggaataactttttctatattcccatagttagaatggatgcctagaaaatgtatccttattgtgatgattaaaaatctctttttgaactaagacacgtaagatagtaacctctttctgctttgcttattctcccacccaggctgtgttgaagttatataagtataagcaaatgtgcactttttttttaaattttattattattatactttaagttctagggtacatgtgcacaatgtgcaggtttgttacatatgtatacrtgtgccatgttggtgtgctgcacccattaacttgtcatttagcattaggtatatctcctaatgctatccctccccccttccctcaccccacaacagtccccagtgtgtgatgttccccttcctgtgtccaggtgttctcattgttcaattcctacctatgagtgagaacatgcggtgtttacactgttttataaaatgcttttgtctaattttgttacctttaagtttagctacttggcaaataaacatttttaatactgcttaagtcaagtcttttacaaatagaattgtcaacatcca

SEQ ID NO: 190328 - DNA, 601 bp, Human
catgagccaccacgcccagccctattttacttttatctattgtcaatgactacattgaatacttttgtatgcaaatgtaacaaaggcatattttgcagttatttatactttatgtctgagaattatcacataatttagcaaacattaactcatctgtttaccttttgctgtaaaagctagagcaagtgatgtagatggggacaagaaaatgactcactcagcctcagaaccacaaggaactatagacttcttgcagtctggttttctcttcaaaaagcaattaaatatacgaccatttgtrtaagtttccacaatgcattcatatttcagaactgatttcttacctagcacggcatggatttcagttataatgtttctccttgcacaagcatggtagacatggggttagtaggtataagaatgcctctgggaacaatcttttaaggttttatagactcttttctctcaccactcccccaacctaagtgtaattgtcatcttagacactttgagtttaggggtggagatagggagagcatcatcagaagggacaaaaggagaaaggggaagtgaaatggtttgttggatactagtgagtgga

SEQ ID NO: 190329 - DNA, 601 bp, Human
tataaagcatatgatacttacagtatatcttttttggttgttttataagatgaagattacaaatatgatatttagcacatcctggctcttcttgaaagcagggactatggctcttttactaaaggacaaatagtgcctaaggaaacaggagggtgtaggagaaagaattcagctttgtggtcagatagacctggggggttgaatttcacttctctctagctgtatggtgttgggctaaacactgtctctagagcggcttcctcacctttcaaatagggatgatactcctttaggtaacgaygttattggtaggatttgatataataagtataaagtgcctaaaacaatgcctgtaaatggtaatttctattaggatggatcatagatttaggattagaatttacactaaacctaccttattcatagatttgtccagaatcatagcaggaaatctactccataaagtagctctagcctctggtgcctagtagaggtgatgtattaggatagtactttaaaacttttaccccaattaagagcagaggaaaatgaatggctagattagccatcctgagggtttaatctgaaatggtccatagaa

SEQ ID NO: 190330 - DNA, 601 bp, Human
ggatggatcatagatttaggattagaatttacactaaacctaccttattcatagatttgtccagaatcatagcaggaaatctactccataaagtagctctagcctctggtgcctagtagaggtgatgtattaggatagtactttaaaacttttaccccaattaagagcagaggaaaatgaatggctagattagccatcctgagggtttaatctgaaatggtccatagaagacatatcattttctttctgaaaaacttatttcaactttgcattcaaatataaatatatatttcaatatagrtatttcttcccctcattaaaaagtctttaaaattgttgttccaggaagatgagtagtatttatcttgtaacattgagttattatacccaggcgcactaccaggaacacttctgatgtacaagtgccttcaataattgtttcagaagcacaattttgagataagttaaagtgccctgggaaagagcattgtttatttttggagccttagcccaaaatgactcggactcatgctacaaaatgataacgctcttcatcagttgtatagagctccttctttatggccagctttcctagagatat

SEQ ID NO: 190331 - DNA, 601 bp, Human
tccagaatcatagcaggaaatctactccataaagtagctctagcctctggtgcctagtagaggtgatgtattaggatagtactttaaaacttttaccccaattaagagcagaggaaaatgaatggctagattagccatcctgagggtttaatctgaaatggtccatagaagacatatcattttctttctgaaaaacttatttcaactttgcattcaaatataaatatatatttcaatatagatatttcttcccctcattaaaaagtctttaaaattgttgttccaggaagatgagtagtakttatcttgtaacattgagttattatacccaggcgcactaccaggaacacttctgatgtacaagtgccttcaataattgtttcagaagcacaattttgagataagttaaagtgccctgggaaagagcattgtttatttttggagccttagcccaaaatgactcggactcatgctacaaaatgataacgctcttcatcagttgtatagagctccttctttatggccagctttcctagagatattttagacttctttagatgtccccaaaggcacaataaccacgtaagaagggaagccacag

SEQ ID NO: 190332 - DNA, 601 bp, Human
tgccagaccattggttaactgaagagagtagactctccagacaggcagtggactcagcctacaccaaaacacacagcaagccttctgtgcctttccccaggacagtgactcttcttttctctctgaagctgtggttctatgtaggaaactacatagggtgaagctaaaaggtaggatgggccagcctatgtagggtaaggctttttaactctatcgcatgggcagtgtgctgacattgcatactttttcagcacctcttcagatcggtatataaagtagattaacctgacagcagatggcrgttggttggaggggcctgcagtaaaggagagcagtttggagaatgccacggcatgcagacgcacactgtggagctgagcactcagtcggtgatgtggctcactcaccaggggaaggacagaggtgagatagggcaagagtcagttgctgaagtcactactccaaagggctagatagaaaggtagggaggaggaatggagagccagaaaaggagccaaaatgattagctattttactagagcaggtctgtcctaaaggcttggctgccattctctagctgggaccttgacgaatcacttcc

SEQ ID NO: 190333 - DNA, 601 bp, Human
ttcagagtttacaagaaagattgctcttccctgcagcctctccacccttccccctccttctctctctcccccacttgcttcttgctccttgtttctttctctgaagaaggacgtgagctacatggaggacagggcagaaaagggaagaaaaaaataggaaatggtgagaaaaatattaaggacatttaaaacttaaagttttatggttctttttagctaaatgaatcttttgagcttccatgggggaaattagtgtaattaaaattttctagttcataaaaccaaatctttacatactgaytgagcccactgtaagtattgactaaggcaaggacaaatgttatcctctgacttggaaaattcaaaagaagcattttgtctcttaaatgaaggtaggttgattatatttgatgagcttcttggaaaaggcattgattagtccacatccagaaatttaacttcccttttgcttatactacttgaaaaatgattttatggacaccgtgatgtaaacaatgagtctctctaggaagggatactgtgtatattttttgttttatttttaactttctggcattccaagacacatacagtgtttatt

SEQ ID NO: 190334 - DNA, 601 bp, Human
gcctctccacccttccccctccttctctctctcccccacttgcttcttgctccttgtttctttctctgaagaaggacgtgagctacatggaggacagggcagaaaagggaagaaaaaaataggaaatggtgagaaaaatattaaggacatttaaaacttaaagttttatggttctttttagctaaatgaatcttttgagcttccatgggggaaattagtgtaattaaaattttctagttcataaaaccaaatctttacatactgactgagcccactgtaagtattgactaaggcaaggacraatgttatcctctgacttggaaaattcaaaagaagcattttgtctcttaaatgaaggtaggttgattatatttgatgagcttcttggaaaaggcattgattagtccacatccagaaatttaacttcccttttgcttatactacttgaaaaatgattttatggacaccgtgatgtaaacaatgagtctctctaggaagggatactgtgtatattttttgttttatttttaactttctggcattccaagacacatacagtgtttatttgagggaaatattcgtaaaatagaatacgaaggaa

SEQ ID NO: 190335 - DNA, 601 bp, Human
tactgactgagcccactgtaagtattgactaaggcaaggacaaatgttatcctctgacttggaaaattcaaaagaagcattttgtctcttaaatgaaggtaggttgattatatttgatgagcttcttggaaaaggcattgattagtccacatccagaaatttaacttcccttttgcttatactacttgaaaaatgattttatggacaccgtgatgtaaacaatgagtctctctaggaagggatactgtgtatattttttgttttatttttaactttctggcattccaagacacatacagtktttatttgagggaaatattcgtaaaatagaatacgaaggaactattccaaagtcaggagttgagtgaaatatcccaattaaaaaactgaaaggattgtttatcagtaagttgcaggatatgtgtagagctccacaacatgaaaattcagtattaataattttggcttgaaatattttcagttctatctccttataagcttcagaattactaaccaccgaaactggtgtaactaagaggacgcatagcatgagtctcataggatctctccaactggtgccttgtaattttgtatggtatgc

SEQ ID NO: 190336 - DNA, 601 bp, Human
agactcaattttctcttctgtgaggtgaaaataatctccattgaaggcttttgaaagttcaatatatgaagcccataatatagttcctgccactgagcagggccttgataaattgtgctagttattattaaggctagacactattgggtaattatattaatagataagttagccctttctcaaagagctcacagtcaagaagggcaaactgataaacctagttgtaatttagtgtgacaggtgctataatctgtctggaatgttcccctagccaccaccacctctgtctgccaggcagacwcctacttattctttaaaactcattggaagcattaattgtagatgaacacttgccttgtgatacccaccccccaccagctcccccttacagacacgtactcaggagttcagaggcagtagctttgacctttcatctctgggtcttagtgctggcacatataatgggtcttaacaaatatttttcaggtaatacctattacctaaacaaagtggaatgtagtacagaaaactgattttgctagtttcacagaaaactttgcatttaaagttgggccttcaaggataagcaaagtcttgggaa

SEQ ID NO: 190337 - DNA, 601 bp, Human
tacttttatttttactggtacccaaagaaggattcaaaaatcttggcagataccatattaccaaatctaactataggagctggaccaagagagaagactctgtaaatcacctgtctacagacccaagacccaaccatcttaaaagaggattcaggaaatcatttaaatgtttcttcctgctttcatgccttgaacatgctgtttctgagcaatacactacagagattgccctaattgacactaaatatgagttttaagcatttattctgaaaactagacccatgtaaacaagttagcatcsaactatcaattcttagaaaatctactttccctatatgtctactggattatttgtctcagatcttaggggaggaagtggaagagctggagaacagcacgtgttattttagagttataactggaagtatttggaatggcttctatgaaagtttatttcactgaaaatgtggaaacagctttggaactaaggaatgggcagagactagatttggaggagcagggtactaaaagcctagagtctggcgaggacttagaagagaaaaagattctggaaagtttggagctcttaaagaaaaataaa

SEQ ID NO: 190338 - DNA, 601 bp, Human
cagataccatattaccaaatctaactataggagctggaccaagagagaagactctgtaaatcacctgtctacagacccaagacccaaccatcttaaaagaggattcaggaaatcatttaaatgtttcttcctgctttcatgccttgaacatgctgtttctgagcaatacactacagagattgccctaattgacactaaatatgagttttaagcatttattctgaaaactagacccatgtaaacaagttagcatccaactatcaattcttagaaaatctactttccctatatgtctactggrttatttgtctcagatcttaggggaggaagtggaagagctggagaacagcacgtgttattttagagttataactggaagtatttggaatggcttctatgaaagtttatttcactgaaaatgtggaaacagctttggaactaaggaatgggcagagactagatttggaggagcagggtactaaaagcctagagtctggcgaggacttagaagagaaaaagattctggaaagtttggagctcttaaagaaaaataaaaatttacttcacttctaactatttggttggtgcaaaaataattgca

SEQ ID NO: 190339 - DNA, 601 bp, Human
gcacgtgttattttagagttataactggaagtatttggaatggcttctatgaaagtttatttcactgaaaatgtggaaacagctttggaactaaggaatgggcagagactagatttggaggagcagggtactaaaagcctagagtctggcgaggacttagaagagaaaaagattctggaaagtttggagctcttaaagaaaaataaaaatttacttcacttctaactatttggttggtgcaaaaataattgcaggttttgccattactttttcaccaactaacaaattcagtttcaaagayttctatactgctgacagtttttttcaaatattagcccttttaattatttcattaccagaccaatataaccttaatttttttcaaccaagataaacaatttttctgcagtaaatttgtatttatgttccagacacatctcatctgatatacaatattttcttaaattgtataaagagaaattattgtacatcggatgagctgtgtctgggattaagtattagctccactgtaaccttcattttcttgaacactggaaagaaaggccaacggtcatttagtagggttggaataggatgggga

SEQ ID NO: 190340 - DNA, 601 bp, Human
gatccaccacgcccagcactataatgcttttaatagagggaaatgaatcttcagatgatgtcagcatcctaattttttttctcctcttggggtttttctaaatgactggcaaatggaaaacctgaaagttacctgagacttctctgcatcgggcttgttggggtatactgttcttcttataatcaaccccagggactgacagatggacagttgttagagacaaagtcctcaatccaaggaggtcactcagggccaactttccttagtatatatcgttcattacattagttggttatattasctgtagtacaactcaagtacaatagctgcaggaggagacagctcgccagctaaacctaaaagttacaacagtgacatagcaagcaagggtaaaataaaaggctcttgacttattccttcattttttaataaagcatgaagtttgacataaattttaacctctggccgcatagtcagttatgcttattatcttgtgtgtattattatgctgtcaggagttggccactgatgaccaactccaaaatttagatgatagagataaaactggtagttaatatatgttgagtaccaggtcaaaaac

SEQ ID NO: 190341 - DNA, 601 bp, Human
ctccataagacactttacactgtgggaactggttcatgtaacagttctccaggatggaggattaatattcccatttcacagatgcagagttatgtgtctttctagacctgacaacacctgtcacctaccaaatgaatagagagctatgctataagtctagggatgagtgatccttggatgcagagcacttcctactagtattctgacttttactattatgcgtctgttactatttgacagctctcatttttgcctgtccaaatttaagcacgtttaatgagataaagagagcagaggcaamggtgagactggatcttcccttgtatcttattgatagagagtaaatcgaatccaatttgctaaggccttctctctcctttcatgtttcctcactttgcctccaccaccatgaggttgaaaaatgagtttccatttagtttaagccttttgttattcattacttaattttgcttctatttccctcttctatctatgacaaattcagcacagtgaggggaagaaacagtgatgatagtgatggcctcaagaagaaaacagggtgactgagtaggagcaaataagtatctcagaccagcatata

SEQ ID NO: 190342 - DNA, 601 bp, Human
acatgacgatacttgttaggtatgagggagacaagaccagaggcgccgggaagcttgactaccgtggagagctcagttgagacttgtctttgcccatggcctgcagcgcttatgtagaaattggggatgcttttactcgttccaaagcctaacctgatcagacctgcccaggttggagtttgggaaaaaaagtgtttgaagtaaacaggaaaattactcaccttaatgatgtgtcttactggcactgacagtgctttgatagtctgacagtctttttttttaagttttgggaggaaagacrggggaaattattaatatgatttttggaaaacatagattcttatgcttatgcacttgctaataaggtggaaaaagcgggctttgcaccatttacagttatggactcgcgtttcctcctaataaagtctatatcaggaattttccattaggaatttctaccaaaaagaaaagaaaatacgttactgtttattttgtgtacttgtgccatgtgtctccacaattgcgctgtggctgttcacacagaacagattcttcctagcacttgggctgtgggttcccaaacttgcaggtcgctttcatc

SEQ ID NO: 190343 - DNA, 601 bp, Human
aaattactcaccttaatgatgtgtcttactggcactgacagtgctttgatagtctgacagtctttttttttaagttttgggaggaaagacgggggaaattattaatatgatttttggaaaacatagattcttatgcttatgcacttgctaataaggtggaaaaagcgggctttgcaccatttacagttatggactcgcgtttcctcctaataaagtctatatcaggaattttccattaggaatttctaccaaaaagaaaagaaaatacgttactgtttattttgtgtacttgtgccatgtrtctccacaattgcgctgtggctgttcacacagaacagattcttcctagcacttgggctgtgggttcccaaacttgcaggtcgctttcatctgtctggtgattaagaccataaaccaagtggtgtgatgagagagtttggtgctctagacagagcaagcacacccttttttcataagaagcacaattcttaaatctctgcacctaaatctttccttaggatgggtcagttttttggaaaaagcaattatatatgttttgatattttgttgaaacataatagatgttgatttcatatggttt

SEQ ID NO: 190344 - DNA, 601 bp, Human
tgatttttggaaaacatagattcttatgcttatgcacttgctaataaggtggaaaaagcgggctttgcaccatttacagttatggactcgcgtttcctcctaataaagtctatatcaggaattttccattaggaatttctaccaaaaagaaaagaaaatacgttactgtttattttgtgtacttgtgccatgtgtctccacaattgcgctgtggctgttcacacagaacagattcttcctagcacttgggctgtgggttcccaaacttgcaggtcgctttcatctgtctggtgattaagascataaaccaagtggtgtgatgagagagtttggtgctctagacagagcaagcacacccttttttcataagaagcacaattcttaaatctctgcacctaaatctttccttaggatgggtcagttttttggaaaaagcaattatatatgttttgatattttgttgaaacataatagatgttgatttcatatggtttttttcctttttttttttttgtctttgctaaatgtcaaacggtacattttttctaagcttgaagacagagaactgggtcatatgtctctaaacatttaaatcttcact

SEQ ID NO: 190345 - DNA, 601 bp, Human
tttcctcctaataaagtctatatcaggaattttccattaggaatttctaccaaaaagaaaagaaaatacgttactgtttattttgtgtacttgtgccatgtgtctccacaattgcgctgtggctgttcacacagaacagattcttcctagcacttgggctgtgggttcccaaacttgcaggtcgctttcatctgtctggtgattaagaccataaaccaagtggtgtgatgagagagtttggtgctctagacagagcaagcacacccttttttcataagaagcacaattcttaaatctctgyacctaaatctttccttaggatgggtcagttttttggaaaaagcaattatatatgttttgatattttgttgaaacataatagatgttgatttcatatggtttttttcctttttttttttttgtctttgctaaatgtcaaacggtacattttttctaagcttgaagacagagaactgggtcatatgtctctaaacatttaaatcttcactgagatagggaagagtgacctgatcttatggatcgtccgagtcctgtgagacaaaaatgctgggtttttcatgcagtccctaattcactttga

SEQ ID NO: 190346 - DNA, 601 bp, Human
ttgtgtacttgtgccatgtgtctccacaattgcgctgtggctgttcacacagaacagattcttcctagcacttgggctgtgggttcccaaacttgcaggtcgctttcatctgtctggtgattaagaccataaaccaagtggtgtgatgagagagtttggtgctctagacagagcaagcacacccttttttcataagaagcacaattcttaaatctctgcacctaaatctttccttaggatgggtcagttttttggaaaaagcaattatatatgttttgatattttgttgaaacataatagrtgttgatttcatatggtttttttcctttttttttttttgtctttgctaaatgtcaaacggtacattttttctaagcttgaagacagagaactgggtcatatgtctctaaacatttaaatcttcactgagatagggaagagtgacctgatcttatggatcgtccgagtcctgtgagacaaaaatgctgggtttttcatgcagtccctaattcactttgaccttggtggagggagtcaaatctcctagtttgagatcccacacatataaagctctagagtttcaggattaaaatctttttaa

SEQ ID NO: 190347 - DNA, 601 bp, Human
ggctgttcacacagaacagattcttcctagcacttgggctgtgggttcccaaacttgcaggtcgctttcatctgtctggtgattaagaccataaaccaagtggtgtgatgagagagtttggtgctctagacagagcaagcacacccttttttcataagaagcacaattcttaaatctctgcacctaaatctttccttaggatgggtcagttttttggaaaaagcaattatatatgttttgatattttgttgaaacataatagatgttgatttcatatggtttttttcctttttttttttttgtctttgctaaatgtcaaacggtacattttttctaagcttgaagacagagaactgggtcatatgtctctaaacatttaaatcttcactgagatagggaagagtgacctgatcttatggatcgtccgagtcctgtgagacaaaaatgctgggtttttcatgcagtccctaattcactttgaccttggtggagggagtcaaatctcctagtttgagatcccacacatataaagctctagagtttcaggattaaaatctttttaactttatattctcagattctgtatagcttattaaactag

SEQ ID NO: 190348 - DNA, 601 bp, Human
ctcacacctgtaatcccagcactttgggagaccgaggcaggtggtcaggagttcgagaacagcctggccaacatagtgaaaccccatctctactaaaaatacaaaaaattaactggccatggtggcaggtgcctgtaatcccagctacttaggaggctgaggtaggagaatcacttgaactcaggaggcagaggttgcagtgagccaagatcgtgccattgcactccagcctgggccacagtgcgagactccatctcaaaataataataataataataataataataataataataatgataatgtaaagtggggaaggcaagatttggctcacgagtcagacttcctatcaatgggtctatctttgaagcaagtgctcagagtgtctattcctttgatcacacgggtagtggtttatttccatgagtatttgctgttttcaggagatttcactttgggttttgtccatattccacattcaggaaactgttaattttggaagaagagattgtttttacttggttcttctaaggaaattaatcaaatgtacacgtgcaacttaaaatcaaagaatccctgttttaagaggagtttttcttat

SEQ ID NO: 190349 - DNA, 601 bp, Human
cacacctgtaatcccagcactttgggagaccgaggcaggtggtcaggagttcgagaacagcctggccaacatagtgaaaccccatctctactaaaaatacaaaaaattaactggccatggtggcaggtgcctgtaatcccagctacttaggaggctgaggtaggagaatcacttgaactcaggaggcagaggttgcagtgagccaagatcgtgccattgcactccagcctgggccacagtgcgagactccatctcaaaataataataataataataataataataataataataatgataatgtaaagtggggaaggcaagatttggctcacgagtcagacttcctatcaatgggtctatctttgaagcaagtgctcagagtgtctattcctttgatcacacgggtagtggtttatttccatgagtatttgctgttttcaggagatttcactttgggttttgtccatattccacattcaggaaactgttaattttggaagaagagattgtttttacttggttcttctaaggaaattaatcaaatgtacacgtgcaacttaaaatcaaagaatccctgttttaagaggagtttttcttattt

SEQ ID NO: 190350 - DNA, 601 bp, Human
ggcaggtggtcaggagttcgagaacagcctggccaacatagtgaaaccccatctctactaaaaatacaaaaaattaactggccatggtggcaggtgcctgtaatcccagctacttaggaggctgaggtaggagaatcacttgaactcaggaggcagaggttgcagtgagccaagatcgtgccattgcactccagcctgggccacagtgcgagactccatctcaaaataataataataataataataataataataataataatgataatgtaaagtggggaaggcaagatttggctcacgmgtcagacttcctatcaatgggtctatctttgaagcaagtgctcagagtgtctattcctttgatcacacgggtagtggtttatttccatgagtatttgctgttttcaggagatttcactttgggttttgtccatattccacattcaggaaactgttaattttggaagaagagattgtttttacttggttcttctaaggaaattaatcaaatgtacacgtgcaacttaaaatcaaagaatccctgttttaagaggagtttttcttatttcaactggcaaacaatatgaaactgaatgtaccc

SEQ ID NO: 190351 - DNA, 601 bp, Human
gtaagcatgtcacactctgaccaaagtgtttgtatttggcccaattccccacagctaataataatccctttctgtttggaaaatgtcttatatttttcaaaacacacacatatatgtattatcacatttaatcctcataacaaacctgtcacattggcaggtggtattctcacttctcacatgcaaagttatgtaacctttcttgagattatacctcagtttggaaagtaggggaatgagccttctgcctctgtgagtaccgtgttcttcacggtgtacgatgcttccaaatatatactcytcccaacaggcagaggtggtgtttcgcagtcaacaaaagatgatttttgttttgttttcccttctgcatgccctgtctcctgctacttcctctgttcaaaacattttttttttctctctctctctctcctctcactgctgcctaccaaaattatgtcacataatttggctatttaatgtaatttggttaataatcctcatctatctaccagaaacttaagagttgttatcatcctggcaatctaccttgaagattggcaaaatgttagttaactattgaatatagatgatgagcatatgg

SEQ ID NO: 190352 - DNA, 601 bp, Human
atgtattatcacatttaatcctcataacaaacctgtcacattggcaggtggtattctcacttctcacatgcaaagttatgtaacctttcttgagattatacctcagtttggaaagtaggggaatgagccttctgcctctgtgagtaccgtgttcttcacggtgtacgatgcttccaaatatatactcttcccaacaggcagaggtggtgtttcgcagtcaacaaaagatgatttttgttttgttttcccttctgcatgccctgtctcctgctacttcctctgttcaaaacattttttttttctctctctctctctcctctcactgctgcctaccaaaattatgtcacataatttggctatttaatgtaatttggttaataatcctcatctatctaccagaaacttaagagttgttatcatcctggcaatctaccttgaagattggcaaaatgttagttaactattgaatatagatgatgagcatatggaattaaatttgaaatttccaatttcaggttccaaaaatccaatttcaaattaagaaattttaaatttaaatcttaaattaagaaattttaaatttaaatcttaaattaagaaa

SEQ ID NO: 190353 - DNA, 601 bp, Human
ttgagctgtgagtgcctcccagaatgaatggtttctgaacgtgtttctgttaggaatgatgcaaccttcagtagagaccagagatttaagaattctatactgtgagtcattttaaaagacaatcaaagagtatgtgtggaagcatagacaataactttcacctctagcgtccaggtgttgaaggaggtcagctaccagggaaggactcctacgactttgggtgccactgcgtgaggctttgtcttggaccagggggtaaaacatatctcaggcaggacgctgagctctaggtagggctatygtttttgtagaagcatgacttcttgatacaacaaagtaagagctgaggaaggaacagggaaaaccagtttgggcccagaggggaaagaaatgatagtgtagtagcccgcggttttgcaggcagttgggagtagcaagccacccttagggggaggataatgttttctctaccttaagggaaaatgatagctgacttgcagagcagtgtgctgagacagacatgctgctactgcagtggaagggggttgcaacgtattgtcttctgtctggagagagagagagagagagcgcgtgtatgtca

SEQ ID NO: 190354 - DNA, 601 bp, Human
ctcccagaatgaatggtttctgaacgtgtttctgttaggaatgatgcaaccttcagtagagaccagagatttaagaattctatactgtgagtcattttaaaagacaatcaaagagtatgtgtggaagcatagacaataactttcacctctagcgtccaggtgttgaaggaggtcagctaccagggaaggactcctacgactttgggtgccactgcgtgaggctttgtcttggaccagggggtaaaacatatctcaggcaggacgctgagctctaggtagggctatcgtttttgtagaagcrtgacttcttgatacaacaaagtaagagctgaggaaggaacagggaaaaccagtttgggcccagaggggaaagaaatgatagtgtagtagcccgcggttttgcaggcagttgggagtagcaagccacccttagggggaggataatgttttctctaccttaagggaaaatgatagctgacttgcagagcagtgtgctgagacagacatgctgctactgcagtggaagggggttgcaacgtattgtcttctgtctggagagagagagagagagagcgcgtgtatgtcacgtctgtgtccataa

SEQ ID NO: 190355 - DNA, 601 bp, Human
ggcatgatctcagctcactgcaacctccacctcctgggttcaagtggttctcctttctcagcctcccaagtaggtgggattacaggcacgcgccaccacgcccagctaatttttggcacgacctcagctcactgcaacctccgccttctggattcaagcgattctcctttctcagcctcccaagtaggtgggattacagacatgtgacaccacacccagctaatttttgtatttttagtagagatggggtttcactatgttgtccaggctggtctcaaactcctgacctgaggtgatctgmctcggcctcctgaaatgctgggattacgggggtgaaccactgcacccggccaacactttttaaacattacattttttaaaaaataatatctttctcgatatgaaatttaaaatgtttttcaagtgagtttttttgtagaggacaaatccaaagtatagtatataattagcccatataacttcatgtgataatcagtgtctttgaagcagaccaaactgaagctgtgtctcagcgctaagggtctttttacattttactgaattggatctttagaattaatttttcaaaccctccttatca

SEQ ID NO: 190356 - DNA, 601 bp, Human
actttgtacttgattaacggaattgttctgagagctttagagcttgacttttttttcttcctgtcaagtattttgggttatttgagatagtacagacaacactttacctcttaagttttttgaactagaagccataaattagaagtgcacctggcatttcctgtttgtgactagtggctatcttttagataacagtgaagtcctcaatgtccttgataggttcttggtaaactgcgaccttaaacaaaatgatgtgcaggagatcttcgagtaattgtttcatacaatgttattttcttayaacagtgatgagaaaaacaaattgttttgttatatgtgttttgcttaaagttacagttcccaaaaatctatcaaaaatgttaaatgaggattcattgtatttgtaaatctcattatttttctctcttttttaaagaaactaaattcaaattcattcagaaagccaggcataaagtgagactaatatgttcgttggtgtatttaagcctttcttagagttttcttttttttaagacctcagtataagaacatgccagacgtgaattgatctggaattgcagactcgggagggctttgatgc

SEQ ID NO: 190357 - DNA, 601 bp, Human
agactaatatgttcgttggtgtatttaagcctttcttagagttttcttttttttaagacctcagtataagaacatgccagacgtgaattgatctggaattgcagactcgggagggctttgatgctactctatctagttgccttccttgaagagggattgagaagagaggtaggttatagaattaatgatttttttttgttccgtgagagtttatttcatccatagtctctaagatttagggctcaagatagccatgtgatttgagatttgcatgtagtatggcatttcttctgggagaggwtgaaagagctaaagttcttgttttttggttttggtgtagtaggcagggagggttttgattctacctttaggaaagggaggtgttgaaaaattacgcaggtgtgtgctgatattacctggcacctctatgcattgtgatactgaattaccagtctgccagccaaaagcgtgtaatatagtatgtctactgaggcaggtggtaaaggtagggtcctagtcactggaattctttttttttcccccttctctttgcaacatattattagtaaaggagctgaatttacttgttttccaaaatccc

SEQ ID NO: 190358 - DNA, 601 bp, Human
aaaaaccccacttttggtcacgcctataatcccagcacttctggagattgaggcgggcggatcacctgaggtcaggagtttgagaccagcctggtcaacatggtgaaaccccgtctttacccaaaatacaaaaattagctaggtgtggtggcgggcgcctgtaatcccagctactcaggaggctgaggcaggagagtcgctagaaccttggaggcagaggttgcagtgagctgagattgcaccattgcactccagcctgggtgacagagcgaagctcagtcttagaataacaaaaataatmatcatcatcatcatcattatcatcaaatggaagtaacactatacattatctattttcccctctatgaatgattagctcaagatttggggggatcatgtaagttgccagttatttctcagtgagtgtcagatatttatgacttctttgaagaggccaatcgtttttgaaaattatttcagatgtgctttatttccccccacccatcacagtattttatttctgatttcacttagatttgcataatgcaaagagccacagttgcactgggggtcctttctaaataggcaacgaggttagtgc

SEQ ID NO: 190359 - DNA, 601 bp, Human
aaccccacttttggtcacgcctataatcccagcacttctggagattgaggcgggcggatcacctgaggtcaggagtttgagaccagcctggtcaacatggtgaaaccccgtctttacccaaaatacaaaaattagctaggtgtggtggcgggcgcctgtaatcccagctactcaggaggctgaggcaggagagtcgctagaaccttggaggcagaggttgcagtgagctgagattgcaccattgcactccagcctgggtgacagagcgaagctcagtcttagaataacaaaaataatcatmatcatcatcatcattatcatcaaatggaagtaacactatacattatctattttcccctctatgaatgattagctcaagatttggggggatcatgtaagttgccagttatttctcagtgagtgtcagatatttatgacttctttgaagaggccaatcgtttttgaaaattatttcagatgtgctttatttccccccacccatcacagtattttatttctgatttcacttagatttgcataatgcaaagagccacagttgcactgggggtcctttctaaataggcaacgaggttagtgcaac

SEQ ID NO: 190360 - DNA, 601 bp, Human
cctgtaatcccagctactcaggaggctgaggcaggagagtcgctagaaccttggaggcagaggttgcagtgagctgagattgcaccattgcactccagcctgggtgacagagcgaagctcagtcttagaataacaaaaataatcatcatcatcatcatcattatcatcaaatggaagtaacactatacattatctattttcccctctatgaatgattagctcaagatttggggggatcatgtaagttgccagttatttctcagtgagtgtcagatatttatgacttctttgaagaggccartcgtttttgaaaattatttcagatgtgctttatttccccccacccatcacagtattttatttctgatttcacttagatttgcataatgcaaagagccacagttgcactgggggtcctttctaaataggcaacgaggttagtgcaacccactgctgacttattgaacccaggacctgatggagtagagttgattcttaaagcaatgagtgggcattttgtgttgtttttatgttcaagctcccattgtgagaatatggttacactttagggaagaaaacctcaactcttagacaaacttct

SEQ ID NO: 190361 - DNA, 601 bp, Human
tatcatcaaatggaagtaacactatacattatctattttcccctctatgaatgattagctcaagatttggggggatcatgtaagttgccagttatttctcagtgagtgtcagatatttatgacttctttgaagaggccaatcgtttttgaaaattatttcagatgtgctttatttccccccacccatcacagtattttatttctgatttcacttagatttgcataatgcaaagagccacagttgcactgggggtcctttctaaataggcaacgaggttagtgcaacccactgctgacttaytgaacccaggacctgatggagtagagttgattcttaaagcaatgagtgggcattttgtgttgtttttatgttcaagctcccattgtgagaatatggttacactttagggaagaaaacctcaactcttagacaaacttctttgcttaactaaaaataagtatatatactcctgtaagaatttggtgatcatatttttatttttgttagtaagatggcctctgagctttacacttgattgtctaatcatatattttctaatcatgtgtttattcactcaaattcactctggcacgaatacac

SEQ ID NO: 190362 - DNA, 601 bp, Human
tggagaatcttagaaatatgaggcttcagtcataattgttatacatgacttttattttgatctttgcagttgagtaagaattttttaatctattttttctttcaccttaagagatgtgaactataattttttccattttatatgtgtaatggtgaagtggccaaaatgtgggttagatgttattgtatttcaaagcgagcttgggaaggggcgcaaagcagtctgcctttaaatgtgttatttccagccaggcgcggtggctcacactcgtaatcccagcactttgggaggccgaggcagrtagatcgcttgagcccaaagagtgagagaccagcctgggcaacatgggggaaaccccgtctctgctgaagaaaaagaaaaatagaaaaaaaaattaaccgggcgtagtggtgggcgcctgtaatcccagctactctggaggctgaggcaggagaatcacttgaacctgggaggcagaggttgccgtgagacaggatcgcgccactgcactccagcctgggtgacagagcgagactctgcctcaaaaataaataaataaaataaaatgtgttagttcccctttggagcagaaagaagtgga

SEQ ID NO: 190363 - DNA, 601 bp, Human
cagtctgcctttaaatgtgttatttccagccaggcgcggtggctcacactcgtaatcccagcactttgggaggccgaggcaggtagatcgcttgagcccaaagagtgagagaccagcctgggcaacatgggggaaaccccgtctctgctgaagaaaaagaaaaatagaaaaaaaaattaaccgggcgtagtggtgggcgcctgtaatcccagctactctggaggctgaggcaggagaatcacttgaacctgggaggcagaggttgccgtgagacaggatcgcgccactgcactccagcctrggtgacagagcgagactctgcctcaaaaataaataaataaaataaaatgtgttagttcccctttggagcagaaagaagtggacacttttataaggtaaggagggaagtgaacaagggcaggcggtccccctgctagcttggtgcctcatctacctgatagttgagttggcaccaacccgggcagaaataagttgtgaaaatggccaagcaggcagacttaagatatgcccttctgatgggtgaaagtcccaaggccaccccgtgaaggtgaaagttccatggcaggtgttctctggtttg

SEQ ID NO: 190364 - DNA, 601 bp, Human
ttacttcatgtaatttttttatttgtccagaactaaaactatcctttctctattgtcgacaattccattggctaagccaggtttcaattgtctgctgaatatcaggagctctgtgttaaaattaactcattcattctgctttgattttagaaaacagataaacaactgatagtatttttgcaagcatcttttgttctaaagcataatatgtattggtctgttttggtacttccatgtatgtatttcatgttaaaaccaagaaggctgaatttagtaaatccaaagagtttcccccatcatkttcccttttcattcatttctactgccctaggttgggccttcctcatttcttgtctgaatagctcctgatgggtttccccaattttactttgcttgttcccaccacctttgtatttctgaatacaaagaactgattaggtctttcccctaccttataatcctcagtgacacctctttgcctgctcatagtagttaacggtatcttgtgacatccaaggctcctcagaatctggtaagtgcctttctagctcagcctcattgacttctgctcggccactcctcctccttcccccatcccatc

SEQ ID NO: 190365 - DNA, 601 bp, Human
aattagatatatcaaaactttgtggacatagctaagaagtacctagaagaaacttggtagaattaaatgtttatattagaaaaaaacgtgaaagtctaaaatgaatgatatatgattctagttcaaaaaaatagcaaactcaaccctggtttgattattgcagtcacataaaaataaaaatttaaaggtatgcagatttgaaaggaagaagtaaaactgtccctgttcatagttgacatgatcatctatgtagatcgtaaggaaggcatctacaaaaagctacaagaactagtaagtttascaaggtcataggctacatggtcattatacatgaattaattaggtataaatacatgacatagtataaaacgcattagaaacaaaaagaaattttcatttttaaaagtactgtttataacaattattttaaaataaaatactgaaggataaatctaacaaaataggtacagtatttatacactgaaaactataaaacatttctgagtaaaattaaagatactctgtttaaatggagagatatcatatgctcatggtttaaaagacaccacattgctaaggtatcagttctcccctaaaagac

SEQ ID NO: 190366 - DNA, 601 bp, Human
catgcctgtaatcccagtactttgggaggctgagacaggaggatcacttaagcctaagagtttgagacaagctgggcaaaatagtgagaccccatctctacaaaaaacatacaccaaaattagctgggcatagtagtgcgcacctgtagccctagctactcaggaggctgaaatgggagaattgcttgagtctgggaggtcgaggatgcagtgagccgtgatggtgccactgtactgcagcctgagtgacagagcaagaacctgtctcaaaaaataaaaaaagaaatcctgatcctgtcakttgcaacaacatggataaatctgaggacattatattaagtgaaataagccaggcacagaaagatgtaaccacaagatctcactcaaatggaatctaaaaatgttaatctcatagaagttgagagtagaataggggttaccagaggctgagaaggggacacggggtgaggggaaatggggaaaagatgggtcaatgggtacaatattacagttagacagaaggaataagttctgttctattgcacagtaggatgactatagttaacagtaatgtattgcatatttcaaaatagctagaagg

SEQ ID NO: 190367 - DNA, 601 bp, Human
aatctgaggacattatattaagtgaaataagccaggcacagaaagatgtaaccacaagatctcactcaaatggaatctaaaaatgttaatctcatagaagttgagagtagaataggggttaccagaggctgagaaggggacacggggtgaggggaaatggggaaaagatgggtcaatgggtacaatattacagttagacagaaggaataagttctgttctattgcacagtaggatgactatagttaacagtaatgtattgcatatttcaaaatagctagaagggaggattttgaatgttcytactacaaagaaatgataaatgtttaaggcgatggatatactacatatcctaatttgatcattatacaatatagacatgtatcaaaacatcacattttacctataaatatgtacaattcttttgtatcaatcataaaataaaacctaaaaagtgaaatttctgtgttacaaagggggagaacacagtctgtattacaatttttttaactcaaaaggtacaaaatatttgaacagatgcttcaaaaaatatcaaatagttgtatagaattacataagtttgtttttatttttattatatat

SEQ ID NO: 190368 - DNA, 601 bp, Human
ctgacaaggatatgaagtcctcatatattgcaagtgacaatgtaaaatggcacaaccactttgtaaaactatttgggagtttgttagtaagcatacacttacccagcaatcatattcctaggtattcaagaaaaatggaaatgtacatcctcacaaaaatttgtacatgaacgttcataatagttttatacacaatagaaaaaaatggaaataattggtgagttgacaaataatgaagtgctattcaaaaatacaatggaatgctgatacgtgcaaaaaccacagataaatctcaaaagcmttatcacataagattatatactatatttttccatttacataaaattctggaaaggtaaaactagtggaggaaacaggtacatgattgttgaggccaggagctagggaggggatgaactgcaaagaagcaaaagataattggaacaggaatggaaatattctatatcttgattgtagtagtagttgcacaacggtgtacatttgtcaagccatcagcttttgcacttaaaaactggtatactttgcggaaaagtataccacataaaacaaaacccccatacaaaaaagaataaattaggcc

SEQ ID NO: 190369 - DNA, 601 bp, Human
taggccttagaatgaaaagaatctcaagtcaatgttgaggagcaatttagacgtgaattttttaaattccacagagaaagaaagatagtaaaataagccatgtgtgttcaaatttacaatttctgctgacttgaatcatcagggtattttaaaatcttgctgtaaatcagattcccatgttccaatcttgcagaagccgggaaaattggagatgatggtgctattttgtaagggatacggaagtgggcaagtctaaggacttgtttatacacatagaccagggagactgaacttagtactrggtaaaaaaaataaaggtcatcatggaacagatttgcaaacaatgaagtaaacagaatagcagagatttggctttgtaaaaagaaaaaaaagcgattgtgccagaccacttcagcgcctctagttgctgaattgcaggactggtagttgaaccaaaagcaataaacataatgcatcttggctgtggtcagatattttgatttagtcaaatatgaagccctcaccactaaaattggaaaatatggtttgcagtacagatacagtactagctgaaaagtgatatctgaattgtcctggcatg

SEQ ID NO: 190370 - DNA, 601 bp, Human
ccacactgggaatatcacttttgttgttgtagttgttgttgcttgcttgttgcttttaatttttttaggtttcagattcagtaggtacatgttcagtattgttacatgaatatattgtataatggtgaggtttgggtttctagtgtacctgtcacccaaacagtgaacattgtacccaataggtattttttaacccgcatcccctcctaccttcctcatttttggagtcctcagtgtccattatttccatctttatgtccatgtgtatccttttggggtttttgtggttttttttcgtatktttagtagagactggatttctccatgttggccaggcatgtcttgagctcctgcctgcctcggcctcccaaagtgctgggattacaggcatgagccactgtgcccgaccacatgtgtcttcactacttatctcccacatataagtgaggacacatgatacttgattttctttttctgagttgtttcacttaggataatggccttcagctcaatccatgttgctgcaaaggacatgatttcagggaatagcattttgaattttgggtgatgatcctatggtgtgtttgaagcattaaaacgt

SEQ ID NO: 190371 - DNA, 601 bp, Human
tgtgtgtgggtgggggtggaggggtagggggaattagagatagataaggccataatacagagggcctcataaagtcctcaataaaccatgttaaagagcaagactgtatccttgaattcccagaagcagctggtgtaatcgtccaggctgtcttccacctagcccaaagttttttcaactctatcacttgctgcctctccctaccattaaatgagtaagcaatatactgagaaattaataaaactatgttaaatagaccacttttgagctccattttaatgcttggagaagagtcggtaarcattgtaattgattcagaaaagaaccacaatgttggaaactagaaaaaggtaaacatttgcatggctgagttaagagaacagagacataagaaactgttattacaggactaggatagactcatataccagttactaagcaggttcttgggcaagtcctttctgtacatttattttcttatttataaaatagggatgataattcaagtcaattatctgttatctacaattctgaagttccaagagctctgaaaatcagaagttggttcagttttattttgatttcttaagtttgtggcaca

SEQ ID NO: 190372 - DNA, 601 bp, Human
tatcattaattaagcttaaaaattagattcccacccccatccccgagaatgaacaagaattagcacttgacgatccttaattttattcttaatgcttttatactgtactctctcgagcttgatttatagtatatcagttattaaaatggaatgttttccttaagaaacttctacgctgaacacttaaccttcatttctgcaatctttacatacttggaaggataccttatttgcctttaggtattagttgacagacttatttttcagtcatctttcctaagggtcatcttacgaaattcayggttagattatgcgttatatacctcctaacgaaaacacgaatggatatgcttattttcttcaagttctcaataaaaggaagttcttaacatgtcataaaacaagttctgtgtaagtctttagttaaaagcactagagcaaaaatacccatctagatttcattcagtgtttcccaagtagaattttatttttgtggttgaagtttggcatgtttcctatttcttcaagctatataaaacccttttgctgcgtctaatccatggcctgcggacatggaggactgattttgcaatacttttct

SEQ ID NO: 190373 - DNA, 601 bp, Human
cttaaaaattagattcccacccccatccccgagaatgaacaagaattagcacttgacgatccttaattttattcttaatgcttttatactgtactctctcgagcttgatttatagtatatcagttattaaaatggaatgttttccttaagaaacttctacgctgaacacttaaccttcatttctgcaatctttacatacttggaaggataccttatttgcctttaggtattagttgacagacttatttttcagtcatctttcctaagggtcatcttacgaaattcatggttagattatgcrttatatacctcctaacgaaaacacgaatggatatgcttattttcttcaagttctcaataaaaggaagttcttaacatgtcataaaacaagttctgtgtaagtctttagttaaaagcactagagcaaaaatacccatctagatttcattcagtgtttcccaagtagaattttatttttgtggttgaagtttggcatgtttcctatttcttcaagctatataaaacccttttgctgcgtctaatccatggcctgcggacatggaggactgattttgcaatacttttctagcattgggaaact

SEQ ID NO: 190374 - DNA, 601 bp, Human
gacagacttatttttcagtcatctttcctaagggtcatcttacgaaattcatggttagattatgcgttatatacctcctaacgaaaacacgaatggatatgcttattttcttcaagttctcaataaaaggaagttcttaacatgtcataaaacaagttctgtgtaagtctttagttaaaagcactagagcaaaaatacccatctagatttcattcagtgtttcccaagtagaattttatttttgtggttgaagtttggcatgtttcctatttcttcaagctatataaaacccttttgctgygtctaatccatggcctgcggacatggaggactgattttgcaatacttttctagcattgggaaacttctaactaaaaattttgtgtgctggaatacttggaagaaaaggaaaggtcatttaaacaaatactatattttaaaatgaagaaataaagcaacattttaaatgtgtgatttttgttaagatacttgccattagtgagagttagggtgggacatatcagtaacgaatccgattgccactatggctctgcccccccaccatctttcctctgggaggatgttggggccaacttacgat

SEQ ID NO: 190375 - DNA, 601 bp, Human
aaacacgaatggatatgcttattttcttcaagttctcaataaaaggaagttcttaacatgtcataaaacaagttctgtgtaagtctttagttaaaagcactagagcaaaaatacccatctagatttcattcagtgtttcccaagtagaattttatttttgtggttgaagtttggcatgtttcctatttcttcaagctatataaaacccttttgctgcgtctaatccatggcctgcggacatggaggactgattttgcaatacttttctagcattgggaaacttctaactaaaaattttgtrtgctggaatacttggaagaaaaggaaaggtcatttaaacaaatactatattttaaaatgaagaaataaagcaacattttaaatgtgtgatttttgttaagatacttgccattagtgagagttagggtgggacatatcagtaacgaatccgattgccactatggctctgcccccccaccatctttcctctgggaggatgttggggccaacttacgattgcaacctgtgtgtgtgtttatcctttgtttggatacatgttactaggtgccccactcttggccagcaattccagtgcctgggt

SEQ ID NO: 190376 - DNA, 601 bp, Human
tgcaatacttttctagcattgggaaacttctaactaaaaattttgtgtgctggaatacttggaagaaaaggaaaggtcatttaaacaaatactatattttaaaatgaagaaataaagcaacattttaaatgtgtgatttttgttaagatacttgccattagtgagagttagggtgggacatatcagtaacgaatccgattgccactatggctctgcccccccaccatctttcctctgggaggatgttggggccaacttacgattgcaacctgtgtgtgtgtttatcctttgtttggatacrtgttactaggtgccccactcttggccagcaattccagtgcctgggtggtttgcctgagcaaagtgcctgagtggctaggaatgtagagatagggctttgacccagagcacagggatgataaggtttactatagtgtaaggattagaatgaaggttctcttctgcttcagaagtgggaagaggaagcaacacaggatgggatctctatctggttctaggtctcaggctttctccagcccgttttgccaacttacaagcaactaaccaccactaaacttcctctccctggagaaggaaaaat

SEQ ID NO: 190377 - DNA, 601 bp, Human
ttctaactaaaaattttgtgtgctggaatacttggaagaaaaggaaaggtcatttaaacaaatactatattttaaaatgaagaaataaagcaacattttaaatgtgtgatttttgttaagatacttgccattagtgagagttagggtgggacatatcagtaacgaatccgattgccactatggctctgcccccccaccatctttcctctgggaggatgttggggccaacttacgattgcaacctgtgtgtgtgtttatcctttgtttggatacatgttactaggtgccccactcttggccrgcaattccagtgcctgggtggtttgcctgagcaaagtgcctgagtggctaggaatgtagagatagggctttgacccagagcacagggatgataaggtttactatagtgtaaggattagaatgaaggttctcttctgcttcagaagtgggaagaggaagcaacacaggatgggatctctatctggttctaggtctcaggctttctccagcccgttttgccaacttacaagcaactaaccaccactaaacttcctctccctggagaaggaaaaatttcactcacttgtgagtgagaagatct

SEQ ID NO: 190378 - DNA, 601 bp, Human
ttacaagcaactaaccaccactaaacttcctctccctggagaaggaaaaatttcactcacttgtgagtgagaagatctgcatccagatcctttctgtgccatgattagctgtgctacatcaggcccggtgttttcaggagtttaggaccaaacagcccctttcagctcttgcattctcctagtctttgacatcagaaggaaagtgcaggcgttcaagggagttcttgttttacagtttcaagcgatctgacgtcaggcgaaatctcttcactctctaacagatattccatcttaaaaaaaatcccatgaaccctaattcctgtgagtgtctctaaagtatattaaagactggattaattgtaatctaggcagaaatctgtctttgtggttgttgtttaatatcactcagtacatgccaatactcttctttcacttagcttctggtaatctatgaagctactcgtggtttcattcatttaaacccctctgagcctcagcttcttcatgctaaaggaaaataacaggaaataatggcataaatgtgttttgataaacataaaaccttttgtaaacatggggttttatttatgatagcacaaaa

SEQ ID NO: 190379 - DNA, 601 bp, Human
aacgagggtaagcagaatttgaatctctaactgttcaacctccttgaaggtcaagattctgtgggcatttttgtttgagacccacctacctgattcagacttctgcactccgatggcagatcagtctgccttttttttttttttttttttttttggctgacagtatctaagaataatgataaataaattcatggctttcacagtggttgaactatttaatattagtaattactagatgacctgaactactggttatctttactccttcctgcttccttctttttatttttcttgcctttaraataaaataagaggctgggtacggtggctcatgcccgtaatcccagcactttgcgaggccgaggtgggcagatcatgaggtcaggagatcgagaccatcctggctaacacagtgaaactccatctctactaaaaatacaaaaaaattagctgggcatggtggcgggcacctgtagtcccagctactcgggaggctgaggcaggagaatggtgtgaacccaggaggccaagcttgcagtgaaccaagatggcaccactgcactccagtctgggcgacagagcgagactccatctcaaaaat

SEQ ID NO: 190380 - DNA, 601 bp, Human
gaaaatcaatggaagaagaaagagaatggatcggaatttaaaagaagaaaataaagtcaaaattctctttaaaaaactattttttacacattaatttcaagtccttgcccacatggccacattatccgtacatttatctcttgcttttcacttaacaatctgccataaagaatattgcaatatagatagacttcattatcagcctccctaacttggtatttcaccaagataacatactatttgtaagcgttttcccattttttaaacataaaaattgtttttagttttaaccataatagaygatgcagcagagaacattttgatatgcttcactttttacttttattgaatggtttttgtagactgggactataggacctaagagctgttaaaaacagctttacgggtcccagttcttggagcatcttcttttttttggagctctgctaaatatcacaattttatgaaactttactcagtctcttttttaaaattgcatcccttttcttacacccaacttgggactccttcaacacacaaacaccagaacgtttcttatctttataatcaacacaatgtttaaaagttgaggaggaggaaa

SEQ ID NO: 190381 - DNA, 601 bp, Human
cttttttttggagctctgctaaatatcacaattttatgaaactttactcagtctcttttttaaaattgcatcccttttcttacacccaacttgggactccttcaacacacaaacaccagaacgtttcttatctttataatcaacacaatgtttaaaagttgaggaggaggaaagaagaagaagtggaagtcatatccttgctatcttctgcttctcagtgtatttgctggtcagacttttgggcagcattttctcagttaaactgatttttttttaaattaatttgcttatttccctttcrttttccaggaagctggcaaaatttcctccacgatgaggtcagagatgtagttatagagttccataaagcttgaatcattaatcttaaactccaaattataggactgttcccttaactgtagatgtgcattccagccctttctgttgctataaaggttatgacaccttcatgtatttgatatctggctatgggatctgttcgtttcttcaaggatgcacattttctttattatacagactatttcttttgccaccaacatcctgttcatgcaatttcattttattttctttatttttaagg

SEQ ID NO: 190382 - DNA, 601 bp, Human
aagcaatagtagtggatgcaagtgttaccataagtgggaaagcctaagagggatctcttagctgaagtttgaatgaacagatgatagatttgtaaatctgttgcatgaagcagagtagtgtggttgaaagtacactggtgtaacaggacccaagttctttggtttgctggcttgctgtgtggaccttcggcaactctctctctctaggcttcagttgccttacccgtacgtatgtactttggactagattatgtttaattctgagaacattttgagctctaagatgttattaatggaagtrtatattcaaatctatattgtactgttttatccacacagggaaaatattcttggagcattgctactgtttttggcaattatccccagttttcccttttcagtgatattcatgaaggtggtatagcctatttgaattacatgatgtggatcagcttacaaacgaacaggatcaaagatcacaaaatgttaaagcctgtctcacctaaggtagtgttcagtgttgcaaacattagctttaagcttccccgcaggcaagatgaagaaaaatctacaacagggttcagagtttgcccttttagga

SEQ ID NO: 190383 - DNA, 601 bp, Human
ggagaagctgcatgataagacctgtgaccttcagcagcaagtgggacgtcagccctcagagccagtgagaataggtatagcattgaagtggactccaggcatgtactacagctttacaaaaacaagtagtcattgtgacaatttctcagtccagggattctcaaaatgtgacttccacaccagtagcataaacatcatctattcacagacacacaccagcaagatacgggctttcctgcaacattacttaagccaaaggctatttcccagcatactgaatttcttttatgtattcttcccyaccatccttccacctccttattgctaggatcacaatcaatgtaaaaacaattgtccccagttaaatggacgcttagggctagagcctctaatcttacatgtgttgctggtactactgtctttttaatatgtatattaaatctgattaacattaatatttaattattaagtatatttaatatgcattagtgctttagaagtgttcccaggatgaaacttgcatttttcctccaccagcgtttcgtcagaacacacatggtatccagatgacatccatcaagaaacgaagatccccagatga

SEQ ID NO: 190384 - DNA, 601 bp, Human
ccagcaagatacgggctttcctgcaacattacttaagccaaaggctatttcccagcatactgaatttcttttatgtattcttccctaccatccttccacctccttattgctaggatcacaatcaatgtaaaaacaattgtccccagttaaatggacgcttagggctagagcctctaatcttacatgtgttgctggtactactgtctttttaatatgtatattaaatctgattaacattaatatttaattattaagtatatttaatatgcattagtgctttagaagtgttcccaggatgaarcttgcatttttcctccaccagcgtttcgtcagaacacacatggtatccagatgacatccatcaagaaacgaagatccccagatgatgaactgttatacttaccagtaggtcttccttgggtgttcatggttgcttcattttaaccttctttgaatgggcttttacagtatgatcatcatctcattatctgtgacaatgggaaaggaggtgtcttagtcagttgaagctgctacaacaaactaccgtagactagatggcttataaacaacagaagtttattttctagagtctggaagtctg

SEQ ID NO: 190385 - DNA, 601 bp, Human
atgtgttgctggtactactgtctttttaatatgtatattaaatctgattaacattaatatttaattattaagtatatttaatatgcattagtgctttagaagtgttcccaggatgaaacttgcatttttcctccaccagcgtttcgtcagaacacacatggtatccagatgacatccatcaagaaacgaagatccccagatgatgaactgttatacttaccagtaggtcttccttgggtgttcatggttgcttcattttaaccttctttgaatgggcttttacagtatgatcatcatctcrttatctgtgacaatgggaaaggaggtgtcttagtcagttgaagctgctacaacaaactaccgtagactagatggcttataaacaacagaagtttattttctagagtctggaagtctgagatcaaggtgcccctatggtcgggttctggtgagagttctcttctgagttgcaaactgccattttctccttgtattctcatatagtggagagggctagagagctctctagggtgttttttttttttttataagggcaaaatcccatttatgaaggctccactctcattacctaaattacttc

SEQ ID NO: 190386 - DNA, 601 bp, Human
caaataaacgttagcaaataaacaaattgcaattacggaatcctcaaataatgaggattgaccacacttctaacagttctacagcttttcatgtttccttctttccttctgctcacttccataggtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagtgagtgtatcaacgtgtcattttaggaggcatgagtgasggtgactttatttggatcagcaatagggtgattgatgagcaatgtggaacataatgggagatagcagattgtcatagattcagatgacctggtatggcaaccctctttcagttgcaaccttttttacgtgtcttattataaccttcccttcagaattccacttatgttctgaaattaaatacaaaccatttctggtgaattacaaagaaactcacactaacagttctcgtctctatatgcctggtccatacacactaacagtaagtacacactctatttggtagtgatgtgtatatttga

SEQ ID NO: 190387 - DNA, 601 bp, Human
ctatatgcctggtccatacacactaacagtaagtacacactctatttggtagtgatgtgtatatttgaaaacatgaaatcttttctcatcccaatggattgtcttataaatctcctgggatgcacactatccacttttgggaataacactgtagaccagggatagcaaataggctttactataatataaagtgacttgtttgaatgctgtaatgagaagaattctgagacctagtgcatgataattggggaaatatctgggtgcagaaggataaggtagcatcatgttgccgtattttagmatctctgctctagattgtcttccagcagtacatttttggcataaatcaagccagatttttcaagtatattaccatatacatataacctatttatatgttaagctttgccttgaatcttggatctttcctaaagtgattttatgactgactagaatagaatagctcttatgaaaggatgagaggttgaccaatcaggaccttgtttatatttacctttctgtggttaaaaataatcacttgttagtttaattaaaatatgatatgtgtcctggaagtattgtcagagactctgtagataag

SEQ ID NO: 190388 - DNA, 601 bp, Human
cttataaatctcctgggatgcacactatccacttttgggaataacactgtagaccagggatagcaaataggctttactataatataaagtgacttgtttgaatgctgtaatgagaagaattctgagacctagtgcatgataattggggaaatatctgggtgcagaaggataaggtagcatcatgttgccgtattttagaatctctgctctagattgtcttccagcagtacatttttggcataaatcaagccagatttttcaagtatattaccatatacatataacctatttatatgttaasctttgccttgaatcttggatctttcctaaagtgattttatgactgactagaatagaatagctcttatgaaaggatgagaggttgaccaatcaggaccttgtttatatttacctttctgtggttaaaaataatcacttgttagtttaattaaaatatgatatgtgtcctggaagtattgtcagagactctgtagataagtgtaaaatatatacattatgagtccacttgagtaatgtagactttcaacttcatactttaggcaaaaaagaagtcaaaaactatcttccagaggcaaagatt

SEQ ID NO: 190389 - DNA, 601 bp, Human
ctttcctaaagtgattttatgactgactagaatagaatagctcttatgaaaggatgagaggttgaccaatcaggaccttgtttatatttacctttctgtggttaaaaataatcacttgttagtttaattaaaatatgatatgtgtcctggaagtattgtcagagactctgtagataagtgtaaaatatatacattatgagtccacttgagtaatgtagactttcaacttcatactttaggcaaaaaagaagtcaaaaactatcttccagaggcaaagattatattttacaatagaaatgcwaatgaacaataaaaatggttattttctatgttattagctgttgtagggagtcagctgtggaaagtgtaataaagagggcttatgattattattattattattgagtctcgctctgtcacccaggtaggagtgcagtggcactttcttggctcactgcaacctctgcctagcgggttcaagtgattctcctgcctcagcctcccgagtagctgggattagaggcacctgccaccatgcctggcagattttttgtattttttagtagagatggggtttcaccatgttagccaggctggtcgc

SEQ ID NO: 190390 - DNA, 601 bp, Human
aggtaggagtgcagtggcactttcttggctcactgcaacctctgcctagcgggttcaagtgattctcctgcctcagcctcccgagtagctgggattagaggcacctgccaccatgcctggcagattttttgtattttttagtagagatggggtttcaccatgttagccaggctggtcgcgaactcctgaactcaggtgatccacccacctcggcttcccagagtgctgggattacaggtgtgggccaccgtgccggccttgttattatgttttaatcaatatgaatgtatctctgatagtraagaaacactttctgagcacctgttatctacagagtggagtagacggcagggagaaaagaggcacattctctgttcaaaggactctaagctatttgagcatccaagatcctttttggcccgaagggatctcaccatttacttttagcataaaagttttgcaaattttaatggtatggttttatttgtaagcctgagcagaaagtttaatcacacagtgtattctgaaggagaattagaactcagagttgcagacacaatttccattgctaatcatatggatgttttgggatatcagatgg

SEQ ID NO: 190391 - DNA, 601 bp, Human
tattttcagtattatcaatgtagaaaagagaaaggtacacggtctccaaactgatagaaaatgtcaacaccgtatttctaggttagacagagaaatcctccacgtttccagaatatctgaaattgccagctttataggttaaaaagagatgaatattgataatttcatatgattcacccttatagttattatggaactacacaagcttttacagtttcctttttttttttttttttttttgagacagagtcttgctctgtcacccaggctagagtgcagtggcatgatctcggctcactgmaacatttgcctcctgggttcgaacaactctcctgcctcagcctcctgcgtagctgggattacagatgcctgccaccatgcccggctaatttttgtattttgatatatatatataattttttttttctttttttttttttttagtagagacgggatttcaccatgttggccaggctggtctcaaacccctgacgttgtgatccccccgaccttggcctcccacagtgctgggattacaggtgtgagccaccgcgcccagcctacagtttacttttgaatttcatagttatgaagttttcag

SEQ ID NO: 190392 - DNA, 601 bp, Human
tttttcttttctttctttcttccttttttttttttccagccaaaaaatggagatttataatggtcacaatgagccctttgggtagttggaaggatgaaatgggatcattcaagtagcatgtttagcacagtgcctggcctggcatctggttggttcaaaaccaatggcaactattgtaaatattgttacatagtaaccttgcagacagtgggttttcagaaaggtgatttcataccatcttacagaggcattttaaaaaaatctgtaaatgtggtgtctttcttcttttgaatttgagcarctcttttataataagaattttctgaatgttgtccatatgtgatgtggatcatggatgcttagctcgaaatgtaaaattgatgtttctcggtgatatgaatttcctactagtttttaggtcaaacctcaggcctgtgaactgccctgatctgagacatcctttattgacaaagagggtcttgaaatgggtgagaggcagaaagacaagaagacaaagttggaagttgcagctgtgttacagattattctaagccttctatccttgctctcttaggtcagtcgagcaaccttacatttttca

SEQ ID NO: 190393 - DNA, 601 bp, Human
ctgaatgttgtccatatgtgatgtggatcatggatgcttagctcgaaatgtaaaattgatgtttctcggtgatatgaatttcctactagtttttaggtcaaacctcaggcctgtgaactgccctgatctgagacatcctttattgacaaagagggtcttgaaatgggtgagaggcagaaagacaagaagacaaagttggaagttgcagctgtgttacagattattctaagccttctatccttgctctcttaggtcagtcgagcaaccttacatttttcatctagtatcagaaaacaaacamaattctcatatatttcttttggattgtacagagatgctgctaaatgcaaacctttctggacacaaacttgccttatttaaacacgaacacacagacattcacatgcccacactagtcttcctgtattattggtattttaaagttaaatggattccctcccacacccttaacccttctcatgacaattgattttattctgatgaacttcatgcaataatttactactatctactggctttgccatgcgtccttaaattgagtgtccagcatttgtagttggctgcctccttcacaggccat

SEQ ID NO: 190394 - DNA, 601 bp, Human
aattgatgtttctcggtgatatgaatttcctactagtttttaggtcaaacctcaggcctgtgaactgccctgatctgagacatcctttattgacaaagagggtcttgaaatgggtgagaggcagaaagacaagaagacaaagttggaagttgcagctgtgttacagattattctaagccttctatccttgctctcttaggtcagtcgagcaaccttacatttttcatctagtatcagaaaacaaacaaaattctcatatatttcttttggattgtacagagatgctgctaaatgcaaaccyttctggacacaaacttgccttatttaaacacgaacacacagacattcacatgcccacactagtcttcctgtattattggtattttaaagttaaatggattccctcccacacccttaacccttctcatgacaattgattttattctgatgaacttcatgcaataatttactactatctactggctttgccatgcgtccttaaattgagtgtccagcatttgtagttggctgcctccttcacaggccatagcatttgtatgcagtattggtaagtgcttgagaacagagtgtgatacatctt

SEQ ID NO: 190395 - DNA, 601 bp, Human
actagtttttaggtcaaacctcaggcctgtgaactgccctgatctgagacatcctttattgacaaagagggtcttgaaatgggtgagaggcagaaagacaagaagacaaagttggaagttgcagctgtgttacagattattctaagccttctatccttgctctcttaggtcagtcgagcaaccttacatttttcatctagtatcagaaaacaaacaaaattctcatatatttcttttggattgtacagagatgctgctaaatgcaaacctttctggacacaaacttgccttatttaaacaygaacacacagacattcacatgcccacactagtcttcctgtattattggtattttaaagttaaatggattccctcccacacccttaacccttctcatgacaattgattttattctgatgaacttcatgcaataatttactactatctactggctttgccatgcgtccttaaattgagtgtccagcatttgtagttggctgcctccttcacaggccatagcatttgtatgcagtattggtaagtgcttgagaacagagtgtgatacatcttgatggaagataagagcccagtggtgcccact

SEQ ID NO: 190396 - DNA, 601 bp, Human
cagattattctaagccttctatccttgctctcttaggtcagtcgagcaaccttacatttttcatctagtatcagaaaacaaacaaaattctcatatatttcttttggattgtacagagatgctgctaaatgcaaacctttctggacacaaacttgccttatttaaacacgaacacacagacattcacatgcccacactagtcttcctgtattattggtattttaaagttaaatggattccctcccacacccttaacccttctcatgacaattgattttattctgatgaacttcatgcaatratttactactatctactggctttgccatgcgtccttaaattgagtgtccagcatttgtagttggctgcctccttcacaggccatagcatttgtatgcagtattggtaagtgcttgagaacagagtgtgatacatcttgatggaagataagagcccagtggtgcccacttaagtacctcccgcaccaagcattagtaaaggatgggatcacctgcttctatcagcttgttccatgtacatgcattgtggtgagctggctgggatatgactgaatgtgtgcctgagagacaggggccttgtg

SEQ ID NO: 190397 - DNA, 601 bp, Human
agcagtttatttaatcatttgaagtttctgttttatccagttctaaaatggaaaaaaaaaatgcttactttaaaaatctgtataacgaataaattcaatagaataatgtcaagtacatgtagtgaataggtgctcattaaatgatatctcttcttagctagtctcaatttatttagaacataactggaatgagactcagagaaatgaaaagttgctagaggtcatgtgttagtatgtttcaactctgggaatacagttcacaccttttcatgtctagtttagggcatttcccatcacactytgtttcctcgccaatgagatatttaacaatttacttcagttataaagttgaccttatttgtctggttatttcaggatatcctttttgttgaaaagcaggtattttcttgcaaagagaacaatccttaagcacagttctgtagagtttagtggagccaactgtcataagagggtatttaaagcaatggtctctaagacaaccttcctactctcctgtgttggatgtaatacacctttgattcctaagagaaagggtactaactaagaagacataaagtacagaattatatcactcttttct

SEQ ID NO: 190398 - DNA, 601 bp, Human
ttataaagttgaccttatttgtctggttatttcaggatatcctttttgttgaaaagcaggtattttcttgcaaagagaacaatccttaagcacagttctgtagagtttagtggagccaactgtcataagagggtatttaaagcaatggtctctaagacaaccttcctactctcctgtgttggatgtaatacacctttgattcctaagagaaagggtactaactaagaagacataaagtacagaattatatcactcttttcttcctgttgtgagtggtttcttccctctgccatcctcatgmtagttcaaaggctgggaagaagattgaacaacaaatgttatgagtgtccatggcattattcaacttttttttttgacaattttgtgggtactgagtagagtagacagaataatgtgcaaaggtggcatttgcagaaagagaccactgcttcctggtggtgctgattacttgtctggagtttcactcctccttgtggaaagtgatggctggaggctcatgttggaagatgaagggatctgtttctggcccaggcagtggggctgttcatctgctgagacttctcataggccattagatttc

SEQ ID NO: 190399 - DNA, 601 bp, Human
aaaaagaaaatactcttattgttttattccctggagatgtatttttctgaacaaacaaagatgagcaagagaaatcagcatttcatcggcacatgtacttttgtcatttcatttaaacataaaaataactctcagatatatattattatttgccttttacaaatgaaagaactgaggctcagagagacttatagacttgcccaaggtttcctaattagtaaagattggaacctgcgtgtgcctgagtgcaaagccttttggtccactacagcatatttactagataccacaccatgaaatytggaaactcatataaccagattcgtaaatgccccatctctgtatcctcacatcacactacctcagcttctgtcttctcctcttcttctactctttcctttccaaacatactgctccaatcctttcttgattctctccagctcacaaaaccccttttaaatgcatataacatcttctatctctattgttattattattattttttttactgtggtcctggaatttgtaatttgtgcttttgtttttgttcatccccattgggcacaggacagaataagctatgccatcagctgagagactt

SEQ ID NO: 190400 - DNA, 601 bp, Human
tgagcaagagaaatcagcatttcatcggcacatgtacttttgtcatttcatttaaacataaaaataactctcagatatatattattatttgccttttacaaatgaaagaactgaggctcagagagacttatagacttgcccaaggtttcctaattagtaaagattggaacctgcgtgtgcctgagtgcaaagccttttggtccactacagcatatttactagataccacaccatgaaatttggaaactcatataaccagattcgtaaatgccccatctctgtatcctcacatcacactacytcagcttctgtcttctcctcttcttctactctttcctttccaaacatactgctccaatcctttcttgattctctccagctcacaaaaccccttttaaatgcatataacatcttctatctctattgttattattattattttttttactgtggtcctggaatttgtaatttgtgcttttgtttttgttcatccccattgggcacaggacagaataagctatgccatcagctgagagacttacaaatgtctctatctaatctgtgtgtcaatcatctttctatctagctctatttattagtg

SEQ ID NO: 190401 - DNA, 601 bp, Human
aaaccccttttaaatgcatataacatcttctatctctattgttattattattattttttttactgtggtcctggaatttgtaatttgtgcttttgtttttgttcatccccattgggcacaggacagaataagctatgccatcagctgagagacttacaaatgtctctatctaatctgtgtgtcaatcatctttctatctagctctatttattagtgaaattaaagaaagatagagcatattaagcccctggctcttaatagttggcacctagaagggacttggtaaatattcattccttcytcatcattcagcactgctgtttacccaaatcattactcatttaatgaatctcagatggagagggggagtatattgagtagatgccccagctggtctaagagaatgtgccacagtttggcaagcaattgggatggtaaaggataggaaatgaatgtgatatttaccttaaaatatctgctgaggatatggtttattctgccctgtgcctagcacagtgactcatacataagaagggcaaaattgaacggatgatgggttcatattatgtcagtgggcccaaaattgactttctggatttct

SEQ ID NO: 190402 - DNA, 601 bp, Human
ggcagcagattgaatgaatagagtagatcgtaagaagtaggctgagcttcggaatcaggctgggtttgaattctagatactgcatgcctagcctgtccagacttagttttctcacctgtaaaatggtaataaacatgcctgccttcctttgcttccttccttccttccttccttccttccttccttccttccttccttccttccttcctccctccctcccttcgttcctcttccttccttcctattatctatgtatctttctatgtatctatctatgtatctatgtatctatctatctattcatctatctatctatctatctatctctatttattaataaggttcaagtaagaaaaaatatattaagcctctagcttttaatagctggcacctagaaggcactcagtaaatattcattccttcctcttcattcagtgctgctgtttacccaaagcctctctcatttgatgaatctcagatggagagggggagtatatcaagtagatgccccagctggtctaagagaatgtgccacaatttggcaaacaattgggatggcaaaggataggaaatgaatgtaatatttaccttaaaatatctc

SEQ ID NO: 190403 - DNA, 601 bp, Human
gcagcagattgaatgaatagagtagatcgtaagaagtaggctgagcttcggaatcaggctgggtttgaattctagatactgcatgcctagcctgtccagacttagttttctcacctgtaaaatggtaataaacatgcctgccttcctttgcttccttccttccttccttccttccttccttccttccttccttccttccttccttcctccctccctcccttcgttcctcttccttccttcctattatctatgtatctttctatgtatctatctatgtatctatgtatctatctatctatctatctatctatctatctatctatctctatttattaataaggttcaagtaagaaaaaatatattaagcctctagcttttaatagctggcacctagaaggcactcagtaaatattcattccttcctcttcattcagtgctgctgtttacccaaagcctctctcatttgatgaatctcagatggagagggggagtatatcaagtagatgccccagctggtctaagagaatgtgccacaatttggcaaacaattgggatggcaaaggataggaaatgaatgtaatatttaccttaaaatatctca

SEQ ID NO: 190404 - DNA, 601 bp, Human
gatcgtaagaagtaggctgagcttcggaatcaggctgggtttgaattctagatactgcatgcctagcctgtccagacttagttttctcacctgtaaaatggtaataaacatgcctgccttcctttgcttccttccttccttccttccttccttccttccttccttccttccttccttccttcctccctccctcccttcgttcctcttccttccttcctattatctatgtatctttctatgtatctatctatgtatctatgtatctatctatctatccatctatctatctatctatctatctctatttattaataaggttcaagtaagaaaaaatatattaagcctctagcttttaatagctggcacctagaaggcactcagtaaatattcattccttcctcttcattcagtgctgctgtttacccaaagcctctctcatttgatgaatctcagatggagagggggagtatatcaagtagatgccccagctggtctaagagaatgtgccacaatttggcaaacaattgggatggcaaaggataggaaatgaatgtaatatttaccttaaaatatctcagaatctttcatgtgtaggaggaat

SEQ ID NO: 190405 - DNA, 601 bp, Human
tacacatgcatatgtctttataatagaataatttatattcctttgggtgtatacccagtaatgagattgctgggttgagtggtatttctttttgtaggtctttgaggaattgccacactgtcttccacaatggttgaactgatttgtactcccagcaacagtgtatagtgttcctttttctctgcaaccttgccagcatctgttattttctgactttttaatagtagccattctgactggtgtgagatggtatctcgttgtagttttgatttgaatttctctaatgattagtgatgttttrttcatatgcttgctggtttcatgtatgtctttggaaagggtctgttcatgtcctttgctcattttttctaaataggttgttttttcttgtaaatttgtttaggttccttctagatgctggatattagacctttgtcagaagcatagtttgcaaaatttttctcccattctgtaggttttctctttgctctgttgatcatttcttttgttgtgcacaagctctttaattagatcctatttgtcaatatttgcttttgttgcaactgcttttcgtgtcttcattatgaaaaatctttgccca

SEQ ID NO: 190406 - DNA, 601 bp, Human
atttcttttgttgtgcacaagctctttaattagatcctatttgtcaatatttgcttttgttgcaactgcttttcgtgtcttcattatgaaaaatctttgcccattcctatgtccagaatggcactgcctaggttgtcttccagggttttaagtctttaatccatcctgagttaatttttacgtatgatgtaaggaaggggttcaatttcaatcttcttcatatggctagccagttaccccagcattatttattgaataggaaatcctttcctcatttcttattttttatttcacctccagyagattataaagtccacaaggacagggacacttgatttgcttattgctgtatcccaagtgcctagaatagtttctagcaaatagcaaatggccaataaggaggcaatgatacataaataagtatatggatagatgttagtgtgattatttgtccccaagaagtagaaagagatagaaccggataagacagtaaattatacatgtaatattcaaataaaatttgacatacatatatgcgcatatacacacatatatatacacatttacacacatacatatacatatgtatatataagtgtat

SEQ ID NO: 190407 - DNA, 601 bp, Human
ctgcctaggttgtcttccagggttttaagtctttaatccatcctgagttaatttttacgtatgatgtaaggaaggggttcaatttcaatcttcttcatatggctagccagttaccccagcattatttattgaataggaaatcctttcctcatttcttattttttatttcacctccagtagattataaagtccacaaggacagggacacttgatttgcttattgctgtatcccaagtgcctagaatagtttctagcaaatagcaaatggccaataaggaggcaatgatacataaataagtayatggatagatgttagtgtgattatttgtccccaagaagtagaaagagatagaaccggataagacagtaaattatacatgtaatattcaaataaaatttgacatacatatatgcgcatatacacacatatatatacacatttacacacatacatatacatatgtatatataagtgtatgtgtgtatttttggagtgttgagtatatatttaaatattgaagtaataatttatgtctatgtacatatatatgtgtgtacatgtatatatgtgtatgtaaaaataagtgtctatttatctata

SEQ ID NO: 190408 - DNA, 601 bp, Human
tgtgcaatgtgctttcaagtacactgcctattcagtttatttagcagtgatgaacgcttacagaaaccatcaagctatgttttgaaagttagttgattcaaaacaatagagtttagtggtcagccaaacagaagcaaggagatttgctagttttgcatatgtgtgtgacttagtttccctattatccacgtgttaaacataagttctttgtacagctctattcctggccaacaattagtgctattttttttctctcgggttttagaagatctacctcctccaaacaacagcaattaactaygacttataactcactctcagctccccaccagggccacttacattcacatttctgatcacaatatttcttaaggtaaatcttcagttctctgagaatgctgaacaatgagtgtcttctagctcaagttacagtttgtaatgaccaattttgtaattgtggaacagccacaaacacggtggcataagattcatgtatcctggcttaatagctcagattatttccaaaaacccactgacgttggatcaatcatgctacctttgtccttttgtttttctgtctattaagtgctgtgtttggccc

SEQ ID NO: 190409 - DNA, 601 bp, Human
ccacacagcattgactcagatctattcctttacatgcaggcagctgtacgaaaacctatgcactcttatagcctcatctggtttcctttgtcaagatattacattatgaaacattttgggaaattagcagcttttgacagtaaatacgaatgatttgtgattccactaagccactgcttaattttaggctgctgaatggtgaacactttaaggagcgtgggaacaggccatattttgttttgatcttacacagtctcatttgaaggaaggttatccatttgaagatgggctataatttacmgaaaggcaattatattgaagactaataatgagcatttagtaatacatatcaaaatgtagaatatgaataacttcagaatttcaagatcttttattctacataattaatttttacagctgaaatgtgcctatctttttggcgatcagataccccctgccctccaaaatacagggttaaatctacataagacgtatacgatttctccatggcatatcattctaggcctgttttctgtaattccttgcctactcacctgcaggttatattctagtcttactagatttcttgttttcctctaaa

SEQ ID NO: 190410 - DNA, 601 bp, Human
tttctgagtttgacattcagctgacttttgtctttggccttgtggtaacaaattatacgcctccaagttggaatctgatttgacaattcattagcatttctttaatttgtatttttattgtaataaaattgaccattttaaccatttttaagtctactgttttgtggagttaagtacattttcattgtgcaactattgccaccattcatccccagaatttttcacattttgtactcaaactgtagcctttaaacattaacttctgagtctgtcctcccctcagcccctggcaacaaccatyattatcactttaaccaacctattcgaaatgcccatgaaatttcaatatcctgtctctggatgagaagtggagaattgtgtttgcccaggattttaaagataaagatgttttcttgggaaactgactgagaaaaacaactttaaaaccttgaatgtggtgcacccatttatacaagtgatgccacactaattataaataacttaagtctgtgcagttccccagaaatgtctcattcgtgccacttcattactttcaaactgataataaaataccctcctagtgaaatatttttttgcatgt

SEQ ID NO: 190411 - DNA, 601 bp, Human
gaattactaaagtcaattagatttgagaaacactgtatattattactaagtaattgagtttcacaacatgcattagcatcctgaaaggccctgaaagaagtcctgtgggaaaagataacttttgaacctctttcacctaatattaataacctaatgtttctctaaactgagggtgaattactaaagcatagcctttcaaaatcattctgtaaaagcctaagctgaacaatgtggttcaatatgtggccttcagagggtctaagataatttaagaatgaaatttaaaatatcaggagactcraattaagtaggtacatttattaggactctgcattgtatccatcctctatttacctaccaggatttacgtgaatattttttcatagcctggagatcctttcaaaccctgtctgtgttaacagagctgctacatctgatattattttccggaatctgaagaaacaccaaagaggactgaaataataagacattaatttcagctgtagaatgccgatgttgctgaccctgcagggttattgcagagggagattaattatgcatatctgccaccctaggctttggagttgaagtaccctgctgt

SEQ ID NO: 190412 - DNA, 601 bp, Human
ttctcctatagactgagaatacctgaaggtaaaggctgcactgaagcccctgtgctttctcccaggtggcgaagtgttggcctggtgcactgtaagtctgctgtgaatgttctaatttaactcttgactttaactcttcctaataaaactagttgtggaaactgaggcatagggacaatgaaatatgtggccaatgttatagcacttgttaatgccagagtcagaactaggagagggctcgtcctgcccatctctctgtgtaatggagaatgaggagcccctgggtgttgcagggtctgawggagtaaggggggcctctccgaggcttctgggcacctgaacaggaggggaactgaggccctcttctgctggatgctttctattgagccaatcatttttctgaaagaattgggggaatgatactaggaagtgctctgtgaagggacaactgactgttttgtgaggccaaggatgccttggatccattcaagtctaatttctgaagacaggttcatttcagaggcagtggatcttgatggctgtcacagaacttacggtggcatctgtttgaaccaaccttttgagaatattccattcttag

SEQ ID NO: 190413 - DNA, 601 bp, Human
gtgaacactacagctctttgagtcctgtacatttttcttttattccactgttacaatctccaaagttatcaaaaacctgtatttaagagcccctgtcaaagttctatagctcattataaacaatcttttgaaaaggattaaaacaagtcaacaattgtctgtgaataacaaaatgtccagggtagttacagttagaaacacaattgacaaagtttggttatctctgtggtttacaataacttaatataacaagcttgttatgattgatagcatatactcagatattagaattttagaaatyccatacaattttggaacatatattagcattattcaccaaaatatttcctaaagaagattgaacatcattttggcaatccaacgtacctaaacatgttaaataatcctgtttacctctcttttctggacactccaggggccctttgaagtatccaaaaagccaggtgtcaggaaagacaattttgtaactaaagtttgattttgggaagcctgataagtatgtaagaagtttaaaacatttgatgttctgaaatagaattccagattatgataaattattttacaaaaatgatgactcagg

SEQ ID NO: 190414 - DNA, 601 bp, Human
actcatttcctaagccaggattgaatcccggccataggtaagctaaacaaagccttgccatgtggttacatgccacgcccccgaggacgtacaacaagatggaggcccgcaaggaagtattttacagaccatacagaaagactgcaaagcacaccagactggctacaacttaagaccagcctcacaaatcctttttcataattaaaactttacagagaatataaacattgatccttatcattcctagcctagtaaaatgtcttctaaaaggaaaacacaaacaaaaaataaataaacaacmaccacgcttaaaagtcaactcctgacctgatggagaaaaggaaagaaaaaaattttttttaatgcctgggaagaacctcttattcttatgcaaatgcgttcctccaccggggagagaaacttaattgctctccaatggggttgaaccccttggccaagggaggtgaagaggccatggatgcatagcattccccagccccagccgggatgggacggggaacggggagctgccgtttgcccgtccatccggaaaaaagaaggaaaaggccaaggaaaggctgggttggactgaggccgtctt

SEQ ID NO: 190415 - DNA, 601 bp, Human
agagaatataaacattgatccttatcattcctagcctagtaaaatgtcttctaaaaggaaaacacaaacaaaaaataaataaacaaccaccacgcttaaaagtcaactcctgacctgatggagaaaaggaaagaaaaaaattttttttaatgcctgggaagaacctcttattcttatgcaaatgcgttcctccaccggggagagaaacttaattgctctccaatggggttgaaccccttggccaagggaggtgaagaggccatggatgcatagcattccccagccccagccgggatgggasggggaacggggagctgccgtttgcccgtccatccggaaaaaagaaggaaaaggccaaggaaaggctgggttggactgaggccgtcttttctgacccctgagcgtgacagtggtgggggcacagtttcctctagcctcagaagtctgaggttgagaaggtttagaaatgagagggaaaggccgggcgcggtggctcacgcctgtaatcccagcactttgggaggccgaggcgggcggatcacgaggtcaggagatcgagaccatcccggctaaaaacggtgaaaccccgcctctactaaaa

SEQ ID NO: 190416 - DNA, 601 bp, Human
ttcttatgcaaatgcgttcctccaccggggagagaaacttaattgctctccaatggggttgaaccccttggccaagggaggtgaagaggccatggatgcatagcattccccagccccagccgggatgggacggggaacggggagctgccgtttgcccgtccatccggaaaaaagaaggaaaaggccaaggaaaggctgggttggactgaggccgtcttttctgacccctgagcgtgacagtggtgggggcacagtttcctctagcctcagaagtctgaggttgagaaggtttagaaatgasagggaaaggccgggcgcggtggctcacgcctgtaatcccagcactttgggaggccgaggcgggcggatcacgaggtcaggagatcgagaccatcccggctaaaaacggtgaaaccccgcctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaa

SEQ ID NO: 190417 - DNA, 601 bp, Human
ctagcaggcttcccgcctcacagattgaaaccctggttactacccaggaacaggagaggcaggctcctcccccctgcaaatggtgcaaactttcatggctccaccccgttcaaccagtgtgcagaccagccggaggttctcctggggaccctttatatttggctgtctcaaaataactttgcttaatgttgtgttaagccaagcggaccacagtattcactgggcagattactccaaacctttaaaatgccagtgtgtattgtgaatctccaagagatacgtgatatgttacttttcaaayttattttttggccatgcagtccttttgcagattgctcagcacaggacatgataattttcatctcggattttggaggaattgtatcctttttggccatttgctttcttgttgtttagtgtgtgtgtgtgtgtgtgtgtgtgtgtgtgtgtctctaactttgctccctacctgtgagatccctgattaaataaatgaacagtgtgtttatttctatatattgcacaacttctattaaagtgtataaagtaggggcttaataaatacattgatttgaatcaaatttgatgctgtagattcaga

SEQ ID NO: 190418 - DNA, 601 bp, Human; identical to SEQ ID NO: 24200

SEQ ID NO: 190419 - DNA, 601 bp, Human; identical to SEQ ID NO: 24201

SEQ ID NO: 190420 - DNA, 601 bp, Human; identical to SEQ ID NO: 24202

SEQ ID NO: 190421 - DNA, 601 bp, Human; identical to SEQ ID NO: 24203

SEQ ID NO: 190422 - DNA, 601 bp, Human; identical to SEQ ID NO: 24204

SEQ ID NO: 190423 - DNA, 601 bp, Human; identical to SEQ ID NO: 24205

SEQ ID NO: 190424 - DNA, 601 bp, Human; identical to SEQ ID NO: 24206

SEQ ID NO: 190425 - DNA, 601 bp, Human
cagctaagacctttatagagtttgaaaaccaaactcagtcatcatgggcctggatcacgtgaaattagatatggaagagacttgctatttgaaagtccatcttttcagatctcctcttcttcccagaattatgcccagaatcactctctatctctgactattaatcattacatttcagcctatgtttttggactaatcaaattcttagaaagtttttagtacataaaactgaaatttgtctctttgattttagtatctaaaactgaaatttgtctctttccaaacatttacttggttcaastgtaggactgaaaaaaaaaaaagaaacaaacaaacaaacaaacaaaacaaccaaaacctaatgcaatggttctctaattgtaatgaagggaacctagaggtcctcattttataaagcttttcatgtaaaattcccctgaacaccataaaccatactttacatatcgttgctttaattccttttctttgtgagagggcttctgcaatgttaagttagctaccatataaccatgacctcagtgttctgcaatatatgccttcaactgtttttcatatgacatggatttgagctctcctacca

SEQ ID NO: 190426 - DNA, 601 bp, Human
gatgcgctaggagacagctccttggctgtttagtccagcatctgtcctgcttggttaggtgtcgcgtttgataggtgagtttcttgatgtcctgattttcaaatatgttaaatataattcttgattttagtttgttcttatttgatttagttctatgtttgaatgctatctgctcacagaggcttccttgaccatcttaactaaaaatccctaccagtcactctctctccctccatcctgttttagttttctttgtaacactcacattccctgatattatattagccttctttctcttctytcctcctcctccctcttcctcttctcttgtttcctcctccttttccttcctttttttcttcctgaactccctgtccttcctccttttctgcctcccttctttcctttctctccatctctttttcttcctccttccctccctctgtcttggattttaagctgcctgagggcaggaacttgttcaggaacttttgtttgttatccaaacactcagaataatactgacacatagacacatagcagatgctcaatacataggtgttaaatggttgaatacatgtccctttacatcctttcccct

SEQ ID NO: 190427 - DNA, 601 bp, Human
tacacgcttatcctgccccctcacagcactgaaacattttcttcaggaggaaaatgattgtaatacaaaattcaaacccaatattcctttttttgcttattatagtattaaatattttcactaataaactcgaagaagttctgtttgtaagacttcgaaatggaaacttcagctcaatacacgtctcttttgctgtgcctcattggcagtgtgtcaggaagctgaactgttaaaagctgcctttggagtagacataaattttggaacctgtgatcccaagttgaggaggtaataaaaatarcaccatatagaatatagtgaatttaaaaaatattaccatatcaaaattatttgctggacaaatcacatgaaaaagagagtacactgccaccccaaaatgcaggcacacacacggatctttgagaaagattttatttcaaagtcaacagttgactgtgtgccaggtgcagggctggatttcacacacattatcaggaacttcgcaggaaccattgtacaggggtaggggctggagactcttctacctgtttgatagtttaggaaatgaagatccagggaggtggcccaagtgctcatgata

SEQ ID NO: 190428 - DNA, 601 bp, Human
atcccagtcaattccagtttcttgatttttatgaaggaacactatgcatcatggacacacacagggtatactcctattagctacttaaattctttctaataacaatgttaacaatgatttcactttattctaaagatcatgcgtttgaccattttagattgtagaatccagggttagtaagaggaatttcttattttaagaggaatacagtaaagtttgagagaaggaagaggaaataattaccaaatagaattccgtgagagcagagaaagttaccaatcctatcaggagatattggggragacttaatcattgctccttcctaggaagaaacgcatctcttatttgggaatgaaatagttcagggcaactcaaaagatagtgcaaaggcatttagaagccaagctggaaaggtaggttgggaacaaattatgcaggacgggaattacttcaggtaaagagaatgtccacatttaatgtattttggttatagttggctaggtttcttttcctttttttaaattctgtcgtatttttgcaaggacatacactattattaattctatgtgatggttctttcaccttttggtaagaattcagt

SEQ ID NO: 190429 - DNA, 601 bp, Human
cttaaattctttctaataacaatgttaacaatgatttcactttattctaaagatcatgcgtttgaccattttagattgtagaatccagggttagtaagaggaatttcttattttaagaggaatacagtaaagtttgagagaaggaagaggaaataattaccaaatagaattccgtgagagcagagaaagttaccaatcctatcaggagatattggggaagacttaatcattgctccttcctaggaagaaacgcatctcttatttgggaatgaaatagttcagggcaactcaaaagatagtrcaaaggcatttagaagccaagctggaaaggtaggttgggaacaaattatgcaggacgggaattacttcaggtaaagagaatgtccacatttaatgtattttggttatagttggctaggtttcttttcctttttttaaattctgtcgtatttttgcaaggacatacactattattaattctatgtgatggttctttcaccttttggtaagaattcagtttgttaccagccccagtggcctcattttatttgaatatccttgctttaataactccgtgctcagatatacttgtgacattgtg

SEQ ID NO: 190430 - DNA, 601 bp, Human
gttcagggcaactcaaaagatagtgcaaaggcatttagaagccaagctggaaaggtaggttgggaacaaattatgcaggacgggaattacttcaggtaaagagaatgtccacatttaatgtattttggttatagttggctaggtttcttttcctttttttaaattctgtcgtatttttgcaaggacatacactattattaattctatgtgatggttctttcaccttttggtaagaattcagtttgttaccagccccagtggcctcattttatttgaatatccttgctttaataactccgtrctcagatatacttgtgacattgtgtcctgtcccagttgcccatggctggtcatcctgaacactcttcatttctatgtaatttagtccaaacatttggaaaatgtatgaagaatactgtttcattttattcttagtcctaaaggtcattggaattacagaatttcaccctgttgtcatttaaatgatgcctctcggaagcagatctcttcacttttttttttttctttagctgtgtttatagcttgaagcacacttatattttagttacttatatttcccaagggtggatttactgtagcc

SEQ ID NO: 190431 - DNA, 601 bp, Human
aattacttcaggtaaagagaatgtccacatttaatgtattttggttatagttggctaggtttcttttcctttttttaaattctgtcgtatttttgcaaggacatacactattattaattctatgtgatggttctttcaccttttggtaagaattcagtttgttaccagccccagtggcctcattttatttgaatatccttgctttaataactccgtgctcagatatacttgtgacattgtgtcctgtcccagttgcccatggctggtcatcctgaacactcttcatttctatgtaatttartccaaacatttggaaaatgtatgaagaatactgtttcattttattcttagtcctaaaggtcattggaattacagaatttcaccctgttgtcatttaaatgatgcctctcggaagcagatctcttcacttttttttttttctttagctgtgtttatagcttgaagcacacttatattttagttacttatatttcccaagggtggatttactgtagcctgattgaaaagaaatttaagtaccacataattggcttgatactgagtttgcaaatacacagcttcttgtatcacagtgataatt

SEQ ID NO: 190432 - DNA, 601 bp, Human
cctataaaagctgatgtacaaaattttctggctttgcctttgcgtgttttagagatagtgggaataatgaaaatgcaagatgactacgacaatgagagaaaataaataaaataatcacttcctcagcaacctagaccatattctgttgtgttttatgacattcatttctccttctaccataggaaccaaaatgcttggtatagctatacattactgggaaataaatagcacttttctgcagtgtttgtagggtctgaaatagtttaaggctcttatccatcagcccatttttttttacttytgagatactttcatatttatttatttatttatttatttattttttgagacggagcttcgctcttgttgccaggctggagtgcaatggtgcgatctcagctcacctcaacctccacctcccaagttcaagtgattctcctgcctcagcctccctagtagctgggattacaggcatttgccaccatgcccaactaattctgtatttttttgtagagatggggtttctccatgttggtcgggttggtctggaactcctgacctcaggtgatctgcctgcctcagcctcccaaagtgctggaat

SEQ ID NO: 190433 - DNA, 601 bp, Human
gaaataaatagcacttttctgcagtgtttgtagggtctgaaatagtttaaggctcttatccatcagcccatttttttttacttctgagatactttcatatttatttatttatttatttatttattttttgagacggagcttcgctcttgttgccaggctggagtgcaatggtgcgatctcagctcacctcaacctccacctcccaagttcaagtgattctcctgcctcagcctccctagtagctgggattacaggcatttgccaccatgcccaactaattctgtatttttttgtagagatrgggtttctccatgttggtcgggttggtctggaactcctgacctcaggtgatctgcctgcctcagcctcccaaagtgctggaatggcaggctactttcatattttttttaaagtgctctttaaggtttatagtagtgttcattttgatatgtgcaccaagatactggtgtttgcgtttcccccttcccttatgtaagaaaatgttatggtctctttgagatttggacttgccacccagtgctaccaagactgaccaatttagtctatttgccaattacgtttcctcagtggaaccttctcc

SEQ ID NO: 190434 - DNA, 601 bp, Human
ctgcacaaaataataagaccctgactccacaaaaaaaaaattaaaaaaatagctgagtatggtgatgcacacctgtagtcccagctaatcaggaggctgaggtgggaggatcacttgagactggccggtaaaggctaaaatgagctgtgatcacgccactgcactccagcctgggcgacagaacaagaccctgtctctctctttctcaaaaaaaagtacaactatagttgaaatatagacctttattattattactagatgagagattaaattgtatttatcatatgtaaaatgacatttygaagtatttatacattgtggaatgactaaatctagctaattaacatatgtattacctaacatagttaccatttttggagtgagaagactttagattcactgttatcactttaaagcaagcttgtccaacccgtggcccgcgggccacatgaagcccaaaacggccttgaatatggcccaacacaaattttgaaactttcttaaaacattatggactttttgtgattttcatttttagatcatcagttattgttagtgttagcttattttatgtgtggcccaagacaattcttcttcttcc

SEQ ID NO: 190435 - DNA, 601 bp, Human
attgcttaatggactgatgtttgatttttagagtgaaaacattaattttattcttatattttcaatgttttttgaatttttaaatttatctggtcatctagagaaaactgaatttcttatatgacagatattttgacattcacagcttgattctacatgtctttttgtcattttctggtgtccactcaaggtaaaggcaaataagaaaaaagagaagaaggagagaaaagaggaataatgagggagagaggaagagagagagagacctttttttgaaaaagagagatagtaggaaaaagasagagagaggcataaaatgcaaagagaaaaatagagataaaatattcctacacgggtttcctggatctgatgtaaacccggctatatacttttttcagattaccaaagaagctaaaccatttttaataccacatttaaatactcccccctttttttcctgagctttgcattgaatggtttcctttttgaacagttaatgttttctaggtttttttgtttgtttattttacattcttactctttccctccttccgagtatattaaaatggtgagagaaaatagaaaccttaaatattccaga

SEQ ID NO: 190436 - DNA, 601 bp, Human
ttttgctagtagcagtgtatttcttgaggcacagtagaaacccaaccaatctatattcaagtctaagaggagggtgtagctttacttggaggttgattgaaatcatggaaattgtgaatggagtaattagtaatcggaagtgttggaggactttctccctcccgctgcatgcagtattcttagtgaaatgctaaggggaatttcaggaagaaagtgaagacggggttggttgttttattaaggcaaacttttagctctctcacctttattactctaaatatcctgttcttaaaaaggattmttcctctcatttataatgcagtaataattgatgactacaataatagccatgaagcattttacagtattgggtttttaatcactaaaagaagaccatgttaagctaaacatggctttaaatctattttattttaattctctgtaaattgataattactatatagtggtgggtaggtatgtaataggaaggaaggtgaggaaactcacattctttgaatcaaggattatattcatataatattatattcatttctgaaaagcctcataattcagaaatacatgttttcttccatcgttacaa

SEQ ID NO: 190437 - DNA, 601 bp, Human
gtgggtaggtatgtaataggaaggaaggtgaggaaactcacattctttgaatcaaggattatattcatataatattatattcatttctgaaaagcctcataattcagaaatacatgttttcttccatcgttacaagtgagggactccaaattcaaaaaattgaatgaacttacctaatatcactatagaagtaagtggtaaaatttgtattgctctttgactttaagatgcactgtcatttaaaatacaccatgctgccactgagttatttataattaaaacttcattttaaaacatgccraccaaatctgtcaataattgatgatacggaacacacatatttgaaaagaaacgtttaaccagttaccaaaacagaatctagtatgtgatttttcgtgttgcaaataaaatttcaagatgatttgcttcagtcttcctgaaacatatacagtacattttaattgtgtatatttagataatatacatctttccaagtttatacaaattttctcaaaggaaagcagttctatacaggaagaagattgcagatgaatgaaggaaaggtggcttggtacaggtgcagtgggtttgagtgcagtgg

SEQ ID NO: 190438 - DNA, 601 bp, Human
tttcttccatcgttacaagtgagggactccaaattcaaaaaattgaatgaacttacctaatatcactatagaagtaagtggtaaaatttgtattgctctttgactttaagatgcactgtcatttaaaatacaccatgctgccactgagttatttataattaaaacttcattttaaaacatgccaaccaaatctgtcaataattgatgatacggaacacacatatttgaaaagaaacgtttaaccagttaccaaaacagaatctagtatgtgatttttcgtgttgcaaataaaatttcaagrtgatttgcttcagtcttcctgaaacatatacagtacattttaattgtgtatatttagataatatacatctttccaagtttatacaaattttctcaaaggaaagcagttctatacaggaagaagattgcagatgaatgaaggaaaggtggcttggtacaggtgcagtgggtttgagtgcagtgggaagctgttaactttagtattctgcaaggttgctttggcattattcatatggcttcccctgtggctaactcagagatactaactctaactccctagcttttgctccttttccaatga

SEQ ID NO: 190439 - DNA, 601 bp, Human
aagatgaagacattgtgcgtgtattcattcattcattcatctgtagtgtgtatgtgctggacactgtgcttgcctgtattggtaaccaaaacaaaaattatctttgccctcatgaaattcacagtcttggggatggcttcaagtcttttcttacttgaagaacgtaagtaaacaaatttttataagaagttctctatagttataaataaggcattatattgatggaaagtaatgggatattcctttccttatcccatagttaaggaaaatctattaaagaatatgctatttaattgagaaytgagggatgagaaagagccaccttcaaaggcagtggcatgagatgtaggccttgggttgcaggagctttgagaactatggggaaagaaacatgcgacgaagaggaagccgtggtcagagtgcagcacatactgagggtgttgttacatttacttgaactgcagtaaaaggccattgaaaggatttgggcaggactgttacattatccagctaaggtattaaatgatcttgtgagctgctatgtaggaataagattggaaaagatttctgtttttcccagtatggcggacaaggtcctcta

SEQ ID NO: 190440 - DNA, 601 bp, Human
taagaagttctctatagttataaataaggcattatattgatggaaagtaatgggatattcctttccttatcccatagttaaggaaaatctattaaagaatatgctatttaattgagaattgagggatgagaaagagccaccttcaaaggcagtggcatgagatgtaggccttgggttgcaggagctttgagaactatggggaaagaaacatgcgacgaagaggaagccgtggtcagagtgcagcacatactgagggtgttgttacatttacttgaactgcagtaaaaggccattgaaaggrtttgggcaggactgttacattatccagctaaggtattaaatgatcttgtgagctgctatgtaggaataagattggaaaagatttctgtttttcccagtatggcggacaaggtcctctaaacaccccttttgctgtaaagcagctagaaatgctgcatttaaaaataaatgtcatttaaaatgaattgctgagttggtaagaaatccttagaggccaaaattgaagtgaaaacaggaatccagaaaagaaaggaagccagctctgcagctggcggctacccagggtaacatccagagtcag

SEQ ID NO: 190441 - DNA, 601 bp, Human
tgggatattcctttccttatcccatagttaaggaaaatctattaaagaatatgctatttaattgagaattgagggatgagaaagagccaccttcaaaggcagtggcatgagatgtaggccttgggttgcaggagctttgagaactatggggaaagaaacatgcgacgaagaggaagccgtggtcagagtgcagcacatactgagggtgttgttacatttacttgaactgcagtaaaaggccattgaaaggatttgggcaggactgttacattatccagctaaggtattaaatgatcttgtragctgctatgtaggaataagattggaaaagatttctgtttttcccagtatggcggacaaggtcctctaaacaccccttttgctgtaaagcagctagaaatgctgcatttaaaaataaatgtcatttaaaatgaattgctgagttggtaagaaatccttagaggccaaaattgaagtgaaaacaggaatccagaaaagaaaggaagccagctctgcagctggcggctacccagggtaacatccagagtcagaggaaggagatatatttaaatgcgaggacatttggataatttttagaaaa

SEQ ID NO: 190442 - DNA, 601 bp, Human
ctatgtaggaataagattggaaaagatttctgtttttcccagtatggcggacaaggtcctctaaacaccccttttgctgtaaagcagctagaaatgctgcatttaaaaataaatgtcatttaaaatgaattgctgagttggtaagaaatccttagaggccaaaattgaagtgaaaacaggaatccagaaaagaaaggaagccagctctgcagctggcggctacccagggtaacatccagagtcagaggaaggagatatatttaaatgcgaggacatttggataatttttagaaaaaaaaaatagttaaattcctaccttgtactttacctcaaaacaaatcgcagttgaattaaatatttaaatgtaaaaaaccctaagagtagtagaaaaaatacatgcaaatatttattataatgttgggatggatacatttgtagatatgtcatcaaaggtaagggtcagcaaagaaagtctgacataattgactacataaagattttaaaaattagtatagcacagaatattgtaagttaaaggacaaatgaaaaattgggaaaacatatggcaaagggttaatgtcatcagaatgcaaggagctat

SEQ ID NO: 190443 - DNA, 601 bp, Human
taaaaataaatgtcatttaaaatgaattgctgagttggtaagaaatccttagaggccaaaattgaagtgaaaacaggaatccagaaaagaaaggaagccagctctgcagctggcggctacccagggtaacatccagagtcagaggaaggagatatatttaaatgcgaggacatttggataatttttagaaaaaaaaaatagttaaattcctaccttgtactttacctcaaaacaaatcgcagttgaattaaatatttaaatgtaaaaaaccctaagagtagtagaaaaaatacatgcaaayatttattataatgttgggatggatacatttgtagatatgtcatcaaaggtaagggtcagcaaagaaagtctgacataattgactacataaagattttaaaaattagtatagcacagaatattgtaagttaaaggacaaatgaaaaattgggaaaacatatggcaaagggttaatgtcatcagaatgcaaggagctattatatatatatacacacacacacacgcacattttaatggaaaaattggcaaagatttgaaactagcagttcaggcagtcaaaaacagatcaacacaaattgat

SEQ ID NO: 190444 - DNA, 601 bp, Human
agaaaaaaaaaatagttaaattcctaccttgtactttacctcaaaacaaatcgcagttgaattaaatatttaaatgtaaaaaaccctaagagtagtagaaaaaatacatgcaaatatttattataatgttgggatggatacatttgtagatatgtcatcaaaggtaagggtcagcaaagaaagtctgacataattgactacataaagattttaaaaattagtatagcacagaatattgtaagttaaaggacaaatgaaaaattgggaaaacatatggcaaagggttaatgtcatcagaatrcaaggagctattatatatatatacacacacacacacgcacattttaatggaaaaattggcaaagatttgaaactagcagttcaggcagtcaaaaacagatcaacacaaattgatcagtctaaaaagaagctcaagttaacgagtgacaaaatagattcaaactaaaccaacatgcgatgccattttttttcactcatcagtctggcagagattaaagaacaatccagcctagcattggtcaggatatggtgatctaataaccaggtatgctggtctctcacacacagtggttgagagctc

SEQ ID NO: 190445 - DNA, 601 bp, Human
tacctcaaaacaaatcgcagttgaattaaatatttaaatgtaaaaaaccctaagagtagtagaaaaaatacatgcaaatatttattataatgttgggatggatacatttgtagatatgtcatcaaaggtaagggtcagcaaagaaagtctgacataattgactacataaagattttaaaaattagtatagcacagaatattgtaagttaaaggacaaatgaaaaattgggaaaacatatggcaaagggttaatgtcatcagaatgcaaggagctattatatatatatacacacacacacacgcacattttaatggaaaaattggcaaagatttgaaactagcagttcaggcagtcaaaaacagatcaacacaaattgatcagtctaaaaagaagctcaagttaacgagtgacaaaatagattcaaactaaaccaacatgcgatgccattttttttcactcatcagtctggcagagattaaagaacaatccagcctagcattggtcaggatatggtgatctaataaccaggtatgctggtctctcacacacagtggttgagagctcacctggaataggctttgtggaggggacctgggctat

SEQ ID NO: 190446 - DNA, 601 bp, Human
cctcaaaacaaatcgcagttgaattaaatatttaaatgtaaaaaaccctaagagtagtagaaaaaatacatgcaaatatttattataatgttgggatggatacatttgtagatatgtcatcaaaggtaagggtcagcaaagaaagtctgacataattgactacataaagattttaaaaattagtatagcacagaatattgtaagttaaaggacaaatgaaaaattgggaaaacatatggcaaagggttaatgtcatcagaatgcaaggagctattatatatatatacacacacacacacgyacattttaatggaaaaattggcaaagatttgaaactagcagttcaggcagtcaaaaacagatcaacacaaattgatcagtctaaaaagaagctcaagttaacgagtgacaaaatagattcaaactaaaccaacatgcgatgccattttttttcactcatcagtctggcagagattaaagaacaatccagcctagcattggtcaggatatggtgatctaataaccaggtatgctggtctctcacacacagtggttgagagctcacctggaataggctttgtggaggggacctgggctattt

SEQ ID NO: 190447 - DNA, 601 bp, Human
gaattaaatatttaaatgtaaaaaaccctaagagtagtagaaaaaatacatgcaaatatttattataatgttgggatggatacatttgtagatatgtcatcaaaggtaagggtcagcaaagaaagtctgacataattgactacataaagattttaaaaattagtatagcacagaatattgtaagttaaaggacaaatgaaaaattgggaaaacatatggcaaagggttaatgtcatcagaatgcaaggagctattatatatatatacacacacacacacgcacattttaatggaaaaattsgcaaagatttgaaactagcagttcaggcagtcaaaaacagatcaacacaaattgatcagtctaaaaagaagctcaagttaacgagtgacaaaatagattcaaactaaaccaacatgcgatgccattttttttcactcatcagtctggcagagattaaagaacaatccagcctagcattggtcaggatatggtgatctaataaccaggtatgctggtctctcacacacagtggttgagagctcacctggaataggctttgtggaggggacctgggctatttgtttcaaagataccaccaaa

SEQ ID NO: 190448 - DNA, 601 bp, Human
cctaggctagagtgctcactgcagcctcaaattcctgtgctcaagaggttctcttgcctcagccttccaagtagctgggactataggggcatgccaccaggctcagctaattttttaatttttttgtggagatggggtctcgctatgttgcccaggttggtcttgaattcctggcctcaggagatcctcctgagtgatcttcttgtgttggcctaccaaagtactgggattacaggtgtgagccaccatgtccagcctacacccaacccttaacagtgattatctttgaaaagtggaattrtgtttgggtttatttctgccccttttaaaataactttattttctgttactacattaattcatttaggattatggcctccaactgcatcggtgtttctgcaaagggagctaagcattgggcacacatgggcataaacatgggaacaatagactctgcagagaactaccagagggaggtgggaggaggacacaggttgaaaaactacctatcgggtatctataccccaaacttcagcattatgcaatattcccatgttactaacctgcgtatgtacccccatatctaaaatgaaagttgaaa

SEQ ID NO: 190449 - DNA, 601 bp, Human
caagcaagaggcaattgtgacaggtatgatagtttaagccttggctctttgtttctgtctgtaaattggtatgttaataacttctctagcacagaggtaacttcaatattcatgaaatgacctcagtagaatactaaattagaaactttgtaatggaaaatagatattaccatagattttcctgcattataaccatggcttgtgtttgtgtatttgttagcatgttgtgtcaagaaaataagcattagctacccaaatacttggaatttgaaattagcaactccccactttcctccatcartctactaatattggatactgtattagtctgttcccaagttgctaataaagacatacccaagactgggtcatttataaagcaagagaggtttaatgaactcacagctccacatggttggggaggcctcaaaatcatggaggaaggtagaaaaggaggagcaaaggcatgtcctacatggcagcaggccagagagcgtgtgcaggggaactgccctttataaaaccatcagatctcatgagactatcatgacaacagcatgggaaaaacccgcacctgtgattcaattacctcacactaggt

SEQ ID NO: 190450 - DNA, 601 bp, Human
attcaattacctcacactaggtccctcccatggtatgtggggagtatgggagctacaattcaagatgatatttgggtggggacacagccaaaccatatcagatacttagccctaaacctatctatacaccctgattcttaccaactttatctactcatttaaacatatctctttgttacaggcagctttctgttttgtttgtttttggttttgtttttaaaagctcagtactacagaacatagtaagctagttatcaacatttccgtatctgtaggcatggttatgcatgtgttaaattartacttcttccttcaaccatcagcctttcttcatttctctatgcaataaacatatgttgtattgggcttacactgtgtgctagatacagttcacattatcattatattcactaaccattacagggatgaatgatatcatacagtatttacagtattaaaatggttatattatttgatcttagaatagcattgtaaaatatattattattgtcacttcacaaataaggaaatagaggcccggagagattaggtggtttagacgtagttttgcatataggaagtagaaccaggactcaaggtt

SEQ ID NO: 190451 - DNA, 601 bp, Human
aatctaattttagaacatttcatcaccccaaaacgaagccctgaggattagcagccaatccacaacccattctcccccacccaagccctaggcaaccagtagtctacttcctgtctctatagatttgcctattccggatatttcatacaagtgggatgatattatatgtggcatattgtgattgatttagttttcacttaatgcaatgttttcaaggtacagctatgatatagcatgtatcactacatcattttttagtgatgaataatattcatcattgaatcataattgagaaatattmttcatccctgatgcacctgtgtgtgatttccaaattttgactatcatgaataatgctactatgaacatatgtgtacaagtttttgtgtggacatatgttttcatttttcttgggtatatagctgtaagttgaattactggatcaaggtaactctatgcttaacattttgaagaactgccaactacgttccaacgtaactgtgccattgtaaatgtctttttgaagtattttgaagtatatacctatttgaggtatttgcactctcatattcaactgagaacatctcctgtgagtatctca

SEQ ID NO: 190452 - DNA, 601 bp, Human
aaggtacagctatgatatagcatgtatcactacatcattttttagtgatgaataatattcatcattgaatcataattgagaaatattattcatccctgatgcacctgtgtgtgatttccaaattttgactatcatgaataatgctactatgaacatatgtgtacaagtttttgtgtggacatatgttttcatttttcttgggtatatagctgtaagttgaattactggatcaaggtaactctatgcttaacattttgaagaactgccaactacgttccaacgtaactgtgccattgtaaaygtctttttgaagtattttgaagtatatacctatttgaggtatttgcactctcatattcaactgagaacatctcctgtgagtatctcatgttcaactgatttcagctcttgtgtatctcgtgttcaactcttatgctcaactgatttcaactccaatgaatatctaccaagaagtgggactgctggatgaaatgctactctcatttttaattatttggcaaaacttccatagtgtttttccagaatggataaagagaatgcattatatcatacaattgagtgtcagtcagccctaagaaag

SEQ ID NO: 190453 - DNA, 601 bp, Human
cctgtgagtatctcatgttcaactgatttcagctcttgtgtatctcgtgttcaactcttatgctcaactgatttcaactccaatgaatatctaccaagaagtgggactgctggatgaaatgctactctcatttttaattatttggcaaaacttccatagtgtttttccagaatggataaagagaatgcattatatcatacaattgagtgtcagtcagccctaagaaaggaggaaatcctgccatatgcatagacctggaggacattatgctaagttaaataagccaggcacagaaggacaracactacatgatgctatttacatgaggaatctaaaatagtcaaactcatagaagctgggagtagaatggtggttgccagaggctgagaagggggagaaatggagaggtgttaatcaaagggtgcaaagtttcagttacgcaaggtaagtcctagaaatctactctacagcttagtgcctatggttaacaattctgtattgtatacttaagaactcgctaggaaattaaatgttacataaagtgttcttatcactaaaataattaatacataaatgaatacataaatagggcaggaggaaa

SEQ ID NO: 190454 - DNA, 601 bp, Human
gctgggagtagaatggtggttgccagaggctgagaagggggagaaatggagaggtgttaatcaaagggtgcaaagtttcagttacgcaaggtaagtcctagaaatctactctacagcttagtgcctatggttaacaattctgtattgtatacttaagaactcgctaggaaattaaatgttacataaagtgttcttatcactaaaataattaatacataaatgaatacataaatagggcaggaggaaacttttagaggttatgtgtatgtttatggcatagattgtgatgatggtttcttgsccgtgtatatatctccaaactcctcactttaggcacatcaaatatatacagctttctgtatgtcaatcatacctcagtaaagtggtttttaaaaaagaaacagcagaagaggtcattgtgaattcagaggtcttcagaggactcagccctttaatctctgattcagtaaagtggcattcgagtgtttccttttttgttagtgtaacaaatataaatctcagtgctatgggagctcagaaagtgttctggatcagaacatgccctgggtaattcacagtgtataaggcagagaagaaaaac

SEQ ID NO: 190455 - DNA, 601 bp, Human
tttgcttagttcttgactctaacaagctagcattctgtagtttgagatttaagagcctctgaaacaagtttcctttctatttctttacatttttgatcaatccatctttgctcattttccatgtggctcttatctgctcctctccatcttaagtattatcctagtccaagccacatcatctcattcttgaacttttcttttcttttttttttttttcatttgagatggagtttcactgtttttgcccaggctggagttcagtggcacgatctcggctcactgcaacctccacctcccgggwtcaagtaagtctcctgcctcagcctcacacatggctgggattacacgcgtgcgccaccacccaggctaattttgtatttttagtagagataaggtttcaccatgttggtcaggctggtctcaaactcctgacctcaggtgatccacccgcctcggcctcccaaagtgctgggattataggctgagccaccctgcctggcacattcttaaatttttctgcagtagcctcataattagctgtttctccttcacttttactctctacagtccattcttcacacagtaaccagtgttacctatt

SEQ ID NO: 190456 - DNA, 601 bp, Human
tctgtagtttgagatttaagagcctctgaaacaagtttcctttctatttctttacatttttgatcaatccatctttgctcattttccatgtggctcttatctgctcctctccatcttaagtattatcctagtccaagccacatcatctcattcttgaacttttcttttcttttttttttttttcatttgagatggagtttcactgtttttgcccaggctggagttcagtggcacgatctcggctcactgcaacctccacctcccgggatcaagtaagtctcctgcctcagcctcacacatrgctgggattacacgcgtgcgccaccacccaggctaattttgtatttttagtagagataaggtttcaccatgttggtcaggctggtctcaaactcctgacctcaggtgatccacccgcctcggcctcccaaagtgctgggattataggctgagccaccctgcctggcacattcttaaatttttctgcagtagcctcataattagctgtttctccttcacttttactctctacagtccattcttcacacagtaaccagtgttacctatttcaaattgtaaattaaatcaggtgtctcctctg

SEQ ID NO: 190457 - DNA, 601 bp, Human
tcttccttcacacactctcctctcaactttgtccctcacatcttcattctatttcactcagctcaaaagtccatttctcagggaacatcccatctcctgccctaatcagcgacctctcaggctaagtaagatccctgttaatatatccactttatacgctgtacgtctttttcatgataatcactccaatagcaattgttgttaattgggtaattatttatttaactacttaattaatgtctgtgaccttctctagaatgaaagctccatgacaacaggcagatttatttgcctctgtatsttttatgtgtagcaaagcctttgcagttagtaggtgctcagtaaatactcagcgaatgaatgaaaggatataataaataggtaacacttaattctttaaatcagctatgagattattttgtatgagataacaaggtatatatgccagagagttctgaagaagcatagacgtttctttctatgtagttactgatctctgtttttactgtgagtgcaaacaatactcatgccaccccattagaaacaaatatccaccaaactctgtgtgctgggcactaagctggatgagcaggactaaagc

SEQ ID NO: 190458 - DNA, 601 bp, Human
cccaaatttctctcatgctgccactgtgccgtccccccacacccagtcactagcaaccactgatcgttttctgctcctataattctgccttttccagaatatcagatagatagaattgtactggtctggcttccttcacttagcataacacatttgaggtacatccatattatcatatgtttgagaagtccattccttgttaccaagtaacattccattgtatggatataccactgttgtttattcattcattagttgtaggatatgtgattgcttcaagtttttggctattatgattaargctgctgtaaacgtctatatacaggctttgtctcaacacaagtttttgttacctaggactgatattgctaggtcatatggtaaggtcattaggtatgtttaacctaataagaggctgccaaactcttttccaaagtagctatactcaattctgtattcccgtcttcaatgaatgagagtccagctgctgcacatttcatgaacacttgctattttccattttttaaaatgctaaccattctaatagttttacagtagtatcttgtgtgatttttaatttacatttatataatgactaata

SEQ ID NO: 190459 - DNA, 601 bp, Human
catgctgccactgtgccgtccccccacacccagtcactagcaaccactgatcgttttctgctcctataattctgccttttccagaatatcagatagatagaattgtactggtctggcttccttcacttagcataacacatttgaggtacatccatattatcatatgtttgagaagtccattccttgttaccaagtaacattccattgtatggatataccactgttgtttattcattcattagttgtaggatatgtgattgcttcaagtttttggctattatgattaaggctgctgtaaacrtctatatacaggctttgtctcaacacaagtttttgttacctaggactgatattgctaggtcatatggtaaggtcattaggtatgtttaacctaataagaggctgccaaactcttttccaaagtagctatactcaattctgtattcccgtcttcaatgaatgagagtccagctgctgcacatttcatgaacacttgctattttccattttttaaaatgctaaccattctaatagttttacagtagtatcttgtgtgatttttaatttacatttatataatgactaataatttggaccattt

SEQ ID NO: 190460 - DNA, 601 bp, Human
ctgatatttttctttgacttttgagagttctctatatattctgaaaatgagttcttcattgaatagctgatttgtggcttgtctttgctaacctttaattttcttgttattttaaaaatcttgctcccaggcccatcactggatctcctatagtctcttaggtctactcagtatgtttatagaacttctaggttttttcagacacagtggggatctaggaagatgaaaatgaccattgccctgttaacaaggagcttttgagtagctggaaagagaattcaggtatccaaatatttataamccacgaaataatgtcccgagtgccatagggatgtatagatggtgtgctatactgcagagtgttgtcactcattgaggtttctggttactaaaatactttgaggccccgaagagagaaacaataaagactgtggatgattacatcctacaaactgtaacaaagtggcttccctctttacagcctcatgtattatctttgatgatgatgggcattaggggatgaaaaaggggccgtgccaggcaatgcagtctttctcaacttgatcagtcacagtgcccactctaaccattgtcaagcaaa

SEQ ID NO: 190461 - DNA, 601 bp, Human
tatttttctttgacttttgagagttctctatatattctgaaaatgagttcttcattgaatagctgatttgtggcttgtctttgctaacctttaattttcttgttattttaaaaatcttgctcccaggcccatcactggatctcctatagtctcttaggtctactcagtatgtttatagaacttctaggttttttcagacacagtggggatctaggaagatgaaaatgaccattgccctgttaacaaggagcttttgagtagctggaaagagaattcaggtatccaaatatttataacccaygaaataatgtcccgagtgccatagggatgtatagatggtgtgctatactgcagagtgttgtcactcattgaggtttctggttactaaaatactttgaggccccgaagagagaaacaataaagactgtggatgattacatcctacaaactgtaacaaagtggcttccctctttacagcctcatgtattatctttgatgatgatgggcattaggggatgaaaaaggggccgtgccaggcaatgcagtctttctcaacttgatcagtcacagtgcccactctaaccattgtcaagcaaaagga

SEQ ID NO: 190462 - DNA, 601 bp, Human
gcattaggggatgaaaaaggggccgtgccaggcaatgcagtctttctcaacttgatcagtcacagtgcccactctaaccattgtcaagcaaaaggaccacatcagaagccattagcctcactgcatctccccaccccctcagcccgtttgctgtaattgtcccatttgacttcgtttaataacaaatgggtaaagaaattccatgcttgacacatgtggagttgcatgtgtgtgtgacccatcagacagcttcagggcacaagtatactgcccagcctatcttttgcttctgctcatactwatcattaacatgtgtcactttaggctgggcatggtggctcacgcctgcaatcctaacactttgggaggccgaggcgggtggattgcctgacctcaggagtttgagaccagcctgggcaacagggtgaaaccctgtctctactaaaatacaaaaaattagccgggcatggtggtgtgtgcctgcagtcccagctacttgggagggtgaggtaggagaattgcttgaacccgggaggctgaggttgcagtgagccaagattgcatcactgcactccagcctgggtgacagagtgagactcca

SEQ ID NO: 190463 - DNA, 601 bp, Human
gtaggagaattgcttgaacccgggaggctgaggttgcagtgagccaagattgcatcactgcactccagcctgggtgacagagtgagactccaactccaaaaaaaaagaaaaaaagaaaaaaaagtcactttattcattaagtaccattagtgactctcagttgctacaaggataaagtttgttcttaccctgattgaccctagtctcattgaccctttaccattctcatgctttgtgaaatcatcccacaccctgtgatctaaccccggctgactcatggactaactcatcatggctcacrtcagcctggactcctccccttggaggaggagtcagtgcacattctatgcattttttccagacttaaatcagatgccatctcttctgtgaaggcaccgatgagtgtcacccatcttgaagtccgaattaaaagtgccttctgccctcctatgacacgttgcatctttattttttccttttagcatttgcttcattttgctttgtgttgtggttgtttgcctgactctccacccagtcttgacagtgagatctttgagagcacagtctatatcttccttgtatctttatccctcgttggagc

SEQ ID NO: 190464 - DNA, 601 bp, Human
atcagatgccatctcttctgtgaaggcaccgatgagtgtcacccatcttgaagtccgaattaaaagtgccttctgccctcctatgacacgttgcatctttattttttccttttagcatttgcttcattttgctttgtgttgtggttgtttgcctgactctccacccagtcttgacagtgagatctttgagagcacagtctatatcttccttgtatctttatccctcgttggagcctaacataaactgttgcatgtggtaagttttcactgagggtttattgattgaaggacatgccataasccacagttcaccttgctttgtgacccagacagaagaggtgtctcagtggctgatagttgtaactggaggtgacagggggctctgatgtgttctaagcaaagacagccctgtttccctattggccgtgattatgccctcctatctagaataggaaaagggtgatttgattttgagcaataagcaacctgactctaattgtctaccttaaatgccttccattgttctgcttaaggtgattttctaccagcatgaaatgttctccttcccagacagttgatggaggagctgagtcatgcctga

SEQ ID NO: 190465 - DNA, 601 bp, Human
cttgcttactcactttgttctactttctattaatgagtgcccacccacttccgttcttttctctgaaaaactggcttgatttatatttttcagagtcaggctagaaaatactcttgaagttagcatggattataaacccatcatattatagagatggacagggttacagatcatctggttttaccttcttatacgtgataaaactgaatcccaaagcaggaaagtgacttggtcacagtcagcattaaatttcagactctagagagtgacagatctgcgttagaatccccgtctcctactkacttgctgtgtaattgtgtgggtatcttttaacttatctatgcttcatgctcgtcatttgttaaatgagggccataataaagctatctgaaagaggcattatgaagagtgaaaatgataataaatgtaaaacacttaatacctggcgtatagaaaacactcacaattaagtgaatggtactggtagttcctatggtggtggcagttttataatggtggtcacactggcagaattaggacaagaaaccaggtcttctgaccctatgtctttgttctccatagggtatactacaagatgtat

SEQ ID NO: 190466 - DNA, 601 bp, Human
tgaaacattttcctacctcaaagcatacggagataaaaaggtctcttacatctttttttctttctttctttttttgagatggcatctcactctgttgccaggctggagtgcagtggtgcaatctcagctcactgcaacctctgcctcctgggttcaagcgattctcctgcctcagcctcctgagtagctgggactacaggcatgcgccaccacgcccagctaatttttgtatttttagtagagatggagtttcaccatgttggccaggttggtcttgatctcttgacctcgtgatccgccygcctgggcctcccaaagtgctgggattacaggcgtgagccaccatgcccggcctacatctttctaagcaaccatcttcattattcattttccactaggcagggaatcacatgcagcattgggagtccaaaagtcctcagggatgagtgtcttggacttgacagtgttgtcctggaatatatacctggacacacatgcacacacacacaagatgtttgtgtgtgtagttgtagttgtaccatgcagttcctaaaagccctcttcaaatgactgtgagttattttcctggtctttcatctat

SEQ ID NO: 190467 - DNA, 601 bp, Human
ctgtaataatccacatcatgatagctaaaacatattcatattaagttcttactgtgtcagagtccatgtggcattttcgtgtatcatcttatttaccgctaacaacagctctatgggattggcactgattaacttcatattttgtgacatatatttgtgacatgtactgttacctatgtggcaactgtggacaggattcttcttcttctttttttttttttggtgagacggagtcttgctctgttgcccaggctggagcgcagtggcaccatcttggctcactgcaacctctacctcccgrgttcaagcaattctcctgcctcaccctcccaagtagctgggactacaggtgcccaccacattcccggctaattttttgtattttagtagagatggggtttcaccatattgcccaagccggtcgcgaactcctgagctctggcaatctgcccgcctcggcctcccaaaatgctgggattacaaggtgtgagccaccgtgcctggccaggattcttctttccaggtgccacacttatgggcagcgatgccatttagcttgttttcagcctcaaggacaaacccacatatcagctttttcact

SEQ ID NO: 190468 - DNA, 601 bp, Human
agagatggggtttcaccatattgcccaagccggtcgcgaactcctgagctctggcaatctgcccgcctcggcctcccaaaatgctgggattacaaggtgtgagccaccgtgcctggccaggattcttctttccaggtgccacacttatgggcagcgatgccatttagcttgttttcagcctcaaggacaaacccacatatcagctttttcacttgtaaaatgggaagggtgaaaatagtaattttatgacttgaccatatagaacacatgcagcgttatcttttttggctcagtattaacrttgtctgttccagtcttcctgggtttgattcttagcctgcttcatcctctgttttgaagaggagtgtactgttgtactatttacattcaaagtgccaagtgggaatgtctgtgcagatatttatttggaatatatatttcactgggacaatgtagtagaacacagaatttggattggagaggaatgattttatacttgctacaagtaaactcttgtgttactcaagttatctttctgggtatagtttgtaaaatcttctcatttgcagaatgagaagaattttttaaaatgttgtaaaat

SEQ ID NO: 190469 - DNA, 601 bp, Human
tcccacaaggaaaactttgtagaaagtgacgcttgtatttacaaactaagagtgaaactccagcatggcagatactgactgcaaactgctcggaggtgctaaaatattcatcctttaataatgctagactctgaaagaccccagctcttttagatttgattttataactctaagtattgcctattataattctgaatttaaacttcgtaggattggttgttttcatccgtcagggttcactttcctttcttacctctttcttttcttcttttttcctttgttcaggtttactttgtaatgwtttgtccatactttttattttttaactggatggaactgccacttcaaattgatatgaaatgacagtctttagggcagtgtaaatacctggtgccataaacaggagtagtacactattcggaataaaaattattctaggagcaaactctaatgaaactgaaaccgtggcttgtggatttctccctcaccaaaccctttttttttttgaatttggcattctttcctaatctgacaaatgttatcatcccttgtatctgtcagagctattttccatttttttttcaaattattcaatcaagaa

SEQ ID NO: 190470 - DNA, 601 bp, Human
gcttgtatttacaaactaagagtgaaactccagcatggcagatactgactgcaaactgctcggaggtgctaaaatattcatcctttaataatgctagactctgaaagaccccagctcttttagatttgattttataactctaagtattgcctattataattctgaatttaaacttcgtaggattggttgttttcatccgtcagggttcactttcctttcttacctctttcttttcttcttttttcctttgttcaggtttactttgtaatgatttgtccatactttttattttttaactggmtggaactgccacttcaaattgatatgaaatgacagtctttagggcagtgtaaatacctggtgccataaacaggagtagtacactattcggaataaaaattattctaggagcaaactctaatgaaactgaaaccgtggcttgtggatttctccctcaccaaaccctttttttttttgaatttggcattctttcctaatctgacaaatgttatcatcccttgtatctgtcagagctattttccatttttttttcaaattattcaatcaagaaaacttccttttgttggtgggagtaaggtat

SEQ ID NO: 190471 - DNA, 601 bp, Human
ataaacaggagtagtacactattcggaataaaaattattctaggagcaaactctaatgaaactgaaaccgtggcttgtggatttctccctcaccaaaccctttttttttttgaatttggcattctttcctaatctgacaaatgttatcatcccttgtatctgtcagagctattttccatttttttttcaaattattcaatcaagaaaacttccttttgttggtgggagtaaggtatgtctaattatctggtcctggaaagcagccatctgcccagtgatgaacacgggtttgtatgcagtrccagcaacatgaggatgcgtgatggatgctcacagacactccagctctccctcctccactcctgacttcttgctctcctcttgatgacttagtcagtgaatgtgaattttcagaaacattttctagactttgtttgggtagctctaccctgaataaacatatctaagttttaatattgtgttagttttctctcatactgctaataaagacataactgagactgggcaatttataaaggaaagaggtttagttgactccagttccacatggctagggagccctcacaatcatggcagaagg

SEQ ID NO: 190472 - DNA, 601 bp, Human
aaaccattgttatcagtgaagacaatgatcagccataagtagacatgtaaaataacagctgtttaaactaattcctttccaagtttagtgagcatagggattacctggggattgttaaaatgcagatcgtgattcaatacatcaggatgggttctgaaaatctgcagttctgacaaggtggcaaggaatactgatgatgctggtgggttgaggaccagactccaagtaatgaggatataaaaagcttatttatcacataaaatgtagaggtggaaagttcagggctggtaaggcaactccscaagttattcaaggtcccacctcctttcactttcagatttcaccatctttagggtgtggtcctcattcttaccgttcattatgtagcgccagctatcatatctatctatgtcccacgcagcaggacagaagaaatgggatggtaggaggagcatgggaaccataggaacatgccagtgtctctcaaggaagatttctgggatctaccatatgacaaatttcaaaccttttctattagccagaacctagtcacctgaccacatccaggtgagaggcaagctgggaaatgttacttttaaac

SEQ ID NO: 190473 - DNA, 601 bp, Human
caagttattcaaggtcccacctcctttcactttcagatttcaccatctttagggtgtggtcctcattcttaccgttcattatgtagcgccagctatcatatctatctatgtcccacgcagcaggacagaagaaatgggatggtaggaggagcatgggaaccataggaacatgccagtgtctctcaaggaagatttctgggatctaccatatgacaaatttcaaaccttttctattagccagaacctagtcacctgaccacatccaggtgagaggcaagctgggaaatgttacttttaaacygagtggctatgtgcctaactgaaagtccccacactctattgggaaggggcgtgtgaggcatggaaatggggcatgtctagcagtccatgccacagatgcggatgtctgacacaagaagtggtttgccaaagatcacagaaaaattacagttcatagattaattataaccagtacatgtatggacattctcagtttatgtgtggtgctgttttatgtcataggcttatttcattttcataactattttacactattatgagcttcttttttggttgtggaaactgaggttcaaaatggttg

SEQ ID NO: 190474 - DNA, 601 bp, Human
gaaatgttacttttaaactgagtggctatgtgcctaactgaaagtccccacactctattgggaaggggcgtgtgaggcatggaaatggggcatgtctagcagtccatgccacagatgcggatgtctgacacaagaagtggtttgccaaagatcacagaaaaattacagttcatagattaattataaccagtacatgtatggacattctcagtttatgtgtggtgctgttttatgtcataggcttatttcattttcataactattttacactattatgagcttcttttttggttgtggaaastgaggttcaaaatggttgagggacttcattgatcataaagcctacccttactactctctttataattgcatattcctgtctctcccttctctctccctccttcattcctgattcctcttaccagattctatattgttctttgttcccttcactcatcacctttcaacattctatatatttttcttatttagcatgtcaattgcttattgtcagtctccttgtgttagaaggtgagctccgtgagacctttgttttgtttgccagtgcatcccaagcacccatttagtatttggcacatga

SEQ ID NO: 190475 - DNA, 601 bp, Human
ttttgtttgccagtgcatcccaagcacccatttagtatttggcacatgacggaatgctcagtacatagttttttaaatgaaggaataatgccactaggtatcaaagtccgccttggaattatgtctgttatcttcaaccctaatgctatacgccttctccatcagggcttctgctaatgttttagactctggaactcctgtgtttgcctcagaaatgtgctcacacttaaacatattgatttcctccttgtcttcgtgacattcatttaatgttgctagccaacttaaccagtttgctctyaccttcagttctctctttatctcagtcccaggttaatatttcctgaggacccaagcataccactagaaaaacaaactttagcaaaactaccaaaattaacgtcaaaccagcgttcctgtttgacttagtctctagcctcaggcttagataggactactagcacacgcagatgggacagtttctaagtggcctgatccgcattggtttctagtttggaatgtaaaaggggactggttctggtctcagccaaatctcaagactctcacctccaccctccgccctgtttacagtaatagaatt

SEQ ID NO: 190476 - DNA, 601 bp, Human
gctaatgttttagactctggaactcctgtgtttgcctcagaaatgtgctcacacttaaacatattgatttcctccttgtcttcgtgacattcatttaatgttgctagccaacttaaccagtttgctcttaccttcagttctctctttatctcagtcccaggttaatatttcctgaggacccaagcataccactagaaaaacaaactttagcaaaactaccaaaattaacgtcaaaccagcgttcctgtttgacttagtctctagcctcaggcttagataggactactagcacacgcagatrggacagtttctaagtggcctgatccgcattggtttctagtttggaatgtaaaaggggactggttctggtctcagccaaatctcaagactctcacctccaccctccgccctgtttacagtaatagaattaatataaaatgtagcacaatataatataatagcatttaatattattatgcttctgtttagaaacctgttatgacaattggttgatttcattcagttaactctatttctatgtctttcttttgtgaagattgttaattttctgatgggaattttctgatacaggttcagctaa

SEQ ID NO: 190477 - DNA, 601 bp, Human
ttcctccttgtcttcgtgacattcatttaatgttgctagccaacttaaccagtttgctcttaccttcagttctctctttatctcagtcccaggttaatatttcctgaggacccaagcataccactagaaaaacaaactttagcaaaactaccaaaattaacgtcaaaccagcgttcctgtttgacttagtctctagcctcaggcttagataggactactagcacacgcagatgggacagtttctaagtggcctgatccgcattggtttctagtttggaatgtaaaaggggactggttctgrtctcagccaaatctcaagactctcacctccaccctccgccctgtttacagtaatagaattaatataaaatgtagcacaatataatataatagcatttaatattattatgcttctgtttagaaacctgttatgacaattggttgatttcattcagttaactctatttctatgtctttcttttgtgaagattgttaattttctgatgggaattttctgatacaggttcagctaatacgtactgagctcgttttgcatgctaggacttttaactctcacacagcactgtaagataggcagggt

SEQ ID NO: 190478 - DNA, 601 bp, Human
ctttatctcagtcccaggttaatatttcctgaggacccaagcataccactagaaaaacaaactttagcaaaactaccaaaattaacgtcaaaccagcgttcctgtttgacttagtctctagcctcaggcttagataggactactagcacacgcagatgggacagtttctaagtggcctgatccgcattggtttctagtttggaatgtaaaaggggactggttctggtctcagccaaatctcaagactctcacctccaccctccgccctgtttacagtaatagaattaatataaaatgtagyacaatataatataatagcatttaatattattatgcttctgtttagaaacctgttatgacaattggttgatttcattcagttaactctatttctatgtctttcttttgtgaagattgttaattttctgatgggaattttctgatacaggttcagctaatacgtactgagctcgttttgcatgctaggacttttaactctcacacagcactgtaagataggcagggtgtacatgcagagactagtttaagagaagcattttgtccaaggccatatggcaactaagtggcacatggaaaataa

SEQ ID NO: 190479 - DNA, 601 bp, Human
atacttatatgtctgtctaccccagcacctagcatagtgctttgcgcatagcaggttctcaataaatatttaatgaatacaaatatatgaagagcttttctgtggaaaatattctgctttgaatgtgtgaggatacatttgggacaaacatcctagctctatagtcaggcagctttttttttttgtgctaccactcaggcaaaagtaagtcaattaatctctctgtctccgtttcctggcatgtaatgtgggaatgggcatgaaagccctagagtgtgttgtgagattaattagttaaaaygtataccctgctatataaatgctaattgctgtcaggagcgtgggttggatcttccagtgacttggctttgcaaagctttgcacatttccattagtcctctgtgccaccaagtctcagccttaagaaacccttttggctgagaggaatgatgactttgtggttctcccatgttgagaggccaatttagagaggacttccactgtggagtaaactgaataagaagggacattataaacaaaaaaggaattcttgtgctagtaatttgctaaattccctttgctgttattagagacaaatgta

SEQ ID NO: 190480 - DNA, 601 bp, Human
aaatatttaatgaatacaaatatatgaagagcttttctgtggaaaatattctgctttgaatgtgtgaggatacatttgggacaaacatcctagctctatagtcaggcagctttttttttttgtgctaccactcaggcaaaagtaagtcaattaatctctctgtctccgtttcctggcatgtaatgtgggaatgggcatgaaagccctagagtgtgttgtgagattaattagttaaaacgtataccctgctatataaatgctaattgctgtcaggagcgtgggttggatcttccagtgactyggctttgcaaagctttgcacatttccattagtcctctgtgccaccaagtctcagccttaagaaacccttttggctgagaggaatgatgactttgtggttctcccatgttgagaggccaatttagagaggacttccactgtggagtaaactgaataagaagggacattataaacaaaaaaggaattcttgtgctagtaatttgctaaattccctttgctgttattagagacaaatgtatttgcataacagccttttcctgtcttttctgaggctggtgcctgcagtgaatcatataattaa

SEQ ID NO: 190481 - DNA, 601 bp, Human
tttgcataacagccttttcctgtcttttctgaggctggtgcctgcagtgaatcatataattaatttggtattacatgacactccagcctgttgccatagattttatttttatttgttcattgaataatataaaaagctctgacaaaatgcgctcaggtggctgtctagagaacttaaaaactcacagaactaatttcaaatgggcaaatatcccaaagaaaaagctcaataataataatgtttatgaatgctaatacatatattttcaggctctgtggtacaggaggctgactcactttayacacatattcatttggtccatgaaacatcatgtaagggagatacatggcaggtataattatttcctttccctttaaaaatgtattgaatttaattgaagacatattaagccgatggattgggccagaaatcttggtgattgacttgtattcaaattttagtatgtaaggaacaaatgcttttttaaaaagtgtctggtcttgatttattaacttatgttatgaaaggaaaattctaccttcctttttttgttaatcaagataggcagtactagttgctatcacaaatctcagtgacttaa

SEQ ID NO: 190482 - DNA, 601 bp, Human
gttttgagatacctgactgcatgtgccaggatagattattgatattggtaataagcaaatccaaatcatctctgccttcaaagaacaaagttgtgtggtatgccatccatcaaagtacccaacctaagggagcctctgtctctgtgctttcatatttgccaaggcagaagaaaagggaattttgtaaaatataccccatccaaaacatccacaagtaggactgactacatcttcttggtcaaagtaagtcacatggccgctccttacttcagaggtgtggaaatgtacaatcttatactcrgaggagaacccataaatagtgggtgaacagcactaatgactctttatcttgatgctgataattcctgggtcttttcagcaccctgaactacagattggtttgttctccagttctctgctgctggtttaggatttgtctttttaggtgtgttaagtctgttaccacttgtccatgttggtatcactattgtcttttctcctactcttgcagttacttgggattatgtattaaacattattttaattttcttttcttttctttttttgaaacagagtcttgctctctcacccaggctggagt

SEQ ID NO: 190483 - DNA, 601 bp, Human
cttttatcaaaattagaataatgacaagtgagttgttttgccagttatccactgctgcaaaaacggtgccttgcaaagaagcacaaatttaaatgaccaaacttcattttatttatttcacttgtatttttgcttctgagtctgtatcttgtgcggctcagctcgtccaggccggacttgctcttgtacctttggtcagttgtggaaagccagatagccatacttctggaggtgggccagctgccagctggggtgtctcagctgtcctctctgtggtctcttatttattaatatgcttttstggacttgttctcatagtgacaacagagttccaagagaaaaagcaaaatcttttaactcttaagtttagatcgtcacacaccacacaatcacttttgctgcattttgtttgccagtagaactcacaaggacagcccagatttgatggctggtgagatagactcttgattggaaaacttacagtttcaaattgcagaggatgtggagataggggaaagggaaaactagggctgtttttgctgactctgtattccagagttttcaaatgatcgttaaaaataatgtttgatgataaaaatat

SEQ ID NO: 190484 - DNA, 601 bp, Human; identical to SEQ ID NO: 24207

SEQ ID NO: 190485 - DNA, 601 bp, Human; identical to SEQ ID NO: 24208

SEQ ID NO: 190486 - DNA, 601 bp, Human; identical to SEQ ID NO: 24209

SEQ ID NO: 190487 - DNA, 601 bp, Human; identical to SEQ ID NO: 24210

SEQ ID NO: 190488 - DNA, 601 bp, Human; identical to SEQ ID NO: 24211

SEQ ID NO: 190489 - DNA, 601 bp, Human
gtgaggattaccagagataaagatgacctttcataataataaaaggatcactttatcagcgaaacataaaaataacaaaagcttgtgtgcttaataacaatgcttcaaaaacatgcagcaaaatttggcagaactcccgagagaaataaaaaattccacaaacacaatttgttgtaaatttcaaaagctgaacattttaaattctgtctctgcttaagttgttaatgatacaatttgggagtcaacttgaagagtcttctgttggccaaagatgaacaatttgaaccgaaataatttgaayctaattgcaatggtttaaatcctatgaagtcagtttaaatttataagtttataatgacatttcacaaaatttaatgggttacatttggatgatgataggaaatcagtttattatcttgaaaactggtaaaggagaataatcaagtattcattctggttttcctagaagacatgtaacattgggtaatgaagtgttgtagagaagtgtgttttgtaaagtgtttctaatagtaaatgaaaatttaatgatccaattagaattatcatcaccttgcaactctcaatagattaataaatctag

SEQ ID NO: 190490 - DNA, 601 bp, Human
ttctaatagtaaatgaaaatttaatgatccaattagaattatcatcaccttgcaactctcaatagattaataaatctaggcatctaagcatcaatgactgctaacatcacaagaggaaaaaccatcagacatgtttcttctgataaaagaagaaaatattacatattgattcatattaccaaattaattaaacctgagtcggattaagcctttggatcccactgtcattttgcaggagatatataaataacatagaaatacattgaactgcagcatgaatatgtcatccataaaatccagrctatgtgaaactctatgggccagatgtgctgggtttttcaaaagataaattgtaagaaaaggaatgtcatgaagagggactgtatagattaaaagaaacatataagacatttaaaaagtagatagcactgtagcatctaagcatgcatatataggtgaaaagtatataaataaaaacaaggaagtgattttactataaaagtatagatagtgcctactttggagggtagtaaaggaggtgtgattgacatgggccgtgacgaaggccttcaggagggactggcaaagttcctggacctga

SEQ ID NO: 190491 - DNA, 601 bp, Human
cattgaactgcagcatgaatatgtcatccataaaatccagactatgtgaaactctatgggccagatgtgctgggtttttcaaaagataaattgtaagaaaaggaatgtcatgaagagggactgtatagattaaaagaaacatataagacatttaaaaagtagatagcactgtagcatctaagcatgcatatataggtgaaaagtatataaataaaaacaaggaagtgattttactataaaagtatagatagtgcctactttggagggtagtaaaggaggtgtgattgacatgggccgtgamgaaggccttcaggagggactggcaaagttcctggacctgactgatggttacaaaggcctttgctttataataactcattaactcttagatgtgttttgcatggtttttttgtatgtgctttattttacaataaaatgactaagagggatggagggagagagagaagaaaggtagaaaaggagtgaggaagagaaagagatgcagagactgatttaagagatttaaccaccaattgcaatgaatcaactttagttggatctttttcatttgaaaaaaactataaagcaaattatgaaaaga

SEQ ID NO: 190492 - DNA, 601 bp, Human
taaaataaaattatatgatgtctgtgatttgcctcaaaataatcttggggtgcagtgagtagctgtgcatgaaataagacatagtctcaattaatacttgttgaggctagtaaagatacaggagctcgttgtcctctctctgattataatttttcatggtaaaaaacctaaaagatggttaaaaaataatattaacagttttacatcaataagtgtaatataccttccagttaaaaaaaaaagtttatttaccgtgcaatctaggttttaatctcgaaccttatttgattttttagttttrttcccatacacatcctgccgttttctcatctccttttttcctcatgcatttcctctgcctagaatgtcctccctttagaacagaccaaattgtaccacctttattaattgttccttgttccctccagctggaaatcatatttctctcatgtattcctgtttatttatacctgtttcaatattatttttcacttctttatttttttagtcattcattcatgactacagatagtcctcgatttactatggtttgacttaagatttttcaacttgatcatgggtttattgggataaaacctca

SEQ ID NO: 190493 - DNA, 601 bp, Human
ataaaattatatgatgtctgtgatttgcctcaaaataatcttggggtgcagtgagtagctgtgcatgaaataagacatagtctcaattaatacttgttgaggctagtaaagatacaggagctcgttgtcctctctctgattataatttttcatggtaaaaaacctaaaagatggttaaaaaataatattaacagttttacatcaataagtgtaatataccttccagttaaaaaaaaaagtttatttaccgtgcaatctaggttttaatctcgaaccttatttgattttttagttttgttcycatacacatcctgccgttttctcatctccttttttcctcatgcatttcctctgcctagaatgtcctccctttagaacagaccaaattgtaccacctttattaattgttccttgttccctccagctggaaatcatatttctctcatgtattcctgtttatttatacctgtttcaatattatttttcacttctttatttttttagtcattcattcatgactacagatagtcctcgatttactatggtttgacttaagatttttcaacttgatcatgggtttattgggataaaacctcatggt

SEQ ID NO: 190494 - DNA, 601 bp, Human
tagaacagaccaaattgtaccacctttattaattgttccttgttccctccagctggaaatcatatttctctcatgtattcctgtttatttatacctgtttcaatattatttttcacttctttatttttttagtcattcattcatgactacagatagtcctcgatttactatggtttgacttaagatttttcaacttgatcatgggtttattgggataaaacctcatggtatgtcaagtagcttcttatgatttatgatggggctatggtttctactgaatttttatcactttcacattatyataaagtggaaaaatcataaataaaaccgtcataagttggggaccgtctgctgtgttgtgagaattaaatgcatttttgacttaaccatatttttgacttatgataggtttgttggtatgtaactttcatcataagttaaggaatatctgtatactagctgaagattaactgtgatcagtgcaatatgccagggggttgagggaacaccataatgaataaaatatatgcccagagctgtgtagtcccaaatgacctcataatttaatacaaataactttgtaaatacaaagaatttctac

SEQ ID NO: 190495 - DNA, 601 bp, Human
ctgtcatgttttccccatgttatcgttgaggaaccaaggtatagcgtggttgagaaatatttccaaggccacagaactaggagctaagattctaacctatgtaatgtaatgtgtcaggaaaccacacttttacactttcatatataatttactcaaaacaatgcagctactgatgggagagtctgggatttcaggccagttctgtgtgattacaaaaactctactctctagaactgatgtaaggagggtggtccagcctttacttttggagcttaggacattttggaagggcagggtgatytttgaacacatactggggtgtggactggaccgtgggacgtaggtgaacctgtggatagagggccctgagaaatcggaggcatctcagacaaactgagattacaggaaacagaaaaccaaatgtttacatttcagaattgctgaagaaatgggataggattggattgtcctcctccacatgccttctctttctcctctttttttttttctgcatggcggaaaaaaattctgccatgaattcacaattctctaattcaacattaggtattctagtttaactcctgtgagttaaactgatgtt

SEQ ID NO: 190496 - DNA, 601 bp, Human
aaccaaggtatagcgtggttgagaaatatttccaaggccacagaactaggagctaagattctaacctatgtaatgtaatgtgtcaggaaaccacacttttacactttcatatataatttactcaaaacaatgcagctactgatgggagagtctgggatttcaggccagttctgtgtgattacaaaaactctactctctagaactgatgtaaggagggtggtccagcctttacttttggagcttaggacattttggaagggcagggtgatctttgaacacatactggggtgtggactggacygtgggacgtaggtgaacctgtggatagagggccctgagaaatcggaggcatctcagacaaactgagattacaggaaacagaaaaccaaatgtttacatttcagaattgctgaagaaatgggataggattggattgtcctcctccacatgccttctctttctcctctttttttttttctgcatggcggaaaaaaattctgccatgaattcacaattctctaattcaacattaggtattctagtttaactcctgtgagttaaactgatgttcagcaaatatttgttgaataagccaggtttt

SEQ ID NO: 190497 - DNA, 601 bp, Human
gattacaaaaactctactctctagaactgatgtaaggagggtggtccagcctttacttttggagcttaggacattttggaagggcagggtgatctttgaacacatactggggtgtggactggaccgtgggacgtaggtgaacctgtggatagagggccctgagaaatcggaggcatctcagacaaactgagattacaggaaacagaaaaccaaatgtttacatttcagaattgctgaagaaatgggataggattggattgtcctcctccacatgccttctctttctcctctttttttttttctgcatggcggaaaaaaattctgccatgaattcacaattctctaattcaacattaggtattctagtttaactcctgtgagttaaactgatgttcagcaaatatttgttgaataagccaggttttgtaactagtctggaaagcaaaccatagtttgtaagtgatttacagaatttcaaacagctggcttataaaacaaattctgaaatataccatgtgtataaatgggagactgccttgtttattcacataggaacctccaaacatatagaagtaaagacacaggtaatgcagtccttttg

SEQ ID NO: 190498 - DNA, 601 bp, Human
gcatggcggaaaaaaattctgccatgaattcacaattctctaattcaacattaggtattctagtttaactcctgtgagttaaactgatgttcagcaaatatttgttgaataagccaggttttgtaactagtctggaaagcaaaccatagtttgtaagtgatttacagaatttcaaacagctggcttataaaacaaattctgaaatataccatgtgtataaatgggagactgccttgtttattcacataggaacctccaaacatatagaagtaaagacacaggtaatgcagtccttttgttgttgcttttgttactgatgagattaatttagagtctttggcaggccatcctaactttcatattactgtattaattctcttccttatagtttgatatttaaaactttatcttttagagatgcttataaaagcatagacaattttctcaccgaggatcaaaagaaccattttattgggtgttttgtagattacatttatgacagctgctgaactactctcacctgctatttatcagaatagataatgacttttctattatctttgtggttgtaactttccacaaagctagttttccttgtagc

SEQ ID NO: 190499 - DNA, 601 bp, Human
atttacagaatttcaaacagctggcttataaaacaaattctgaaatataccatgtgtataaatgggagactgccttgtttattcacataggaacctccaaacatatagaagtaaagacacaggtaatgcagtccttttgttgttgcttttgttactgatgagattaatttagagtctttggcaggccatcctaactttcatattactgtattaattctcttccttatagtttgatatttaaaactttatcttttagagatgcttataaaagcatagacaattttctcaccgaggatcaaargaaccattttattgggtgttttgtagattacatttatgacagctgctgaactactctcacctgctatttatcagaatagataatgacttttctattatctttgtggttgtaactttccacaaagctagttttccttgtagccacagtgattactaaaattgatatattacctccacttttcatttttattgtggtcaagcattttttataactatctcttagaaaataggaaaatatttgctcttccagactaagtgctattaggaaagaacatttctgaaaacgtgcctggcttggcct

SEQ ID NO: 190500 - DNA, 601 bp, Human
tgttaattggaagtgactagtttatctaactcttctaagacttcatagcaaagtatgtgttttataccaactttatcttgaatgcaaaaacttcagtagatactactaacagttcaaaccttgtatctcaattaaactctttgtatctttacatctactttccctttccatcctacaacccaccatccaatgtcttatattccaaatactcatcagcacttatacactcgatgagccctcagctccatgccttttgggtcttggcttctctcattcatacctttgatcaggcaacactaaygtgtcgagcatttaccaagcaccaagtattgagcaagtttccgaccacgcagatatggaacttaaaaaccccactgtccctcatacaagttaattttccaaaggaggaactctgcatgaaaacagagcattataataatgtagtttaagtactaacagtcagggaaaaaaattaagacaatacaggtgagttcttcacgctttttcctgtgcctgaagtgtctacttcccatgtctaccttcttcctcaacagatgttaatattcttatcatttaagaaccagcccaaatctttcttcat

SEQ ID NO: 190501 - DNA, 601 bp, Human
cacacagcaggttaatgttcatagacatttgtagtgtaacaatgccctgaattaccctcacacacgtattagaatgtaaaatattccctttatttctaaaatgttttaggcctaatagctttgaaacagctataaaaagtttctttcatcacattcttaaggaaatactgttgacaagttcagtaaaaataattgacttctcatcctcaaaagtgtgcttcctcagtttaccactgattgcaggaattagcctgttttaagtgatagagccacatcacgcttttcactcaggctggctccmgggatggcacaggttcagggctgctatatggaatgaagagacactatcaggtgaaattaaaagcaaggactttgaaacaagtagatctgaattcaaattccagctttaacactgtctggtggtatgacattgacagttacttaacgtttctaggccttgttcattcatctataaaacggaggtaaaagcattacaaactttacatgtttggaataaggatcagacgagacagagtatatgttaagtgcatgtctcagtataattttttatagcctcaactcactgctgaggagaggtatt

SEQ ID NO: 190502 - DNA, 601 bp, Human
aggcggatcacgaggtcaggagttcaagaccagcctggacaggatggtgtaaccccatctgtaccaaaattacaaaaattagccaggcatggtggcgcgcacctgtactcccagcttctcaggagactgaggcaggagaagtgcttgaacccagaagactgaggttgcaatgagctgagatcacgccactgcactccagcctgggtcacagactgatgagaccctatctcaaaaaaaaaaaaaagtaataaaagaaaaatgcaaaacagtttggaaatatctgatacagggaaacaacagsgtgattaaaaatgccaatcagacatctaaattggggcctagattatcagacggagtgactggagtcccaaattaatataatcagtgaagaaatattataaaaagaaaaagaattgctttctaaatagcaggtcttgcagttgctcaagtttccttagtcattatttcaaaactgtaactttgctttactatcaacataggatgcccagaatttgatcctgagacaggaagcctgtgtttttgaagtcacactttagtttagaattttaatttctcatgatcagaaaagataatgacaggt

SEQ ID NO: 190503 - DNA, 601 bp, Human; identical to SEQ ID NO: 24212

SEQ ID NO: 190504 - DNA, 601 bp, Human; identical to SEQ ID NO: 24213

SEQ ID NO: 190505 - DNA, 601 bp, Human; identical to SEQ ID NO: 24214

SEQ ID NO: 190506 - DNA, 601 bp, Human; identical to SEQ ID NO: 24215

SEQ ID NO: 190507 - DNA, 601 bp, Human; identical to SEQ ID NO: 24216

SEQ ID NO: 190508 - DNA, 601 bp, Human; identical to SEQ ID NO: 24217

SEQ ID NO: 190509 - DNA, 601 bp, Human; identical to SEQ ID NO: 24218

SEQ ID NO: 190510 - DNA, 601 bp, Human; identical to SEQ ID NO: 24219

SEQ ID NO: 190511 - DNA, 601 bp, Human; identical to SEQ ID NO: 24220

SEQ ID NO: 190512 - DNA, 601 bp, Human; identical to SEQ ID NO: 24221

SEQ ID NO: 190513 - DNA, 601 bp, Human; identical to SEQ ID NO: 24222

SEQ ID NO: 190514 - DNA, 601 bp, Human; identical to SEQ ID NO: 24223

SEQ ID NO: 190515 - DNA, 601 bp, Human; identical to SEQ ID NO: 24224

SEQ ID NO: 190516 - DNA, 601 bp, Human
ccagcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagasttcaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgatttt

SEQ ID NO: 190517 - DNA, 601 bp, Human
gcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagacttyaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaa

SEQ ID NO: 190518 - DNA, 601 bp, Human
aaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagacttcaagagtcataaaaaagattgcatcatctgacctaagactttcggaattttycctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtataaacatgatttctatgttgatagtactatattattctacaataaa

SEQ ID NO: 190519 - DNA, 601 bp, Human
ataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtatamacatgatttctatgttgatagtactatattattctacaataaatggaaattataaagccttcttgtcagaagtgctgctcctaaatcagactgtgtctaaaactttctttgtgtctctcacctaacacagaatcccagaaaatcccttcaaggatgttttcaatggtcttgagaaaagtaatgatgagttatcacacatgaaatcatgaaatcaggtcattcagaatcctcctggctcctagtctatagagtgtgtaatatttcttcaaaagtgaataacatagcacataattgttacat

SEQ ID NO: 190520 - DNA, 601 bp, Human
tctatgttgatagtactatattattctacaataaatggaaattataaagccttcttgtcagaagtgctgctcctaaatcagactgtgtctaaaactttctttgtgtctctcacctaacacagaatcccagaaaatcccttcaaggatgttttcaatggtcttgagaaaagtaatgatgagttatcacacatgaaatcatgaaatcaggtcattcagaatcctcctggctcctagtctatagagtgtgtaatatttcttcaaaagtgaataacatagcacataattgttacattttacagaracttaatgcttttttaaagctgatgaaaaacaggattcacctcaaactttcattacaactttaaaactaaatagcaaaggcctgaaatgtatatgctgcgtatgaagtactagtgaatcagttcagggtaattcattgcttctgctcctcagaagccagtgtgaaaaggaaagactgaagtacatgatgtaaggcagtttcccaaattgagttctcgggaacactactaagaatcagtattgtcctgcaatgcattattgtactctagaatcagagcacctgtgttgaaattctggtttc

SEQ ID NO: 190521 - DNA, 601 bp, Human
atcctcctggctcctagtctatagagtgtgtaatatttcttcaaaagtgaataacatagcacataattgttacattttacagagacttaatgcttttttaaagctgatgaaaaacaggattcacctcaaactttcattacaactttaaaactaaatagcaaaggcctgaaatgtatatgctgcgtatgaagtactagtgaatcagttcagggtaattcattgcttctgctcctcagaagccagtgtgaaaaggaaagactgaagtacatgatgtaaggcagtttcccaaattgagttctcrggaacactactaagaatcagtattgtcctgcaatgcattattgtactctagaatcagagcacctgtgttgaaattctggtttctgcacatcctaactctgtgaaaagtaaatctctctgagccttaatttccttatatttaaagtagacacaataataccactaccttataaggttgttttaaagtgctcagcacagttattggcatatatacctatatatgaaatgctcaataaatatgaactcattatttccttaagattttcataggtgttatttgacaaaggcttttatcatcaaa

SEQ ID NO: 190522 - DNA, 601 bp, Human
ttatttattttttatttttgagacacagttttactcttgtcacctaggctgaagtgcagtggcatgatctcggctcactgcaaccactgcctcctgggttcaagtgattctcctgcctcagcctcccaagtagctgggactacacaggcatgtgccaccacgcctggctaatttttgtatttttgctagagacaggatttcaccatgttggccaggctggtctcaaactcctgacctcaggtgatcctcctgcctcagcctcccaaagtgctgggattacaggtgtgagccaccacgcccrgctcattgttttataataacagcatgaaaaggactaaggcaaggtatctgtttaactttgtgagaaactgccaaacctgtttccaaagagattgtaccattttacctgtcctctagcaatgttcacaaattccaggcgctctatttcctcaccaatttttggagctgtcaaactttcaaattttagccatactgatggatgcatagttttattacattgtgctttaaatttgcatttattggatactaatgatgttggacaatttttcatagccttatttgtcattagctaatatatctt

SEQ ID NO: 190523 - DNA, 601 bp, Human
caagcaattctcctgcctcagcctccagagtagctgcgattacaggtccccactaccatacccggctaatttttatagttttagtagagacggggtttctccatgttggccaggcttgtctcaaactcctgacctcagatgatccaccctcctcagcctccctcccaaagtgctgggattatagtcgtgagccaccatgcccggcctgtaatagtactttttaaattttcattttccagttgttcattgaaaatgcaattaattgatttgtatatattgatcttgaccttttgaactttarggtggggtttgtttgtttagtttgttaggattttccatatgcttgattgtgtcacccatcatcaaacagatttttacttcttcctttctaaatttcataactttaataactttttactgtccgtttcactcttttggacctccagtacaatgttctgtagaagttttgagagcagccatctttgcattgtttccaaatttagagggcaagccttcaggtttttatatacaggatttttttgtagatgacctttattttcatgagcaattttttcattttcagtttgccgagaattttttt

SEQ ID NO: 190524 - DNA, 601 bp, Human
catataatatggatttttccaattctctcttcagttctgccagtatttgtctcatgtattttggaactgtgatatttaatacatgcttatttaggattgacaagtctttttcatgaattgactcttaaattgtgaaatgtccgttttttctctgttaatactctgtgtctaatatgaatgtagccattccagctttctttttttttacttttttaattaattaatttttttttggtagagggacggagtcttgctctgtcgcccaggctggagtgcagtggtgcgatctcagctcactgcmagctttcttataattagtatatgttttttccattattttattttacctatcagcatctttatgcttttatacttatactttatacttaatgtatgtatcttatttacagcatattattgggtattggatccaatctgatcatttctggcttttaacttgaatgtttaatccatttttctttaattattaatatgactgcctttaagtttaccatcttgctatttgttgtccacctgtctttatttttatctcctctagactaattggtattttcattgtattttattttatcactttttt

SEQ ID NO: 190525 - DNA, 601 bp, Human
catcagtaaacatttaagctccttatcattatcagtgttttaatatttatttgtaggtttcttttctaggtaaaatttgcataaagtaacaaattgcataattcaagtgtaccatttgataatttttgagaaatgcatatatatatgcattacctaatatcctattaagatatagaatattaccatcaccagaaagtaacattcttccccttatcagtcaatcctttctacccccaccttccccacctccccaaacaatacaactgtttttatttccttttttagaatagttttttttttwtatattctagaactctgcgtatgtggacccatacagaatgcgctactgtataactgtaccttcactcagcaaatgttcttgatattcacccatgctgttgtgtgtatcaggcattttctccttttgtttgccatggagtggttttgttttgtttttgttttgtttaagaatgcagaatgatttgtttattcattctctgggtggtgaacatttgggttgttatcagttttggggtcttttgaataaagcttctgtgaactttcttatccaagtttcttaatggactaccgcttttacttc

SEQ ID NO: 190526 - DNA, 601 bp, Human
aaatgcaaacggggcagtttttgttgctgctgttgttcttgtttatttttgtgccctttatgtatttgttatgtttttctttggcagattttaagatcaccttttctttattgattttgaaaatcaaattatgatggcctgtggtgtcctttgtgtgtgtgtgtttcttacttagagtttattaaacttctcagttctatgtgtttatatttttcctttactgtgaacaattttcagccattttcttttcaaatatgtctagctttccccctcactctttctcttcttttagtactccagytgaaattaggatagaccactgctatccaattagtagtgccccacagatcactgatctcgttatttttatttcttcctttttcatccttttccctgctctgtgtttgtgtagtttccaatgtatgctggccattttctttgtgatgtctaatcgatagcattttctttatttcagaattgtatcttttagcttttgaatttccatatcttcattgaaaggtccctattgatattttctatttgctgttcacagtgttcatggttttaaaaaaattgaacaaatacacatagaatactcatt

SEQ ID NO: 190527 - DNA, 601 bp, Human
atatgtctagctttccccctcactctttctcttcttttagtactccagttgaaattaggatagaccactgctatccaattagtagtgccccacagatcactgatctcgttatttttatttcttcctttttcatccttttccctgctctgtgtttgtgtagtttccaatgtatgctggccattttctttgtgatgtctaatcgatagcattttctttatttcagaattgtatcttttagcttttgaatttccatatcttcattgaaaggtccctattgatattttctatttgctgttcacartgttcatggttttaaaaaaattgaacaaatacacatagaatactcatttttaggtgtttatctgataattccaccacttttgtcaatttttgttctgttttgattagctatctttttattagctaatatagacttttttgcttttttatatagctttttaaaaattatatgctggatattatggatgttacaattttgagttctgaatttcgtaagacagtgttaaattttgttctagcgggtaattaaattacttgcataactgcttgcttttaaaaaagcatcttatctttgttaaag

SEQ ID NO: 190528 - DNA, 601 bp, Human
ttttgaatttccatatcttcattgaaaggtccctattgatattttctatttgctgttcacagtgttcatggttttaaaaaaattgaacaaatacacatagaatactcatttttaggtgtttatctgataattccaccacttttgtcaatttttgttctgttttgattagctatctttttattagctaatatagacttttttgcttttttatatagctttttaaaaattatatgctggatattatggatgttacaattttgagttctgaatttcgtaagacagtgttaaattttgttctagmgggtaattaaattacttgcataactgcttgcttttaaaaaagcatcttatctttgttaaagcaggtctaaaatagccttttctgtaaggttagattggacctacttctaaagcatgtcatacctgaagtctctaattaatactggggagctaaacacagtctcttcactctgagtggcctgtaccaaatgtctcacagcccttcatgtgctcctagagttgatctgttcccagctattctttgcctaaccttttaaagtattcccccaaatatgtgtagctttgtatttggccgaagact

SEQ ID NO: 190529 - DNA, 601 bp, Human
ttcctagagaaacgtgattgtagagcaagaactcaaaacagggaaaatgccaagagctaaccaaggtggttacctggaaatttgggctttgaagccagttatttacattgaactacaaaagggatggaaaaaatactgatttaaggactaacaaccatcaaggagctaaatctggctacatcctgaatcagaatattagtaaaatcaatgagagaagtttaggagtccagtttggtcgtactacatcatgtctttctgataggaaattctttttttatttttatttttatttttttgagayagagttttgctcttgttgccaaggctggagtgcaatggtgcaatcttggctcactgcaacctccgcctcccaggttcaagcgattctcctgcctcagcctcccgagtagctgggattacaggcatgcgccaccacacccggctaattttgtatttttagttgagacagggtttctccatgttggtcaggctggtctcaaactcccgacctcaggtgatccaccggtcttggcctcccaaagtgttggggttacaggcgtgagccactgcgcccggcctctgataggaaattctttagtct

SEQ ID NO: 190530 - DNA, 601 bp, Human; identical to SEQ ID NO: 24225

SEQ ID NO: 190531 - DNA, 601 bp, Human; identical to SEQ ID NO: 24226

SEQ ID NO: 190532 - DNA, 601 bp, Human; identical to SEQ ID NO: 24227

SEQ ID NO: 190533 - DNA, 601 bp, Human; identical to SEQ ID NO: 24228

SEQ ID NO: 190534 - DNA, 601 bp, Human; identical to SEQ ID NO: 24229

SEQ ID NO: 190535 - DNA, 601 bp, Human; identical to SEQ ID NO: 24230

SEQ ID NO: 190536 - DNA, 601 bp, Human; identical to SEQ ID NO: 24231

SEQ ID NO: 190537 - DNA, 601 bp, Human; identical to SEQ ID NO: 24232

SEQ ID NO: 190538 - DNA, 601 bp, Human; identical to SEQ ID NO: 24233

SEQ ID NO: 190539 - DNA, 601 bp, Human
cacctcttctttctgattccctcagaagtgacccacactacttacatggcatgattctccatttatgggttgtactggaatttgtgacttaccctaattttttgaattgaggtcctaactcacttatgaattaagcatcaccttgccttctaaactccaggtcaccctggctggcaggcttgattcaagtcctcaagtgtcatccaatggaaaacagacaagggttccatataacaaggacacacagagctgggcacaaaaatagccccaagagggtcatgtacacaagggtagggcagargatggacagcagggcagaattcgtagaaggggcaggcaggagagctgctagtcctgtatgatgctgtcaacatgggaggcagatggaaagacaaagctgtggaaggggaccaggagccaggctgtgcagaggctctccatgagcaaactcagcctgaaaaatgcagagctggaactgagggtgggggtggggttgcagtggggtgtctcctgggatcacatacccaggtgtcagtctagcaaggtaaaggcaaaacccccatggtagatgacttctttgaccccagatagtgccgtggcc

SEQ ID NO: 190540 - DNA, 601 bp, Human
gcatgtggcaagtttaagtggttataacagacaggaatcagtgggctggcacagaatcacagcaagctcatggagtctaagggtcatcttgggtcacaggctcgactttcctgactctgaataggattctagactgtgctatcaaaccagatgagggacatggatggtttctacttttcccctcacacttctattacacaaattgtctacaaaggcggggattattggtagattcagaagcaaaggttaacaagaactcaggtttggcaggtgagcgatgggtaggggagtggcctctccyatttctaaagctacgaagagtgaggccatctccagcacggcatttctcatccctttcggtccaaaggctgtacggattattcccagcacccccagtgcccaccccataccgtcactgacctgctttcggaacttcatccaggtacaggtgatgggctgagtgcctgtcactttgccaaacagctccactgactctcctgcgcgtaccttctggtcctcagggaactggatgatctgagggggcattgctgagggaggacagggagaaagtgagcgaggcagaagggtctcaggcattctg

SEQ ID NO: 190541 - DNA, 601 bp, Human
tgtctcttggctgaaaatgagaacctatacatgacatatgtgatacgtaagacttgtcacacaagagaagatgcaaaatttggggcgagggactttaattccaagtaaaactccaacatttttaaggaatttgctaccaaattaaggagttcagaaaagacccaagtcagaagtcctaggagattggaggcctcccactcctccacctgcctttagagctgtgggctgcacctaatgctttctgttctttctaagctatgagccccatgcagtggctgaactagtaaagggatgaaaactstcagaaaagaacagatgtccttagaacagggagctcctgtgagcttgtcctccacggcgacacactcagactgggagggagaccctgggcatctctgggcaaaggagactccacatttcctctgaattctcccagggctccctggaggcttgactaacagaataggaaactcagctcagtctaagacaagagtctccagtggcaccagctccaggattttctcctcagcaaatgttctaatttccaggaaaatggaggatcctgtcctacagcttcccactagagtaactgctcttgagg

SEQ ID NO: 190542 - DNA, 601 bp, Human
ttctgccctcttcctcctcccccttggtaatccagccagcctcagctggggagtagcttcctgtctggaagccctgggtggactggactcctcctctggatttcaagtgatttcaacattgccctttgtctattcccagctgggaggggtggcagcaggggaggggagtctgaaggcccagagagggttcagcgggctgatggcagggaacaagggagaggccacttgccccagacaggcagtcacagctcttcctcctggcagagtctccacacagccctgggagcagctgtcctagacycctgggggccacaccttgtagctcccgtggcctctggtcctgctgcctggggttagtcggggattctccagtctctccctctttacaccatagcacagacctggatgatttcctttccagccaatgaacatcttcacactgcaatcttactccttttcctgtcacttttccaagtaacatcctaacaccacagactggaacttgattgcccccctgggacccacactctatgcagcccccactctgctcatttcagagggatgttgtgtgtgtgtgtgtgtgtgtgtgtgtgtgtgtgtg

SEQ ID NO: 190543 - DNA, 601 bp, Human
tccagcccctctttctagtgcactgtgttcctttatgctgcaggaaactcggatcaagagtccggactaagcagggagcagtggcaagtgcctgtagtcccagctattcgggaggctgaggcgggaggaatgcttgcgtctaggagttcaaatccagcctgtgcaacagagtgagacccgatctctttaaaaaagagaaagattccaggctgctacatccccttctgcttttcccttcttgtcctgcctctcttctatttgaccacaaggggaggagtgagagagaagtagaggaaagacyacagttcaattagcagagctcttggtgcataaagggttgttgagaaaggtgaactggtttccatctttccactagggaagggtcttccactgaacttaaaaaaaaaaaaaatctgttcagaatgagctatgagatccatgagctaagtggaaggctatttggaagatggttctgagatatttctgcaaacagatgagagtctcgttaccctggagtgtttgggagaggatcagctgagtgctcaggaccctcacatggcacaagtccagtcagtcccctggacagagaattgtcccttcc

SEQ ID NO: 190544 - DNA, 601 bp, Human
aggcaggccccagggagcaacaggaagctgaggcactgaatctaactgtgagacccgcaccaccctcaccctgggagcccagaggcaacttcccactccacttacgatcctaatctctcctcaatgtcgtagaagtcagatactttttgttcagtattgattgtcactgtccggtaatcaacctcgggctccttctcatctgtggggcacaggtcagggttggtgtgagtctcagatgcccccactcagccccctccaccccaagagcctgacccgaagacaggggctgcactcaccatcrtctgacacctccacttcatccttcggctctggggggggcacaaggaaggacagagaggacacaggtgattagtactgaaggcccactgagagcaagatgtgctgggggccctgccaggcctcagcctccccaggcagacgactaccaggtccagagctctgggcatcccctggggctggtcagtccatatagcaaatagggcccagtgcagactggcaggtgccagcctcctccctccactcagctccacttctccaccaggtctcccctctgtcccatcctctctagcctcatggtccc

SEQ ID NO: 190545 - DNA, 601 bp, Human
tttataagtaaggtgttactggagcacagccctgcctggctgtttgcatgttgtctatggcagcttttgtgctacagtggcagagctaaaggcatatcgcccataaaatctaagatatcagcctttatgaaaggcccagactcctgctctagagcaatgaggcacatttgttttttcttatctttaaacatttttttttttttagagatggggtctcgctatgttgcccaggctggtcttgaactcctggcctcaagcaatcctcccacctcggcctcccaaagtgctgagattacaagcrtgagccaccacacctggcctttgaagcacatttctaatgttgacaagcctactgtcaactttggctgatggcatctcttcccctccctgcagtggaacccatgaagatgggtggagacagcccttcccaaatgcagagtattactgagcagttgccttccttccttccactccctaccactgaccccctggtgatggcccaggcagggtcctgcttcctactgctgagagaggggagagtggggctcctctgtgatggcactgacttctttctgacactgttacccagtttgcatcactc

SEQ ID NO: 190546 - DNA, 601 bp, Human
atgaaagggggaggagagaaaagccacatttagccaagctttccgctaacttggggttggcaaattatggcccatgggacagatctggcccacctccttttataagtaaggtgttactggagcacagccctgcctggctgtttgcatgttgtctatggcagcttttgtgctacagtggcagagctaaaggcatatcgcccataaaatctaagatatcagcctttatgaaaggcccagactcctgctctagagcaatgaggcacatttgttttttcttatctttaaacatttttttttttttagagatggggtctcgctatgttgcccaggctggtcttgaactcctggcctcaagcaatcctcccacctcggcctcccaaagtgctgagattacaagcatgagccaccacacctggcctttgaagcacatttctaatgttgacaagcctactgtcaactttggctgatggcatctcttcccctccctgcagtggaacccatgaagatgggtggagacagcccttcccaaatgcagagtattactgagcagttgccttccttccttccactccctaccactgaccccctggtgatggcccag

SEQ ID NO: 190547 - DNA, 601 bp, Human
gtgggaggatcgcttgaacctgggaggcggaggttgcaataagccgagatggcaccactgccctccagcctcggcgacagagtgagactctgtctcaaacaacaacaacaacaaacaaaccaaactaaaaaagcaaagtatatgacagtgagtataagaagttactttttgtgttaaaaggcaagaaaataagaatatatatatgtgtgtgtgtgtctgtatacacttatattttcataaagaaactttggaaggatacagataaaagccaataaaattgtttgtgttggtgatggttgtrgtgtttaggaaaggatagacaggaataatggtggaaattagacttttcactgtgtatttcctaatattttttgaggtgattgtagcatatattctaaaaattcagataaaaaaggaaactgttaagaatgcagatgctgtgggggatgcctggcttgctgatgccagtgtgcatgcttgactgtatgtgtgtgtgtgtgcatgtgtgtgtgtgcgtgtgtacacgcatgcaccaacagctcagaggtaagggaggtggaggattcaggtgcagaagaaacaatgaattctgcgaaaggct

SEQ ID NO: 190548 - DNA, 601 bp, Human
ggtggcaggctcatctctagacccttatttgcctccgactatatttggcacagacaaggtgctccaaaatgtttacatttaaattttaaatattctgaaaaagcaagcaaccattgttttcaatgcccttgggaatgtctgaggcagtgagtggtgggaatctgagccatggagataattcctgctgcatttctggaggaaacctattcaatataaattcaaataggttcaatcctattcagatatacttattatattttgaaaactgttcctatggttcaactttctaagatggaagggrttaaagaggcaggattaatggttctgtgggtttatcttcaaaatacttaatgctatgggtggaaaatattggtttgatagacagaaactgccacccacagtaatgggataatgccaagggccaagattaggcttaaattaatggtgagtgagtgaatgactaaataaataagtgatccctatcctaaggaatcagattcatcccccaaaccctagaccttggctagctctcataggaagcaagaaggaatggtgctatcactggactcgagaccctccgctccttgccctatggcagcca

SEQ ID NO: 190549 - DNA, 601 bp, Human
tggccagggtaggctgggggtaggagaaattggcaggaaagcccagggaatgggggtgatgggcaattcctgaatccccaccctccgacatgggagaagggtcagggcctcctggtttcccatcagggaaccctgccctgcaccttctaagctgctggggactcagggaagcatctacactaggcagtttcagaggtgggtgtgaacacagagatccagacatgatcttcttagcaaaaagagtgacctctaaacagtctctttccctcaaatgaccacacatgcctaagggaacattctygtactctagccgtgtcttttagtcacagggaactcaagttcaaaatactcacagttcccacaagcatttgttctgcatagccaggaacggaaaaatatcttcaatcatcaataatgagcctcagcaaattttctaaaattagttggctgtaactcattatacctacagctgtgacagatttgcttactctggccaggcctatagtattggtttactccctgcagtcataattaactggtctcccttggaccccttccttaccccagctgtgtaatcctttctaactggataggctttgga

SEQ ID NO: 190550 - DNA, 601 bp, Human
ggtggtcaggccacaggctcatggaggccaggctggcagggagtctggccagggtaggctgggggtaggagaaattggcaggaaagcccagggaatgggggtgatgggcaattcctgaatccccaccctccgacatgggagaagggtcagggcctcctggtttcccatcagggaaccctgccctgcaccttctaagctgctggggactcagggaagcatctacactaggcagtttcagaggtgggtgtgaacacagagatccagacatgatcttcttagcaaaaagagtgacctctaaacrgtctctttccctcaaatgaccacacatgcctaagggaacattcttgtactctagccgtgtcttttagtcacagggaactcaagttcaaaatactcacagttcccacaagcatttgttctgcatagccaggaacggaaaaatatcttcaatcatcaataatgagcctcagcaaattttctaaaattagttggctgtaactcattatacctacagctgtgacagatttgcttactctggccaggcctatagtattggtttactccctgcagtcataattaactggtctcccttggacccctt

SEQ ID NO: 190551 - DNA, 601 bp, Human
tgtggatgtactccactccctccgagatctgccgcatgtacttgatgcactcacgctccgtcagctcaaagtcctcgtcaatgatgcgctcaaacagctcccctcctgacacgctgcgggaacacgtgcacggggtggtcaggccacaggctcatggaggccaggctggcagggagtctggccagggtaggctgggggtaggagaaattggcaggaaagcccagggaatgggggtgatgggcaattcctgaatccccaccctccgacatgggagaagggtcagggcctcctggtttcccaycagggaaccctgccctgcaccttctaagctgctggggactcagggaagcatctacactaggcagtttcagaggtgggtgtgaacacagagatccagacatgatcttcttagcaaaaagagtgacctctaaacagtctctttccctcaaatgaccacacatgcctaagggaacattcttgtactctagccgtgtcttttagtcacagggaactcaagttcaaaatactcacagttcccacaagcatttgttctgcatagccaggaacggaaaaatatcttcaatcatcaataatgagcctc

SEQ ID NO: 190552 - DNA, 601 bp, Human
aggacagtggcctatttgtttaatttattggtggtcactgttcaaaggcaggccctgtatgccagccactgcccctaccctgtcctcttagcaggagtgagcagagcagagcaggcacatgcgcccagcgccgaggcatgtttctcacctgactgcgctgaccaccagaccggtcatagtctatcggaacctcgcccctgcttacccctttcctctttatgaccaacacagcctcagccagcactgaacatcgtgggagacatttattgggtggcattcatttggcccctcctttctactmcctgcagggtggtgaaataaagccagctcaccccagccctcgggctccttgctagcagggcagtggctaagaagggaggatgaagctgtttcctcaatcaccgggacatcaaagggctgcagaggcaggctggatgcaggcagaatgtgagccaggcaggcatctaccaaagtgctttcagggcggccttgagaccctgaccgcctacccctgtgacctctctcctggctagcataagaatcagaggtgctgcagagcaccctgagcaaggtctggggtccttgttccaatcccagcaca

SEQ ID NO: 190553 - DNA, 601 bp, Human
gggataggaggggagcctgccaccctcctgactctggggggggctccccatcatgacaatggcagggcagcctggggaccctcctgtggaaccctcagcccccacccactggtccaccaagtggtccaccagtccaccaagtgccccaggactcacaggatgtagcagatgaccccgatgctccacatgtctgtggcgtagccgatgggctcatagttgatcacttcaggagccacaaattctggggtgccaaagaggaccttcagagaccccgcgttctctgaaaccaggatggagaggsataaattgccagcacatcacggagccagcttgagaccagcagctgcccgaatctgtgtgttgaccccaacctgggaggggccagacacaggctttggcacagagaacaggcacagagacatctgacctccttgttaaacaggtgcgtcaacacaccagtgaaaccaacaaacctcacactcacctcaaatgtcctgtgcagggtgggcagggggagaagaggccgctaaatcacccgcccctgaatggtctttttgtgagtctgtctcatgagttagttcccctaggcagggactgtgac

SEQ ID NO: 190554 - DNA, 601 bp, Human
agcccaggagcagggtgggctgccagggataggaggggagcctgccaccctcctgactctggggggggctccccatcatgacaatggcagggcagcctggggaccctcctgtggaaccctcagcccccacccactggtccaccaagtggtccaccagtccaccaagtgccccaggactcacaggatgtagcagatgaccccgatgctccacatgtctgtggcgtagccgatgggctcatagttgatcacttcaggagccacaaattctggggtgccaaagaggaccttcagagaccccgcrttctctgaaaccaggatggagaggcataaattgccagcacatcacggagccagcttgagaccagcagctgcccgaatctgtgtgttgaccccaacctgggaggggccagacacaggctttggcacagagaacaggcacagagacatctgacctccttgttaaacaggtgcgtcaacacaccagtgaaaccaacaaacctcacactcacctcaaatgtcctgtgcagggtgggcagggggagaagaggccgctaaatcacccgcccctgaatggtctttttgtgagtctgtctcatgagtt

SEQ ID NO: 190555 - DNA, 601 bp, Human
taacagggaggggtgccagagggctgtgggggcctggcagtgcttggtttcttgatccgggtagaggttacacaggtgaaaacttagtgagcagtctagtcactgctctgtcactgaccagtagagagaccaattgtcctggtttgcctgggactgttcccatgttagcaccaaaagtcctgtatcctggcagactgggacgactggtcccctggcccgactgtgggaagtgggcagccacgtgggcttccttggcccctgtcacctcaacgccacatgaagatggaatccctgccatgayccactcttgggtttgttgtgagcatcaaacaaggtcctatgtgaaaatctgtagctgcagaagatcctgatgccacggcagtgggaaaacccactgaagaataaacagtaaggcaagtctccatgacggctggagggggaccctgggaccaagcgagaccacagcgcagctggggctgaacagtgagagctgaccaaggactgcttctcaagggtctggtgtttttcccagggccagaggttagcactgcccaggcctggggccgccctgaaaggggcaggctggccccgccccctaccc

SEQ ID NO: 190556 - DNA, 601 bp, Human
ctttttctttgtggcagaatttgcataagggatcatgtcttttaattttttttttttttttttgagatgcggtcttgttctattgcccaggttggagtgcagtagtgcgatctcagctcactgaacctctggctcaagcgatccttccacctcagtctcctgagtagctggaaccacaggtgcgcgccaacacacctggctaattttttgtattttggtagagatggggtttcaccatgttgcccaggctagtctcaaattcctgagcttaagcaatcctcccacctctgcctcccaaagygcattacaggcatgagccactgtgcccagccttgtctttttatttataaaatagtcattattattatttctttttatttttttgagacagagtctcgctctgtcacccaggctggaatacagtggcgtgatcatggctcattgcagcctcaacctccccaggcttaggtgaccctcccacctaagccacccaagtagcagggaccacaggcgcacgccaccatgcccagctaccttatgtatttcttgcagagatggggttttgccatgttgcccaggctggtctcaaactcctgggctc

SEQ ID NO: 190557 - DNA, 601 bp, Human
ctctggcctctggcactcctccttcctggcagcctatccatctgaaatactctcctcaccctgcctggctccttgcctgcccaagttcccccagcattcttcctattaaagagcatgtgtctggaataaaaaatataatacatacacagcatgttgacaaagagggtgtttgaattttcagtaatgctgttgctgggtggtggggttttacaggatttttaaaaacctttttggggaactttttctttgtggcagaatttgcataagggatcatgtcttttaattttttttttttttttttgagatgcggtcttgttctattgcccaggttggagtgcagtagtgcgatctcagctcactgaacctctggctcaagcgatccttccacctcagtctcctgagtagctggaaccacaggtgcgcgccaacacacctggctaattttttgtattttggtagagatggggtttcaccatgttgcccaggctagtctcaaattcctgagcttaagcaatcctcccacctctgcctcccaaagtgcattacaggcatgagccactgtgcccagccttgtctttttatttataaaatagtcattatt

SEQ ID NO: 190558 - DNA, 601 bp, Human
caccgcgcctagccagcttctccttttatacatcaaggggactaggctagatttcctaggggcctcccagctctctctgtctctgtgaccccgacccccacgtggcccatgcaagccccatcaggaagcagcctgtctcttgcctgtcagccacctgctgcttctttacattttccactggaaacagagaggggggaagtccggcagtactccaaaagatggcaggaaaagcaaacaaccctgctgtggaatgcagaaagttccccttctgcaaacctcccttccttattaggaactatamtcctgcaaagataggtcttaatctctgcaactctgggcacagtcagggagagcctcctcgcctctggcctctggcactcctccttcctggcagcctatccatctgaaatactctcctcaccctgcctggctccttgcctgcccaagttcccccagcattcttcctattaaagagcatgtgtctggaataaaaaatataatacatacacagcatgttgacaaagagggtgtttgaattttcagtaatgctgttgctgggtggtggggttttacaggatttttaaaaacctttttggggaac

SEQ ID NO: 190559 - DNA, 601 bp, Human
ctgggattacaggcatgagccaccgcgcctagccagcttctccttttatacatcaaggggactaggctagatttcctaggggcctcccagctctctctgtctctgtgaccccgacccccacgtggcccatgcaagccccatcaggaagcagcctgtctcttgcctgtcagccacctgctgcttctttacattttccactggaaacagagaggggggaagtccggcagtactccaaaagatggcaggaaaagcaaacaaccctgctgtggaatgcagaaagttccccttctgcaaacctccyttccttattaggaactataatcctgcaaagataggtcttaatctctgcaactctgggcacagtcagggagagcctcctcgcctctggcctctggcactcctccttcctggcagcctatccatctgaaatactctcctcaccctgcctggctccttgcctgcccaagttcccccagcattcttcctattaaagagcatgtgtctggaataaaaaatataatacatacacagcatgttgacaaagagggtgtttgaattttcagtaatgctgttgctgggtggtggggttttacaggatttt

SEQ ID NO: 190560 - DNA, 601 bp, Human
ggaggcggtccatgcccggagatctcatgcagttctgctgggttccctccactgccttaccaagctgtgagtgcaggaatgactttgtgaccagcagcttaagccaaataaactttataaggtaaagaatttcaaaacaaaatagagcagatttgtggcttactgaccttacctctcacctctgtgcacctcaccttcatagcaacaactcaccccactgttcatgagggccttgtgagtcagcctcatgggtgttagaccagcacagttgcccacagtcccacccttagacaggccctgkgcttggtttaatgctctgctgctgtcgtctcaagattctcaataaggtttgaacaagtggccccacctttcatgttgcaaattgtgtagctgttcctgccctgatctcagctgagccccatgagatgggtctgggggccaggcgtggtggctcatgcctgtaatcccagcactttgggaggccaaaatggatggatcacctgaggtcaggagtttgaggctagcctggccaacacggtgaagtcctgtctctactaaaaatacaaaaattagctgggcatggtggcaagcacctgtaatc

SEQ ID NO: 190561 - DNA, 601 bp, Human
aaattgcagtgttcagcactggcaccaggcctggtccacagtaaggaggcggtccatgcccggagatctcatgcagttctgctgggttccctccactgccttaccaagctgtgagtgcaggaatgactttgtgaccagcagcttaagccaaataaactttataaggtaaagaatttcaaaacaaaatagagcagatttgtggcttactgaccttacctctcacctctgtgcacctcaccttcatagcaacaactcaccccactgttcatgagggccttgtgagtcagcctcatgggtgttwgaccagcacagttgcccacagtcccacccttagacaggccctgtgcttggtttaatgctctgctgctgtcgtctcaagattctcaataaggtttgaacaagtggccccacctttcatgttgcaaattgtgtagctgttcctgccctgatctcagctgagccccatgagatgggtctgggggccaggcgtggtggctcatgcctgtaatcccagcactttgggaggccaaaatggatggatcacctgaggtcaggagtttgaggctagcctggccaacacggtgaagtcctgtctctacta

SEQ ID NO: 190562 - DNA, 601 bp, Human
agtaaattgcagtgttcagcactggcaccaggcctggtccacagtaaggaggcggtccatgcccggagatctcatgcagttctgctgggttccctccactgccttaccaagctgtgagtgcaggaatgactttgtgaccagcagcttaagccaaataaactttataaggtaaagaatttcaaaacaaaatagagcagatttgtggcttactgaccttacctctcacctctgtgcacctcaccttcatagcaacaactcaccccactgttcatgagggccttgtgagtcagcctcatgggtgttagaccagcacagttgcccacagtcccacccttagacaggccctgtgcttggtttaatgctctgctgctgtcgtctcaagattctcaataaggtttgaacaagtggccccacctttcatgttgcaaattgtgtagctgttcctgccctgatctcagctgagccccatgagatgggtctgggggccaggcgtggtggctcatgcctgtaatcccagcactttgggaggccaaaatggatggatcacctgaggtcaggagtttgaggctagcctggccaacacggtgaagtcctgtctcta

SEQ ID NO: 190563 - DNA, 601 bp, Human
ttcttcatcctcatcatcatcatgatggcagcagacattcattgaggtttttctatgtgccaggcactgggtcaagtgcctaaaacaagtgaactcacttaatcttaacactgccctatgatgcaagtaattcttataactttgttttacagatgagggaattgaggcacagcccaggctcaagtcacctgcccaaagattcacagccagtgagattggaagccaggtatctgcctctagagcctgtcctcttaaatgctatactatcctaacatttctgtaaagatgaagtaaattgcartgttcagcactggcaccaggcctggtccacagtaaggaggcggtccatgcccggagatctcatgcagttctgctgggttccctccactgccttaccaagctgtgagtgcaggaatgactttgtgaccagcagcttaagccaaataaactttataaggtaaagaatttcaaaacaaaatagagcagatttgtggcttactgaccttacctctcacctctgtgcacctcaccttcatagcaacaactcaccccactgttcatgagggccttgtgagtcagcctcatgggtgttagaccagca

SEQ ID NO: 190564 - DNA, 601 bp, Human
ggagagacaagagcaggacagcaggtgtggctaggagagggcgcgacgaccaggtgagtggtaactgaggtcaaaggcgagggtcggccagcctccccacccccaaactcatgctctgtgggccttgcacctgcctttcttccacttgtggaaagaaaagagggtgtggttcacagccctgtcttttcttggtcacctgcctcttgacaccacctacctgtgaggctgaggtgcagcaggttggctttagattacgggcttctgcagggtacgcggcagggctgataagtccctctgtccyggttttctattattccccaaagcccaggctagagccttctccaagccccttcctcccgtgctcctgccccctctctgtggactgggcacatggtagtgatcaccactgcacccttctgtcccctccttcccacctctctccacacaccttcagctccaagaagagggcccggcaaataagagaggctcagcaagtgaagtgtgtgcccaatggatagatggactttgaatcagcaatgtaggttcggggaacttgaggcatttatgccaaactagaaaacttccctatgaggtgccatgg

SEQ ID NO: 190565 - DNA, 601 bp, Human
tgatcgggacccacagagaagttctaagatgcccgtgtcctctgctcttgcttgttgagagggtccttcccctgcagcccctgaagagggctgtggctggccacaactgtacccagaaaataagaagggtggtcattattcacacagaacagctgccccttgctctgtaacgtggtcaagtgtcgcttttcaagtcaggtgtctgagcctctgaaggtgaatcccatgtctagctccagggggcagggcctaggaagtcgcctccccaacccacatgcattcgggtctcttaccatgcccrccctcccttcctcagggaatgctaggaacgacccaaggcggggtggcaaggagggcaccccaacaggcaaaggaatccccctttgcttcccaacacagggcagggagtagggaagcaaagactgaaatcccaactcattacttcatatctttcttcagcagattgctgatgaaatccttggcatcgtcggagatctcatcgaatgcctcgtcgtcgaagtcccaggtggctgaggtaacgttggccaaggtttcgttatcgttgtctcccatgaagggggaaaggccactgactctggag

SEQ ID NO: 190566 - DNA, 601 bp, Human
tgcagagcccaggacagttccttccaggagattctgtctaggcacacccactgcccaccttcagccaacctcccactctggtctcctctacaactccaagctccaatcttctactgaaacccagagggcttgagtgcctgacctttccccacagcccatgcatgctgacctcccactgttcactttcctatgttcacagctgcagcaggcacaggtggggaacctcaacagaggaggagctgggagagggctaagcccagtggtctgggatcatagcctccctttggccagatgttagaasgtacctggctgtattcaagcaggcagttattaaataactgagatataaaaaaacactaagccagaataataataataatctggggatatgatcgggacccacagagaagttctaagatgcccgtgtcctctgctcttgcttgttgagagggtccttcccctgcagcccctgaagagggctgtggctggccacaactgtacccagaaaataagaagggtggtcattattcacacagaacagctgccccttgctctgtaacgtggtcaagtgtcgcttttcaagtcaggtgtctgagcctct

SEQ ID NO: 190567 - DNA, 601 bp, Human
agttaaatcctaggataaaatctccgacaatcactgaactttcatgtttaatgtcttacggtgttgttgaatatcaggtttttccattacaactcaaagaagtaggtcctgcctataacctatgaattatgactactttagaactgcgctgaaactcacttcatctttctgaaagctctggggatctagaaacattttagagccattgccttaactgtaacaggactaggaaagcctaaagaaccaaatgctaacatacatagaaaaatgactggaaagaagtatagcaaaatgtagtgawctttagataaagggattatagatgatttaaattttattatattcttcaaatcctctataattttcatgcattatttttatagtaggaaggaattttttttttaagtgctgataggtggtgatttctggttgaagagaggctgggtataagagtttatgggaatttagtgtcttgatctatttgaataagatcagttctttggtgaatccattttatgagcacagagggatccagtacagcctgttactgacttaattcaaggtcagatgagaaaataagatatatacacacacaatacct

SEQ ID NO: 190568 - DNA, 601 bp, Human
cttcttcatccggtccttggagagtttcttggcctccatgttcttggtatctttcattagccatggatgctgaaggcactgcgtgcagtccaggcggtttctgacagaggcagagatcaggagatttttgagcaggaggagacctcagagaccactggttagttcagaaatgggaggccacctgtccctggtcatgagggcagagcccagggcccctgctcccggaccatccaccgtgatcaggatcactgtgctcttcacctttctcctcacttggtctgggtcacactaaccagaaccrgcatgggttggtgttaatgaaagcccaagcaccaaggaagtgactgggctccatggcctgctcttgggatcgaggaagagtaagtgctgcagggcagacgtttctgggattggctggcaccctattccagggtggcgtcattctgctcctctcatgagggctggggcccacaaagcctaatcctcctgccaccctgtctggaggaggggagagttaaatcctaggataaaatctccgacaatcactgaactttcatgtttaatgtcttacggtgttgttgaatatcaggtttttccatta

SEQ ID NO: 190569 - DNA, 601 bp, Human
ctcgtgtaattctcataattatcacaacaatgctgtgaagttggtaccactattatccccgctttatagatgagaaaaatccacagcaaggttacatcatttgctaaggacacatggctattaacatacaaccttcctagatggtgggaccatgtctctctctttagatcatgtgccctccttcatcataaagaaatgtgaaaccaccatactaccaccccattctcagggttgacaaatggaccttaaagtgatgttgctcatcccaagccatgaagacacaaaatgtcattggcttaayctgaataagggtttacggtcccctggggcaaaggtgagcaggaacagagagacagctaagctaagaatccatcccatctccttgagaaagggactctgcactcaggactaagcaaaccactgtaccttaatcagctgcctaaattggtcccagactacttcagaaataaatttaaactttcttggtgtgaggccagggcaagctgggaatgaaagtggcttgaacaacacaaatatgaggggcaacatcccagtccaaagtgaccctctcattacctgccatttccttcttgccatgtac

SEQ ID NO: 190570 - DNA, 601 bp, Human
cctgcctcctagggttaaaagatttagtgcatagatagtgctttaaatggtccctgacagatggcctaccttcatacctattagcgactgggatcgcttctggacactcaccatgtgccaggcattgtactactaaaggccacatgaggatgatctcgtgtaattctcataattatcacaacaatgctgtgaagttggtaccactattatccccgctttatagatgagaaaaatccacagcaaggttacatcatttgctaaggacacatggctattaacatacaaccttcctagatggtgrgaccatgtctctctctttagatcatgtgccctccttcatcataaagaaatgtgaaaccaccatactaccaccccattctcagggttgacaaatggaccttaaagtgatgttgctcatcccaagccatgaagacacaaaatgtcattggcttaatctgaataagggtttacggtcccctggggcaaaggtgagcaggaacagagagacagctaagctaagaatccatcccatctccttgagaaagggactctgcactcaggactaagcaaaccactgtaccttaatcagctgcctaaattg

SEQ ID NO: 190571 - DNA, 601 bp, Human
ttctaggtcgggagtggtggctcacgcctgtaattccaacactttgggaggccgaggcgggtggatcacgaggtcaggagattgagaccatcctggctaacacggtgaaaccccgtctccactaaaaatacaaaaaattagccaggcgtggtggtgggcgcctgtaatcccagctacttgggaggctgaggcaggagaatggtgtgacccgggaggtggagcttgcagtgagccgagatcgtgccactgtactccagcctgggcaacagagcgagactccatctcaaaaaaaaaaaaaaaagaattgtaattctaattgtggtaataaaaatgataaaataggtgatgatggtgataaactgaaaaacatcctgtggttttggataataattttatccacccatgccttttatcagaggcagtcttggggttaagactatgtgttttgcagtcaagctctgggtttgaatcctgacccttctgcttattagctgtgtgatcctggatggctttcctaaccttttctctgcctcaattttgtctgtaaagtggggataataatagtacctgcctcctagggttaaaagatttagtgcataga

SEQ ID NO: 190572 - DNA, 601 bp, Human
ccattgcactacgtagtccctgagtaaggaaaccatgtcctctcaattgcttgaacctgggaagcagaggctgcagtgagccgagatcgtgccactgcactccagcctgggtaatggagtgagactttgtctcgaggaaaaaaaaaaaaaagaaaccatgtcttctccagcagcctaagaattgtaattctaggtcgggagtggtggctcacgcctgtaattccaacactttgggaggccgaggcgggtggatcacgaggtcaggagattgagaccatcctggctaacacggtgaaacccygtctccactaaaaatacaaaaaattagccaggcgtggtggtgggcgcctgtaatcccagctacttgggaggctgaggcaggagaatggtgtgacccgggaggtggagcttgcagtgagccgagatcgtgccactgtactccagcctgggcaacagagcgagactccatctcaaaaaaaaaaaaaaaagaattgtaattctaattgtggtaataaaaatgataaaataggtgatgatggtgataaactgaaaaacatcctgtggttttggataataattttatccacccatgccttttatc

SEQ ID NO: 190573 - DNA, 601 bp, Human
taaactccacacttgtggcccccattcgcctttgctccctctttcaacctctgagtgacactctactttctgaggcaactgtgatttagtcacctggtgtggtaaatgaccagtgttccagttgcctccaacacagtgatttcccttttctttgccacccaggcaaagtctcaatgcccctgggtcccttgagtatccagctaaaagactctgctcctgtccagccaagcccagccggaatgggtccggctcccacctctgtgccttctcctccacctgtgcagtcctcttctctgtattytgactgaggttccacacctaattcaaactcctgcacctgggagcatttcctcataatcacatccaactctggttgcgaccaggtccgttctatccatacacacccatggctatggagaactatccggatagtttatacatcttggtgcgtgttacatcctttcatgtctagttgcttcagttccccattgcactacgtagtccctgagtaaggaaaccatgtcctctcaattgcttgaacctgggaagcagaggctgcagtgagccgagatcgtgccactgcactccagcctgggtaatg

SEQ ID NO: 190574 - DNA, 601 bp, Human
agaatactccgtgctatactgagtccagtgttttctcccctaatgcccttggtccatactgctggggtctttatggttcccagaaaataaagatggctacctaagggcctctgatgtctagtcttttgcttccagtgtgcatgcggaaaccctgttaatctgctcaacctacctgcccccattgctacacctttccaacatatctttgtaaaattcttttaatataaatttaaaatataccttctttcggaataacttgattccaagatgagtaatatgattagtcatctatacccagcctagctttgcttgtagggatttgttcccatgtcacttcattccttctagggctttttatgaaaaccacaccagaataacaagaaggtgccttctctggcacagctgcagagagttctgggccacctgagcctgatcttcccctctccctctgcccccgcccacagcccactccaccccactgcacagaaccttggctgctgcaagagggaaccctcatattccaaggggagctaaggccctggtgattgcagttaaaatgcagaaaacgttttcctgagggagcaacgtaacatgaaatggt

SEQ ID NO: 190575 - DNA, 601 bp, Human
gcaattgcccaggctgggttcctgtgtcgctggtgagcagtatctgcaccagcctccttcatgcagcacaaattccctgccccttggagagcttgtggggccagccatcctggcttgcccaggcaggcttgtggagtttcccaggattagggtcttttggcaccaatactaagacattccctgacaaacatacagcaagctggttacccatcaaagccccccatatataccagtagccccaagactacagtttcccctgagcagtgcataccatccaaatgggatggccaagaatactccrtgctatactgagtccagtgttttctcccctaatgcccttggtccatactgctggggtctttatggttcccagaaaataaagatggctacctaagggcctctgatgtctagtcttttgcttccagtgtgcatgcggaaaccctgttaatctgctcaacctacctgcccccattgctacacctttccaacatatctttgtaaaattcttttaatataaatttaaaatataccttctttcggaataacttgattccaagatgagtaatatgattagtcatctatacccagcctagctttgctt

SEQ ID NO: 190576 - DNA, 601 bp, Human
cctttgagctgacaattggttgttgctttactgaccaaagacctttggaaatttttggaacatcaagatcgccaagttttgattttgtaatttctccctttttcttgcttgagggcaattgcccaggctgggttcctgtgtcgctggtgagcagtatctgcaccagcctccttcatgcagcacaaattccctgccccttggagagcttgtggggccagccatcctggcttgcccaggcaggcttgtggagtttcccaggattagggtcttttggcaccaatactaagacattccctgacawacatacagcaagctggttacccatcaaagccccccatatataccagtagccccaagactacagtttcccctgagcagtgcataccatccaaatgggatggccaagaatactccgtgctatactgagtccagtgttttctcccctaatgcccttggtccatactgctggggtctttatggttcccagaaaataaagatggctacctaagggcctctgatgtctagtcttttgcttccagtgtgcatgcggaaaccctgttaatctgctcaacctacctgcccccattgctacacctttcca

SEQ ID NO: 190577 - DNA, 601 bp, Human
tattaacaaataaatatgtctcacatagggagaacttttctaaaagatggagatatccagcatataatttctaaaacatagaaaaatatttgggaattgatttgtgaaaaaaaattgccgaggaagttatttgtcagaactagaaatgaatatatcagtatgttctagtcttccagttttatgcctttgagctgacaattggttgttgctttactgaccaaagacctttggaaatttttggaacatcaagatcgccaagttttgattttgtaatttctccctttttcttgcttgagggcarttgcccaggctgggttcctgtgtcgctggtgagcagtatctgcaccagcctccttcatgcagcacaaattccctgccccttggagagcttgtggggccagccatcctggcttgcccaggcaggcttgtggagtttcccaggattagggtcttttggcaccaatactaagacattccctgacaaacatacagcaagctggttacccatcaaagccccccatatataccagtagccccaagactacagtttcccctgagcagtgcataccatccaaatgggatggccaagaatactccgtgc

SEQ ID NO: 190578 - DNA, 601 bp, Human
cttattgctgactgggcctagcggggctatttctcgtaaaacaatgccagtgatgtgattataattggccaagagaatagttactacagatcccacaagtcctgatgcaaaaataatcataataataataacacagcatcctgttgaccttgggcaagtcacttaaccactctgagcttcagtctccttctctaggagggggctggacaagatgatctccaaggtcccatttagctctgtttataattcagagacttaaaagattttgagaaacactctggctggcccctgcacaagtctrtgatgcagtgaagctctggagaggagctcttccttggtgtgcattcaggcaccaaaaagaagcattgaagaaataaaaggcaacggcactttgcttctcagtgactagacttgggagaggaaagaatttctgctgaaaaggatcagaacttgagatgtaatttatttacattgcgaaaattctaccaagcataggatccctaataatgtacaattgtgtcttattgtttcttatctttcagtaagtttttcaccttttttctaaggttaacaggaatgactaagataagaaaactaaggc

SEQ ID NO: 190579 - DNA, 601 bp, Human
gaatattttataaatcttacacaactacatgtaattttaatgttatttttgcctattaatatagaatatcacttttgccataagaacaaaagaagattttaatacaatctttgttaattttaacacaaaatatatgaaaaagcatagctgaggtcatctagttctattagacaaataacaactttccctccgaaaatggttaagcttaaagttaaacgattaagaataattattagacttagtaattgtcagggcaacccaaaattacttctgaatttatccttgcagggaatattaaaawaaaaaaaaaaagaacaaaaccaaccaaaacctcaaaatgcccctttgttccccagccctttctttctcaccagctggctggagaaactcctccttaccttcagattctagtttttctgcattgagcgggctggttggtgaccctgttgaggatttcctgccactgagccctgagatcattgccatagaggacagtcttccaatggctctcacagcattgcccgttttctggaaaatagacacgagggttggactcaggcgttgtccctggttccagctgggtagtgcgaggggctgcagg

SEQ ID NO: 190580 - DNA, 601 bp, Human
agctccagagcaggcagttgctggcctcaccaataaccctacctttgctcaccaagggaatctaaactcagattctcacctgtggatacaaaaagcaccaggcagggagggacagagggtgtctctggccaaatgagataagggtctggccctgcatgcacctgaagcaggaaaaggctggggttttcactgaggagatggacgggacagcatctaagatggtgagcaagtaactgaccctattagtctccaggaggagacctgccagtcccagtctgcccagttcaaatgacacgattcrgcatcatgaacaatgccaaagaatgtggaccatatgagttaatttttatttaaaacaaaaccacaaagatggtagaaaatagaatattttataaatcttacacaactacatgtaattttaatgttatttttgcctattaatatagaatatcacttttgccataagaacaaaagaagattttaatacaatctttgttaattttaacacaaaatatatgaaaaagcatagctgaggtcatctagttctattagacaaataacaactttccctccgaaaatggttaagcttaaagttaaacga

SEQ ID NO: 190581 - DNA, 601 bp, Human
gacacctgtatctcctcccttcccttcaggctatgtctgggtcatctgaggaggggcagaagtggctcaggagggaccaggcctgtgtgctgcagtctctatccctggctgtgaggaagctccagagcaggcagttgctggcctcaccaataaccctacctttgctcaccaagggaatctaaactcagattctcacctgtggatacaaaaagcaccaggcagggagggacagagggtgtctctggccaaatgagataagggtctggccctgcatgcacctgaagcaggaaaaggctggggytttcactgaggagatggacgggacagcatctaagatggtgagcaagtaactgaccctattagtctccaggaggagacctgccagtcccagtctgcccagttcaaatgacacgattcagcatcatgaacaatgccaaagaatgtggaccatatgagttaatttttatttaaaacaaaaccacaaagatggtagaaaatagaatattttataaatcttacacaactacatgtaattttaatgttatttttgcctattaatatagaatatcacttttgccataagaacaaaagaagattttaa

SEQ ID NO: 190582 - DNA, 601 bp, Human
cttggagggacacctgtatctcctcccttcccttcaggctatgtctgggtcatctgaggaggggcagaagtggctcaggagggaccaggcctgtgtgctgcagtctctatccctggctgtgaggaagctccagagcaggcagttgctggcctcaccaataaccctacctttgctcaccaagggaatctaaactcagattctcacctgtggatacaaaaagcaccaggcagggagggacagagggtgtctctggccaaatgagataagggtctggccctgcatgcacctgaagcaggaaaargctggggttttcactgaggagatggacgggacagcatctaagatggtgagcaagtaactgaccctattagtctccaggaggagacctgccagtcccagtctgcccagttcaaatgacacgattcagcatcatgaacaatgccaaagaatgtggaccatatgagttaatttttatttaaaacaaaaccacaaagatggtagaaaatagaatattttataaatcttacacaactacatgtaattttaatgttatttttgcctattaatatagaatatcacttttgccataagaacaaaagaa

SEQ ID NO: 190583 - DNA, 601 bp, Human
acatctctttccatgtctcctggatgagataatataaaagaagttcaccacacaaaaacaaaaagggattgcatattttgttaacagccagtacaaaagctaagagctgaaaataacagacctgagttaaaaattgtggccaatcctcagctcagattcagttacataaaacatacaggagaaagtacaagcaacaacaataataataatgataggtaaacttttcattctaaaggctcaaaatagtaacattaagaaaaaaaggtaaactgaacttcaccaaaacttaaaacttctgtayagcaaaagacattatcaagagaatgaaaaggcaaccaacaaaatgggaggtaatatttgcaaatcatatatatctgacaagatattaatatccagaatatataaagaactcctacaactcaataacagaaaacaaagtttaaaaatcagtacaggtctagaaaagataattctccaaaaaacatacaaatgaccaacaagcacataaaaagatgctcaacatcattagtcatgagggaaatgcacataaaaaccacaatgaggctgggtgcagtggctcacacctgtaatcccagcactt

SEQ ID NO: 190584 - DNA, 601 bp, Human
ggtacagggcaagaccctgtctcaatttaaaaataaaaacaaaaacagctgggcgcagtggttcacacctgtaatcccagcactttgggaggccgaggcaggcggatcatctgaggtcaggagtttgagaccagcctgtccaacatggtgaaaccctgtctctaataaaaatacaaaaactagctgggcatggtggcaggtgcctgtaatcccagctactcagaaggctgaggcaggagaatctcttgaacctgggaggcagaggttgcagtgagtcaagattgcaccactgcactccagyctgggcaacagagtgagactctgtatcaaataaataaatacaaataaaaataaaaaggccagcacaatggctcacacctataatcctagcactttgggaggcaaaggcaggtggatcacttgagcttaggagtttgataccagcctgggcaacatgctaaaatctacatgggcatggtggcatatgcctgtggtctcaactactcgggaggctgaggtaggaggatcacttaagcctgggaggttgaggctgcagtgagctgagatcgcaccactgcactccagcctaggtgacagagag

SEQ ID NO: 190585 - DNA, 601 bp, Human
tttcagagagataccaatgccttgaagaaacttggcccacatcctgggtaacacagtaagattccatctctacaaaaaaaaagaaaaaattagccagacttggtggcttgcactcagctactcaggaagctgaggtgggaggatcacttgaccctgggaggctgaggctgcagtgactggtggttgcaccactgcattccagcctgggtacagggcaagaccctgtctcaatttaaaaataaaaacaaaaacagctgggcgcagtggttcacacctgtaatcccagcactttgggaggccraggcaggcggatcatctgaggtcaggagtttgagaccagcctgtccaacatggtgaaaccctgtctctaataaaaatacaaaaactagctgggcatggtggcaggtgcctgtaatcccagctactcagaaggctgaggcaggagaatctcttgaacctgggaggcagaggttgcagtgagtcaagattgcaccactgcactccagtctgggcaacagagtgagactctgtatcaaataaataaatacaaataaaaataaaaaggccagcacaatggctcacacctataatcctagcactt

SEQ ID NO: 190586 - DNA, 601 bp, Human
gagcgagactccatctcaaaaaaaaaaaagaaattttatcaaaaataacgaacactttaagctaagtaatttaattttaaacctagttaataccctacataccttcttgtaagagaatctaacagcaaagcttaaattttccttaaggctactgtaaaatttatagtcaaatataatttttatatttaaaaagtactgagtgaacaatttattcatactaaagagggtgttaaaatcctacagactaggtcggacatggtggctcacacctgtaatcccagcactttggaaggcttaaggyaggcagatcgcttgaggtcaggagttcgagaccagcctagccaatgtggcaaaaccccatctctacaaaaaatataaaaattagctgggtgtagtcatgcaatcctgtaatcccagctacttaggaggctcaggcatgagaatcacttgaacccaggaggcagaggttgcagtgagccaagatcacgccactgcactccagcctgggcaacaaagtgagactctgtatataaaaaaaaaaaaaaaaaaaatcctacagactagctatttccctcacttaaggtataccacaggtttagat

SEQ ID NO: 190587 - DNA, 601 bp, Human
gagattgagaccatcctggctaacacagtgaaaccccatctctactagaaatataaaaaattagccaggcatggtggcaggtgcctgtagtcccagctactcgggaggctgaggcaggagaatggcgtgaacccaggaggtgaagcttgcagtgagccgagatggcgccactgcactccagcctgggcgatagagcgagactccatctcaaaaaaaaaaaagaaattttatcaaaaataacgaacactttaagctaagtaatttaattttaaacctagttaataccctacataccttcttstaagagaatctaacagcaaagcttaaattttccttaaggctactgtaaaatttatagtcaaatataatttttatatttaaaaagtactgagtgaacaatttattcatactaaagagggtgttaaaatcctacagactaggtcggacatggtggctcacacctgtaatcccagcactttggaaggcttaaggcaggcagatcgcttgaggtcaggagttcgagaccagcctagccaatgtggcaaaaccccatctctacaaaaaatataaaaattagctgggtgtagtcatgcaatcctgt

SEQ ID NO: 190588 - DNA, 601 bp, Human
ctggtaaaatttcaagtataaacactcaatactactgaactgcaatcactaatgttttggtaatgtttttcaatatattatgaataagggaccctgttcatgtaactgttagaatcacataaaaaaatacagctttcatttattccagacacactgaatcccaatctctgagcatattcattttaagaaactgatacaatctaaatttgggaaccaccataaagatctcttaaatacagaaattttaggccgggcgcagtagctcacgcctgtaatcctagcactttgggaggccgaggcrggcggatcacgaggtcaggagattgagaccatcctggctaacacagtgaaaccccatctctactagaaatataaaaaattagccaggcatggtggcaggtgcctgtagtcccagctactcgggaggctgaggcaggagaatggcgtgaacccaggaggtgaagcttgcagtgagccgagatggcgccactgcactccagcctgggcgatagagcgagactccatctcaaaaaaaaaaaagaaattttatcaaaaataacgaacactttaagctaagtaatttaattttaaacctagttaa

SEQ ID NO: 190589 - DNA, 601 bp, Human
tttcattaattggcaaataataattgcatgtatttttgaggtacaatgtgatagagtttttttgtttgtttgagacagggtctcactctgtcgcccaggctggagtgcagtggcatgatcacagctcactggagcctcaacctctgggctcaagccaagtgatcctcccacctcagcctctcaagtagctgggactacaggcacacaccaccatgcctgagtaattttttgtactttttgtagagatggggttttgctatgttgcccagactggtctccaaatcctgggctcaagtgatcyacccaccttatcctcccaaagtactgggattataggaataagcccccaagctcggccaatgtgatgttttgacacatgtatacattgtggaatgatcaaatctggctaattagcatatctatcacctcaaatatttattatttctttgtgaagagaacatttaaaaattctctcataaatattttgaaacatacaatacattattattaactatagtcacggtgctatgcaatagaatgggggtgggggtggttttgggatgaaactgttccacctcagatcatcaggcattagattctc

SEQ ID NO: 190590 - DNA, 601 bp, Human
ggcttgggggttagcagctttacaaataaagtgtatcacaaactagtctgcatttgcacaaaacagtagttagccttcctgtcttaaatcctggtgctgacttctcttcctaataaatgacctttgtggcattttttttctccagaattgggcactttgatctgcattaaaaacttgttcagggtcagacaaggcagctcacacctataatcccaacattttgggaggccgaggtgggaggattccttgaggtcaggggttcgagaccagcctgggcaacatagtgagacctcatctctayaaaaaattaaaaattagctgggcatggtggtgcatgcctgtagtcccagctactcaggaggctgaggtgggaggatcacttgagcccaggagggcaaggatacagcctgggcaacagagtgagatcttgtctcaaaaacaaaacactaaaaatctgttcaggcaggtatctattctcctcagtgatttttcttaatggcatctgggaactcatctgctatttctaggtcaggaaaaataacttctcctgttaccttgattttttttatgccaaacctttctaaaattgtcaaatcggccg

SEQ ID NO: 190591 - DNA, 601 bp, Human
caacaacacttgtaaggttggtgtgggaactggagaatatatgaaaaataagccataccaggaattatgcagaataagtgctcaacacagaacaacgactgttaagtcattgagcacttaccctgcataattggttgttgtcattgctatggttattcacagtaattcaagaacaaaacaaaacaaaacatctggctgtgtgcagtggctcatgcttgtaatcccagcactttgggaagctgaggtgggtggatcatctgaggtcagaagtttgagactagcctgccaacatgatgaaacyccatctctactaaaaatacaaaaattagccaggtgtgatggcaggcgcctgtaattccagctactcaggaagctgcggcaagagaattgcttgagactggggggctgaggttgcagggagccaagattgcgccatcgcactccagcctgggcaacagagcaagactccgtctaaaaaaaaaaaaaaaaatccttgagtttctaccttaatctaatgccagaccctagatgctagaaccactatacttgatacaacagtagtagcatcatctagtttgtataattgctatgaacattcaga

SEQ ID NO: 190592 - DNA, 601 bp, Human
aatcttgacttaaattgaactttagactcaacgtatctcaggacagaatgacaaatggtgtttttccctagataaacttacttgtttagagaaaatgcctgaaggcagaatctttttttcacatctgtcctaacaaatacttattaacatgttgtctaaaaggaggcaaaactgggtaaaaccagagacacctggatgaaatcctggctctaccactgaccagctatgaggactggcacaaaacactaaacttgtcttcctttcagtctcttcactgtaagatgggggaaagacaacaacrcttgtaaggttggtgtgggaactggagaatatatgaaaaataagccataccaggaattatgcagaataagtgctcaacacagaacaacgactgttaagtcattgagcacttaccctgcataattggttgttgtcattgctatggttattcacagtaattcaagaacaaaacaaaacaaaacatctggctgtgtgcagtggctcatgcttgtaatcccagcactttgggaagctgaggtgggtggatcatctgaggtcagaagtttgagactagcctgccaacatgatgaaaccccatctc

SEQ ID NO: 190593 - DNA, 601 bp, Human
caggccaggtgcagtggctcacacctgtaatcccagcaccttgggaggccaaagcgggtggatcacttaagctcaggagttcaagaccagcctggcaaacacagtgaaaccctgcctctactaaaaatacaaaaaattagcatggcgtggtggcgcctgtctatagtcccagctactcaggaagctgagtcagggaatcccttgaacctgaaacggggcagttgcagtgagcctagctcatgctactgcactgcagcctggacgacaaagtgaaactccgtctcaaaacaaaacagaacaraacaaacaaaaaaccctacaattgtgagaaataaatttctgttgtttataagccacccagtctatggtattctgttacagcagcccaaacagactaagacagtgtcacacacatcaaagaacacaggctaggatgctaggaatcattttgagaagtcgcatgcctcctctttcctccttgacctcacctcccagtaagacaccaatgatcttatatcctaatagttttcccatatttcaagcagttgttcattatcactttcaatgacttcatgaaatattgtaccttttttttttgaga

SEQ ID NO: 190594 - DNA, 601 bp, Human
tcctcatgaatgggattagtgtccttataaaagagaccccagaggccgtgcacgctggcttacatctgtaatcccagcactttgggaggccgaggtgggcagataatgaggtcaggagatcatgaccagcctggccaacatggtgaaaccctgtctctactaaaaatacaaaaattagctgggcatggtggtgcatgcctgtagtcccagctacttgggaggctaggcaggagaatcacttgaaccagggagtcggaggttgtagtgagctgagattgtgtcactgcactccagcctggcracagagcgagactccgactcaaaaaaataaataaaataaaataaaataaataaaaaagaccccagagagcttcatctcctcttctgccatgtaaggacatagcaagaagacaggtacgtatggaccaggaagcaatccctcataatgaactagtgccttgatctagtacttcccagctttcagaattctgagaaacaggccaggtgcagtggatcacacctataatcccagcatcttgggaggccgaggcgggcggatcacttaagctcaggagctcaagaccagcctggcaaacacggt

SEQ ID NO: 190595 - DNA, 601 bp, Human
atttaatttaaataaatcactcccctgaatttaagatgtcttacattcaaacttttaaaaactaaacttactatttcacatctattttttccagtattttacttgttcttctgtgttttctatgagttggtgcctgccatagactgaatgtttgtgtctcccctggcgaattcatatgtagaaacctaatctctaatgtgatgatatttggaagtgaaaactttgggatgtgattaggtcatgagggcagagtcctcatgaatgggattagtgtccttataaaagagaccccagaggccgygcacgctggcttacatctgtaatcccagcactttgggaggccgaggtgggcagataatgaggtcaggagatcatgaccagcctggccaacatggtgaaaccctgtctctactaaaaatacaaaaattagctgggcatggtggtgcatgcctgtagtcccagctacttgggaggctaggcaggagaatcacttgaaccagggagtcggaggttgtagtgagctgagattgtgtcactgcactccagcctggcgacagagcgagactccgactcaaaaaaataaataaaataaaataaaata

SEQ ID NO: 190596 - DNA, 601 bp, Human
cctcccccagaatatttcacgtttatactatatgatgaaatagaaagcagctataagtgttaaaaaaattcataatgatataagacaataattataaggctaactaaaacaatcaaaacagccgaatgagccgggcacagtggcttatggctgtaatctcagcacttggaaaggccaagcaagttgggcggatcacttgaggccaggaatttgagaccagcttggccaagatggtgaaaccccatctctactaaaaatacaaaaagaagctgggcatggtggcgcacacctgtaatcccarctactcgggtggctgaggcacaagaattgcttgaacctgggagatgaaggttgcagtgagccaagactgcatgccactgcactccagcctaggcgacagagcaacactctgcctcaaaaaaaaaaaaaaaaaaaaaaaaaaagcaaagcagaatacaaacatatacatacacatatttgtctgtacaatcattatgctaaaatacaaacataactgcaaaaagtgacaaaaacatgccaaaagggtaacaatgattatctcagaggtaagtactattatgaatatttactatttaatact

SEQ ID NO: 190597 - DNA, 601 bp, Human
gaccttatatgtactaaaccacaaaaattgagggccacaccagaaacctgagaagaggtgtaacatcatgttatctgctaataaattgcagctccatattctcaaacacatattactttataattggcatgcctatacccctcttgtttaaacaacaacaacaataatatcacaaaataacaagactttcctaaaattctgtaactactaacctctaactgggcacttataataatattccttacataatgactattttttagtctccaagatatttcaacaaaaacatcttcaagttacytgaaggcaaagccaaggacctagtctttaaacagtataccttatagggagaggggtgctgcactgcacatagcatatttaaactccactttactccaaaaataatctggggcaattcagtgccgtatagaagcatattctcaaagaattcttaattaaatgaaaataaataaatacccgaatgattaataaaggcttttgagaatggtcaaacctaatgcctgcaaaattcttgccattcatggaagtaacaaaaaaggggcaagggaaattccacgcataaatatttcagactggaatt

SEQ ID NO: 190598 - DNA, 601 bp, Human
aaaaacttccagaatgtctctcagaagttatatatgatattatgataaatatattcatccaaaaacttttcactatgaaagatccatttctctcacattcctttgcctacactgtatattctctctctctctctcttttgtacagggtctctcctgtctaaccctgcacaaaaacacatacatgcttctgtttttctttataataatagaggataatgctggtaaaatatacattctcctttacacctcttaaggtaaaaagaaatgttaaattaaagaaacagaaatctacttgaatgayggcagaacatgaagaaaagtcagtacttctatgttgcccaccaagcatttttcatcttgtttcttcttatggactagagttcaacagcttactatcagaataccacaactcccaaagctgtgcacataagttataactgctcctggaccttatatgtactaaaccacaaaaattgagggccacaccagaaacctgagaagaggtgtaacatcatgttatctgctaataaattgcagctccatattctcaaacacatattactttataattggcatgcctatacccctcttgtttaaacaa

SEQ ID NO: 190599 - DNA, 601 bp, Human
ctttggtggtaatggaagaggaagattagatgaatttcgatttatggcagcctctatggcaatcatttcttgttcatacattttcttgatcttgcagcattccacaagtataaaatggggcagggctctgttcatcacacagttccggatatactataggggcaagaaaggggaaggtattgattttcatgccaacacctaaatcaatagaataaaatgaagctgaacaacactatatcaaatgcactgtgaaagtatgtcttaaaccacagcagaatatcaagaaattaaaaaaaaaaawttttttttttttttttttgagacagggtctatgttgcccaggctggaatgcagtgacacgatcacagctcactgcagcctcaatctcctgggctaaagcaatcctcccacctcagcctctggagtacctgggactacaggcacacaccaccatgcccagccaatttttatattttttgtagagacagggttttgccatgttacccaggctggtcttgaactcctgagctgaagtgatctgcctaccttgacctcccaaagtgctaggattacaggtgtgagccaccaagcccagcctaag

SEQ ID NO: 190600 - DNA, 601 bp, Human
aatattctatgctagcaatgcaattgtcatcagttctaatgtctattggcaaaactatgaaaatagagctctaaactaacaactgaaagtcacatatactaaattaagcattgaccgggcgcggtggctcacgcctgtaatcccagcactttgggaggctgaggcaggtggatcatgaggtcaggagatcgagaccatcctggctaacacggtgaaaccccgtctctactaaaaatacaaaaaattagctgggcatggtggcgggcgcctgtagtcccagttacttgggaggctgaggcaggagaatgacatgaacccgggaggcggagcttgcagtgagccaagattgcgccactgcactccagcctgggcgacagagcaagactctgtctcaaaaaaaaaattaattaattaattaagcattataacccctagcacttggctttcatggcaaaacataggcagcattccactaatgctaagagatttcactaaattaaaaagcattaacaaatagtaataaaagctttgtataaattaagagctgaccatttatattaatatagaaataacatcatcaaggagtagttcaatatacaat

SEQ ID NO: 190601 - DNA, 601 bp, Human
tggtaatttttggcaaggggctcctgaatatatcttcaagcaacaaacatttcaaacaaaccaaatctctttcttggatcacaaaaattattcacttaatttcctacccagcaaattagggaaaataaatgctttatactctgagacaaaatgctttgttaagtctttatttaaatgtatgggattgagcaataaacccccatgtgttaacaacttgtggtccataacgtagtaatctattttcttccaggaaatggtattacatgttctctgtgctcagtttaaaaggaaagaaaagaaaaaaaaaaaaaaaaaagactgaaagaggggttcagtgcagctctaggcaaggctgagagaggagagtaagcttgcataaaaacatgagatctatagttttggcttaactttcacttgctgaaatttaacatattcatcatcacatatagttacctttgttttttttgagtaaggagtggtaagagtacctaaaatctactctcctagcaaattcctgtataaaatatcattaactatagtcttcgggttgtacattagctctctagaattattcaaccaagataactctactttgcacctt

SEQ ID NO: 190602 - DNA, 601 bp, Human
ctagcaaatttcctgtatacaatattattaactatagtcttcatgttgtatattagatctccagaattattcaaccaagataactctttgtaccttcaaattatttctctcaacttttttcacagcctcacccacttgtctaacaccaaaggcggtaaccacccttctactctcccccaaaatctttaatacccatgtacaaaagcaagacattggtaatttttggcaaggggctcctgaatatatcttcaagcaacaaacatttcaaacaaaccaaatctctttcttggatcacaaaaaktattcacttaatttcctacccagcaaattagggaaaataaatgctttatactctgagacaaaatgctttgttaagtctttatttaaatgtatgggattgagcaataaacccccatgtgttaacaacttgtggtccataacgtagtaatctattttcttccaggaaatggtattacatgttctctgtgctcagtttaaaaggaaagaaaagaaaaaaaaaaaaaaaaaagactgaaagaggggttcagtgcagctctaggcaaggctgagagaggagagtaagcttgcataaaaacatgag

SEQ ID NO: 190603 - DNA, 601 bp, Human
atggatgccaggcgcagtggctcacgcctgtaatcacagcactttgggaggccgaggcgggtggatcatgaggtcaggagatcgagaccatcctggctaacatggtgaaaccccgtctctactaaaaaaaatacaaaacattagccaggcatggtggcgggtgcctatagtcccagctactcaggaggctgaggcaggagaatggcatgaacccgggagggggagcttgcagtgagccgagattgagccactgcactccagcctgggtggcagagtgagactccatctcaaaaaaaaaaaraagaaaaccaatgaattaaaatatacaaatcatctcaaaaaatgcagaaaaagtgattaactttttcttaaaggataaaaattttcagcaaactaggaagagaatttcttgaataaggggcatctatgaaaaaaactacattatatttaaagttgaaagacttaatgaatgctgtcctttaagataaagaacaaaatcaagatggcaggctgggcatagtagctcacatctgtaatcccagcattttggaaggctgaggtgggtggatcacctgaggtcaggagtttgagaccaggctgg

SEQ ID NO: 190604 - DNA, 601 bp, Human
caacttttgaaaaccaatggatgccaggcgcagtggctcacgcctgtaatcacagcactttgggaggccgaggcgggtggatcatgaggtcaggagatcgagaccatcctggctaacatggtgaaaccccgtctctactaaaaaaaatacaaaacattagccaggcatggtggcgggtgcctatagtcccagctactcaggaggctgaggcaggagaatggcatgaacccgggagggggagcttgcagtgagccgagattgagccactgcactccagcctgggtggcagagtgagactccrtctcaaaaaaaaaaagaagaaaaccaatgaattaaaatatacaaatcatctcaaaaaatgcagaaaaagtgattaactttttcttaaaggataaaaattttcagcaaactaggaagagaatttcttgaataaggggcatctatgaaaaaaactacattatatttaaagttgaaagacttaatgaatgctgtcctttaagataaagaacaaaatcaagatggcaggctgggcatagtagctcacatctgtaatcccagcattttggaaggctgaggtgggtggatcacctgaggtcaggag

SEQ ID NO: 190605 - DNA, 601 bp, Human
ccagccttgatcatttgtaaaaagtgaaaaactgtctcttctaccttcatcacttcagacaccaaatgtgagggttttcctacaccaaccaattctccaactctctggacaccaattgggtatcctacaattcaattttgatgctacctggacttagggcagatgctaccaggttatggcattagttccataagactgacttccaattcaggtgacaattgcaaatctcaggttattatttgtacttgtgatcaatcaagggttcccacaaatgccctcctcaggttcaatttgctctaayggctcacaaaactcagggaaacacatttacccatttattataaaggatattacaaaggatagaaatgaatagccaaatgaaaaggtatatatatgttcttcaaggtccagaagggttccaagtgcagaagcttgtccccatagaatttggctgcactatcctctcagcatgtggatatattcactaacccagaagtcctgcaaatcccattatttagggtttttatggaggaggctccattaagtaggtatggttattaagtcattggccactgttaagtcggtctctgtcctccctccc

SEQ ID NO: 190606 - DNA, 601 bp, Human
acagtattgaaatatgctacaaactcataaataactagtttgttttaccttatgagattctgaatattataactgatcatgttttctctttgccttgtccactaggtgtagggcaagcagacagtcaaatatgtagcccacatcaaaaaattaatcacacaggatctaatattatacacatacctactaggaatcttgctactgggtgttttttttttttttttcttatttcctgtcaattaactatcctctattttttttaaagtcaaaactgtctgtattgtatgtgctatgtaagagccacacacacacacacacacacacacacacacacgtgtgtaggctcacctcaaataatctgtaaaatgagatttggtaaatcataaataaaacaaaacatacataaaatatattttgcatctgttgtatgggaggttataagataggaatatcaggataaaagtggtattcaattcttactctcgataatcttacctgaatttgtcacctttttaatatggcatttaaatatagtttatgcagaaaattatgaattttacaaatgattatttttcagtgttctggtgataaagacattgag

SEQ ID NO: 190607 - DNA, 601 bp, Human
atcactaagacctctatttcaacaaccaacacctctttctccccacttctctaatagttttgtctgccttcactctcaccaaaattatctgcaagtgcctctctcccatcacactcgtctggaagtctgtatcttggataaacctaatcacctgcctcctctccatcccaaatgttttcaggcagaccagcaccatgactgactgttttcaaatgtaaaattactatttcaggctgggtgaggtggcttacacctgtaatcccagcactttgggaagccaaggcaggcagatcccttgagygcaggagttcaagaccagcctgggcaacatggcaaaagcccatctctacaaaaaaatacaaaaattagtcaggtgtggtggcgtgcacctgtagtcacagctactcaggaggctgacgtgggaggatcgcctgagccctagaggcataggttgcagtgagcagagattgtgccactgcatgccagcctgggtgacagagcaagaccctgcctcattcagaaagaaaaaagaaaagaaaggaaagaaagaaaataaagaaaaaactattttgttactgtaagatttcttaccttttactgc

SEQ ID NO: 190608 - DNA, 601 bp, Human
ggggaagaaatgtgtatgtacagtgtgaaaatagaaaatgagacctgaagaaatagctaggctagaaaaaaaaagcttgggaatcaagcaaagtggtgtactttttcaagtttctgacaagaaagataccaataattgctttccaagatgtgaagacgactaagtgagaagaaaatcactaacaggtattgatgcagggtccgcatgcctgaggcaaacaacccatctgactcctgagttccttgacctaaatatctccaactaggtacttctctccttcccttcagccacacaatctcaygatgccaccctgaatttgacttcaccacaccctagcacctccaaatcactaattattacatctcagtttccaaccacttcccaccctgattccaacttactgttaatacattcccaaaggaaaactttgtagccatcactaagacctctatttcaacaaccaacacctctttctccccacttctctaatagttttgtctgccttcactctcaccaaaattatctgcaagtgcctctctcccatcacactcgtctggaagtctgtatcttggataaacctaatcacctgcctcctctccat

SEQ ID NO: 190609 - DNA, 601 bp, Human
aagtctttcaaggctgaagaaataatcaatttcatagctttaaacacattaccaaaaattctgtatgatattatatactcaacatttaacctaaattccattcatttaaactaaattcatataaactcccaatctgctctgcaaacactgacaaaaaaaaaggggggtaggggaagaaatgtgtatgtacagtgtgaaaatagaaaatgagacctgaagaaatagctaggctagaaaaaaaaagcttgggaatcaagcaaagtggtgtactttttcaagtttctgacaagaaagataccartaattgctttccaagatgtgaagacgactaagtgagaagaaaatcactaacaggtattgatgcagggtccgcatgcctgaggcaaacaacccatctgactcctgagttccttgacctaaatatctccaactaggtacttctctccttcccttcagccacacaatctcatgatgccaccctgaatttgacttcaccacaccctagcacctccaaatcactaattattacatctcagtttccaaccacttcccaccctgattccaacttactgttaatacattcccaaaggaaaactttgta

SEQ ID NO: 190610 - DNA, 601 bp, Human
tactgctttttacaatggttgaactaatttacactcccaccagcagtgtgtatgtgttctccacaacctcaccagcatctcttattttttgactttttaacaatagccattccgactggtgtgagatggtatctcattgtggttttgatttgcatttctctaatgatcagtgacattaagcttttttgcatatgcttgttggccgcatgtatgtcttcttttgaaaagtgtctgttcatgtcatttgcccacttttaatgttttttttcttataaatttgtttaaattccttatagatactggctaatagatctttgtctgatgcatagtttgcaaatattttctcccattctgtaggctgtttactctgttgataggttctttggctctgcagaagctcttacgtttagttaaatcccacttgtcaatttttgcttttgttgtgatcgcttttggtgtctttgtcataaaatttttgcccattcctaagtgcaggatggtattgcctaggttgtcttccagggtttttatagtttgaggttttacatgtaaagtaaatataagtgtacatttacattaagtctttaatccaccttgagtt

SEQ ID NO: 190611 - DNA, 601 bp, Human
tatccaatctgtcactgatgggcatttaggttaattccacatctttgcaattgtgaatagtgctgcaatgaacattcgcatgcatgtgtctttatgctagaatgatttctattcctctgggtatatacccagtaataggattgatgggtcaaatggtagttctgcttttagttttttaaggaatcgccatactgctttttacaatggttgaactaatttacactcccaccagcagtgtgtatgtgttctccacaacctcaccagcatctcttattttttgactttttaacaatagccattscgactggtgtgagatggtatctcattgtggttttgatttgcatttctctaatgatcagtgacattaagcttttttgcatatgcttgttggccgcatgtatgtcttcttttgaaaagtgtctgttcatgtcatttgcccacttttaatgttttttttcttataaatttgtttaaattccttatagatactggctaatagatctttgtctgatgcatagtttgcaaatattttctcccattctgtaggctgtttactctgttgataggttctttggctctgcagaagctcttacgtttagtt

SEQ ID NO: 190612 - DNA, 601 bp, Human
aacagagtgagacgctgtctcaaaaaaaaaaaaaaaaaagaagtagtttatagtggatagctggaatattggtgattgttgtctcctctgattaaagggggacaaatattaaaatcaatgatctttgattttattttatataatgttacctttaaatatttttaaatagcccagaaagtattataaaatggctgaatgtccaaatgtaagaccctatatacagacataacagcaaaatgaccacagtcaatccaaaactcattaaatgaaaccatgaatgaaaatagaaattttttgtggttttttttttaaactttcattttaggtttgggggtacatgtgaaggttcgttacataggtaagctgttgtcacaggggtttgttgtatagattatttcatcatctaggcattaagcctagtacccaacagttaccttttctgctcttctccctcctccccgcttcaccctcaagtaggctccagtgtctgttgcttccttctttgtgttcataagttcttatcgtttagcttccttataagtgagaacatgcggcatttggttttctatttctgcataagtttgctaaggataatagcctc

SEQ ID NO: 190613 - DNA, 601 bp, Human
tgttcaccttgtaaactgtgtgaagaatacaaataaaagtagtttacaggctgggcacggtggctcatgcctgtaatcccagcactttgggaggctgaggcaggcggatcatgaggtcaagagatcaagaccatcctggccaacatggtaaaactcggtctctactaaaaatacaaaaattagctgggcacggtggcacacgcctgcagtcccagctactcaggaggctgagacaggagaattgcttgaacccaggaggcagaggttgcagtgagccaagattgtgccactgcactccagyctgggcaacagagtgagacgctgtctcaaaaaaaaaaaaaaaaaagaagtagtttatagtggatagctggaatattggtgattgttgtctcctctgattaaagggggacaaatattaaaatcaatgatctttgattttattttatataatgttacctttaaatatttttaaatagcccagaaagtattataaaatggctgaatgtccaaatgtaagaccctatatacagacataacagcaaaatgaccacagtcaatccaaaactcattaaatgaaaccatgaatgaaaatagaaatttt

SEQ ID NO: 190614 - DNA, 601 bp, Human
accatctctactaaaaatacaaaaattagctgggtgtggtggagagcacctgtaatcccagctactcaggaggctgaggcagaagaatcacttgaacccaggaggcgggttgcagtgagccaagactgaaccactacactccagcctgggtgacagagaaagattgtgtctcaaaaaaaaaaaaaaaaaaaaaaaaaaaaaagcatgttcaccttgtaaactgtgtgaagaatacaaataaaagtagtttacaggctgggcacggtggctcatgcctgtaatcccagcactttgggaggcygaggcaggcggatcatgaggtcaagagatcaagaccatcctggccaacatggtaaaactcggtctctactaaaaatacaaaaattagctgggcacggtggcacacgcctgcagtcccagctactcaggaggctgagacaggagaattgcttgaacccaggaggcagaggttgcagtgagccaagattgtgccactgcactccagcctgggcaacagagtgagacgctgtctcaaaaaaaaaaaaaaaaaagaagtagtttatagtggatagctggaatattggtgattgttgtctcctct

SEQ ID NO: 190615 - DNA, 601 bp, Human
ttatactattctacttttgtgtatatttgaaacttttcttttgaaaaaaaattaagctaaaagaaaaaaattggttattctaaacacagatggattattataacatgataaatattcaagtaacaggtgttacaaaggatactaaaagtagttgcagtaaatcctcaggtcactaggaatttatatctgaacacatgacctaattcccttcaactccagaaaaaggcgtaatccttcaagtcccctggtcccatattgctccagctccccaagtactgagatgttactcctttgctcctcygcattggaaaaatcttcctccagcaggctataaacctgtgcaagtctctctcagatcaaactcaaacaaaaatctaccttagaagctgactaaccataatcacacatgttctttctaccacagtgacaatggtaccagcagctactcagtcacctctgtctcctactttcaattcatcatgaagtctatgctgtatacaaagaaaaagttgatttatgatgtaaccttaaatgaaaaacagtataacgcaacataccatcaaaatactatactatagcaaaatattatcaaaagcacagc

SEQ ID NO: 190616 - DNA, 601 bp, Human
tccgttatataaaacaatcctcagaagttggtatatcattaccacttttccagctttcctgatggtctgatatttagagggattaatagttttcgttgatttcttcgtttttactttatccaaaactgcataaacagcaaaacataatcgagccattcttggtaagtcacaaatattaatatcaaattccagtggttcattccaaatatgatcatttttccctgatacctctgagcttacgatggttttacacaggagctcagtaccatgaaaaagaccagccctgacatgaacctgtaaygaagcagacaaaaacaaaaacaaagtcatgaatactgtaccacgaaaaacatctctttttgtttgtttgtttgtttctacactaaaaacatctttattttggagaaggaaggaacatactggaagaagaaacatgccaagttttagaaagcctacttgtctgcagaaccactagagtgtaattaaccagtatatcgttcagtaaaccgtagttagtctaatctgtttttcacttgctaagtaaaccagctataaaatcacatattggtccaaatgccagggtgctcaatggtttaaacag

SEQ ID NO: 190617 - DNA, 601 bp, Human
attctcccacctcagcctcccaaagtgttgggattacaggcgtgggccactgcgcctagcctaaaaattatttttagaagactatatgatgataaccagaggagatgcttatattcccatgttaagaataaaagaacacggccaggcacggtggccacgcctgtaatcccagcactttgggaggccgaggcgggtgaatcacaaggtcaggggttcaagaccagcctggccaacatggtgaaatcctgtttctactaaaaatacaaaaaattagctgagtgtggtaacgggtgcctgtaaycccatttactcaggaggctgaggcaggagaatcgcttgatcccgggaggcggaagttgcagtgagccgagatcgtgccattgcactccatcccaggtgacagtgtgagactctgtctcaaaagaaaaaaagaataaaataacacaaattaatatatagataaatatagtaactagattttaaaaacatataaaattaatgtccctatccccaccaaaaagctttcaaaaagcaagaagaaagtgaaacatttgactgaaaacataacatggaagatgaaagtatgacaacaggtccatcc

SEQ ID NO: 190618 - DNA, 601 bp, Human
aatatattcagaaatacggccaggcgcggtggctcacgcctgtaatcccagcactttgggatggccgaggtgggcggatcacctgaggtcgggagttccagaccagcctgaccaacatggagaaaccctgtctctactaaaaatacaaaattagctggacgtggtggcacatgcctgtaatcccagctagcagggaggctgaggcaggagaatcgcttgaacctgggaggcagaggttgcagtgagccaagatcacaccatggcactccagcctgggcaacaagagcgaaactccgtcgcaaaaaaaaaaaaaaaaaaaaagaagtttagtctatttcattcctaaatatggtatggagatgcataagatttaaagacaaagctacccatcacaaaacttaaaagttatgtcccatagcgagactagacaatctctaatgagctaaatgaataatttgttaatactagagttaacttgttactagcaaaataatggtacattatttgttggaagtatgtttaaaatactaacttgttaaaataaccgtttaaaatacaggtcagtaacagtggctcatgcctgtaatcctagcactttggg

SEQ ID NO: 190619 - DNA, 601 bp, Human
tacaaaaaattagccaggtgtggtggtggacacctgtagtcccagctactggggaggctgaggcaggagaatggcatgaacccaggaggtggagcttgaagtgagcgcatatcacaccactgcactccagccgaggtgacagagcgagactccatctcaaaaaaaaaaaagtgtttttactatttctccctaattagagatgttccttctactcatgaagaaagttagcacaattaggagcaacaaaggttattataaagaagacactgttccttaggagaatttctcaaaaaaaaaaagaaaaaaaaacctacaaaaaatgctgaaagcaacacacattcattaaaataagaaatatattcagaaatacggccaggcgcggtggctcacgcctgtaatcccagcactttgggatggccgaggtgggcggatcacctgaggtcgggagttccagaccagcctgaccaacatggagaaaccctgtctctactaaaaatacaaaattagctggacgtggtggcacatgcctgtaatcccagctagcagggaggctgaggcaggagaatcgcttgaacctgggaggcagaggttgcagtgagcc

SEQ ID NO: 190620 - DNA, 601 bp, Human
atatgtagatatgtagatatggtgaataaagcaagaagcagaacattacacagaatgtgtcattttgtgtaagtatagggggaaaaacaggaatcgacatttgtatttcctagtccacataaaaaaattatggaaagttaggaaaaaaaataataaacgtgattgtataccttgtaatgatgacctagggactctggatggtagattatttgtagtttctttgcttcttgtttgcccctactgggttaaatgtaacaattctagagctgacacatgcagaactaatgtgttcatttattaytttttatcatacattttctcagagaggaagtcaggttcatagtattatgccaagttaacaccaccaaaaattgtaatttttactaaaaatactagtcaagttggttggtgattctggagaacatgtgtgagtctaaattaagattctcaagaaagtacagtattttgctgctatattttattgtattgtgaaagtttagttcctcctaagaaatatgtcaaataggctgggagctgtggctcatgcctataatcctagcactttgggaggctgaggaggtgaaaatcacttgagcccagg

SEQ ID NO: 190621 - DNA, 601 bp, Human
aaatcaaatttagtattttagtacttattagccccatacatagaggtaatcctttagccttgttcaaaagtgatcagaaaaaaaggcactctttttctgtgtgtatagggagacagagtctcactatgttgtccaggctggtctcaatctcctggactcaagtgatcctcctgcctcagtctcccaaagcattgggattatacatgtgaaccaccatatgtggcaaaaaaaaaaggcattcatatatactacacatggagagcaaaaattgatacacgctattgaggaacaatttgtaatkataagaattataaatttatctattctttgaatcaataaacccacctctaaggaatttatctcagatatacactgtacataagcatggttattcattatagcagcactgtttgaactatcagaacacaattctgcttaaaaaaaaaaatctaacagtccaggcatggggggaaaaacagttctctacatagatacgtagagaagatatggtgatatgtagatatgtagatatggtgaataaagcaagaagcagaacattacacagaatgtgtcattttgtgtaagtatagggggaaaaaca

SEQ ID NO: 190622 - DNA, 601 bp, Human
gatgagaaaatagagttaggtgtacaatctaagatcctctctctccaaagtaatttttcttttcttatactgactgtagtacagttgttctttctgtatctcctaaggaaaaaaaatatcagctctactctaattaggtctaatgtccataaagtatgcacactcagaattatttcctaaagctggaaaatctttacaagttttcgttccttaattcttcgttcatctttttaaatattttctcacctcacggactcaattttttctttttcttttttttttttttttttgagacagggtytctgtcacccaggttggggtgcagtggcatgatcttggctcactgcaacctccacctcccaggctcaagtgatcctcccaccttagcctcctgagtagctgggaccacaggcgcatgccaccatgcccagctaattttttaatttttggtagagacagggtttcaccatgttacccaggctggtcttgaactcctgagctcaagagatccacccaactcagcctccaaaagtgctggaattacaggtgtgagcaatcacacccagcccaaactcaattttcacctggatggaggcaactc

SEQ ID NO: 190623 - DNA, 601 bp, Human
ttttttatttcacagataagaaactcatgatgagaaaatagagttaggtgtacaatctaagatcctctctctccaaagtaatttttcttttcttatactgactgtagtacagttgttctttctgtatctcctaaggaaaaaaaatatcagctctactctaattaggtctaatgtccataaagtatgcacactcagaattatttcctaaagctggaaaatctttacaagttttcgttccttaattcttcgttcatctttttaaatattttctcacctcacggactcaattttttctttttcttttttttttttttttttgagacagggtctctgtcacccaggttggggtgcagtggcatgatcttggctcactgcaacctccacctcccaggctcaagtgatcctcccaccttagcctcctgagtagctgggaccacaggcgcatgccaccatgcccagctaattttttaatttttggtagagacagggtttcaccatgttacccaggctggtcttgaactcctgagctcaagagatccacccaactcagcctccaaaagtgctggaattacaggtgtgagcaatcacacccagcccaaac

SEQ ID NO: 190624 - DNA, 601 bp, Human
taatctggttttcatggttgtcacaataaccaaattggtattttaagtcatcaatgacattcttcttatcaaatctaacgataatgctctttattatcctgcaactgctgacagaaaataccttctctggtagcctctggaatactccattaagtggcgctccttttacctcaccaactgcttctttcttcaaggtactccttccttttccttttccaccacgctaaatatggtcaattcacagaactgtgtgtgtgattttagaatttcagtgtagttagaaaactctggagttcgcatyatataatttttttatttcacagataagaaactcatgatgagaaaatagagttaggtgtacaatctaagatcctctctctccaaagtaatttttcttttcttatactgactgtagtacagttgttctttctgtatctcctaaggaaaaaaaatatcagctctactctaattaggtctaatgtccataaagtatgcacactcagaattatttcctaaagctggaaaatctttacaagttttcgttccttaattcttcgttcatctttttaaatattttctcacctcacggactcaatttttt

SEQ ID NO: 190625 - DNA, 601 bp, Human
ttaatatttgaaacaacattttatgtattcagttacatatgaatatatttatagccctttaagggcgtgagatattaaaaaatagaacaattatgatttcttcattttataaataagaaaagtgaactccagagatgccttttctctctctcttttttttgagacggagttttgcttttgttgcccaggctggagtgcaatggcacgatcttggctcactgcaacctccgcctcccgggttcaagcaattctcctgctcagcctcccgagtagctgggattacaggcatgtgccaccatgyccagctaattttgtatttttagtagagacagggcttctccatgtttgtcaggctggtctcgaactcccgacctcaggtgatccacccacctcgggctcccaaagtgctgggattacaggcgtgaaccactgcgcccggcctggaggtaccttttcttacttagtcagtgataaaaccaaaactaacagagttaagaaggctccctgatccatggtcttcccactcaacaaagctgtcactgtatgggaagttttgaaagagacagatagagcttaaactatacatagaggaactgatcat

SEQ ID NO: 190626 - DNA, 601 bp, Human
ggcttatatatattcaaagactaaaatctctatcccaaactgatcttcttcaagaaagactctccaagagattagaaaggcaaaaaaaaaaaaaaaaaacaaaaaacaaaacaaacaaaaaaaaaaacttatatttgcaaatataggaggctatatttgtaaaagtacttcaaaaagcatttcatttgagccaaaagagcctataactgttgaacacacatcataactgaacatgataatagtcacagctaaaactattaaatatatcacgagtagctatggcttatggataaatttctaycaaaggaataactaaagacactacataaacgtattggatgagtcaaaatgtagctttttctactcagtgtatactaacgtatatgattcttgccatatttgaaatttatattataagcacaaaatttaatttggttgtaaattattgttcagaaaaacatgtttaaaaaacttgaaataaaaaattactccttagatggataaaatccaattataatgaaaatgaagaaagagtgaattacataaatttaatttgctaatactttaaatgtacaggtagattatcttaagtatttataaa

SEQ ID NO: 190627 - DNA, 601 bp, Human
ttcttcaattaacagacaccaaaagtagaagtaacgacaatatctaacttgtacaattgaaggagatcaataagcatatacttatttacatactttttgtttgtttttgagatggggtctatgttgcccaagctcgccttgaactcctgggctcaggcaattatcccacctcagcctcaagcagatgggactaaaggctgctgtccctggcttatatatattcaaagactaaaatctctatcccaaactgatcttcttcaagaaagactctccaagagattagaaaggcaaaaaaaaaaamaaaaaacaaaaaacaaaacaaacaaaaaaaaaaacttatatttgcaaatataggaggctatatttgtaaaagtacttcaaaaagcatttcatttgagccaaaagagcctataactgttgaacacacatcataactgaacatgataatagtcacagctaaaactattaaatatatcacgagtagctatggcttatggataaatttctaccaaaggaataactaaagacactacataaacgtattggatgagtcaaaatgtagctttttctactcagtgtatactaacgtatatgattcttg

SEQ ID NO: 190628 - DNA, 601 bp, Human
taagataaatgacagtaactaattacaaatcatcgaataaatggaaatcacaaatccatctcctataagttaaaaaaaagaagaaagaaaaaagagatgaatgggggagaagaggagttcaaggctgcagtgagctatgactgtaccattgcactccagcccgggcaacagagcaagaccctgactctaaaaagatagatagatagatagatagatagatagatagatagatagatagatagagatagagtagaagaaaagcctctaacctatgttataagccaactaataaatccaaaasgaaaagcaagatttaaaattggcaacccactgcagtaacactgattcaaggaagatgtattagtgaatgcaaaaagaagtgggtgacagcttgatctgaaatagaatgtttacttagtgtcaaaatacgcccccacaaaacctttatttattaactttatactagaaaaacctagcagacaccgtactaaccaagggataacagttaacttccagagtagtggtaaaagccgatattgcctcctgataaaatgcagtaagaaaactacacctttacttctttgatattcacactaaaaat

SEQ ID NO: 190629 - DNA, 601 bp, Human
agatacaaaaatataattccataaaaaaaaaaaaggcagatcctttaataatttctaagctaaggatgaagagattcttaaaacagtttctaaaaatctaaaaatgtaaactgtgcaaacactgggtggcagtattgctttttggataaaaatccaagtcaggccaggcaaggtggctcacgcctgtaatcccaacactttgggaggccaatgtgggtgggtggactgcctgaggtcaggagtttgagactagcctgggcaacgtggtgaaaacccgtctttacaaaaaatacaaaatacaaaaaaaaaaggataatgaggtggagactaagaagacagttataagactagaagactgattacaaacaggggattgagcaaataagtaaatacaccaaagttaacagaaatccagatttctcatcattagaaaagggaattacaaatatgaaaagacaaagactagaaaatatacagtgggaatggatccatattagaggtattgatgagaactcatggtctttaatagatggataaataaatatatctctgtgtatgtttattttcccaaacatatggaggtaaacaaatatatactgtc

SEQ ID NO: 190630 - DNA, 601 bp, Human
atgtgaatccaaccaagtaccatacacccaaaaaaagttatagaaacgatcttttgttacctgagcaacatcctcaagtttattccacttgattgacagcagtaattttggcagtgattgtgggaaaatctctcggcagtcttgtcgcaaagtccaaataagatccatttcattttcacacagttgagacaagggatccctgtccaagatttctttcaatacaggaagaaacttttttccacctcgactctaaaaaagtaaaatgctcattatagaatttaattgtgcaaacaccacagcraactttcagtaaatttatatatatttatatataataaatgaacctaagtatgtgagatacaaaaatataattccataaaaaaaaaaaaggcagatcctttaataatttctaagctaaggatgaagagattcttaaaacagtttctaaaaatctaaaaatgtaaactgtgcaaacactgggtggcagtattgctttttggataaaaatccaagtcaggccaggcaaggtggctcacgcctgtaatcccaacactttgggaggccaatgtgggtgggtggactgcctgaggtcaggagtttg

SEQ ID NO: 190631 - DNA, 601 bp, Human
ctggttaatttttgtatttgttgtagagacaaggttttgccatgttgcccaggctggtcttaaattgctgagctggtctcaacctcctgatctgcccacctcagcctcccaaagtgctgggattacagacatgagccacagaccccagccattttatttttttgagacaaggtctcactctattgcccagggtagagtgcaatggcatttggttcactgcagcctcaacctcccagattccaacaattctcccatttcagccactcaagtagctaggactacaggcacatgccagcatgtccagctaatgtttgtattttttgtagagatggggtttcaccatgttgcccaggctggtctggaactcctgagctcaagcgatccacctgccttggcctcccaaagtgctgggattagaggtgtgtgctaccatgcctggctccaaagatctttagacactaaaagtaaacacaaaagaaatcctttctactcttaaattgagaagtgaaacaataaatccaaagatttttaaaatgcatataattaagataaatctgtatttcttcactaaatttttagtcactatagatttactaagact

SEQ ID NO: 190632 - DNA, 601 bp, Human
agaaacttaaatattccttaatagggaatgaattaaataagatatatccctatgacagaatattacacagtagtgaaaggaataaatgacatttaaacataatgggagagactaacctcaaaaacctgatgttgaatttttatttatttatgtatttgtattttattttttgagacagggtctcactctgtcacccaggctggagtgtagtggcaccatctcagctcctgcaacctccgcctccagggctcaagtgatcctcctacctcagccgcccaagtagctgggaccacaggtgcgyacctccacgcccagctaatgtctctgtatttttggtagagacggggcttaaccatgttgccaaggctggtctcaaactcctgggctcatcgatctgcctgcgtttgtctcccaaagtgatgggattataggtgtgagccaccacagctggctgaattattattatttttttttggagacggagtctcgctctgtcaaccaggctggagtgcagtggtacgatctctgcccactgcaacctctgcctcctgggttcaagtgattcttctgcctcagcctcctgagtagctgagattacagg

SEQ ID NO: 190633 - DNA, 601 bp, Human
tggataaacttcattgtctgagacagtcatttcttcagtgaatctcatagattctcacaaatgcaccatccaagggagactgtacaaacatgttcactgaagcattatttataatagggaaatgtggagaaacttaaatattccttaatagggaatgaattaaataagatatatccctatgacagaatattacacagtagtgaaaggaataaatgacatttaaacataatgggagagactaacctcaaaaacctgatgttgaatttttatttatttatgtatttgtattttattttttgasacagggtctcactctgtcacccaggctggagtgtagtggcaccatctcagctcctgcaacctccgcctccagggctcaagtgatcctcctacctcagccgcccaagtagctgggaccacaggtgcgcacctccacgcccagctaatgtctctgtatttttggtagagacggggcttaaccatgttgccaaggctggtctcaaactcctgggctcatcgatctgcctgcgtttgtctcccaaagtgatgggattataggtgtgagccaccacagctggctgaattattattattttttttt

SEQ ID NO: 190634 - DNA, 601 bp, Human
tcattttttaaaactatctataacacaattttgattaggtttattgtaaaattcatgcccactatataacctataaatagtgtaaaaaatagaaagtataggaataggaagctgtttcctcttctctcacatttctaatttcactccccagaagtaagcactattggtgagtctgtgtaattacttttggctattacacagcttaaaacatacacgattttaaaaagaaaaaaggatcatagtatccacactattttgtgggcttttatgtttcaaaaaccataaagtacataagcctcayttttgaacctagaaagaaaatggataaacttcattgtctgagacagtcatttcttcagtgaatctcatagattctcacaaatgcaccatccaagggagactgtacaaacatgttcactgaagcattatttataatagggaaatgtggagaaacttaaatattccttaatagggaatgaattaaataagatatatccctatgacagaatattacacagtagtgaaaggaataaatgacatttaaacataatgggagagactaacctcaaaaacctgatgttgaatttttatttatttatgt

SEQ ID NO: 190635 - DNA, 601 bp, Human
gctcaattaattaaggttagtggttctctattttgtgtcaatctccaaaccattctacctgtaaacacactcctatcagaggcaactccagcagtataaggtatgaagcccaagtgccccaagtgctccacttactctccacagtattgggtaataaatggttaaggaattagtagtctaaggcagatatctgggactgaaacccagggcactatataccaaaaccaaaaactcataaccagaaatttcacaatagaaaaaccaccagaattagctacacggaatacacggatcactgccrtctcctcagagggatcaatgcgtttaagaaaaacacttggctcagcccaaggagaaccaggtggcccctccacaacaggtctccaatgcaaacttaagcagatggtgaagcaactgggaattcattttttaaaactatctataacacaattttgattaggtttattgtaaaattcatgcccactatataacctataaatagtgtaaaaaatagaaagtataggaataggaagctgtttcctcttctctcacatttctaatttcactccccagaagtaagcactattggtgagtctgtgta

SEQ ID NO: 190636 - DNA, 601 bp, Human
gtgactgaatcaatgtggccctccatgctagtctcatgacagtgagtgagttctcatgagatctgatggcttcataagaggtggtttcccctgctctttcccttttcctgccaccttgtgaagatggtacttgcttctccttcgccttctaccataattttaagttttgtgaggcctccctagccatgtggaactgtgagtcaattaaacatctttcctttataaattacccagtctcaggtaattctttataatggtgtgaaaatggactactacagattgttaaaattcatgactgtatttttcagtcagctaagagttaccaaaaatattaggtactttaatactgatttctgatcatgctaaaaaatttgtgcttagtaaaacaatcatttttaaaataaaaattccatcagtactttcacaatttattttcctttgctgttattagggttaagttgtcccagataaccaatgtacaattaaaatcttaacttcaaatagtttgaaggatgagaaagtgaatacatttataagtgggaattgatcattgaaataatataacagataacattgtaattaactgagctcaattaattaa

SEQ ID NO: 190637 - DNA, 601 bp, Human
aatcaaatcatagctcactgcaacctcaaattcctgggctcaagcaatcctcccacctcggcctctcaagtagctgggactacagttgcaagccaccttctaattttttctagagatgggtctcactatgttgtgcaggttagtctcaaacttctgggcttaagtgatcctcccaccttagcctttcaaagtgctgggttttcaggtgtgagccactgcatctggccacagtctacatttttaaaatgtcactttatcttctgtgtatagaatgttgggggagatgtaggaagggaaacamggggtacaatttagatagttaatgaagaagtccagtgaaaaagaatagtagcttggactaggatggtagccatgaacacaagggaaataggcagagatgtgagatatatttcagggttctataaaattcagaggattaataatattgattccatgttgttgttaagaataaatgacccataataagtgatgaataaacattagctattattacaatcattaatgggcttttcaaaaggaagggatcagaaaaagtttttaacatcatgaaaaatcctaaatattaaaaacacctaatgga

SEQ ID NO: 190638 - DNA, 601 bp, Human
aaataaataataacaacaaataaaattcaactttattatttaataactgagggtcttttatgtcacagtacataaaattcataacaacttcagccacgcataaagaaggagcagcttattttacaagtatatcattaaaactggaaaaaacaaatgttaaaaatagaattaaaaagtataccgtaacaagcatataaaatatgtctatcacaaatataaacaatgtggcttgaaattccatgaacaagagatttaatttataacatgttttcatttttaaattctgcttctatgcaaggaraccactaagactatgtagggagatgaattcaagcatgcagtttccacagaggctgagaccttgctcacaggaaactaggaaggacctatgcagcttgatgataaaattgagatggctgaaacttaccaagttagccatctgttaaaaccacagatcactctacttctcaacagtttcaggagctgtacaaacactggtgacaaggcaaccagataaaaactgggctaagcaaacaggaactttttacaagtatgtgaaatttgaaacttcttccatgtctgtacagttgaaagttttcat

SEQ ID NO: 190639 - DNA, 601 bp, Human
tacttcttgtcatcactcttgtatgatatctcaatatattctatttccattaacagcatagctagaacgaattattttataataaagtgtgaatatagacatgctatttgttattcaaatctaaattacttgtttttataataactatggctatcaaaacttatgcaagtaaaaaaaaaaacttatgcaagtagtacaaggtgtatcaacaatggccaactaaatcaaaaccattatgtttaaaattcaactttaggctgggtgtgatggctcacgtctgtaatcccagcactttgggaarctgaggcaagtggatgagttgaggccaggagttcaagaccagcctggccaacatggagaaaccccctatctactaaaaatacaaaaattagccagacacggtggtgtgcacctgtaatcccagctactcaggaggctgaggcaggagaatcactggaacctgggagctggaggctgcagtgagccaagatcgtaccactacactctccagcctgggcaacacagtgagactatgtctcaaaaaataaataaatcagggtcaggtgcagtggctcatgcctgtaatcccagtattttggga

SEQ ID NO: 190640 - DNA, 601 bp, Human
taagaagataaatgtggcccagcactttgggaggctgaggcagctggatcacttgaggtcaggagtttgagactagcctgggcaacatggcgaaaccctatctctacaaaaagaaatacaaaaatttgctgggcatggtggcacttgcctgtaatcccagctacttgggaggctgaggcataagaatcgctttaaccttggaggtggaggttgcagtgagccaagattaagccactgcagcactccagcctgggtaagagagtgagaaactgtctcaaaaaaaaaaaaaaaaaaaaaaaagaagaaagaaagaaagaagataaatatgaaacttaaactactcaaaattctgcaattcattgtatagtagaatttgagacatcactaacctaaaccagtccatttggccaacttcctagtattagagaaaaacctatgtagaagtaactctgaggttcttgctattcaaccttaatatctacttcttgtcatcactcttgtatgatatctcaatatattctatttccattaacagcatagctagaacgaattattttataataaagtgtgaatatagacatgctatttgttattcaaatct

SEQ ID NO: 190641 - DNA, 601 bp, Human
acttaagaagataaatgtggcccagcactttgggaggctgaggcagctggatcacttgaggtcaggagtttgagactagcctgggcaacatggcgaaaccctatctctacaaaaagaaatacaaaaatttgctgggcatggtggcacttgcctgtaatcccagctacttgggaggctgaggcataagaatcgctttaaccttggaggtggaggttgcagtgagccaagattaagccactgcagcactccagcctgggtaagagagtgagaaactgtctcaaaaaaaaaaaaaaaaaaaaagaaaaagaaagaaagaaagaagataaatatgaaacttaaactactcaaaattctgcaattcattgtatagtagaatttgagacatcactaacctaaaccagtccatttggccaacttcctagtattagagaaaaacctatgtagaagtaactctgaggttcttgctattcaaccttaatatctacttcttgtcatcactcttgtatgatatctcaatatattctatttccattaacagcatagctagaacgaattattttataataaagtgtgaatatagacatgctatttgttattcaaa

SEQ ID NO: 190642 - DNA, 601 bp, Human
gagagttcttaagaatcacgtaagtaactgcatcacgaggtcacaaaactgtaatggttcaatttattatcatgtctaagggtattttcagggaagagagcacatgaaactagtgacatccacataatgacatttgtatggtcaagtgacattaaatgtttagcaaaaccctatgagttctttttaagttgtaagcacatattctgataagcacatttgcttatgttatctcaattccttttaataaccctgacatacagatgctataattctcaaggatatgaaaaacctgaagctcaaycagttttctgtgccttgtttgtagtcacataactaacaagtcaccactgcctattggctggtatgattacttcagaggcatttcctttacacattttgggtctgttaggtactttcatcaaaatacaaaactatggcagcaaaatcaatattgctatcactgaaacaagatgtatgaatatattactgaaaatatccttgcctgggcacggtggctcatgcttgtaatcccagcactttgaaaggccggggtgggtgaatcacttgagctcaggagttcaataccaccctggtcaacatg

SEQ ID NO: 190643 - DNA, 601 bp, Human
atattttcactaattttataacaaatattacactctttggatagcatgtccctgtgacattatttcagacattaaattaaaagattttttaaattgtttgccatgtgtaagttacatcctattgaatataagcatagcttcggagaacttttaagattttccttccttgattatattctacctcccgaggctgacagctggccctactactcccataaggcagtgactttctgcttgctattcacaggagattcactgcgcaaagcacagtcacttactagaggtccgagaggataacacmtgggttcaggggtactaattgtatgctgtaatactgtttgtattacactgtatgtgtattacattaattacatggttaattttttccttcttgcttgcttttaccactatacggagagttcttaagaatcacgtaagtaactgcatcacgaggtcacaaaactgtaatggttcaatttattatcatgtctaagggtattttcagggaagagagcacatgaaactagtgacatccacataatgacatttgtatggtcaagtgacattaaatgtttagcaaaaccctatgagttctttttaa

SEQ ID NO: 190644 - DNA, 601 bp, Human
gcatgtgctccacgcctggctaacttttgtatttttagaagagacagggtttcaccatgtgggccaggctggtctcaaactcctgacctcaagtgatcggcccgctttggtctcccaaagtgctgggattacaggtgtgtgccaacatgcctattagtttgtttttatactttttataaaatgccttttcacatcttttccttatgttcacttctatgggctctttaaatatttaccccttgttctgttcattgtgaatacgattcccagtctgaggcttgattttatgtttccttttttytgtcacgacaccacaaacctcttccgctcactatctacccctattgatggtggcaaactaaaaacctgagaatgcacctaaacattttcctctcttttcccttggtaggtagagaaatcaatgtccctggactaagtataaaaaggcacaggactttctctggccttgtcattgccatgacccacagtacatctttcaacaccataggttggaatgtaattctggctgtctgtccaaaccttattaaagttcaaacctattccttctttctggaatttcagtaacatgtgtagttttaaa

SEQ ID NO: 190645 - DNA, 601 bp, Human
caattgttcttataatctgtacttcttaattggaactgacaattttcatgttagtttttttttttttttttttttttgagacagagtctcactttgtcatccaggctggagtgtagtggtgcaatctctgttccctgcaacctccacttcccgggtttaagcgattctcatgcctcagccaccagagtagctgggagtacgggcatgtgctccacgcctggctaacttttgtatttttagaagagacagggtttcaccatgtgggccaggctggtctcaaactcctgacctcaagtgatckgcccgctttggtctcccaaagtgctgggattacaggtgtgtgccaacatgcctattagtttgtttttatactttttataaaatgccttttcacatcttttccttatgttcacttctatgggctctttaaatatttaccccttgttctgttcattgtgaatacgattcccagtctgaggcttgattttatgtttccttttttctgtcacgacaccacaaacctcttccgctcactatctacccctattgatggtggcaaactaaaaacctgagaatgcacctaaacattttcctctctttt

SEQ ID NO: 190646 - DNA, 601 bp, Human
ttagttaaaatataagtggtagaatttatcctaaagtacctataatgatcaagaagagggctaagttatggattaattttggaatttgttaaatctggctgggcgcggtgactcatgcctgtaatcccaatactttgggaggccaaggcgggcggatcacctgaagtcgggagttcaagaccagcctgaccaacatggagaaaccccgtcttactaaaactacaaaattagccaggcatggtggcacattcctataatcccagctactcgggaggctgaggcaggagaatcacttgaaccygggaggcggaggttgcagtgagctgagatcgtgccattgcactctggcctgggcaacaagagggaaactcccgtttcaaacaaaaaaaacttgttaaatcaaatatgcagtttaaaaacttaagaatattccctaaaataaataatatagtatataaagattctatataagagctgggtatggtggcatatgtctgtaatcccagatacttgtaagactgaggtgggaggatcgcttgaggccaggagtttgagaccagagagagcaacatagtgagactctgtctctcaaaaaaaattt

SEQ ID NO: 190647 - DNA, 601 bp, Human
gctgggttacaggcgtgagccaccgtgcccagccttactcaagattgagggtaatataaattcattttcagacaaaacccggagtgagggagtatggtacaaaaagcaatggtgaatgaagaaatatttaaaattgtatacaagaaattctagtaaaaattcactgtaacgaataatataaggagttgttaaatattagttaaaatataagtggtagaatttatcctaaagtacctataatgatcaagaagagggctaagttatggattaattttggaatttgttaaatctggctgggcgyggtgactcatgcctgtaatcccaatactttgggaggccaaggcgggcggatcacctgaagtcgggagttcaagaccagcctgaccaacatggagaaaccccgtcttactaaaactacaaaattagccaggcatggtggcacattcctataatcccagctactcgggaggctgaggcaggagaatcacttgaacctgggaggcggaggttgcagtgagctgagatcgtgccattgcactctggcctgggcaacaagagggaaactcccgtttcaaacaaaaaaaacttgttaaatcaaata

SEQ ID NO: 190648 - DNA, 601 bp, Human
tatggataaataaaatgtggcacatccttgcaaaagaatattgtttgacaatgaaatgaaatactggttactgttaaaacatgaatacactttgaagccattacgcttagagaaagaagccagtgacaaaggccccatattgtgtttccatttatataaaatgtccaaaaaaggtacatctatagaccattaattagtggttgcctagaattggagtggtttcagggagggggttgggggtaacagctaaggagtgcagggtttttgaagggttgataaaaatgttgtaaaattaattgtrgtgatggttgcacaactcagaaaatgcatataaccactgaaatgtacactctaaaccagtgaattgtgatatgacaattatactgtatcccaataatagtaaacaaaaactccatacccagctaaactattatgcaagattttttttttttttttgagatggagcttcgctcttgttgcccaggctggagtatgcaatggtgccatctccgctcactgcaacctccccttcctgggttcaagagattctcctgcctcagcctccccagtagctgggattacagggatgtgccaccatgcc

SEQ ID NO: 190649 - DNA, 601 bp, Human
cacctgtaatcccagcactttgggaggccaaggcaggtggatcacctgaggtcaggagttcaagaccagcctggccaacgtgatgaaaccctgtctccactaaaagtacaaaaattagccaggagttgtagtggccgcttgtcattatcccagctacttgggaggctgaggtggagaatcgtttgaacctgggaggtggaggtgtcagtgagccgagaccgcgccactgcactccagcctgggcgacagcacaagaccctatctcaaaacaaaacaaaacaaaacaactgtgagaatgatrtatcaacaaaggaagactatcaatagatagatattatttaaatgaatcaaacagaaattccagagttgaaaagggcaataactgaaattttaaaattcaccaggtagacacaacagcagatatgagcataataaaaaattggcaaacttgtggataggtcaattatccaatcagagaaacaaaagaaaaaataatgaagaaaaaagaacagagccttagagacctgtagaacaccaccaagcaaagcaataaatgcataatggcgtttaagaaggagatgagagagagaggcagaaaaaa

SEQ ID NO: 190650 - DNA, 601 bp, Human
atagaaaatatggaaggttaagagacataaaggagagaacaggaaagtttaatataaatctactagagctgcagaaaaagacaatgagagtgggagaactgcaatactgaaggaaatgttcaaagttttcagaaactaaaagatgtgacttctttgaaaaggcacaatgaaaatggtgataaaaaaaagaaataaaagaaatacacacgcacagattgtactgcagacaaaggcaaagagaaactttttgatgcactaaggtgtaaaaaagacattacttacaaagaaccgataaccagaycgagaacagactttttaaaaaccgagactagaagacaaatgaataatatcctcaaggcttctgaggaaagcagtcaatttggatttcaaacttctatagccaaatgatatcaaactctgaatatctacttctccataaaagcaacaagaatactgacaaaaattgttgaaatcaactattttagagttctgaaaataaaacaaaggcttgcagcaatccaataagtgtttatttaaaacacacacacacgtacacacacacatacacacacacacaccccaacgtgaatctgttttgttt

SEQ ID NO: 190651 - DNA, 601 bp, Human
tgaaaagactcagcctggtctcaacgccagagcacacagagacttgagtaaaactgttataatgataagatatgaaaagatagaaaatatggaaggttaagagacataaaggagagaacaggaaagtttaatataaatctactagagctgcagaaaaagacaatgagagtgggagaactgcaatactgaaggaaatgttcaaagttttcagaaactaaaagatgtgacttctttgaaaaggcacaatgaaaatggtgataaaaaaaagaaataaaagaaatacacacgcacagattgtacygcagacaaaggcaaagagaaactttttgatgcactaaggtgtaaaaaagacattacttacaaagaaccgataaccagaccgagaacagactttttaaaaaccgagactagaagacaaatgaataatatcctcaaggcttctgaggaaagcagtcaatttggatttcaaacttctatagccaaatgatatcaaactctgaatatctacttctccataaaagcaacaagaatactgacaaaaattgttgaaatcaactattttagagttctgaaaataaaacaaaggcttgcagcaatccaa

SEQ ID NO: 190652 - DNA, 601 bp, Human
ggggatgtaaaatgtaaactccattagtgtaattcagatatgaagtcttaatggaggcaactgtcaaaaaattgatttcacatgtatttgttggggtagagtgggggtgtgcagaggactggcaaatctacccacggccagataggtttatatgtagccagcctataagatttgcttattacttcttcaccaaaggaggtcagggagtcctaacacatcaatgtcttataaatgatctaagctgacatgaaaggtatcaaaagagtattttggaacgtcatagaaaaatgaaaatgagcawtatgtattttcattcatgcaaacatggcactgttacaagtactaaaacagtaatgtacagaaggtacctcaagatttgggattgaccttaaaagagtgtgtgctacatgacccactttaacctaaacagctggccgaaagaaaaaacaaacaaaatagaaacattggagcacatatatttatagaaacagtaaaaaaggtttggtgagaaaaaggtaccagtttggaaatgaacttaaaaaaaaattaaagtccttcattttttaaaaacatggggtcaaagtacaaaaagtcagcaaag

SEQ ID NO: 190653 - DNA, 601 bp, Human
gtataggtctcttaaaagggaagtaggccaggtgcggtggctcacgcctgtaatcctagcactttgggaggccaaggtgggcggactgcttgagtcaaggagtttaagaccagcctgggcaacatggtgaaactttgtctctacaaaaagtaaaaaaattagccaggtgtgatgacaggtgcctgtggcagctactcaggaggctgagatggaagatcacctgagcccaaggagttgaggttgccgtgaaccatgattgtgctactgcactccagctggggtgatacagtgagaccctgtytcaaaaaaaaaaaaaaaaaaggggggggggatgtaaaatgtaaactccattagtgtaattcagatatgaagtcttaatggaggcaactgtcaaaaaattgatttcacatgtatttgttggggtagagtgggggtgtgcagaggactggcaaatctacccacggccagataggtttatatgtagccagcctataagatttgcttattacttcttcaccaaaggaggtcagggagtcctaacacatcaatgtcttataaatgatctaagctgacatgaaaggtatcaaaagagtattttgga

SEQ ID NO: 190654 - DNA, 601 bp, Human
caccttcttcctccaaccctctgagatgctgacaccactatcattaaataacttttgtataggtctcttaaaagggaagtaggccaggtgcggtggctcacgcctgtaatcctagcactttgggaggccaaggtgggcggactgcttgagtcaaggagtttaagaccagcctgggcaacatggtgaaactttgtctctacaaaaagtaaaaaaattagccaggtgtgatgacaggtgcctgtggcagctactcaggaggctgagatggaagatcacctgagcccaaggagttgaggttgcsgtgaaccatgattgtgctactgcactccagctggggtgatacagtgagaccctgtctcaaaaaaaaaaaaaaaaaaggggggggggatgtaaaatgtaaactccattagtgtaattcagatatgaagtcttaatggaggcaactgtcaaaaaattgatttcacatgtatttgttggggtagagtgggggtgtgcagaggactggcaaatctacccacggccagataggtttatatgtagccagcctataagatttgcttattacttcttcaccaaaggaggtcagggagtcctaacacat

SEQ ID NO: 190655 - DNA, 601 bp, Human
ctctgacacaatgaccaaagtctgagtagtaccttagccatggcttccaaaggagaaaagtttaaatcttttacctaatgcttgcattatttccaccttcttcctccaaccctctgagatgctgacaccactatcattaaataacttttgtataggtctcttaaaagggaagtaggccaggtgcggtggctcacgcctgtaatcctagcactttgggaggccaaggtgggcggactgcttgagtcaaggagtttaagaccagcctgggcaacatggtgaaactttgtctctacaaaaagtaaaaaaattagccaggtgtgatgacaggtgcctgtggcagctactcaggaggctgagatggaagatcacctgagcccaaggagttgaggttgccgtgaaccatgattgtgctactgcactccagctggggtgatacagtgagaccctgtctcaaaaaaaaaaaaaaaaaaggggggggggatgtaaaatgtaaactccattagtgtaattcagatatgaagtcttaatggaggcaactgtcaaaaaattgatttcacatgtatttgttggggtagagtgggggtgtgcagaggactggcaa

SEQ ID NO: 190656 - DNA, 601 bp, Human
tgactctgacacaatgaccaaagtctgagtagtaccttagccatggcttccaaaggagaaaagtttaaatcttttacctaatgcttgcattatttccaccttcttcctccaaccctctgagatgctgacaccactatcattaaataacttttgtataggtctcttaaaagggaagtaggccaggtgcggtggctcacgcctgtaatcctagcactttgggaggccaaggtgggcggactgcttgagtcaaggagtttaagaccagcctgggcaacatggtgaaactttgtctctacaaaamgtaaaaaaattagccaggtgtgatgacaggtgcctgtggcagctactcaggaggctgagatggaagatcacctgagcccaaggagttgaggttgccgtgaaccatgattgtgctactgcactccagctggggtgatacagtgagaccctgtctcaaaaaaaaaaaaaaaaaaggggggggggatgtaaaatgtaaactccattagtgtaattcagatatgaagtcttaatggaggcaactgtcaaaaaattgatttcacatgtatttgttggggtagagtgggggtgtgcagaggactgg

SEQ ID NO: 190657 - DNA, 601 bp, Human
aaacactaatatttcctctaacacactgctgacttctattgggagcatacagtatttgtttggctgtttgtacagaaaaatgataattaaacagaataaactaacccagagttgtattctttaagccagttcagaagggcatctttgttgaaggctgctgcagcagccacattgctactgttcagctgaatgtcagcaattgtttcagaggtgctcacaacttcaatgaggccagagcgatctcctgttgctaaacagccataaggcaacatcctggaaggaaaaaaatgggcatagagtyatattttccttaaaatgaaacattaatttggtaagattttccctttactttttaaaaaaagttttattattattgatatacttgccattactatattattgtcatatggaaaaacacaagttccaccaaaggagtaaatctcttggccaacagaaggagtaatttacaaggattccaatgtgccaattacatataaaattttttgtctaattattctggtgaaacattctatttgcttgtgtaggtggacagaagtacattggatcaaagtctttcactcttactctacattttggggaa

SEQ ID NO: 190658 - DNA, 601 bp, Human
ttcctcaatggctcggtccaggtcatccctgaacaagagaaaagaacagaagcaaaaaaggttttcagcctccaagcgtgtagagtgagacccaaaccatacctctgtttcctttttaattgtgaggagaacacagagctgccaaaaccgtatgagagaacatgtggatcagccaaggggagtgtgggtggtcttcacaggggctgggctgagagagctgccttcaaagacattaaataactgggccttagatattcaaacgtcctgggagctgtgtttcggtggggctgtgagtagactmatgttcacagtacttagaagagaccatggctttgctagatcatgctaggggttgggaacattttagttagttttgaccaaagactgactacaatttcatgtttaagagttaagcactgcagtttcaaacatttaagtcactgatttcaattagaagtaagtaatagagattccctggagacaaggccttaagatcaaaatttggaaactgatttgcatattacaagttctcgataaaatgtgtctgactctgaagtctttagccaaaaatacttgcagaccatttccccctcacactgtg

SEQ ID NO: 190659 - DNA, 601 bp, Human
ttgattggtggacttccttgtatagaaactagggagaaatctcaactgtcagatctgcaggacttttcaatggaaccaatcagatttctagaatagaatcacctagtcttttgatgagggtcaactatacatctggctgccactgttcttagaataaagcaagtggaagtggctgcagattgtaccatttactacgccgactttcactccatctccatttttaatatgggaccctttcttgtagtctctgtagaaataagtgtgcttgagtcagaaccagtttcttcagagaataaatctrtctccttcttggcatagggaaggggacttgagtgcctaactgttccatatataagctgccaactagttctgtttcagcctctttctgtatccctccttgaacagtatacatggtgcctctgattccagagcttttatgggacttgcgtacccctttacaagtactgactttctattttctcagttctgctaagtcactgccacttctctatctcactttctatcaccccgaagtctggtaataggtttcacccactgtggcctattttcctatcatctttgacttcttgagtttatatat

SEQ ID NO: 190660 - DNA, 601 bp, Human
tagtatattatttgcttagtaagtgcccttctttcctcttctttttttttttttttttttttttttgagacggagtctcgctctgtcgcccaggctagagtgcagtggcgtgatttcagcttactgcaagctccacctcccaggttcacgccattctccttctttctggaatatccattaggctgagagtatacctccctggactgagtctctattgtttctggatcttctctctatttatcatattttttggagatattaaggcatggtggattaaaaaaaaagaatatgagccaaactsccagggttaaaatcctgatatgtctactctctgttgccttaatatcctcacttgtaaaatggggctattgccgccactctataaggttgtcatcaggcctgaaggcattagattatatataaagcacttacaactatgcctgccacaaaatatttacactatttctattttaactttttgtttgttcctatttctaattttcaagacctctatgtgctgattgtaaaaaacagaatcctattattactttaaagatacaatatatttttttgctttgatttttaaaatcaccctctgttt

SEQ ID NO: 190661 - DNA, 601 bp, Human
gtatgtgttggttacatgatatgtctctaaccatcatagtagcccttaatttcatatttttgtccccattttaagatgatacaaaggcaaaaagacaagtattatgcttgggaacatgtaggtagccagtaatagatcagagattaaaaaatttgccctgaattctagttcccttactgtactccatacacaatgacagcagatgtcttttcagcatcttcctatcaactgtcttaatagtttcagagaatgttctgaaacaggtaaaaggtagtatattattggaataaaatataataaytattttaaatttctagcattctgtttctcctatctgggaatttctgaaccagcacaataatctgacaggcaaattcccccaaaagcttcctataatcagactgaatatctcccagatccaaatatatctcagctaagaaatgctggtccacctggtcagataagaaaatgttagaagtgttcagccttggcacaagggcagtactcaccggccaaacttttctgtatttcctgtttttccttgttgaatgacatggatgaaatcataggtaagaataaaaggcactcgctcccttttaat

SEQ ID NO: 190662 - DNA, 601 bp, Human
ttggccctccctcttcccccactgctgtttcctctggtctgggctggaggggccctgacttactgaataggtgtcagctgcaaagttcaaagaatgctcagtaggcattggatgacagggtggggcaggggatggccaggagccaaatcccagctctggggcaaggatgggcagatcagggggcttccagcagagatcaaggggcccccagcttcctggagtgacttcacactaagtcatactgaaagtttacacttcaaaggggttacctgtgtttcttttttctttcctcctttctttkcttttaccctccaccagcccagtcagccagagaacggcatcaacagacatgctttgaactccagaccctccctagctgtgctactctggacatgttacttcatctctttgagactgtttcttcatctgtaaaatgggcatattcatatctccctcaaaggctgtgtgaggcttaggtgaagtcatgtgcataaagcaccgggcagagtgcctgaacgcagtggagacacagcacatggcagccttcataaccatcaccttccagtgtagatagagcaggatgcttcatgagttggtgctg

SEQ ID NO: 190663 - DNA, 601 bp, Human
tatcttgtttctgcacagactaccagcagagaagctggcagaaagcaggactgtgggcttcaacatcagaaggcccagggctcaagtctcatctcttacaagtctcttcctctgtctgagcctcagtcactgcataacatggggttacttatccctccctcactgtgctgtgctgtaagatgactagcacagtgctggacacacagcagaccagcggtaaagacccttggtaaatggtgggaggtggtgggtgaggaccccatcaataagcaaggtggctcctgggatgaacataagccasttctgaacccaagactataaagggagaacaagagtaccttgacctcccagcaaccagataatgttgatggaggcctggggctggccttccggcatctgctgtggcagtactaattgggatgtcctgggtcaggagtttcccacccttgtggaagggagctcttggccctccctcttcccccactgctgtttcctctggtctgggctggaggggccctgacttactgaataggtgtcagctgcaaagttcaaagaatgctcagtaggcattggatgacagggtggggcaggggatggccag

SEQ ID NO: 190664 - DNA, 601 bp, Human
acttgagagtgggcatccctgagtcctggggcagtgatagtaaccatgcatcctagaccagtttcactggattcgtccagtggctgaatctgcacggtctgctcgactactgcttgatgctcgattgacgctgatgctgtagtgagaagaaaaggtggcccttgtcctttcctttgtatccaaaaccctcccttctacctccctgctttattttacaatgaagcacagaagtcacctctttcagaaattcttctgggatccccttctctgggtagtccccatcccctcactcccaccctgkgcttttctttgccacactgtgttgcgagtgttggtgtgcctgcctccactgcaaagactttgctttcctggacatcagggcctgtgacatgctctgctgtcctgtgcctgccgtggtgaccagcccgtgagggaagcagtatgttcagggcagtggttaactaaaatcctccctctgcacttccccaaggtcacacagcaagaaatcctgcagtggttttcttatctgtaaaatgaggcttgaaagggtgttgtgaagattaagtcagctaatgtaacgtttgaatagcatctggcatga

SEQ ID NO: 190665 - DNA, 601 bp, Human
gtgatgctgctgctgctgctgctgcctctgctttgggatccacagctctaaaggaacccacagtgcaaacagcgacaaatggccatttgatccttgacttcaggtaacaggatgggctgaagactgtggtaaactaggaaatgtaacatctaaagggagcagctgcaacatattccagggatccacgcagtgcaggaataaacaggtgcccagtgtttccagggcctttccttttcttgttgtttttgttaagaacagccagaaatacggattttctgtgaaatcttacaatctttggcarttattggcaactgactctgaagcttttcaaacattgtacaggccaaacaaaacacatctgcaggctgggtttcaccctctggctgcagttctagaatacagataaggttcccatggaaaagaggcaggatcagagatctctcagccagtgagagcctctgccctttggggagggatgtcagcctggccacacctctcccagcaaggactcacagaggcctgtcagggtcacatcaagtctccctgccaggttctcctggctctcttctctcccagccacatcttgcactccaggcatgct

SEQ ID NO: 190666 - DNA, 601 bp, Human
gacaccgatttcaaaggtcggagaactttagctaagacatgaaagagatcctgtgtttctagcctggaaagggcccagctgaatgccgggtgcctgatctgggcaggggcagctctcagaggctcccacatccaacggcattctcagcgctgcagcccagggagttaatttagccagtggcattgtgtgtgcgtgtgtgtgtgtgtgttttttaaaacaaatcaaaaaatctctttaatgggtcaagaataggatcagaaagctggcaagagtttaaaccaaagtgtcaacagtactttgktggatttcatgtattaccatatataattagatggatggatggatgggtggagaaatagaaggatgtaagtaaggaagtcaagggagggaaggaaaggaaacatagacggttaaaaaagaacttagaaaatctgtaagtgctgatatggaaaaatgtgtaagaaatatcactgagttaaaaaaatatgtagagaagtggattcctttttttcttttcctttctttcttttggttttagatagagaccttggccaactgcctaatcaatagatagatcaattataagtctgaggaagatttc

SEQ ID NO: 190667 - DNA, 601 bp, Human
acttagtaaagattcagtacatgttattttcctttgttcctgcctaacaaaacccaaaacccaacaaagcagtgtgatttttgaaagctactttgtgaattttatttgggttgctttaattcttctttttgtaatcctcaaaagcacgctgctgacaccgatttcaaaggtcggagaactttagctaagacatgaaagagatcctgtgtttctagcctggaaagggcccagctgaatgccgggtgcctgatctgggcaggggcagctctcagaggctcccacatccaacggcattctcagmgctgcagcccagggagttaatttagccagtggcattgtgtgtgcgtgtgtgtgtgtgtgttttttaaaacaaatcaaaaaatctctttaatgggtcaagaataggatcagaaagctggcaagagtttaaaccaaagtgtcaacagtactttgttggatttcatgtattaccatatataattagatggatggatggatgggtggagaaatagaaggatgtaagtaaggaagtcaagggagggaaggaaaggaaacatagacggttaaaaaagaacttagaaaatctgtaagtgctgatatg

SEQ ID NO: 190668 - DNA, 601 bp, Human
actttccttcaattggatttttccatgcagctaaggaaggtggggtaaggggactggcctcagagaacaccaagcttacatcataacagctcatcaacctttaacggaatagaactcacctgtctctcagggttcctaaattaactcccaggaaatggtgactggcccagcttgggccacatacacaagtatgtgacaggccacgggacactgtgatcaccctagcagaaggtgctcttcccagaagagacagggtactatgatttgcagccccaccaggacccaaaaggttgaggaggagtaattcccaccataaagaaaacagtgcttctcttgggtgggaggtggaggaacaatgttggtcagaaaaacaaacagctgtaattcattcagtaaatacctggccatcataagtgattatgccatgcccctcagtctcgggtatcacaggccctggccctgttctcacatagtattgtggcttcccaagctcatgtgccctgtactatctctatggtcctcagctttgccttgtgagacacgctgagcagcaattatgatgcccgttttgcagatatgaaaacaaaggcagtgtgtctaa

SEQ ID NO: 190669 - DNA, 601 bp, Human
gaacattttgctggcatgaatattatggccattgaatatcacctggcaggctgcgggcctggtctggctcagtcatgggacagctgcctgcctgccaagctgggcattcaggagggacccaatgatagccttgggtagaggcagacctgaactgcaggttctcaccttgttcttgctgggtgaccaaagcaatttactccacctctctgagccttcacttcctcatctgcaaaatggggctagtgagcccagccacagagcagagccatcaggatgaaatgaaacaaggggtttcaaggamctatttcagtgcaggacacacaaaatgtgcagtaagcaataattcctctctgctcttggcctagtccatcctgttccctgcgggtatggagaggcaggtgccttttcaggccagcctccactctcataatcctgctagctcttctctggtttgccaggtatcccttcatacatgtgaccacccccagaatttgtcttctggaggtcacaggtcagtgtgagaggattaataataacagctcatactgatggggcagtttgcactgtgggttttcccacacaccgttcatctaatcctcac

SEQ ID NO: 190670 - DNA, 601 bp, Human
aagacatggtttaaatcccctctgcctagctctgagcccatggtctgcctactgttcccacatgaacattttgctggcatgaatattatggccattgaatatcacctggcaggctgcgggcctggtctggctcagtcatgggacagctgcctgcctgccaagctgggcattcaggagggacccaatgatagccttgggtagaggcagacctgaactgcaggttctcaccttgttcttgctgggtgaccaaagcaatttactccacctctctgagccttcacttcctcatctgcaaaatggkgctagtgagcccagccacagagcagagccatcaggatgaaatgaaacaaggggtttcaaggacctatttcagtgcaggacacacaaaatgtgcagtaagcaataattcctctctgctcttggcctagtccatcctgttccctgcgggtatggagaggcaggtgccttttcaggccagcctccactctcataatcctgctagctcttctctggtttgccaggtatcccttcatacatgtgaccacccccagaatttgtcttctggaggtcacaggtcagtgtgagaggattaataataaca

SEQ ID NO: 190671 - DNA, 601 bp, Human
ttgctcacagcctctcttcttcctcacagtatgtcttcgtgctccagctggccaaacctggtgccatggaaaatccagatgcttgcttacctggcaggccgtgctggatctgctacctggggccagtacaagcaattggtgtgttattagttccaccagcaaaggcaggggtgtggaagttgggggtagggtgggagaataagaataagagaggggacatcctgtcagagagtgcttaggaggggcactgaaggcctcatcccttccatgggaatctctggcctctattttatatatatayataaaatatatatatatataaatagatatatatatatatctcaaggcaaatagaaataaatagctcccagaagataagaggtgctagatcagtaaccaggtaaccagggaagagtgagcatgtcaggatctcttgatgaagaactccttggggtctgggatccttttattcactgcaggataccagcccccatgttagaatccatggcagagaaaatgtgcattaccatttgttgaatgaatgaatgaatagcagaaagcattctagtggcactcttgcagtgaacaccacgctttctct

SEQ ID NO: 190672 - DNA, 601 bp, Human
tgtgactgtaatcccagctacttgggaggctgaggcaggagaattgcttgaacccgggaggcagaggttacagtgagctgagatcacgcgattgcactccagcctggaaaacaagagtgaaactccgtttcaaaaaaaaaagaaaaaaaaaagtggaaagaggaagaagaggaacaagggagtcccaggcaaagggaacaagcccaggcagttgcaggaaaatcagggacagcagggtctgcatgagggaagtttctacataggttttgcccagcttaactctgtgggttgaccttccccrtgaaggctgaccctgtacctctgacccagaatttactggggagattgctcacagcctctcttcttcctcacagtatgtcttcgtgctccagctggccaaacctggtgccatggaaaatccagatgcttgcttacctggcaggccgtgctggatctgctacctggggccagtacaagcaattggtgtgttattagttccaccagcaaaggcaggggtgtggaagttgggggtagggtgggagaataagaataagagaggggacatcctgtcagagagtgcttaggaggggcactgaaggcc

SEQ ID NO: 190673 - DNA, 601 bp, Human
ctgcacagaagctctgtcatggggtagctcagcctggagagaaggcaatgacacctctgtgctatatgctgggagggatgacggcccgcaacccagcctggggggtcagggaaggctccctggtgggagtgatagcattgctgtcattatcagtcaccataatcaatatcatagcaacatgtgttgttatgataatgataatgcccaacattatgtgctgggcagggtactaggcaaagtatatgtcataccagttgactcctgacaacctcctagagcaggtatgcttctcatcattttwcaaatgtggagactgaggcctgaagttcacccagccgtgaagtggggagatgagatttggctctagagctcatgctcttgatgactgtgctctgcagttccctgctttaaactgacccttgactgagcaataggaattcaccacgtggttctgtgcaagggaacggcattcagcaatcatgggtttcacacctcctatgcaccagctgtaggtgctggagagagggaagtaaggtcagtggcctgctcttgagggctcacagattatctgagaagaaggtaagaagacagagaattccag

SEQ ID NO: 190674 - DNA, 601 bp, Human
tctaaaagcagattaaaactaaattaataaggccttaaaatgtgaacgagtaattagagacataatagatgttcaaagcaatcactataaatagtatagccacaacaaagcttttgtgagcatgaaagaatgcaattctaataccatgaaaaagctaacagcaaatgataacacaattattaagacaaaatgagaaaatgttaagactaataaacttgacatgttatagttatttttccttaaacaattcagaaagttcctagagtcagtttaaaccattggagtgctcaaggccaaggtyctggataaggaggtgggaacaggactggagaaggtcacagggccctgtggaactgcactcattcatcccagggacctagcacttagggtggccctaaggctgggctgcacagaagctctgtcatggggtagctcagcctggagagaaggcaatgacacctctgtgctatatgctgggagggatgacggcccgcaacccagcctggggggtcagggaaggctccctggtgggagtgatagcattgctgtcattatcagtcaccataatcaatatcatagcaacatgtgttgttatgataat

SEQ ID NO: 190675 - DNA, 601 bp, Human
tctcccactctccccatgttaacttttggtgggactggatttttcattttaagttttttatcttgtgggaatagactagttatttcaaagagaatctgatttgtcataagaacagaaaaaggaggtgtggagccaaggagggggactatcacttaaacacaaatgacagggaaaaggaaataagtaatgttggaaggtgaatgcctaacaaacaatgataattcattttcttgtgacacaaagtagaacttatgaaaacaactttccctaggacccaataacttattccatgacctccctytgaagtcagcagccagctgtctttgctagatcaggagcagtgaacattcggggacaaggattcagccagatctgaaagggtcgttaaatggtcatttaatctggtttcctagattaatccaattaatcagggtctaatggaagaatttcaggtaggaagatattcctgatgcttttcaagtcccacagaaaaggcaggtggctgtgggggtggggtgaacatgggtacaaaccaaaggggctagacaatgctgcttcccccaacccccacatgggctctgggaccaccttagaaatgaag

SEQ ID NO: 190676 - DNA, 601 bp, Human
gcgttagtggggccactccctgcaggaggacctccccaccccaggcctcccacctgggcctgctgatcactactgccccctgctgttggggtgaagcctgcaatgcgacacatgcacgagggaggcaggtggagccacatgtgctcccccagctttgcataggagtaagtctgctctctgctccagagagaaatggggcataaaaggacttggggggcagatcctctctctgatccagaaattcactcggggcacagtctagtcccaggctagagagaacgcaaaacatagtgtggttaaygtgtggtgagacatgtcatgggtaaagactactcatgacctcatgccataaataagacaggacacccattcacttatccgtgctccttccatcccaggcctgtagagggaagtggggacccagaaatcagtcctcagcttcaagaagctcataagaacacttggtttcctcatcaactgatcttctcttcatgtgtttatccagaaggctactgtgcatatgaagggttccggattcactcagaggcacaagagacaattgcttgttttcagctatgacatacatttttgcctcttctgg

SEQ ID NO: 190677 - DNA, 601 bp, Human; identical to SEQ ID NO: 24244

SEQ ID NO: 190678 - DNA, 601 bp, Human; identical to SEQ ID NO: 24245

SEQ ID NO: 190679 - DNA, 601 bp, Human; identical to SEQ ID NO: 24246

SEQ ID NO: 190680 - DNA, 601 bp, Human; identical to SEQ ID NO: 24247

SEQ ID NO: 190681 - DNA, 601 bp, Human; identical to SEQ ID NO: 24248

SEQ ID NO: 190682 - DNA, 601 bp, Human; identical to SEQ ID NO: 24249

SEQ ID NO: 190683 - DNA, 601 bp, Human; identical to SEQ ID NO: 24250

SEQ ID NO: 190684 - DNA, 601 bp, Human; identical to SEQ ID NO: 24251

SEQ ID NO: 190685 - DNA, 601 bp, Human; identical to SEQ ID NO: 24252

SEQ ID NO: 190686 - DNA, 601 bp, Human; identical to SEQ ID NO: 24253

SEQ ID NO: 190687 - DNA, 601 bp, Human; identical to SEQ ID NO: 24254

SEQ ID NO: 190688 - DNA, 601 bp, Human; identical to SEQ ID NO: 24255

SEQ ID NO: 190689 - DNA, 601 bp, Human; identical to SEQ ID NO: 24256

SEQ ID NO: 190690 - DNA, 601 bp, Human; identical to SEQ ID NO: 24257

SEQ ID NO: 190691 - DNA, 601 bp, Human; identical to SEQ ID NO: 24258

SEQ ID NO: 190692 - DNA, 601 bp, Human
ccagtactgttgagctcacattctcccacttttcctcttttcaggtggttcacgtatttgggattttatgaaacctcagaagcagacatgttaacttttcttatctttttattccctgaggtagtcctggggctcttaagagattacagttcttaaaacctggaaagtgacaccagagaggtagatcttagttcccaaaattaaagttactttctagggcataaaaccttttcagaattcagattaaattttatttattttttcttttttctgtaaccttatatttgaggggaaaattttrttttcaacttttgcatatatctaatttaacatttgggaaaactgtaaatgggccaaagtttctccctttatatgattttccagatttttaccactttcttagtgccacttgatgctaggcattgtctattggagactcactggtacgtaactgcaggttttaccatggaactacatatacacatgtcttggaattgagggttagggtttccagaaggacttagttgtcctgtgcttttgtctgccccatgccaaagaccactaagaacagttttgtaagtgaaacttgggtctacacgtt

SEQ ID NO: 190693 - DNA, 601 bp, Human
agtgcttgagcttagaggctgggtgaaaaagttagttacctgggtttgaatcttcacctaatttccaacttttgttaatgtctttgggccttcatattctcatatataaaatggggatagtaaaaatacctatctcacgggttgttatgaggtttaaataagcctccctccctactctgcccctcctcatctctgcctgctctttctcactccccaggatctgggtcatacaccgaccatctcttaggaaggagtaaagtaggagataaaaactaatcttcatctgatgttcttgtccaaygtatactggagtttccaggtgtacaaagctgattaaaatctgaagacctatattcttctttaaacgttgttaattaatcttcatatggcgttagccagctcacttatcttgaagcttaccttccgcatcttttaaatgggaatgatgcttttccactatccattgtatacaggttgttccctctgcttgggattgtctttcttctttactccaccccatctttatgtcaggaagctcctactcatccctcaaaagcctgctctatgtgatctccttcccaaaaccttctgagacacttcc

SEQ ID NO: 190694 - DNA, 601 bp, Human
aattattttagctgcctaactgcttatgtgggtttgtatgtacttttgagtggttcttggatatgtgtacacacatacatacacacacacagatatacacatacacacctttatatgctcatgggtgtaacttctttatgtgtctaggtgtcttttttttgtggagggggggcgaagatcaatatgaatcctattttggccccctggatgctgtcaccagaaataacagccatatcccatatatagcctgtccatgtagccctgagttctgccagcacctggctttttgccttccttttgyttgtcataccaggctctcttggtcaccttggtagccttgctaagcttcttgtagctataggtaccattggcttagcccagaagagattcctgccatatgtacttcagagtttggtttgccacttgaggaaggggtctgtagggagcttgtagatcagcacacattcaaaactgaaaccggaagtgggcaaggcaaaccacaggaagatcctgcccgcaacttggtgacgtatctatataacccatagacacttcctggcaataccttgtgaaacttgccttttcgtgtatagtagtttcc

SEQ ID NO: 190695 - DNA, 601 bp, Human
acacacacacacgaaaaaacagttctttgcttcactgagtctcggctagccacccaaactgtgtcatattcctagagtcctgtgcccactcaagtgtttgctcactggtactacctcattttatcatagtgccttgttcttaggcagaaccagatttctggtaggagttatttaatgtgttgattttttttttgagacggagtctccctctgtcaccaggctggagtgcagtggtgcgatctcagctcactgcaacctccacctcccaggttcgacaattctcctgcctcagcctcccgawtagctgggactgcaggtgcacgccaccacatccagctaatttttgtgtttttagtagaggcggcatttcgccatgttagccaggatggtctcgatctcctgacccgcccacctcggcctcccaaagtgctgggattacaggcatgagccaccgtgcctggccaatgtgttgtttttttaaagattaccaatcgagtgggattatagactcttggattattttacagatacaagtcatttgccaggagtgaggaaaattgcttgacaactgagttatctcaccatgttaatttatgcattg

SEQ ID NO: 190696 - DNA, 601 bp, Human
gagacctgtttttattcactgttatatccccagcacttagaacagtgcctcgtgtgtttaggcacttagtaaatatttgttgagtgaaatgcaacaagtacaaaacaatatgatcactgtagtagagatgcaaggtacagtagaaacacatgggaaagagtgacatgactacataggaattgaggaagactttgcaaagatgcccttaagcagagctctttggagagaaaaacaggtagggcatttcatacaaagaaaatagcattgcagatacacagaggaatgagagaacagtgtgttsaaggaactaaaatatagtactgctacagcataatttgtgggggtaaagatgaactagatgaggttgaacatgtagtagatagcacctgatcatggagggatggagggtttttgtgccagactaaggaattttagattttgtcctgtcaagtgggcagtggtagatagtgtgagccattgaagacttctaagcaagggatgttttatttatatttatttatacgtgtctctgtgtttgtgtgtgtgtgtgtgtgtacgtattaaaaaggtaactagcaacattgtgaaggttgagtatcaa

SEQ ID NO: 190697 - DNA, 601 bp, Human
agtggtcaaataaggtgggactgaaaagcagtgttacgatttgggcacttaatattagtggttttttgggttttttttttctttctttactattgagacagggtcttgctcttttgtcccaggctggagtgcagtggcagctcactgcaactcccatcccctgggctcaagccatcctcacacctcagcctcccaagtagctgggaccacaggcatgcaccaccacgcctggctaattttttgtatttttagtagagatgagatctcaccatgttgccaaggctggtttcaaaatcctgtkctcaagcagtttgcccaccttggcctcccaaagtgttgggattacaggcatgaccactgcgcccagcctgttagtgttcttcaaggttctaaacaagaagtagagaagtaggataagagggcaagttgcaggtttaggctgtgagttgaagggagcacttgaaaggagagattatagaataagttttcaagaaatttggcaatggattttttttttttttggtccaaggcgcatgctcatttatataccagaattggctagagttcatgaggccctgaacaaatatcacacacaagcaag

SEQ ID NO: 190698 - DNA, 601 bp, Human
gagagcacaggtaaatggatgagctttggatgagaagaggaataactagtctttggaggaagaggaaaatggatgaataccggttcagatatagattatttgtcttagtgacctggtttatttgtaaggactaacccattttaggcagttaattaaattaatcatttaaaaggtgagattcctcaattctgacttgagatggacctaaatttgtttattctgtttaagtagtaactttatttttttagtgacagatttaagaagtatcttactggtactattccattggttttcttatttyaattttataaataatgtgtttactgagtttttttataggtgcttcttaggtttctaatagacttctctaaaatatattggtttaaatggcctttaaagttgataagcagaaagatacttgagtttatctagtccaaaccttcatcaggaaagctgtgattgagtgatttgtctgaagtcatacagccacttagtagcagagtaagagaggaatattggttttatggttcttggggtaatgctgtttcccttatgccaactgattgcataagggaactagtgtactgatttcagcgcccat

SEQ ID NO: 190699 - DNA, 601 bp, Human
aagtcaaaataaggaggccgggcgtggtggctcacgcttgtaatcccagcactttgggaggcagacgcgggcagatcacttgaggtcagaatttcgagaccagcttgggcaacatggtgaaaccccgtctctacgaaaaatacaaaaattagttgggcgtggtgctgggtgtctgtaatctcagctacttgggaggctgaggcaggagaatcgcttgaacccaggggtcggaggttgcagtgagccaagattatgccattggactctagcctgggcaacaagagtgaaactccatctcagaaaaaaaaaaaacaacaaaaaaacaaaaaacagggtgtggggtattattggaatgagcatgtggtggatgaaatattgaatgccatgccttatctgaatcatattttaggtcagttgtattttagggatctgttttttttttttatgcctttaaaaaaatatctttcttttacatttgcctttgaagtttccctttatgtctttattttcattttttataattttaaatatctattgaattcttcttagaaaaggtattgtataaaactgaaaatacttgagtagcccaaaaacatttcaa

SEQ ID NO: 190700 - DNA, 601 bp, Human
ggtcggaggttgcagtgagccaagattatgccattggactctagcctgggcaacaagagtgaaactccatctcagaaaaaaaaaaaacaacaaaaaaacaaaaaacagggtgtggggtattattggaatgagcatgtggtggatgaaatattgaatgccatgccttatctgaatcatattttaggtcagttgtattttagggatctgttttttttttttatgcctttaaaaaaatatctttcttttacatttgcctttgaagtttccctttatgtctttattttcattttttataattttmaatatctattgaattcttcttagaaaaggtattgtataaaactgaaaatacttgagtagcccaaaaacatttcaaggagtaaacttgaaatctttagtcttaattctcatattgttcttatttggctttagaatgtactttaaacataatatttgaatgtggatgtgatatataaaggaaattctgcatttataattgtttagaaaataatgcaaagagatacatacctacacatgtcttgtctttcatatcatgttttcatatcatatttgactaatagttctttttgcattgatttct

SEQ ID NO: 190701 - DNA, 601 bp, Human
cttaaaatgaacttataaaaataagctttgcaacatgaggatgggcaaagatttcttgctttgaatgcaagaagcaccactaattataaaagatgaaaattggtaaattagattttatcaaacttagaggctccttttctttaaaagacactgtcaagaaaattaaatggcaagccacacctgggagaaagtattctgacaaaagacttgtatccagaatttatttaaaaacaaaaaccctgataactcaaaagaagaccgatggccatttaaaatatggggagaatacttaaacagatayttcagaaaagatatggccaagagcacatgaaaaggtattggacattgttagtcatcaggaaatcaatttaaaaccatttttgtcactatagattctagaacataatctgcagtgatagaaatcatatcactggttgcctgtaagaatatggtgggagtgattgcagagtcacaagggaactttctggggagataaaaatgttttgtatcttgattataaggtagagattacataggtgtatacatttatcatgttacattcactagaatagctaaagttaaaggctgtcagtaccaagat

SEQ ID NO: 190702 - DNA, 601 bp, Human
tattggctcacagtttttcaggctgtacaggcttctgcttctggaaggcctcaggaaacctacatgagtgaaaggcaaaggggaagcaagcacatcttcacatggctggcaggagagaggagagttgggatgtgctacacacttttacaataaccagatctcatgagaactcactgtcatgagagcagcaaggggatgtctgcccccatgattcagtcaccttatgccaggcccctcctccaacagtgggattacagtttgccatgacattttcgtggggacacagagtcaaaccatatcrgtgaccaataaatatatttctctttttttttgagacggagtgtcactctgtcgcccaggctggagttcagtggcgcgatctcagctcactgcaagctccgcctcctgggttcacgccattctcctgccacagcctcccgaatagctgggactacaggctcccaccaccacgcccgactaattttttttgtatttttagtagagacagggtttcaccatgttagccaggatggtctcgatctcctgacctcgtgatctgcccacctcggcctcccaaagtgctgggattacaggcgtcagc

SEQ ID NO: 190703 - DNA, 601 bp, Human
ggaaggcctcaggaaacctacatgagtgaaaggcaaaggggaagcaagcacatcttcacatggctggcaggagagaggagagttgggatgtgctacacacttttacaataaccagatctcatgagaactcactgtcatgagagcagcaaggggatgtctgcccccatgattcagtcaccttatgccaggcccctcctccaacagtgggattacagtttgccatgacattttcgtggggacacagagtcaaaccatatcggtgaccaataaatatatttctctttttttttgagacggagtstcactctgtcgcccaggctggagttcagtggcgcgatctcagctcactgcaagctccgcctcctgggttcacgccattctcctgccacagcctcccgaatagctgggactacaggctcccaccaccacgcccgactaattttttttgtatttttagtagagacagggtttcaccatgttagccaggatggtctcgatctcctgacctcgtgatctgcccacctcggcctcccaaagtgctgggattacaggcgtcagccactgctcccggccaataaatatatttcttaaataattgtca

SEQ ID NO: 190704 - DNA, 601 bp, Human
caatatgtttttcttaattataaaactgttatatgttcttagtatttggtagtgattctctacagaaataactacagttaataatttggtgtatttcttccattctttatttcatacatttgtattactacattttattcagattttttccttttcaattaataccatagtgatcctttccccatatcattaatatttgttaaaactatttgttacataatatcctttatagaaaagtgttttattttaaccacatccttgttggtgaacatttacatttccaaattttgggcatcctcartggtgttgctatgaacaaatgtcctttggcataaatttttgcatgtctctttttccccaggataaattcctagaagtgaaaatactgagtcaaggggtatgaacatttttatgatttcctctgtaaatttctgtattgcccctctgccccacagagtatcatactaatatggacgacataaatgttgtactaatttacatttcctcaaagatgtcatgggcataaccattttaccaccccctggccattcttgcatattatcattgaaaaaaatttgccaatatgataggtgaaaaataa

SEQ ID NO: 190705 - DNA, 601 bp, Human
ctacctattaacttcaaatatttttcttaattttcctgtgccattcttatatatcattttctctaactttgtggaatcatgtactctttcttctctgtttcttcaggccaactggcctcatgcaactagatctttacatatcagaaactgacatcttaaaaaggagcttaagaataagagctggcaataaaattacagattattctcagctcacaaatgacttgtttatgcagctagtcagagaagggtttccctctcataggacaagaaacattcaactcttcagtgacagtgaatgtcrtgatactcatgatgcagaataggaggaagaggctgcttgctttagaatatattacctgtgtgactaagagaggattctcttttgggaaggcacctgtgacagatgagatgtatttccagtgatctgagagtagtgagtcataaataggacaggtaaatttctactctagtttttagcagcattgttagttaaatagagtttggttagggaagcctggaaatcaaatcagcatttacaacacaatgccattgtgattgttgaatgagggaatgaatttgtcaaaccaataaactcctaaat

SEQ ID NO: 190706 - DNA, 601 bp, Human
aatttgggacttgttttagtggtgtttgtatgtattatatgtatgtacatatgtacatctatatacatattcataaattgtgtacaaaactaaaaattatggaaattgtaaagtagaaatttcaccagaagtctactgattcgtttctggatggtaagtaaactctcttaaaattttgtgccagatattatctgtcctttttctggggagaggacataaaagatacacagttacaaagattcttaaagggagggtaatggttctcaaaaggtaagagcttcagctataggatgtatagatrtatttctgtatgtacatatatattttttgagtatcaaactgttatgcattgccttaacattttatttatgtctggtgtggaatctgtggtaattaggactacttgatagaattatggtaatcatttgtggtgtgcaatattgaatactttgtcataattttatatcttaagccattcctggtaatatatggatttgccaggaatttgatacaattcatagataaaacatatccagagatttggatgatttgtctcttaacctaaattcttcctgcagtttaaggaacatttgagtattcc

SEQ ID NO: 190707 - DNA, 601 bp, Human
gtggaggctagattcttagaacaacagacattaaaatttgcctaagttcatctgtaaaatgagtatacaaaatgaaaagttaaaaatttttgcgtaagttacaattatttttgaaaagagtttagtttcttataaaatacactaaggtatttgggtggtttgtttgtttttggttgactaccgcataaaataattggcttgcattctgggccatggtaaatgaaaactatatactgtatctttaaactgtagacctcccccctgccctgactcagtacagcaatagatactgcaagtggcrcatggaaactgagacccactaatcatttcttatattcctatgttcactgtgcttattgagcataagttctcactgtttaaatattgttttttttctttccctttcatgaagtgaataatgttttctctcagtctttccctctcattttaataactatttgctttgcaaaatataaaggaaagaaaaaaacaccattttgagatgccattgtattctttttgtatgtatgatgagacatgtctcttcctctgcttctctgtaaatctactccagtctctttttgagacctaaaagacgcca

SEQ ID NO: 190708 - DNA, 601 bp, Human
ggaggctagattcttagaacaacagacattaaaatttgcctaagttcatctgtaaaatgagtatacaaaatgaaaagttaaaaatttttgcgtaagttacaattatttttgaaaagagtttagtttcttataaaatacactaaggtatttgggtggtttgtttgtttttggttgactaccgcataaaataattggcttgcattctgggccatggtaaatgaaaactatatactgtatctttaaactgtagacctcccccctgccctgactcagtacagcaatagatactgcaagtggcacmtggaaactgagacccactaatcatttcttatattcctatgttcactgtgcttattgagcataagttctcactgtttaaatattgttttttttctttccctttcatgaagtgaataatgttttctctcagtctttccctctcattttaataactatttgctttgcaaaatataaaggaaagaaaaaaacaccattttgagatgccattgtattctttttgtatgtatgatgagacatgtctcttcctctgcttctctgtaaatctactccagtctctttttgagacctaaaagacgccaca

SEQ ID NO: 190709 - DNA, 601 bp, Human
gaaaggttgaggcagacagattgcttgagcccagaagtttgagaccagcttgggcaacatagcaagaccccatctttataggggggggaaaaagagtgattaaaccaaatctcccatatggagaatttgctgctctcattaattaaggagtttgtctcacacaacttgtccaagcagtaaatccagatgtgctatcaaccatgtcctatatgatgcaattacttagttaataggtctttaccaacaagcatatcttgaatttctggatcatgccataagttattgattgttttataggtgttttttttttaaagacctctgccttacctgtttaaaaagacatttaaaaagaaatgcaatgattatagctaataataaatacatgaggatttttaaaacatgccctattcaagacataacaaatgtaaaaacataattcattattgcaggttgattttttttaacttcattttaaatttttatgtgaattaataatgagccattctagatcatattaaatacttctttaaggagaaaacaacaccttcataaagaactgccattaatataagagatattaaataaaatttgtattttgctt

SEQ ID NO: 190710 - DNA, 601 bp, Human
acagaatggtgcttactgaggagctgtttactgagaattggaataaaaggctgcagaattgtgtgaagcttgccctatatttatgaatcagatttttaagtggaagctgcagttgtttccttgtttgtcattcatgctttagcagaggatatgatgccatagagctggcttggtttgtagcttctcatttagggtttgcaccactttcttttcctttttagaggccacagcagttttgatgtattatcaaaccgcaaaatgtaccttgttgggtatttagcagaaggaaatgtgttgactrttacacatcccttatctacagtgcttgagactgttttgaatttcttattcttatttttttttttgagtatttgcattatatatacttgcccattaagcatcccaaatccaaaaagcccaaatttgaaatgctgcagtgagcatttccttggagcatcatgtcagtgctcagaaagttttgaattttggaggactttggatttttgaatttggaatgctcagtctgtgtttgatagtttcattagtgattgtggcattcctgtttagtctcattttgaaaatacagcataaatttaaaaat

SEQ ID NO: 190711 - DNA, 601 bp, Human
agaattgtgtgaagcttgccctatatttatgaatcagatttttaagtggaagctgcagttgtttccttgtttgtcattcatgctttagcagaggatatgatgccatagagctggcttggtttgtagcttctcatttagggtttgcaccactttcttttcctttttagaggccacagcagttttgatgtattatcaaaccgcaaaatgtaccttgttgggtatttagcagaaggaaatgtgttgactattacacatcccttatctacagtgcttgagactgttttgaatttcttattcttatttttttttttgagtatttgcattatatatacttgcccattaagcatcccaaatccaaaaagcccaaatttgaaatgctgcagtgagcatttccttggagcatcatgtcagtgctcagaaagttttgaattttggaggactttggatttttgaatttggaatgctcagtctgtgtttgatagtttcattagtgattgtggcattcctgtttagtctcattttgaaaatacagcataaatttaaaaatgcatacatacatatgtccatacatattactacctattccatataggtagtatat

SEQ ID NO: 190712 - DNA, 601 bp, Human
gtttctgggaaaggagatacagttgtatgatcactaaattaaataggagatcaagggaggtaagaactgagaatttatcgtcagatgtggtgatgaagagagattttaggagagtgatctgtgaggaagccaagattataaggagttactatagtgagtgggtggtgaggaagtacaagctgtaaggatggattgcagttttcagatttgtctaagaaaggaaagagataggaagaccataatttaaggggagaatttttcttagacttgagtgagatgaacaagctggtattattttgattttttttttacactaccttattcttttctgctacttccatagttgcttttatattcagctattgagtaaaatattacttggacattttcctctgcttttatccacaattgaatattttgcagatgatcatttttaagctgtaggaaaaatgtatttttttaaaaaaaatttttactaaaatattttgtttacaggtaaccagatccagtagttacaccagaaagtcccagttccaggtagaagaggaggacattgaaaagctagaaatcaggtatgtgccttggggttttacagaattgc

SEQ ID NO: 190713 - DNA, 601 bp, Human
ctgtgaggaagccaagattataaggagttactatagtgagtgggtggtgaggaagtacaagctgtaaggatggattgcagttttcagatttgtctaagaaaggaaagagataggaagaccataatttaaggggagaatttttcttagacttgagtgagatgaacaagctggtattattttgattttttttttacactaccttattcttttctgctacttccatagttgcttttatattcagctattgagtaaaatattacttggacattttcctctgcttttatccacaattgaatatttkgcagatgatcatttttaagctgtaggaaaaatgtatttttttaaaaaaaatttttactaaaatattttgtttacaggtaaccagatccagtagttacaccagaaagtcccagttccaggtagaagaggaggacattgaaaagctagaaatcaggtatgtgccttggggttttacagaattgcttttttgtataccaaaagaaaatcctagattcaaccaaaaaaagtaaaccaactttaatagaattctctatagcaagttggttgatgaaacttagaggaatatgcaactaatttaaat

SEQ ID NO: 190714 - DNA, 601 bp, Human
tgctttaaaataataatgcaggaacaggatgggagagtgagtgaaggtatggctgaaacaagatcagtcttttattaaaaaaaaatcagtgtatgtatttttaaattttgtttggcattgcctttagatagagaatagagaagatggcagcttttttctcatgttagttagaaacttctaattgctttcaaaaagtgacccaaggcttcaaaaccaaagcattcattcactcactctctagtcaatatccatgggaatgtctactactaagcccatgtgccctattctgacctatctactraaaataaaatcgtgggttcaaacagcaatgcttaaaaaaactcaaactgcttaaaaatattgcacctgtgaatctgttttagtatttttagggaattactttactactgggctttgtaattttaaactttagaaaggccttagcacaggatttataaaacttgaaaactatgagtataaataaataattccaggccaggcatggtggcttacacctgtaatcccagcactttgggaggctgaggcgggtagatcacctgaggtcaggagttcaagaccagcctggccaacatagtgaaac

SEQ ID NO: 190715 - DNA, 601 bp, Human
ttaagttacttatggcctattaagctgtatagcattttcacttcacaagacagtacaattatttttcattatattcataaatacctctcttaaagaactcgagtccattcattgcatgaatattatgtacccgttaaaaagaacaaactggatctatgaaaagtagtttcaaagagttaactaggaagtgctttcaggtaaaaaaaacaagatacaggagagtagaatatgataacatttttgtaaactgactaataggctcagaactcatttataaatgtgtatatatgcacacattttwaaaaatctatataaaattatataagcatgaagaaaatagagaagggtccatagtaggtagttaacaggttcctaagagaagcggaggtgcagaatggtagtgttttgaagataggaaaaaagataagagaaaaacaaagttaaaagagaaaataaagaaaacgttccttaaaaaaacaaaagcattgatttgatgacattgtttatatatgtatgcatcgttatctatttgtctatgtgtagtaaggattttttaatattaaataaagaagattctggttcaaagagtgatgaaaatagt

SEQ ID NO: 190716 - DNA, 601 bp, Human
gaagaaaatagagaagggtccatagtaggtagttaacaggttcctaagagaagcggaggtgcagaatggtagtgttttgaagataggaaaaaagataagagaaaaacaaagttaaaagagaaaataaagaaaacgttccttaaaaaaacaaaagcattgatttgatgacattgtttatatatgtatgcatcgttatctatttgtctatgtgtagtaaggattttttaatattaaataaagaagattctggttcaaagagtgatgaaaatagtaagtggcactccacacagattctttcttrgttcttgaagtttgagcttcactacaaaaagaatctccattcagttgcttttatctaccctacagcgtttgttaatagcaaatccaaatttgtaaatttaatttggagttatttctgaaaataaattttgtgggcaatatgatgataagccacaggaaaaaaaatatgcagataaatatttataaataaattcctttaatatattctaattgtgatagtttctgcagcataatttaaaattatgctattttcagtgtccaaataaggatgttatcagtgttagtattgatcatctggctg

SEQ ID NO: 190717 - DNA, 601 bp, Human
tggtttgtgagatatttaaggtttttatttatttatttatttttattttattttattttattttttttgagacggagtcttgctctgtcaccctggctggagtgcagtggcgctatcttggctcactgcaacctccatctcccgggttcatgccattctcctgcctcagcctcccgagtagctgggactacaggcgcccgccaccatgcccagctaattttttatatttttagtagagacggggtttcaccatgttagccaggatagtctcgatctcctgaactcgtgatccgcccgcctyggcctcccaaagtttctgggattacaggcgtgagccaccacgcccagcctaaggtttttaagtacaaccttctttagtttttcaaaatgattctatctttctcataagaaatctgatttttcttgaaatctcaaaatacatattccattttatttcagtataatgcaactttatacaaagagcaaatcaaaatcaccattaaagaaaggcaaaaattcagaactgtaacattatataagtaagcacttataccagatgcttatgagagttaaaaatacctttgttatttataccaactat

SEQ ID NO: 190718 - DNA, 601 bp, Human
atacaaagagcaaatcaaaatcaccattaaagaaaggcaaaaattcagaactgtaacattatataagtaagcacttataccagatgcttatgagagttaaaaatacctttgttatttataccaactatcttttccagctgcatgcattcagatagtgagaatctttagttccataaaattgactagatttgacagtttgagaatgctaataaggttttggtggtgagaggtttttacagaaatggtcttagacattagaaacctttctgttgtaacatacatagagttttaaggtacatayatcagtaactggcatgttttaattttgaaaaagtagctatgtcaaggttttgcttagaaacttttcataaaattaagtgttactgtcgctgctaatacttagaattattcacattttaatatatttctgataagtaaataaacttgctataggtagctttccagatctgtctataatgggaggtggtgggtaggagggtaaaattaggcaggtacttaaattaccagtcttaaccagctgtgcaaaactgtaagtttatttctgtaaccatctgaagagattttgcagttttatgttctt

SEQ ID NO: 190719 - DNA, 601 bp, Human
tttagcagtttaattcttgtttatataaatgatcttaaacactttatggggtttttttgggttttgtttttgtttttgtttttgagactgagtttcactcttgttgcccagactggagtgcaatggcacaatctcggctcactgcaactccgcctcccaggtttccagcctcccgagttgctgggattacagacatgtgcctccacgcctggctaattttgtatttttagtatagatggggtttctccatgttggtcaggctggtctcaaactcctgacctcagatgatccacctgcctcrgcctcccaaagtgctggaattacgggcgtgggccaccgcgcccggccaacactttatgtttttatatacatgcagatgtatctctttagttatgtttttgttgacttaactattaatatggttatcatatcctcagtagactatagtagtgacagttttgttgccataagtgtttcatattctctcgtttttgttgttcttactaccctagaagaatgggggaaggagggcagagcagacagcaggtagaaagcagatattactaaagaatgacaaattaaacgacttgttaatggttac

SEQ ID NO: 190720 - DNA, 601 bp, Human
gctgggattacagacatgtgcctccacgcctggctaattttgtatttttagtatagatggggtttctccatgttggtcaggctggtctcaaactcctgacctcagatgatccacctgcctcagcctcccaaagtgctggaattacgggcgtgggccaccgcgcccggccaacactttatgtttttatatacatgcagatgtatctctttagttatgtttttgttgacttaactattaatatggttatcatatcctcagtagactatagtagtgacagttttgttgccataagtgtttcatrttctctcgtttttgttgttcttactaccctagaagaatgggggaaggagggcagagcagacagcaggtagaaagcagatattactaaagaatgacaaattaaacgacttgttaatggttacctactgaatgacttagaagagttaaaactcgaaccaaacctaaagattctttccctcaccatctgcttcaccaccatctgtctgattgttgggtaaattgttgactccagtctgaaacgaaagttgtaggtgaatgatcaaagccaccagtagtcttcagttcatctgcatttttattt

SEQ ID NO: 190721 - DNA, 601 bp, Human
ttctgaggggctggcttgtgcgtttcaggatatttagcagcatgcctggcctctaccccttagacgcaagaagtatgcccctgttttgacagccaaacatgcctccaggtattgccaaatgttccttgagggacagaattgcctctggttgagaacctctggtctctgggggtaaaggctttgtatggtgcctgatgtagagtgggcacttaattgccatagtaaaaaatatatacattattgaacatttaatgaacaatataaatttatggtagtaacctgaggaaaattactataaatktacaaaaacctgtagtatataatatcctaacacaaggcctgcagcatacaaaaatcactgtacttagaagttcagaatgttttgaaaggatctttaatttcttgagtctttagtcctgaatcatctaaacaaaatatagcattatcgtaaaatgctgaaaatttataaagaaaagttacctttgaagtactctatcccatatagtctagaagttaagaattaaaaaataaggaaagaaatgaattacatctaaactgggcctgaagaaagtactgtattatatgtatcacagtcttaact

SEQ ID NO: 190722 - DNA, 601 bp, Human
tgaggaaaattactataaatttacaaaaacctgtagtatataatatcctaacacaaggcctgcagcatacaaaaatcactgtacttagaagttcagaatgttttgaaaggatctttaatttcttgagtctttagtcctgaatcatctaaacaaaatatagcattatcgtaaaatgctgaaaatttataaagaaaagttacctttgaagtactctatcccatatagtctagaagttaagaattaaaaaataaggaaagaaatgaattacatctaaactgggcctgaagaaagtactgtattwtatgtatcacagtcttaacttaatgaatccaaattagcaaagccaaatgttaaagacttcattcaatttctgtagcacaactagcagttggttgccagagtatttattttgttgagatacatgtttgagcctttttttatacttaggattcttacagagacttagtaagtgaaaaatgatgatttaaaaaattcaagtccgttggaatatttttcatctggaatagtgcctgtttaaccaaaatttttttaggcaaccattgaaggcttttgaggagaaagtctttcaaaagaataggca

SEQ ID NO: 190723 - DNA, 601 bp, Human
tcagaattgcagttaaggaattatggattgaattattcctacaaggaaatatgttctgggttttaagtaacttaagaacaaagttttaggctgggcacggtggctcacacctgtaattccagcactttggtaggctgagtcaggcagatcacttgaggccaggagttcaagaccagcctggccaacatagcgtaaccctgtctctactaaaaataaaaaaaaatagctgcccatggtggcacatgcctgtaatcccagctacttgggaagctgaggcatgagaatcacttgaacccaggarggagaggttgcagtgagctgagattgcaccactgcactccagcctgggcaacagagtgagcctctgtctccacataaataaataaataaataaataatacttttataatacttgtcatttgtaaattagggatttcctctctaattaaatatgtgttttgttttataaattactattatgtgtattcattaataatgaagaacttcccattataattaatgacatgtaagataaactgaattttttataatgtaccttatcacacagtgtaatatttgcccatttccccatttagttctt

SEQ ID NO: 190724 - DNA, 601 bp, Human
gtggctcacacctgtaattccagcactttggtaggctgagtcaggcagatcacttgaggccaggagttcaagaccagcctggccaacatagcgtaaccctgtctctactaaaaataaaaaaaaatagctgcccatggtggcacatgcctgtaatcccagctacttgggaagctgaggcatgagaatcacttgaacccaggaaggagaggttgcagtgagctgagattgcaccactgcactccagcctgggcaacagagtgagcctctgtctccacataaataaataaataaataaataatmcttttataatacttgtcatttgtaaattagggatttcctctctaattaaatatgtgttttgttttataaattactattatgtgtattcattaataatgaagaacttcccattataattaatgacatgtaagataaactgaattttttataatgtaccttatcacacagtgtaatatttgcccatttccccatttagttcttggatgaaatttcatctactgaaactaaagagtccagtggtacgagtgagcctgtgcacctgaaagaagggtaatttaatcaaattagacgtgaaagtca

SEQ ID NO: 190725 - DNA, 601 bp, Human
tgacttggggctaccattgataatattaattgttatatggattctgatttagtgatattttcagggctgcttaaaggtgtgtgcaactgtttactccagctaaatgcatttactccgcagctaaatgccttggactgctgtgctttttgtgttcctatgttcgctttatacagtttttctgtatcctttgtggtaaggctgtggccttaaatttcttgtgatgtctgtgaaccataatataacaccttattcccatcccatcacccacctctattttttacagtagtgtcctataagtgargatgcaagtgctatgtttgtttaaattatgcctaagattaaaaggctttgaatgaaaacgtcaggactttctcctgtaaataaaatacctgggctttgcattctctgtttggttgttgagcaaatgttttgcttacttccaatttccctgctgttttctaggtagccaagacttgctagttaattagtcttttgctacacttactgtgtgactttggtgtctgaaagaatacctcccaaatttcctgtaacatagacctaaatcattgagtctttcactctctcttcctaatatacagta

SEQ ID NO: 190726 - DNA, 601 bp, Human
ttaaatttcttgtgatgtctgtgaaccataatataacaccttattcccatcccatcacccacctctattttttacagtagtgtcctataagtgaggatgcaagtgctatgtttgtttaaattatgcctaagattaaaaggctttgaatgaaaacgtcaggactttctcctgtaaataaaatacctgggctttgcattctctgtttggttgttgagcaaatgttttgcttacttccaatttccctgctgttttctaggtagccaagacttgctagttaattagtcttttgctacacttactrtgtgactttggtgtctgaaagaatacctcccaaatttcctgtaacatagacctaaatcattgagtctttcactctctcttcctaatatacagtagtattgtgaatcaagtatttctgtcacttagtgtcaaataatatgcatagtcttttcccaatttactggaaaatgaattagtagaattttctctgtattaaggatttttcttcaataagtttttaaatttttgaggcccctttaggcaagtgctaacaggcaatagtaagcaactaatcagtagagttaaattaacatgtagcaaa

SEQ ID NO: 190727 - DNA, 601 bp, Human
gaggatgcaagtgctatgtttgtttaaattatgcctaagattaaaaggctttgaatgaaaacgtcaggactttctcctgtaaataaaatacctgggctttgcattctctgtttggttgttgagcaaatgttttgcttacttccaatttccctgctgttttctaggtagccaagacttgctagttaattagtcttttgctacacttactgtgtgactttggtgtctgaaagaatacctcccaaatttcctgtaacatagacctaaatcattgagtctttcactctctcttcctaatatacartagtattgtgaatcaagtatttctgtcacttagtgtcaaataatatgcatagtcttttcccaatttactggaaaatgaattagtagaattttctctgtattaaggatttttcttcaataagtttttaaatttttgaggcccctttaggcaagtgctaacaggcaatagtaagcaactaatcagtagagttaaattaacatgtagcaaatgaatattatcagacactcagccatcagtcatgattaccttgagagatttttatggccctgtgtacttacaattatgattttatattgctat

SEQ ID NO: 190728 - DNA, 601 bp, Human
ttaattatagggtttataacatatctggatatgaaatatatgacagtaacagcacaaaggaagggggtggagtaaattattccaagggtcttatattttatgtgaagtgatgcaagaataattttaagtagactgtgatgagttaaggctgtatattataatatctagaacaaaaatttagggaaatacttgacataactaatccatcccctctcctcctcccaaacaataaataaattaaaatgtgaggaagggaagaacagaggagcaaaaatcagatgagacagacagaaaacgtatracaaaatgatagcttaaacccagccatatcaataattacagtaaatgtaaatgaactacattacattgaaagagactatcagactatattttaaaaagcaagatccaataatatactttctacaatatatccacgttaaatatattataaaagcacagataggttgaaagtaattgggtggagaaagatgatgtaaacagtaagcagtaatcccagaccaagtagatgtcaaaacaacttttaccaaatatgtttgggcacattttataatggcagaaggagcacataatcctaaatgtg

SEQ ID NO: 190729 - DNA, 601 bp, Human
agggggtggagtaaattattccaagggtcttatattttatgtgaagtgatgcaagaataattttaagtagactgtgatgagttaaggctgtatattataatatctagaacaaaaatttagggaaatacttgacataactaatccatcccctctcctcctcccaaacaataaataaattaaaatgtgaggaagggaagaacagaggagcaaaaatcagatgagacagacagaaaacgtataacaaaatgatagcttaaacccagccatatcaataattacagtaaatgtaaatgaactacawtacattgaaagagactatcagactatattttaaaaagcaagatccaataatatactttctacaatatatccacgttaaatatattataaaagcacagataggttgaaagtaattgggtggagaaagatgatgtaaacagtaagcagtaatcccagaccaagtagatgtcaaaacaacttttaccaaatatgtttgggcacattttataatggcagaaggagcacataatcctaaatgtgtacatacctaattacaacttcaatgtagttggagaaaaaaacagaattgaaataggacatc

SEQ ID NO: 190730 - DNA, 601 bp, Human
cagacagattgcctgatctcaagagttcaagaccagcctgggcaatatggtgaaaccccgtttgtattaaaaatacaaaaattagctgtgcatggtggcccacggctgtaatcccagctactcaggaagctgaggtccgagaatcacttgaatgcttgaactcgggaggcagaagttgctgtgagccgagatggcatcactgcgctccagcctgggcaacagagagagactgtctccactgtctccaaaaaaaaagatgatagaatcatagacctcaaagaaaatgtggaaaaatatcttyaaaccatgatatgctaggatttcttgaagagaacattaaaagcactgaacatttttcttaaatgaattggacttcattgaaaagaaagatgtattttctccattattcattgtgattcctttttctttttttaatatgatgaccataaaatgtattacttggtggttgaaatttttcaagagcttgttggggtttgttgaattttttgaaccataagataatgtttttcaccaaatttgggacttttttgacttatttcttcaaatttctcccctttttcttctagggatcctccaattt

SEQ ID NO: 190731 - DNA, 601 bp, Human
agacagattgcctgatctcaagagttcaagaccagcctgggcaatatggtgaaaccccgtttgtattaaaaatacaaaaattagctgtgcatggtggcccacggctgtaatcccagctactcaggaagctgaggtccgagaatcacttgaatgcttgaactcgggaggcagaagttgctgtgagccgagatggcatcactgcgctccagcctgggcaacagagagagactgtctccactgtctccaaaaaaaaagatgatagaatcatagacctcaaagaaaatgtggaaaaatatctttgaaccatgatatgctaggatttcttgaagagaacattaaaagcactgaacatttttcttaaatgaattggacttcattgaaaagaaagatgtattttctccattattcattgtgattcctttttctttttttaatatgatgaccataaaatgtattacttggtggttgaaatttttcaagagcttgttggggtttgttgaattttttgaaccataagataatgtttttcaccaaatttgggacttttttgacttatttcttcaaatttctcccctttttcttctagggatcctccaattta

SEQ ID NO: 190732 - DNA, 601 bp, Human
ctcttgtcactaactttttatcttaattgcctatgaagatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctaaacggaaattggctctgctgtcaggagactggtgaaaacactctcggctgcaagccatgtactgcgtaagtttctttctgattataaaagcagtgtgtcaaaatttgatatatccatgyaatgttaatattatttgtccatgaaaaggaatgacatactgatccatgcaacaacaaggatgggaccttgaaaaattatgctaagtgaaagaagtcaatcataaaggccacgtattatctgataacattgatataaagtgtctagaataggtaaattcatagaaacacaaagtagattagtggttacaagggataagaagggaggaatggggagtgctattggatgcagagattcttttaggagtgaagaaaatgttccaaaattaatagtggttgcacaagttaaaaaattttaaggca

SEQ ID NO: 190733 - DNA, 601 bp, Human
tagacgtactctgcagggtgagccgatgcaatcaaaacaggctcagtttttatcatccctctgtgtatctaaacggaaattggctctgctgtcaggagactggtgaaaacactctcggctgcaagccatgtactgcgtaagtttctttctgattataaaagcagtgtgtcaaaatttgatatatccatgtaatgttaatattatttgtccatgaaaaggaatgacatactgatccatgcaacaacaaggatgggaccttgaaaaattatgctaagtgaaagaagtcaatcataaaggccaygtattatctgataacattgatataaagtgtctagaataggtaaattcatagaaacacaaagtagattagtggttacaagggataagaagggaggaatggggagtgctattggatgcagagattcttttaggagtgaagaaaatgttccaaaattaatagtggttgcacaagttaaaaaattttaaggcaatgtttaaatagaagcatgagcttgaaccaagatatcaagaaagaaggatccttagcattctctttctaattgtatggaacaaccattgtatttctatagacttaagtaat

SEQ ID NO: 190734 - DNA, 601 bp, Human
tgtttactactttatctttaagttctacactagggtctaagattgaataggtggtcagtaagtactcattgaattaatgaaacaacatttggcatgagagattatccagggaaaattctaaatacttaatggattatatatttgtcaccctttaaatttttgtatttcttaaattttgaaaaatgactttttttcttctctagggaaaatccaattgttgggaaagcatcttagagtttaacagattggttcagaagaactggaaaatattatttttcttggagcttttcaattcatcatrtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatc

SEQ ID NO: 190735 - DNA, 601 bp, Human
tcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaaytccaattcatgacagttcagagcttttcatttagttcatgtagaccctcccactttaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgt

SEQ ID NO: 190736 - DNA, 601 bp, Human
gcacccttcaagcttcctttttcctgagatgctggctggggaagatgccctgccacagcgaaagactgcacagagcaaagttggggaaactggggagggcagtttcacaaccccactcgctgaatgcctgcagtcaatatcaaaggcacatattgtttgcatgagcagaagatgaaaccttgtcacattcccattaagtgcagagctgcatctaccccttcaaaatgtgggaatgacaactgtaaccttcacgccaatcatctccgctgtgcccaggcctaaactgtgcagggcacaaagrccccaggtttgacctgcagagtccccaagcttcagcggctggtggttcacttcattttttttctggcggggcaggaggaagggaaagaaagagggcttttcagggctctacaaccaataaaatcgtgccgctttgaggacatacttgagctccccaaaagacaggcagctgaagggcaaacagtgtctaatcagtagtgagcatgttatttggtaactgccaaggtgcagtgggcgcctgggctgctccaacaatttcttcgcttctatttctagacagacgccagttacactccaaaag

SEQ ID NO: 190737 - DNA, 601 bp, Human
gtacaggggtcaagcagacaggcaatgcaggacctcagttggaagccctgtcagcatgatgtactccctgacacccttgagagcacatcagatgatcctaactatgatctataaagactgagactcctccagaacatggagtattcttaaagcctgttcaaacctctagaaggcaagtgcaaggccatctggaataaaacattaaacttgggctgagcctggggctcaatgagctaggtacccagactttgtgatacttcacctggaaaatgatcctgggtgttttgcactgaaaaaagcmcattccccatcccaggcaaagtgcctggcaattaatccatccagacctaggctgaatacaagtcactatattgactatcccccttaaaaaatgaccaaaattatctgagtgtagctcagagaagacaaggctaatgtatgcatctggagaggccagggtgatggtaaagattacgcctgtttctatactggccgtctaaaggtatttacttgggtctgtctgtgttgtgacagtgtcctagactcaaatgaatgcctctaacactccacatttttgagccattcagtcatgcatttttgt

SEQ ID NO: 190738 - DNA, 601 bp, Human
ctctgccagttagtcatgccgggttctttttttcttcccccgagcagttggtctttttgatgtctggcacacatttatctgggcttccaataagatgtttttacatagtttccaggcttcctggaggttattgacttttttaactctcccattcagttttttcccctaatttctaacatttgttagagtttctttctcaaaagttgaatacctggctgatgcagctctttgatttttctctcccaccagattgctgaattaaatgcatcagaacttaaacataatatttcaaattacctcyaggatggaatcgcttcatgcattttctgcactttcatgttctctatagtaagcaacagatgtttaaccaagtagatttgaaaatgctagtttttacctgtttgtattttagtatgtctgtttatttatataaaatattctgatacccttcaaagcttgtgttcttcttggtaaagacaataaacttgagtttttttatgttaaaaggtaactgatgcacactgaacagttgcatgtggtaaatttgctctaaattgcctaatcacaacagtctcaactgttcattctttaaagaagtgta

SEQ ID NO: 190739 - DNA, 601 bp, Human
atcacaactgtaactaattaccaattttcagaattattgaatcaatgtctgcctcaccatttagactgtgagctccataagtgtgagacctggcttgtatcctttttattcactgttctatccccagcgcctagcaattaataggcacttgctaaatatctgctgaatgaatgaatccagtttaggcaccccctttctacagatgggagttcatatgtataatctcatattcacaagtcctaaagagtcaactatgccctctgaaagcttttttcctaagagcaacctatttgcaaggagyactcattcatgtattcattcaacaaacatttttgagtattagccaatgtggtaggcattgggtatagggcagtgaataaaagaggcaaagcccctgcccacaggtcaggtggtgataactaagaagaagaaagcagagaggaagaaggacgaagtatatgaatatatgtgtgtgtctgcagggggtgggggggtgggagtatcctattttatacagagaccaggaaaagcttctctattaaggtgataggtaatcaaagccctgaaacatgtgagggagtgaaccatgctgctatctggc

SEQ ID NO: 190740 - DNA, 601 bp, Human
catttgctagctaaaggtgacatacttcctctgagtttcctgaaaacacccacctccgtttaactttgggactttcagaactcccctgaagcaaccaatcagagctcacctgtaccaaccaatcagggctcacttgtatcaaccaatcagggcccagctgagtcaaccaattggaattaagcaaatttcagtctttcatttgcataacacttgcttaggaacctaggtgggaacttttgcactaaaaccagaatccagccaggctcggtggctcacgcctgtaatcccaacactttgggascccaaggtgggcagatcacttggggccaggagtctgagcccagcctggccaacatggcaaaaccccatctctacaaaaattagcagggagtggtggtgtgcacctgtagttccagctacttgggaggctgagttgggagaattgtttgaacctgggaggcagaggctgcagtgagccaagatcacaccactgcactccagcctgggcgacagagcaagactctgtcccaaaacaaaaacaaccagaaaccagaatcctctctttggtctctggaatgtgcacttttgttttacactgaag

SEQ ID NO: 190741 - DNA, 601 bp, Human
cttgctcccaatttacaacaatgcagtcagttcactgcattaaatggagagcttgggacttcagcctttgtcatggctatgtagtatgcccttcagaagaggggtccacattagaaaatagctaaaaatacttgcttgtaacccagaaacactgggatgtcacagctactcatgtacctctaggtaaaattgtcaggcatccgagctagtgtctctatacataccccagcctcagggttcctcattaggactttgaatttctgaacaaactaagaaatagggatctactggccaggccccrtggctcacgcctgtaatcccagcattttgggaggttgaagcgggtgagttcacctgaggtcaggagttcaagaccagcctggccaacatggtaaaacccttcctctactaaaaatacaaaattagccaggtgtggtggcaagcacctgtaatcccagttactcgggaggctgaggcaggagaatcacttgaacccgggaggtggaagttgcagtgagacaagattgtgccactgcactttagcctgggtgacagactgagactctgtctcagagaaaaaaaaaaaaaagaaatagggacc

SEQ ID NO: 190742 - DNA, 601 bp, Human
aggcatggtggtgtgtgcttgtgatctcagctacttgggagggtgaggtgggaggatcatctaaggctgggaggttgaggctgcagtgagccgtgatcacaccactgccctccagggtgggtgacagagtaagaccttgtctcaaaaaaaaaaaagtaaaaataaaaataaagcagagacaatcacatacccataaacttaaagctaagtttagataaagattggtttgccctatcataagctcatgcagctcagcccacaccctgagtgcctcctagcatatggatcattagagccattrtaagagaaattaaacacttatattcttaatcagaaaacttacccttataataatagtaggctgaggctgggcacagtggctcacgcctgtaatcccagcactttgggaggccaaggcgggcagatcacctgagctcaggagttcgagaccagcctgagcaacatggtgaatccctgtctctactaaaaatccaaaaattagctgggcgtggtggtggctcacacctgtaatcccagctacttgggaggctgaggcaggagaatcacttgaacccaggatgcacaagctgctgtgagctga

SEQ ID NO: 190743 - DNA, 601 bp, Human
gccctctgaaacttccacaggcctcaggtcacagccagagaaccctaaatcaggactcataatgaactcacatctgtttgtacaaaaatattaaaatgcatcttaatacaggtaactaactgatgtccccaagagtctaggattacctcgttatcactgtcctgcacctttccagctgtgagtgaataaagtaagtatatttaagtacaacacagcctctatctcacaggaaggcattctttttgatttgttgtagagcattcagttcaaggactcagtattgcttgggattgcaaacagrgtgacttgcagtgacatttgcaagccatatactcttcaaggcaatttttatgggttgtcaggttgggggacatggggaaaagagcataaaagtgttcatgatctacatggtcttagaagaaatgtaagaaacaccgaagaattcagttgttaaacatcgggaacagtcaaaaagtctggctaatttgcttttgatttttacttgaaagtatttatcatcagaatagaagtaattgtcataataatggcaatgcctcacatacatatggtgcttaaagcatcttcacgtatattatcattt

SEQ ID NO: 190744 - DNA, 601 bp, Human
tgttgttggctggaggtgtggcttggcaggcaattgctagggcccttgagaagtaatgaggagatggcatggcctaagaaaatgagcacagactttggagtcagaaagacgtgggttcacttcatacactgctggtgggaatgtaaactgtagttgccaccatggaaaatgctttggcatttcctcaaaaggtaaaacacagaattaccatatggcccaataattccaatctaagaaaactgaaaacaggtgttcacatacaaagctgtatacaaacattcacagcagcactattcaccayagccaaaaggcagaagcaacctaagcacccatcaactgatgaatggataatgaaattatggtgtgtccatacagtgcaatattcttcagccaccatgaagggaataaagtgccagtagattacgctaagtgaaagaaactagacacaaaagtcatatattgtatgattccatttatatgaaatgtctagaatgagcaaatccagagagactgaaagcagattagtggttgccaggggctggggggaggcaggaatgagaagtggtgtcttaatgggtacagaattttacttttgaagtca

SEQ ID NO: 190745 - DNA, 601 bp, Human
aggcattagggaaagagagaggaaaacatatccaaggaagctaatctacaccagggctctgccaactgtgggatcatgacctccaaagaacctggagagaatttcaagggggtcagaggccctggagcccagagcctaagacctcccaacatctgttgtcagtgagggtagagcagcctttttaatacaatttcctcacatgcaacagcaccagttcttttttcagcccttaagtgtacccaacacccactcccatatgacctcatctcccagtactacccaaattattgtcccattacaytgtcctatagtgctcatttcccttggcagcagggttgaacaaagaatttaaattttaagaggaatgctatgtgtttccagtctttgctgccctatcatgaacaccatccatcagttggaacttcaaaaaaatattttatgatgcttatattaatagttaacaacatgcattgagcatttgttatgtgtcaggcaccatgccaagcactatattatctatattagctcctttgatcttcacaactcaatgaggtaggtacagaactattatcttatcctccccccctttaaacatgaatcc

SEQ ID NO: 190746 - DNA, 601 bp, Human
taatctttgttagtgctgtatgtttgctttaaatcctgttactgcattccttcatgcaatcaagtgccctttaaaaactagtatatcagttacatttgcctcctctgagagaggttatgacccttttataccctgtggggcttttgaccctagttcctgtttttcttatatttctgttaagttacagttcccccagaacaattgtcgctcaaatgagataactagagtctgtcttaaatgatattgaactttttcccattagacagtgtgagttaagcaaagaaacctaatatagtagtaygatgcatttgataaagagtgacatgaaaacctagtcaagaatgtcaaaatattttaaaaatactttgctcacaatgtgaattataatgcagccattttgtactactctctcctaaatgaatttaaactgaattaaacaccgaagtattcacaaagctttctttgcaggataattatttctgcatatgatatgattatttaagtgaggattcttgaaaagtaagtaactagttaggggtgcagtactgggcatttaattatcctaagggattgtgaaaagcaagaggttgagaattggagt

SEQ ID NO: 190747 - DNA, 601 bp, Human
cttttgctctatcaaagggaggaagccagttagaggaaccacttaatcacagtcacagggctaaaatggagatggtggagagactgaatgaattctttgtcttgtaaggagatgcgcatttccaaaccagaacactgaactcggcaggtcagaggtactagatcaaatagtggtaaacatgatgccctgcatctaatcaacaaaccaggagtagataaatcactgggaccagatggtatccaccagccagttttgaagtaactcaagggtgaaactgttttggccaacatgtgtaggctgyctttacaaacagccactgtgcccgagactggtgcttgtcaatgtaattcctattcataagcggggttctagaagggaccctgggaagtagaaaccagtaaatctaatttccataatcaagcaggctggccaactttacgggaaaggtgaaatcactacacatttatgaaaataaggcctatgctggggggggagagaaaacccaaatattttggcaaaggagaaaaatctaataaaccaggactcttggggtgggtggtgcaagtagaatatatgaataaaggggaccctgaggatatga

SEQ ID NO: 190748 - DNA, 601 bp, Human
ctaatcagtaggagaaatgcagccagttagcattttgcaaaaccttgccaaaatatagctctggagggcttaagactgccaattatttctaggtccactaatcctgcaaggtagtatagagaaggccagtcagaaacacatacattcaataatcagttttattatatttttctaagaataactttatgtaagtgtagttggaagagttagggttgctactttaaaactctacacttcatttcaatgagcttataatagctttaaactgcactccagacagaaatcaaccaaggcttcttaytgcttttcaaatgataagcaaattgtcaaccaaggttaatatctgacaatcttagatccccattttaactataccaaaggtttattaaggcacaccaaaccaaactgagtgaatggcctgaaatgcacactttgaccttgtgttgccatcacttctgagcagctgaagcaactgcatctattttgcacatttacaaccactacctccaggactcaaaaggaatagtaatactactagtgattaacccaaaactctccaaaaattctgaggctcctgtaaatactttctaagcagtgctaa

SEQ ID NO: 190749 - DNA, 601 bp, Human
acacataatgtcaagaaaagcatgcttcaaaggtactatgtaattagaatggcctttaaaacaggcacaaaggaaatcaatcctcttaaaactaaatctacttcataaaaatcttcaaactgagtgaacagcaccagggaaaagaatcctgaggtgttttggactccatattctattttttaaagtctgttatctgtaccattgttcagataggatcaaagtacactttcaattggctcatattggctatttcttcaatattaagagaaagtgtgcctgcaagaagccacgtctggcatargtgattagaatgggttctgtcgtggcttttacatggaaagactatgccagagcttcagctaatgtgaggttggatggagcccagcttaatgaagactatagtaaaatggctacttttgggtctctgctgcatggaaactcaagaactttaatcctgcctgtgttctgcaaaacttttaggaattctagttgtctttggggatccattttgaaatttaatttgaagtccagcatctgtaaattctctttattttgactaagacagttttcagatgcctgctttttattatgaggtcttttt

SEQ ID NO: 190750 - DNA, 601 bp, Human
tgtgggctccctgccaggaagatacaagtctaacaagaaatgaggtgacttgcagtagaaggccttggaacttggaaacaactttatctccactacattgtgctgccaacgggagagtcatttctaaagagcagatttttttttccttctaaattccattatgaagcccctaagtggtgatttttaaatatcaacatcttaagttttcaaaaatgaccatttaattagctttctaagttttctccccaaagtaaaagaaaaggcttaggttattatcttgaatgagaaatgccatggtcargaaaacaccattcttttcaataataataattcagtgatcaggagagacagaggaggtctaatgatagattttgccaataacacccattttcacatggtattaacatattgttaaatacttttaacagctacagcatatatgtagggggatatgggtaataagaaggatatacagatatataaattgttcccattcatccagggaaaggtgatagaactaagacataattttgcacatagcgtgtttgaaaaaatgggtaggatcaacggcatactacatagacagtgttttagttcaact

SEQ ID NO: 190751 - DNA, 601 bp, Human
tagtaagtgtggctatataaacgacaattatctatataggtagaaaatagttaaagtcaggggtcaggaaaattccagaaatttcagcttagtcaatggccatgaagcttatctggacatatttgtcttttaaggttagcagatagctcgcttccactgaggtcatgcctttcatgggcatataaattttaatgcctcctactcactgatcctctgcactggttaatggctaatatgaactacagaaaatttgcagttagtgattaaaatgcagattctgctaagtctgaagagtgcttcrtgccctgcctctgtgaagtgataggaaacaaggggccttagggcttaagggaagggtaactgcttggtttacacttggcccatgcagatagatgggacagacaattatttcttttgtgtgcattttaagctaattcagaaaatttctactattattcaagttaacaagcttcaggctcatgggagggtttttcaaagacctggtgaaagtagctgagagttaaaaaatgatagagggaaaatagagggtaccatacagacggctaattaacatcttgtaaggcctttcactaaagcagct

SEQ ID NO: 190752 - DNA, 601 bp, Human
gttttagactttttccaatgtaaaaccctctcaggggatctttagtaagtgtggctatataaacgacaattatctatataggtagaaaatagttaaagtcaggggtcaggaaaattccagaaatttcagcttagtcaatggccatgaagcttatctggacatatttgtcttttaaggttagcagatagctcgcttccactgaggtcatgcctttcatgggcatataaattttaatgcctcctactcactgatcctctgcactggttaatggctaatatgaactacagaaaatttgcagttrgtgattaaaatgcagattctgctaagtctgaagagtgcttcgtgccctgcctctgtgaagtgataggaaacaaggggccttagggcttaagggaagggtaactgcttggtttacacttggcccatgcagatagatgggacagacaattatttcttttgtgtgcattttaagctaattcagaaaatttctactattattcaagttaacaagcttcaggctcatgggagggtttttcaaagacctggtgaaagtagctgagagttaaaaaatgatagagggaaaatagagggtaccatacag

SEQ ID NO: 190753 - DNA, 601 bp, Human
taatgaaatgtgaggtgaggattaaaaaccaatcaatgttgtatattatgctatgcatatctatgacacacttactttgagggtgttttagactttttccaatgtaaaaccctctcaggggatctttagtaagtgtggctatataaacgacaattatctatataggtagaaaatagttaaagtcaggggtcaggaaaattccagaaatttcagcttagtcaatggccatgaagcttatctggacatatttgtcttttaaggttagcagatagctcgcttccactgaggtcatgcctttcaygggcatataaattttaatgcctcctactcactgatcctctgcactggttaatggctaatatgaactacagaaaatttgcagttagtgattaaaatgcagattctgctaagtctgaagagtgcttcgtgccctgcctctgtgaagtgataggaaacaaggggccttagggcttaagggaagggtaactgcttggtttacacttggcccatgcagatagatgggacagacaattatttcttttgtgtgcattttaagctaattcagaaaatttctactattattcaagttaacaagcttcag

SEQ ID NO: 190754 - DNA, 601 bp, Human
atatggaaagaaaagaaaatagaatcataaaggaaagagtagcagtgctttcaaactaaatcggagaccactggcataatctggaagaaacactgcatttgcaggaaggccagaaggcctcatgtctttctccgtactttcgaggctactcagcctatgaaatgttgcccgctgtactacagcagaggttttagaaagcaatgatttttttaatgtcttaatgaaatgtgaggtgaggattaaaaaccaatcaatgttgtatattatgctatgcatatctatgacacacttactttgaggrtgttttagactttttccaatgtaaaaccctctcaggggatctttagtaagtgtggctatataaacgacaattatctatataggtagaaaatagttaaagtcaggggtcaggaaaattccagaaatttcagcttagtcaatggccatgaagcttatctggacatatttgtcttttaaggttagcagatagctcgcttccactgaggtcatgcctttcatgggcatataaattttaatgcctcctactcactgatcctctgcactggttaatggctaatatgaactacagaaaatttgcagt

SEQ ID NO: 190755 - DNA, 601 bp, Human
tgcattttcaatccgatgagatagccaatgctaaagtcacaattggtcacacttcagataacaactcaaaaggcagaaaacctttgtcaatagagaaatgtgtgcattttgtctgagcttttgatttgattacagtaagctggcagtggctcattctggtcaagtttcacagagagattataaaagaattagcaaaagtagctggctttttagtctctttcatatggaaagaaaagaaaatagaatcataaaggaaagagtagcagtgctttcaaactaaatcggagaccactggcataawctggaagaaacactgcatttgcaggaaggccagaaggcctcatgtctttctccgtactttcgaggctactcagcctatgaaatgttgcccgctgtactacagcagaggttttagaaagcaatgatttttttaatgtcttaatgaaatgtgaggtgaggattaaaaaccaatcaatgttgtatattatgctatgcatatctatgacacacttactttgagggtgttttagactttttccaatgtaaaaccctctcaggggatctttagtaagtgtggctatataaacgacaattatctata

SEQ ID NO: 190756 - DNA, 601 bp, Human
agtgctttgggctcgtaaagctgcacatgcattttcaatccgatgagatagccaatgctaaagtcacaattggtcacacttcagataacaactcaaaaggcagaaaacctttgtcaatagagaaatgtgtgcattttgtctgagcttttgatttgattacagtaagctggcagtggctcattctggtcaagtttcacagagagattataaaagaattagcaaaagtagctggctttttagtctctttcatatggaaagaaaagaaaatagaatcataaaggaaagagtagcagtgctttcmaactaaatcggagaccactggcataatctggaagaaacactgcatttgcaggaaggccagaaggcctcatgtctttctccgtactttcgaggctactcagcctatgaaatgttgcccgctgtactacagcagaggttttagaaagcaatgatttttttaatgtcttaatgaaatgtgaggtgaggattaaaaaccaatcaatgttgtatattatgctatgcatatctatgacacacttactttgagggtgttttagactttttccaatgtaaaaccctctcaggggatctttagtaagtg

SEQ ID NO: 190757 - DNA, 601 bp, Human
gatgtatttttctacttttccaaattttctacagtgagcactgtaatacttaataaaaagaaaaacattattttaaaacttcaccaaagcagtttccatatttttcataaagaaatatataattttttcctaaatagtattcctcattatagcaacttgaaaaatatggacaggtaagaagaaaatataaatataatccccactgctaaaagacagtaacaatggcttatcaaatttccttcctccctttttcctatgaaatacatgttgctacgtggttgaaataaaatgtatttacacygtgttcttatgtaacactatatggttagcattttctatgtgattaaaacttcttcagaagcatcattttttttttcgagacagagtcttgctctgtcacccaggctggagtgcagtggtgcaatctcaaatcactgcaatctccacctctctggttcaagtgagtctcctgcctcagcctcccgagtagctgggattacaggcgtgcaccaccacatctggctaatttttgtattttagtagagatggtgtttcaccatgttggccaggctcgtctcaaactcctgacctcaagtgatcc

SEQ ID NO: 190758 - DNA, 601 bp, Human
tgggtgctggggatcaagggtaatttttttcattctatctttcttgattttgttcccccagatatttcagtgacattttataatcagaaaagtgatataccttcatgctttcaaaagtaactatttccctttattcccttcattctatttaaccactggaggatttgatgtatttttctacttttccaaattttctacagtgagcactgtaatacttaataaaaagaaaaacattattttaaaacttcaccaaagcagtttccatatttttcataaagaaatatataattttttcctaaawagtattcctcattatagcaacttgaaaaatatggacaggtaagaagaaaatataaatataatccccactgctaaaagacagtaacaatggcttatcaaatttccttcctccctttttcctatgaaatacatgttgctacgtggttgaaataaaatgtatttacaccgtgttcttatgtaacactatatggttagcattttctatgtgattaaaacttcttcagaagcatcattttttttttcgagacagagtcttgctctgtcacccaggctggagtgcagtggtgcaatctcaaatcac

SEQ ID NO: 190759 - DNA, 601 bp, Human
cattacattaaacaagagaataccatacacacaccacacacatataaaaaataagaataaatcagcaggtcgacaccccccacccatgtatttcatttgcatactaccttctttgccagaagtccacttggtataaggattgagctagggaagtgtaagtactttccagttctaaaatctaatcattctaaatgcaagtagtactaatttaacatgggaaaaactagagtgaaaagacaaaacttttccatataaatgttttctatgtaaatatcctgtcttttaaaaaagagaagaacaycatgtacttctggaacttctatccccagctacttgtcttgcatcaaataaacattcaaaattcttgaaataggccaaagaacctccagttctgctactaaatgccacattagttactcctttataaacaatcaactggctattgattaatgcattctagaattaacccataaccttaagagattggggcccttttcatttgatccattttttttggtgctataaattaccacctggtatttacattattaggaagctgccttttacatataaggattgatttttctcttactataaatgc

SEQ ID NO: 190760 - DNA, 601 bp, Human
acctttaccatacactgccactctccacatacggttttatgagaataccagagatttttttaaacatctataaaattgttaatccctcactacatacaaaaagttcctaaatattcatatatttaatctatgagagtcaaccagacaaaaatcaggggatccagaagacccagactcatttctttttagatggattcttactagccctgttgcttgggactattctacctatgccttttgcctcaaagggacctcataaggatggcagacatcatttaaattctaaaatccatagcaattrggtacaatatcaaccaaagcataataatttgctattagaaagaaggagaaaaaatccttttgcatctgttcctcctattaaactagcagctcgcatgttcttgcataattctttcacatccccaatcctcctttctattcccatgacatttacttctacaatgaggaatgaagcataaattagccattcagatcctggtccacagccatcaatagcaacttcagtaatcgctgcaatgttcatctccatttttttttcaatcattctcagaactcagaatcagggtcagatcttaactgc

SEQ ID NO: 190761 - DNA, 601 bp, Human
agatacttggatgagataacattgtttagtaaaacaataatgacttactgagccagtgctatgtatttagaactattcaaggtgccgcaggtgagaaaaatgatatgaatatatgtgtattactcatcagtccctgctcacaaagaattcaaaggctcaagaaaacactgctggatgtgaagagaaaaaagttcacttgaacaaaaccaaccagaaaacaattacatattttaccaattttaatgttttgaaagaactatactaatgtagcagagatgatcaattcctactataaaacggkacgtaatgtgcataaaaataaaaagatttctacattatttacataagaattaggtttgcttcatttgcttttgtggggtggtatgatagaaagggaatatcatctggactgagtacttccatattaactcatatatcaaaatcaatctgagttattgacccataatgacaatacattgataccaaatttccaagcctataaaatccttcaagactgacagaggtctttcttaatgataaggtaactgtaggaggtaccttaaaatttaagattttaggagccaatctatgtttcatgata

SEQ ID NO: 190762 - DNA, 601 bp, Human
aacaggtctcccctgcaaagtctcatccccctagaagaaacagcaataatgctagcactgcccaggcctttggtccccacccttgtcgacctgcccaggctcagaacagtgagcccagagtgtcaaggactctggactaccctagtgagtaaacaaaatggttgcctctcttttggagtctttaagagccaaaagtatgccaccaccatggaagaaaaagctacacagtatatggcacatgttgagtagcctttatcaaaagtgcttgggacaagaagtgtttgggtttttttttttttttggattttggaatatttgcattataattatggtttgagcatccctaaaccgaacacccaaaatctgaaatgctccagtgagcatttctttaagcatcaggttggtattcaaaaagtttcagatttagagcatttcggatcttaaattttcagatttggcatgttcaatctgcaactttaatttaagttctctcgtggagcttctggtgaaagtccaagatcttctggatccagtggtggcacttactgtcacatggtaatataccaggcactgctgggggctctttcattagctctcaatg

SEQ ID NO: 190763 - DNA, 601 bp, Human
aacaggtgcttataaagacactcaaattcggcaattatgcaaaggtgactagggtggggaaaaatgtgagtttctttttgtgagctgttagtatgtgtgtgcggtcctactaatactcagcataaggaacttcaacactggttactgttgcttcaggcatcaaggtaattgacaactggacatttaaattctccttaatttgtcctttccccaaaatcataactaaccctctctgcaattggccacttcatttacattgctgtctgggttctgagaatggttttctaggtggaatatatakgcaggaatatgtatcccttaaattctcagggctaaagtccttccactctcaccagagcagactactactgctaaatggtgtacagaaacagaatccctgaatttctcaatcagatttcacctgatccaaataacaaatgcgtatctggccggtttgcagaagatttagttgcagtgtaatagatataacattttaaaagccacttttacaactccatgaggactgtactccagcatttacatggatacaagcctataatcataaacacaactgactttcaggcgggaaatatcaaaaaga

SEQ ID NO: 190764 - DNA, 601 bp, Human; identical to SEQ ID NO: 20481

SEQ ID NO: 190765 - DNA, 601 bp, Human; identical to SEQ ID NO: 20482

SEQ ID NO: 190766 - DNA, 601 bp, Human; identical to SEQ ID NO: 20483

SEQ ID NO: 190767 - DNA, 601 bp, Human; identical to SEQ ID NO: 20484

SEQ ID NO: 190768 - DNA, 601 bp, Human
ttgctcctgggttcaagcaattctctgcctcagcctcccaagtagctgtgattacaggcacctgccaccacgcccggctaattttttgtatttttagtagagacagggtttcaccatcttggccaggctggtcttgaactcctgaccttgtgatccagctgcctaggcctcccaaagtgctaggattacaggcgtgagccaccgtgcccaaccatattttaatacatcatctacaaatataaatctcagctctttaaaaagtaattgaatatagattttaaaatccacagggtgtttctcytaccattcagtaaacatgacaaccagatcatcttgatcagcatagtgttccatgacttctttcattaatctcactttctggccccctccaatactattaattccatcaccacctctccattcttctccttgaccaaggacctataaacaaaatcaacatttcattcctgagcaaaactcaaattatgaaagtactatgaaaaacttaaagacatcatcaacttgaacagtactgtaccgtaaccactcttctaatgtttcatggaatcatgattctagaaaaaaaaatctagatgcctaa

SEQ ID NO: 190769 - DNA, 601 bp, Human
tctgtttaaccagaatccattaagttacccgtctcaatagtaaagctcactatgatctttattcttaactcaagactaaagtatgaatttcacaaaaacgttagctcttgccatgttgtctcattagtgtttatggtaattcatcatctttaattacatcatctcagaccatagttgatataatttgaatctacgtccccacccacatctcatgttgaaacgtaaccctcagtgctggaggtggggttgggtgggaggtgattggatcatgagggcagtttctaatggtttagcaccatcmccctagtgatgttctcattatagagttctcatgagatctgattgtttaaaagcatgtagcacatcccctcacttcctcctgctccaatcatgtgagaccttcattcctcctttgccttctgccatgatcctaagtttcctgaggcctctccagaagccaagcagctggccagcatcatgtttcctgtacagcctgtgaaattgtgagccaactaaatctcttttctttataaattatgcagtctcaggaatttgtagcagcacaagaactgattaatacaatagttttataactagtaat

SEQ ID NO: 190770 - DNA, 601 bp, Human
atttacaactttcttatttatactaatgcataaaaatattactcttattttcatctgcaaataatttgtgtctttatattttcaaattgagaaaaaatatgtaaaaagaccttcctaagttagaggggaaaattcatggggacttaaaatgagcaatcaataacaaaaacaaataagacacagaaaataaaataaaggaagtagtaactaataactcatgacaatttgatgttattataaaattataagaagatggcaaaaaagagtggatattttaattaggagagtgaaatattacacaaaatacatttacattaaaaaggttcttctttcttagtaacacaggctttctaatgtctcacttgtatttataactttgcgtggtcttttttcttctgtttaaccagaatccattaagttacccgtctcaatagtaaagctcactatgatctttattcttaactcaagactaaagtatgaatttcacaaaaacgttagctcttgccatgttgtctcattagtgtttatggtaattcatcatctttaattacatcatctcagaccatagttgatataatttgaatctacgtccccacccaca

SEQ ID NO: 190771 - DNA, 601 bp, Human
taaaccaaaacatacccagtatttattctacagagctattttaatgaacttggtattctttttctaagtgtaaaaaaaataacaaatgctgtagaaaaattcccagtacactatggctaacacttgccttaccatacttcatcttgcaaaataggtaaccacaagcagaacttaatattttgtgtaaaatataacaggaaaattttacagatgcaagtgttatgtatcttttgaaaatttttaagtgtgtacggcactgggacttcattatattaacatctattttcatttcataatttayaactttcttatttatactaatgcataaaaatattactcttattttcatctgcaaataatttgtgtctttatattttcaaattgagaaaaaatatgtaaaaagaccttcctaagttagaggggaaaattcatggggacttaaaatgagcaatcaataacaaaaacaaataagacacagaaaataaaataaaggaagtagtaactaataactcatgacaatttgatgttattataaaattataagaagatggcaaaaaagagtggatattttaattaggagagtgaaatattacacaaaata

SEQ ID NO: 190772 - DNA, 601 bp, Human
acccatgttttcagttagctggctgttctcacaggagatgtcagaaattttatctgtttgtttccatgatatatcccaaacactaacagtgcctggaagacactgtgtcttccattaaaattttattatcttttctgtcaagctgggtcctaaagtatcatctaaatcaacaaactcaacctcaagcaggctttaggtatatcacagtgtccttcttctcatgagaaaaaaataggtccctcactataccagttgtccacaaggacaaatattagatagggggccggaggtgggggatggygatgcgagagtgatggtagagaaaagttcttcctaaaacccaaaaggaagcttgaggatgtaaaatcatttctgactcacatgtagtaactcttacaaggagaatctgcctcagagccaaagtgaaaatgtacatgtggcaagtttaagctgactaatatggttgtttgaaatccatggtaattttaaaccaaaacatacccagtatttattctacagagctattttaatgaacttggtattctttttctaagtgtaaaaaaaataacaaatgctgtagaaaaattcccagtacactatg

SEQ ID NO: 190773 - DNA, 601 bp, Human
catatcctgaattctggacctttaccagagctaaccttaattaagagtttaggaattgtgttacagaatgggcatcatatttcaaaccatttacaaacagtttaattcattctcccaggccctagattacaattttcaactagattcattactctgtataaactttttaaaaagggtgttgtttttaaaaaataagaagggtaaaaaaaatttcttatgtggcttcaattgctcatccctctttaacctcctggttactttctcatgacccctaggttttttccacaggatagtcatggtrggtaatgatgcagaaaatgttaatgactcttcttagacaacaacttggctgagtgggcacccatgttttcagttagctggctgttctcacaggagatgtcagaaattttatctgtttgtttccatgatatatcccaaacactaacagtgcctggaagacactgtgtcttccattaaaattttattatcttttctgtcaagctgggtcctaaagtatcatctaaatcaacaaactcaacctcaagcaggctttaggtatatcacagtgtccttcttctcatgagaaaaaaataggtccctc

SEQ ID NO: 190774 - DNA, 601 bp, Human
aaccactaagtatatacatctgtgtatattttcatatgatagtgacctatgcttccataaaacagttgagttgtccttaaaaataccacataaaaaataagaatgttttgctttattaaaatgaacatatcctgaattctggacctttaccagagctaaccttaattaagagtttaggaattgtgttacagaatgggcatcatatttcaaaccatttacaaacagtttaattcattctcccaggccctagattacaattttcaactagattcattactctgtataaactttttaaaaaggktgttgtttttaaaaaataagaagggtaaaaaaaatttcttatgtggcttcaattgctcatccctctttaacctcctggttactttctcatgacccctaggttttttccacaggatagtcatggtaggtaatgatgcagaaaatgttaatgactcttcttagacaacaacttggctgagtgggcacccatgttttcagttagctggctgttctcacaggagatgtcagaaattttatctgtttgtttccatgatatatcccaaacactaacagtgcctggaagacactgtgtcttccatta

SEQ ID NO: 190775 - DNA, 601 bp, Human
aatggaatacgggataattatggggtattggaaacattctaaaattgaataatggggatgactgcacgactctgtaaatttaattaaattcattgaattttacacttacaaatgtttatggcatgttatataaattatgccctaacaaagctgtgtttcttaaaaggctcatctaaaccactaagtatatacatctgtgtatattttcatatgatagtgacctatgcttccataaaacagttgagttgtccttaaaaataccacataaaaaataagaatgttttgctttattaaaatgaayatatcctgaattctggacctttaccagagctaaccttaattaagagtttaggaattgtgttacagaatgggcatcatatttcaaaccatttacaaacagtttaattcattctcccaggccctagattacaattttcaactagattcattactctgtataaactttttaaaaagggtgttgtttttaaaaaataagaagggtaaaaaaaatttcttatgtggcttcaattgctcatccctctttaacctcctggttactttctcatgacccctaggttttttccacaggatagtcatggta

SEQ ID NO: 190776 - DNA, 601 bp, Human
aagacagtatcagatggtctcactcatatatggatatcttcagttttccttttgttctgagaataacctaaaaccttgccaaatatctaaatttttttatctaaattaaatataataaatcttaccctacagattataaagagccagtttctaattttaaacgttcatccaaaagtaagtttagaatacatattccatggaaggaatgcgacaaaattgtttctaaattaattcaggctttttagcatgtctaaatggaatacgggataattatggggtattggaaacattctaaaattgmataatggggatgactgcacgactctgtaaatttaattaaattcattgaattttacacttacaaatgtttatggcatgttatataaattatgccctaacaaagctgtgtttcttaaaaggctcatctaaaccactaagtatatacatctgtgtatattttcatatgatagtgacctatgcttccataaaacagttgagttgtccttaaaaataccacataaaaaataagaatgttttgctttattaaaatgaacatatcctgaattctggacctttaccagagctaaccttaattaagagt

SEQ ID NO: 190777 - DNA, 601 bp, Human
cggccaacacttagggaaataggaaagaacctacgttgaaatattgggggtggttcccccgatacacaggtcataaaaatattctcacagaaattgagtcgatctacatgtgaagaaaataaaattttccacatataactgtggtaagtatgcctgggtcctgaaaaaaccataagattctacctgatgtggtcatactgagtcccctgccagacatgtcagtgttctatctcaatagatgattgagattttctaagtgtttttcctttttgtccttctgtgttccctacttctgtgacamcatcaaccacatagtcacctaggttgaaaatctttcattcacccttcactcctctctttccatggcctatctcatggaatcttttccttaatcctattgattccatctacttaatttattttgcattcaaatcctctccactcccactagaaggcacaaggctagattaattttaaaaccctagagacctctacattacccatctcttcctcactcataaataagactgtctgacaaactattttaaaaatgattctgtgccagttcccagactgtatcaatggttctcaactatggcct

SEQ ID NO: 190778 - DNA, 601 bp, Human
gaggaagacatgaaaaacagggcacagaagaatccacacagggtagagtcacagaggattcccatatgatggtgaagggaagtccctgcaggcctagagacgcatcaatcccaactgcggaacagcacaggctctgagagggatgtcttcattaaaatcgacaaactatcaatgtattgactacactgagaagaattccaggattctgtagaaaacttgggggggatgaattaataaaatgaatatagaaaacaaaacaaaacaaaaaaacttgctggttttgcggcttggggggcagcayggaacctgccaacatgtgatgtctcccccggacacccagctttaaaatttctctcttttgtactctttccctttatttctcagaccggccaacacttagggaaataggaaagaacctacgttgaaatattgggggtggttcccccgatacacaggtcataaaaatattctcacagaaattgagtcgatctacatgtgaagaaaataaaattttccacatataactgtggtaagtatgcctgggtcctgaaaaaaccataagattctacctgatgtggtcatactgagtcccctgccagac

SEQ ID NO: 190779 - DNA, 601 bp, Human; identical to SEQ ID NO: 20485

SEQ ID NO: 190780 - DNA, 601 bp, Human; identical to SEQ ID NO: 20486

SEQ ID NO: 190781 - DNA, 601 bp, Human; identical to SEQ ID NO: 20487

SEQ ID NO: 190782 - DNA, 601 bp, Human; identical to SEQ ID NO: 20488

SEQ ID NO: 190783 - DNA, 601 bp, Human; identical to SEQ ID NO: 20489

SEQ ID NO: 190784 - DNA, 601 bp, Human; identical to SEQ ID NO: 20490

SEQ ID NO: 190785 - DNA, 601 bp, Human; identical to SEQ ID NO: 20491

SEQ ID NO: 190786 - DNA, 601 bp, Human; identical to SEQ ID NO: 20492

SEQ ID NO: 190787 - DNA, 601 bp, Human; identical to SEQ ID NO: 20493

SEQ ID NO: 190788 - DNA, 601 bp, Human; identical to SEQ ID NO: 20494

SEQ ID NO: 190789 - DNA, 601 bp, Human; identical to SEQ ID NO: 20495

SEQ ID NO: 190790 - DNA, 601 bp, Human; identical to SEQ ID NO: 20496

SEQ ID NO: 190791 - DNA, 601 bp, Human; identical to SEQ ID NO: 20497

SEQ ID NO: 190792 - DNA, 601 bp, Human; identical to SEQ ID NO: 20498

SEQ ID NO: 190793 - DNA, 601 bp, Human; identical to SEQ ID NO: 20499

SEQ ID NO: 190794 - DNA, 601 bp, Human
ataaaaccagcatgcacaggagttagaacagagggcttttggagtgggaagtgcctagagccaaaacaaaacccaggttctggttaaccactgggttataaggggaggtaatgctgcaagtcttaatctctgggtatatgtaacacagaaatctaccacttgagtattctgacctggagcttaggaaagacacaggagttagaggaaggatttgaaaaccaccagcattgagagaattcactgatgaggaaatgactcaaattacccaacaatgtatatggaaaagaaaaggaagaggccycagacaggcccctgtgaacatttactaaaacagtaaggatgagggtcactacatgcacacaaactgagctgtaaaatttttaaaataaatattttgaagaaccatagagattgaagaggaaagcccagaaaataaatagacaaagcagcagagcatcgtggaagcaaagggaaggagcattcaagtaggaccaaacgaaatcaatgaattgtcagatgctgtctttaggtgaaataaaaataagggctgaacaatgtccactactcaacaaagatttcacaatggaccttaacaggagca

SEQ ID NO: 190795 - DNA, 601 bp, Human
aggaccaaaatcactcctcaaagacatttaaatttttgagacacaatctcgctttgtcgcccaggctggagtgcaatggcccgatcttggctgactgcaacctctgcctcccaggtttaagcgattctcgtgcctcagcctgccaagtagctgagattacaagcagctgcctaattttttttcttttttttttctttgtatttttagtagagacagggtttcaccatgctggccagtctcgaactcctggcctcaagtgatctgcctgcctcagcctcctaacgtgacatgaggtgtgaamcaccgcaccagcctaaatttgattaaaatattatattaccaaggaggaacagaacactatgtagttatgggaaaagtggggttctaccagctcttgactaactggcactgacagtatcacagacagctaaaacagtgactacacacacatagtaaagggattcatctattaaatttgcctagggaaagttacagtgaccaacttttttttttttttttttttgagacagagttttgttcttgttgcccaggctggagagtaatggcgtgatcttggctcactgcaacctgtctcccgggt

SEQ ID NO: 190796 - DNA, 601 bp, Human
cagcaaaccaccacagcacatgcatacctatgtacaacaaacctgcacgttcagcacatgtatccaagaacttaaagtaaaattttaaaaagctaccaaattcataattaagatgtatattgtttgatatttaaaagaaaaggctgaacattaaaatatgcatcttatacattactaacaataaatgggtttcaagaaaaagtaaaccttcaaattagaaaccagtttctatctaaaaattgattcatattagatttatacagaccaagtatgaaaataattatttaaaatacctaaatakgttttaaataaaatgttaattaagaaacacaaaattgtttatatactactatgaaaacaaaggaaaatataaatgttcatagatatatactgaggagacataaaaactgaaaacagctatgaattaaaaccatatgggagggcagtataaatgatttttaaaattacttaaaattgttaatattttttccaatggcataaaatttggagaaagtaggaaataagctcattttttatactttagtatcatcaacatactataatcacttcaccacttatagattatatacatttttaatga

SEQ ID NO: 190797 - DNA, 601 bp, Human
ctcgttaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaataataataataataataataaaaaaagaaaatgtggcatatatacaccatgaaatactatgcagccatgaaaaagaatgagttcatgtcctttgcagrgacaaggatgaagctggaaaccatcatcctcaccaaactaacacagaaacgggaaacaaacactgcatgttctcactcataagtgggagctgaacaatgagaactcgtggacacagggaggggaacatcacacactggagcctgttgaggggtggagggaaaggggagggagggcattaggacaaatacataatgcatgcagagttaaaaacctagatgacggattgacaggtgcagcaaaccaccacagcacatgcatacctatgtacaacaaacctgcacgttcagcacatgtatcca

SEQ ID NO: 190798 - DNA, 601 bp, Human
tgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaataataataataataataataataaaagaaaatgtggcatatatacaccatgaaatactatgcagccatgaaaaagaatgagttcatgtcctttgcagggacaaggatgaagctggaaaccatcatcctcaccaaactaacacagaaacgggaaacaaacactgcatgttctcactcataagtgggagctgaacaatgagaactcgtggacacagggaggggaacatcacacactggagcctgttgaggggtggagggaaaggggagggagggcattaggacaaatacataatgcatgcagagttaaaaacctagatgacgga

SEQ ID NO: 190799 - DNA, 601 bp, Human
ggagaattacaaaccactgctcaaggaaataagagagaacacaaacgaatggaaaaacattccatgctcataataacgtgaaaatggccaaactgtccaaagtaatttatagattcaatgttattcccatcaagctaccattgactttattcacaaaactagaaaaaactactttaaatttcatatggaaccaaaaaagagcccgtatagccaagacaatcctaagtaaaaagaacaaagctggaggcatcatgctacctgacttcaaactatactacaaggctagagtaaccaaaacagsaaggtactggtaacaaaacagatatatagaccaatggaacagaacagaggcctcagaaataacaccacacatctacaaccatctgatcttcgacaaacctgacaaaaacaagcaatggggaaaggattccctatttaatatgtagtgctgggaaaactggctagccatatgcagaaaacagaaactggacctcttcctcacaccttataaaaaatcaactcaagatggattaaaggcaaacctaaaacctaaaactataaaaaccctagatgaaaacctaggcaatatcattcaggacac

SEQ ID NO: 190800 - DNA, 601 bp, Human
agtaaatggggcagtagtaatgtgacctctaactaacacaacgccacacaaaataaatactaagtaagctttgtcaccaaaagacactaagctcttccaggaaactatgctactataagctaagcttctgggcagtgattcaggggtactgattcaggaaaagagagcttgcagatcaaaacagatctagggcaaccactaataacagtcatctgacaaatcctagtgacagtaagctaaagtacaatattatttctctacccattttctttcagatctctctgagtatcccctttgtgargtatctgttcttaaacagctattggtattcattttaactgtaaaaaaaaaattctgtgctcttctgtgtgttttggggaggggtggtgtgaaggaagaaggataggtgacagaggtagacacacttagatttgctctgaaccctcaaacaaaatttttaatatccctagaatttgaacatgttagggaagatcctgctgagtaaacagcaagtgaaattactacatcttctgcaattttaatacccagtagtggtatgagcattcatattaataggctttttaaattttctttccacaaa

SEQ ID NO: 190801 - DNA, 601 bp, Human; identical to SEQ ID NO: 20500

SEQ ID NO: 190802 - DNA, 601 bp, Human; identical to SEQ ID NO: 20501

SEQ ID NO: 190803 - DNA, 601 bp, Human; identical to SEQ ID NO: 20502

SEQ ID NO: 190804 - DNA, 601 bp, Human; identical to SEQ ID NO: 20503

SEQ ID NO: 190805 - DNA, 601 bp, Human; identical to SEQ ID NO: 20504

SEQ ID NO: 190806 - DNA, 601 bp, Human; identical to SEQ ID NO: 20505

SEQ ID NO: 190807 - DNA, 601 bp, Human; identical to SEQ ID NO: 20506

SEQ ID NO: 190808 - DNA, 601 bp, Human; identical to SEQ ID NO: 20507

SEQ ID NO: 190809 - DNA, 601 bp, Human; identical to SEQ ID NO: 20508

SEQ ID NO: 190810 - DNA, 601 bp, Human; identical to SEQ ID NO: 20509

SEQ ID NO: 190811 - DNA, 601 bp, Human; identical to SEQ ID NO: 20510

SEQ ID NO: 190812 - DNA, 601 bp, Human; identical to SEQ ID NO: 20511

SEQ ID NO: 190813 - DNA, 601 bp, Human; identical to SEQ ID NO: 20512

SEQ ID NO: 190814 - DNA, 601 bp, Human; identical to SEQ ID NO: 20513

SEQ ID NO: 190815 - DNA, 601 bp, Human; identical to SEQ ID NO: 20514

SEQ ID NO: 190816 - DNA, 601 bp, Human; identical to SEQ ID NO: 20515

SEQ ID NO: 190817 - DNA, 601 bp, Human; identical to SEQ ID NO: 20395

SEQ ID NO: 190818 - DNA, 601 bp, Human; identical to SEQ ID NO: 20517

SEQ ID NO: 190819 - DNA, 601 bp, Human; identical to SEQ ID NO: 20518

SEQ ID NO: 190820 - DNA, 601 bp, Human; identical to SEQ ID NO: 20519

SEQ ID NO: 190821 - DNA, 601 bp, Human; identical to SEQ ID NO: 20520

SEQ ID NO: 190822 - DNA, 601 bp, Human; identical to SEQ ID NO: 20521

SEQ ID NO: 190823 - DNA, 601 bp, Human; identical to SEQ ID NO: 20522

SEQ ID NO: 190824 - DNA, 601 bp, Human; identical to SEQ ID NO: 20523

SEQ ID NO: 190825 - DNA, 601 bp, Human; identical to SEQ ID NO: 20524

SEQ ID NO: 190826 - DNA, 601 bp, Human; identical to SEQ ID NO: 20525

SEQ ID NO: 190827 - DNA, 601 bp, Human; identical to SEQ ID NO: 20526

SEQ ID NO: 190828 - DNA, 601 bp, Human; identical to SEQ ID NO: 20527

SEQ ID NO: 190829 - DNA, 601 bp, Human; identical to SEQ ID NO: 20528

SEQ ID NO: 190830 - DNA, 601 bp, Human; identical to SEQ ID NO: 20529

SEQ ID NO: 190831 - DNA, 601 bp, Human; identical to SEQ ID NO: 20530

SEQ ID NO: 190832 - DNA, 601 bp, Human; identical to SEQ ID NO: 20531

SEQ ID NO: 190833 - DNA, 601 bp, Human; identical to SEQ ID NO: 20532

SEQ ID NO: 190834 - DNA, 601 bp, Human; identical to SEQ ID NO: 20533

SEQ ID NO: 190835 - DNA, 601 bp, Human; identical to SEQ ID NO: 20534

SEQ ID NO: 190836 - DNA, 601 bp, Human; identical to SEQ ID NO: 20535

SEQ ID NO: 190837 - DNA, 601 bp, Human
ccagggcctcctacaacatggcaggctgggggtgacttctgctgccgcaggggaagtagatgacagcattgtagactgggttggccttggtggagtcccaagcttctgttgggagggccctgggtaacctcatgattcttctctctgtgggtcaatacaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccacygtgctgcaggcattacctgacaggtgggcatgcttattcttgtcttccttcacggctggtccacagaagggattgttctgcttctcttgtactgattataatcatgcactgtccagaggcctcccttgtaaagaccattaatattgaacttttaaatattaaagtttatttatattttggaatataaataaactgttaatattttgaaccatttgtgtggcttaaaattcaaaggtataagatggtgtacagtaaacaatctccccaccagactcctgttccccagacaacccagtccct

SEQ ID NO: 190838 - DNA, 601 bp, Human
agaggcctcccttgtaaagaccattaatattgaacttttaaatattaaagtttatttatattttggaatataaataaactgttaatattttgaaccatttgtgtggcttaaaattcaaaggtataagatggtgtacagtaaacaatctccccaccagactcctgttccccagacaacccagtcccttcccagaacatcaaatagaatcattttcttggagtctgtccagatctgatatgcacatgtaatcaatgcatataatatactgtttttcttactgaaatggtgacatacactataycctgttctgtgccttgctgtaaaacaaaacaacttaaccttgaagtttatgctggacagcttccatgcccctccagatgtactctccaccacacttcatgctgccttctgctggggccagaggtggggcatatgctgatagcatgggccaccacacagggcgcttctcagggagggatggagggaggagagtgaagtcaggagatggattatctggcccccttcctgtgagattgtgttgagctggctgggttccttcactgggctgtgttcccttccaagcaactttccaggctgtcct

SEQ ID NO: 190839 - DNA, 601 bp, Human
acctgtgctccgagccttaggttgcagcagtctccctcatagttcctctactccgtccacacctttgtgacatgtcccttgtaaataaacccacccatttagagtggcactccttcctgttgggactgttacaaagcacattgcacatccatgtataaggtataaggagcttttttcttttttacaactgtatagggttccaccatcttgcatttagtcaattctcttgatatgtccagttttgtcctactccaaacaacactgtgatgaatgacatttcatttaccttttttttttttttaacatggtgaagtgcattagtttcctgtaactactgtaacaaattaccacaaactggcggggtgacttaaaacaacagaaaagttattctcccacacttctggaggccagaagtcccaaatcaagcattggcagggttggttccttactgaggctctaagggagagtatgtgccatgcctgtcttctggctcccggtgttgccagcaatccttggtgtttcttggcttgcagacgcatcactctaatctctgcctccaccttcacagtgcttcctgctctgtgtgtgtgtgattttcaat

SEQ ID NO: 190840 - DNA, 601 bp, Human
gcctcagcctccctttgtgctgggattacagacgtgagccccctacacctggccaattaatttttttttaagatgaggtcttgttctgttgcctgggctggagtgcagtggtgcaatcattgatcactgctcactgcagcctcaaactcctgggttcaagtgatcctcctgccccagcctgcggagtagctagaactataggcatgccccacaggacctggctaatttaaaaaaaaaatttgtagagatagggtctcactatacagcctagtctggtggtcataaatttttaaaaaatatrttgctagatctgaattgttaatattttgttcagagggttttatagttcatcaaagttatttgatcaataacgaaagttactcatctttagttttcttgtctcataatgtctttctcttatttagatatcagaggaaacctggcctcataaatgcattgaaaagtgttccctctcttctttttttttttaattcataatattttcttattatccttttaatatctgtaggctctgtagtgatgtgtcctttctcattcccgatgtaggtaatttgtgttttctttcctttttcttggtcag

SEQ ID NO: 190841 - DNA, 601 bp, Human
atattttctactttctcttgtgaattcctctttgatctatggggtatttagaagtaaactgtttaatttctaaatatttggggattttcaagatatctttctattaataatttctagtttaattcccttctggtcatattatatacatagtaatatatcaattcttttaagttgatacttgtttcatgctccagaatgtggcctattggtgaatgttctatgtgtacctgaaaaagctatatattctggtatcattaggttaattattctataaatgtcaactaggtcaagttaattgatrgtattgtttaaattttctttgtctttactgattttctgtccatttgttctattgattagcaatagagaagtatagacacctccagctctaattgtgaatttgtctatttctatacatttttgcttcatgtattttgaagctctgatgttaaatgcatacaaattagaactgttatgtcttattggtgaattgacttcttttcataatgtctttttttatctttcataatatttcttgttcagaagtttactttgtctgtttgtaatatagctactccaggttttttttaaattagtgttt

SEQ ID NO: 190842 - DNA, 601 bp, Human
ctcctgggctcaaggaatcctcctgcctcagtctcccaacgcgttgggattacaggtgtgagccaccatgcctggccatgattgtctttttaaaaatacctcttaaaaaaaatttactagttgttttaagtttgtatatcttctttttctttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgccmgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccaagtttgtatatcttcaattataatataccttcaaataatgttatactgcttcacatgtagtgtaagaatcttaacaacagtatactccctatttgtcctcccatttttatgctattgttgtcatacattttgtttttgtatatgctata

SEQ ID NO: 190843 - DNA, 601 bp, Human
ttgtttttggcttgcatgtttgtcttttgtacatctttgctcctctgtaggcagtgtgccttttttccttggatgcctccacagttttctctgtctttggtttttcagtctctatctttggttttcagctgttcgaccatgatgtgtctcaatgctttgtgttgttttcaatcctacttggggttttctgagcttctcggatctgtgctttgatgtatttcattatttttggaaaatacccattcattatcttcttctctgctttctctcttttttctcctcctgatatttcaattacaaktatgttaggccatttgatactgtcccacaactcccggatgcttgattttgctttttctctactcatttttctccttgtgttttagatggagtaatttttactgacctatcttcaggttcactgagtctttcctttgctatgccaatgctactaatgagactattgaaagcattttttatctccatcactgtactttgtttttatgtcaatttctaatattacattcttttaaaagtaatttctgcattctggctgggtgccgtatggctcacacctgtaatcccagtgctttgggagatg

SEQ ID NO: 190844 - DNA, 601 bp, Human
cctgggcaggcccaggctgaggcacatctccccaccccctagctcagacccatcccttcctttccaactcagaagagcatgttgaaattcaggggaataaaaagacactatgatagagataaccatggatcatacactcccatttataagaaagggaaatcattctcaaactggggtttttcacttcttccaagtaatctcagcacagtggttgttaataacaattgggttagctatagtaagaaagtgtgtgtgtatgcatgtgtgtgtgtgcatgtgtgtgtgtgcgcgtgtgtgtgtygtatgggcagggaggagaagtcaaagaggcaaagaaaagactgaggaccaagcctgaaatgccaaaggaatagcaacatcagacagaaaggcagagggcactggagatggggagcagcaaggcatgtcaaagtgcacaatgtggtactttcatcaaagtggagtaggacagcggttgtaagtcagatagacctgggctttactcctggctctgccacttgctgcatctctttggacaagtaaaataacttttgtgagcctcgatttctcacctctctgttgggactaacaacagtatgta

SEQ ID NO: 190845 - DNA, 601 bp, Human
atgtcaaagtgcacaatgtggtactttcatcaaagtggagtaggacagcggttgtaagtcagatagacctgggctttactcctggctctgccacttgctgcatctctttggacaagtaaaataacttttgtgagcctcgatttctcacctctctgttgggactaacaacagtatgtacttctagggctgaggtgaggattaattaagaaagtacatgtgaagtgttcagtagcttggcacattgcactcattaaaaggtaactgctgttatcaccgttgttgcagttgtaacagcatcacygctgatgggcattcagggagctacgagtgtggagttaagatgtaggagaagggctgaagctggagctgtagacttggcagccagccgcacaagagggaggaaaagtgtgtccctagaagtggaggacagaccctggcatcccagcctagggaaggaaagaggtggagggaaagcggaggaaggaggtcgagctgcaggtatacacccacagaggacagtatgtcaagaaggcatagatgctgcaggagatggagtcagttggggcttagggaggcatctcttagagcaggtgatcaggag

SEQ ID NO: 190846 - DNA, 601 bp, Human
ctacaagacagaactcaaccaaatcagagtgtaggacattccagggaacaaataccatgatgttgccaataaataaatggcacaaaataggggaaaaaaatatttaagaaatagaacaggacaatgttatatctttcatgcaatgtgtggaccttgtttggatcctgattcaaacaaactaaacatctttgggagaaatagaaaagtctgaatgcagactgggctgtagatgatattaaggaattactattcattcagttagataaactaatggcatggaggatttaaatgttgcatgcayattgtgtgcgtgtgtgtatacatgtacacatatgtatttaaaccttgccagtgagaaatgcacactaagtttttaggggttaaatgacatcttggatttgtttgaaacacttcagaaaagataaagtggaatataatatattaaactggcaaaaatgatgccaatttttgaagctgggtcatgggtgcttggaggtttattatactacctgtcttggggtatgtttgaaattcttgaaaataaaaaagtgatcaataaaaataaaatgatgaaaaatagagttcatactgaaatagagga

SEQ ID NO: 190847 - DNA, 601 bp, Human
gtttgccaagcaactggatgagtggctaaaagtggctctccacgacctcccagaaaacttgcgaaacatcaagttcgaatgtaagtactgagttgagagcgggatggaagagagaattacattttagtgccaaatattttacataagttgttaatagtagcagcagctactgtttactggttgactataaagcaccaggtattatactaattactttacatatgtaaatatatttaatcctcataaaatgtttattataggtggcacatttcttcctttacagaagaggaatcaacttagagaggtagtaagtagcagagacaggattttctcccaggtctgtctgacaccaaagtttctgctcaccaccaccaccatcctccttatctcatttaatcctcatgctgcctctgcgatgtagaaagtagtatccctgttctacagatgaggctctaagaggcaaagagagttcccccaaagccacgcagccacacagctgtaagtaggggccaggaatcaaactcaggtctcagatttccttgaagttcctgcccataaaatggtggtagcaggagagagagaatagcttaagggcttcatg

SEQ ID NO: 190848 - DNA, 601 bp, Human
ttacattttagtgccaaatattttacataagttgttaatagtagcagcagctactgtttactggttgactataaagcaccaggtattatactaattactttacatatgtaaatatatttaatcctcataaaatgtttattataggtggcacatttcttcctttacagaagaggaatcaacttagagaggtagtaagtagcagagacaggattttctcccaggtctgtctgacaccaaagtttctgctcaccaccaccaccatcctccttatctcatttaatcctcatgctgcctctgcgaygtagaaagtagtatccctgttctacagatgaggctctaagaggcaaagagagttcccccaaagccacgcagccacacagctgtaagtaggggccaggaatcaaactcaggtctcagatttccttgaagttcctgcccataaaatggtggtagcaggagagagagaatagcttaagggcttcatgcattctctgcctaattagaaagccaaattaatatttctcataaagggattgagactgtgaaccttttctttgctgagtgttggcacccattccccagcattagttttctaattttc

SEQ ID NO: 190849 - DNA, 601 bp, Human
tgcagcctctcctttaaggtgctgttggttctgggtgggttcaaggtcaaggtggtagggaggggtttctagttagagtggcctgaaggagggtcccagaccaggaaccagaaagtataacacaacacccacatatacctcactgctcctgtcctgcccctggcatggacagcacaggggatgatttggagaccagagggaaactcatccagattcatgcaggctgctacagaggctacacctgggcattgttctggtgatggtgcagagcctgacagattaatgggattcaggaaagaargtgaatattggcctaacaaagaaacactgccttatttctgaggatgcatgccagcatctggttcttttttccagcttggaagagtggctcttgggtcatatcagggaactagacatggttttggtgcctccctctggggatcagacaatttagagaggactttgttcctttaatgcacatgtagataaaagcgtccacacccatgcctatagccacgtgttgcacaagcgtaggggcgcacacacacgttccctctccaccttccgcacaaaaacagtatgtaatttaatcagcaaatgc

SEQ ID NO: 190850 - DNA, 601 bp, Human
ttaaggtgctgttggttctgggtgggttcaaggtcaaggtggtagggaggggtttctagttagagtggcctgaaggagggtcccagaccaggaaccagaaagtataacacaacacccacatatacctcactgctcctgtcctgcccctggcatggacagcacaggggatgatttggagaccagagggaaactcatccagattcatgcaggctgctacagaggctacacctgggcattgttctggtgatggtgcagagcctgacagattaatgggattcaggaaagaaggtgaatattggcmtaacaaagaaacactgccttatttctgaggatgcatgccagcatctggttcttttttccagcttggaagagtggctcttgggtcatatcagggaactagacatggttttggtgcctccctctggggatcagacaatttagagaggactttgttcctttaatgcacatgtagataaaagcgtccacacccatgcctatagccacgtgttgcacaagcgtaggggcgcacacacacgttccctctccaccttccgcacaaaaacagtatgtaatttaatcagcaaatgccccatttccatct

SEQ ID NO: 190851 - DNA, 601 bp, Human; identical to SEQ ID NO: 21374

SEQ ID NO: 190852 - DNA, 601 bp, Human; identical to SEQ ID NO: 21375

SEQ ID NO: 190853 - DNA, 601 bp, Human; identical to SEQ ID NO: 21376

SEQ ID NO: 190854 - DNA, 601 bp, Human; identical to SEQ ID NO: 21377

SEQ ID NO: 190855 - DNA, 601 bp, Human; identical to SEQ ID NO: 21378

SEQ ID NO: 190856 - DNA, 601 bp, Human; identical to SEQ ID NO: 21379

SEQ ID NO: 190857 - DNA, 601 bp, Human
catgttctttgaatctcatttaacatttacacttgacctcacaagtcttttccatatcttcctgctgttagtgactattcaaaggtaatatttgaaatacatagacatttttaaaagaaaagaaactaatattgttttggactctaaggatgggtttgagctaacattctaaggcagcttttctaaaagattagagtaaaatctccattagataatataatagcatttggttccttgataggatattttatttaagaatctcagccctcatgaataatgtgaattaaaaattaaaaaaaaaccttatgcaatcacccaataatgagaagaaagcaaattacccagttgtccaaagatattagctgaggcctaaaagaaggtgttttcccaagctccaggcactgccttctacaaactactgtatataaaattgggactttgggaggccgaggcgggcggatcacgaggtcaggagattgagaccgtcctggctaacgtggtgaaaccccatctctactaaaaatacaaaaaattagctgggcgtggtggtgggcgcctgtagtcccagctagctactcaggaggctgaggcaggagaatgg

SEQ ID NO: 190858 - DNA, 601 bp, Human
gtttgagctaacattctaaggcagcttttctaaaagattagagtaaaatctccattagataatataatagcatttggttccttgataggatattttatttaagaatctcagccctcatgaataatgtgaattaaaaattaaaaaaaaaccttatgcaatcacccaataatgagaagaaagcaaattacccagttgtccaaagatattagctgaggcctaaaagaaggtgttttcccaagctccaggcactgccttctacaaactactgtatataaaattgggactttgggaggccgaggcrggcggatcacgaggtcaggagattgagaccgtcctggctaacgtggtgaaaccccatctctactaaaaatacaaaaaattagctgggcgtggtggtgggcgcctgtagtcccagctagctactcaggaggctgaggcaggagaatggcgtgaacccgggaggtggaggttgcagtgagctgagatagtgccaactgcattccagcctgggcaacagagcgagactctgtctcaaaaaaaaaaaaaaaaaaaaaaaaaaggaactgcaactaagagtaatatattttttattttttatttt

SEQ ID NO: 190859 - DNA, 601 bp, Human
ggtcaggcagccaagagagggcctgctatgcagcaggtcggcactgtgggcaactgggactcagtcctgcttgagaccctgtgagctggtacagagaactcaaagttgtcccatatcaaggggcatacaggcatgtgcctcccagatatcccagtcaagggcatatttattcaccagcttccatcagtcattagctgagaggctgctccctggatgttaactctctagtccttctggcatattttgtgatcaggtagactcgggccactagttaagccttcaggcaggtggaagatggatrgttctacatcacagtagtaaggcctgaggggatgtgggcagagaattgtcagtgactactccatgtaaataatattgttattatccctgtattgcagatgagaaaacaggaaaagaaagggcaaatagcttcccatagttacacagattgaaaatagcagaactggtgtaaaggaaagaaaagagaacagacaacagtggccttaaacaagggtttggaggaaccaggagacacaccctccaccaatcagcaggcagttcaaagaggggattttaaatctcttctgaatcttggtaacag

SEQ ID NO: 190860 - DNA, 601 bp, Human
acagtagtaaggcctgaggggatgtgggcagagaattgtcagtgactactccatgtaaataatattgttattatccctgtattgcagatgagaaaacaggaaaagaaagggcaaatagcttcccatagttacacagattgaaaatagcagaactggtgtaaaggaaagaaaagagaacagacaacagtggccttaaacaagggtttggaggaaccaggagacacaccctccaccaatcagcaggcagttcaaagaggggattttaaatctcttctgaatcttggtaacagaccctagccaycattgcaagggacaggaaattgtaaaacacaggaagatgagctcggaaggtccattctgcttaattgggtggattaaatgtgagaaaagacagatgttctgggccagttgaaccagaaacggaatgacagctttggaagagagtgttccacatgcagtttttctcaggatatggagagatctctctttttttgttttgaagaggattgcaggtgatgaagttgagcaaatatgagggattttaaattatttgttatgtttatttttttataccatgagccctgttttgctttcgtgtgca

SEQ ID NO: 190861 - DNA, 601 bp, Human
gctaggttaacccaaaggtggtgcggtgggagacttcaggccaccctgaaggcctctggatgccctaggatgactctgagcacaaacagatacggggcttaggtatgcattgctaattccaaattctataggctactaatacatgctctttcctggtcaggtttggtccagagcctgggctgggccaaacctgcaggtgaaactttctagtgcctgctcaagttggacaaattggtccaggactctcagcctactctcctgcacacagccagccccagcactgcccagcaacacctgcctsttcatttgttgacatacacattgccaaagtgtgatcaatatgtcaatattatttttttattttgctttttttctccttaattatgaatactttaattctgagcactgatacaggtattaacatgcctcagccgggcacggtggctcacgcctgtaatcccagcactttgggaggccgaggcgggtggatcacttgaggtcgggagtttgagaccagcctgcccaacatggtgaaaccttatctctactaaaaacacaaaaatccatcacatggcggccgtcgagcatgctaatcagaggt

SEQ ID NO: 190862 - DNA, 601 bp, Human
tgagacagagtctcactctgttgcccaggctggagtgcagtggcataatcttggctcactgcaatctctgcctcctgggttcaagcgattctcctgcctccacctcccaagtagccgggattacaggtgcctgccaccacgcctggctaatttttgtatttttagtatagatggggtttcaccatgttggccaggctggcttcgaactcctgacctcaagtgatccacctgcctcggcctcccaaagtgctgggattacaggtgtgagccaccgtgctcggcctcatttttccttgttgaygggcatttgtattttcttggttattaataaaacttaatatctttccatatatttataggcatttctgttttctgtgaaatgcatgttcatgtcttttgttcatttttctattgaattgttgaatttttcttactaattcattgaaattctttataaatattctaaatatgaattctttgccattattattatcatattattgctaataccgtctcacagtttgtagtttgtctttttagtttctttgcgatgtgtcttgatgaaaagaagttcttgattcttatgtaaatacaaccatca

SEQ ID NO: 190863 - DNA, 601 bp, Human
cagagtgaattctgatcatctgccctccgaggagggcagccaggagcttgcctaccctgatgcacaggtgttccaggttaggctctccagaagcagatgtagagacagattatggagtgcaaggtggttattagagatgcactattatagcagaaagtgggcagagagaagtactggacaaaaaaagagaagtcaaacttcaactcaggcctgatgaagcttcagctgatccgttatgctgcactgggttgaaatggtgtaaagtggcttggctgtaataccccctgttgctgccactctkggatgtttgccaccctggaaagagcaagatcttgagcaaggcagctctctgcagctcaggcagaccctgaagaagctgacagctgggacaataagtctatttgaaggggtatattgcacggcacggttttggattcaccacataagggacttggatattttcctttaatttttttttttttttttgagatagggtctcattctgtctcccaggctggagtgcagtggcacaatcatggctcgctgcagcctagacttcctgggttcaagcagtcttcctatctcagcctcctgagtagct

SEQ ID NO: 190864 - DNA, 601 bp, Human
atggtgtaaagtggcttggctgtaataccccctgttgctgccactctgggatgtttgccaccctggaaagagcaagatcttgagcaaggcagctctctgcagctcaggcagaccctgaagaagctgacagctgggacaataagtctatttgaaggggtatattgcacggcacggttttggattcaccacataagggacttggatattttcctttaatttttttttttttttttgagatagggtctcattctgtctcccaggctggagtgcagtggcacaatcatggctcgctgcagcctaracttcctgggttcaagcagtcttcctatctcagcctcctgagtagctgggactacagacattgccaccacatctggctaattttattttttgtagagatggggtctcactatgttgcccaggctggtcttgaacttctgggctcaagccatcctcctgcctcagcctcccaaagtgctgagattacaggtgtgagccactgcacccagcggatattttctgagtattgcttgcttgttatccacaagatgcaggcagctgtagccttgctctgacctcaaccagcgatcctctatctgct

SEQ ID NO: 190865 - DNA, 601 bp, Human
cccttgactagtgcttctcaacacaaggtgaatttgtctcccgggaaacattttgcaatgtctggagatcttttcgattgtcatgactgggtccgtggtgctactagcatctagtgtatagaagacatttctcatctttcttccagccacactggccccttggcttttcctagaaaatgctgagcagcttccacacttggccttttcccttgccattctacaatgttctaagcattgtacaatgcacagaacagcctccacaacaaagaattatctaccccaaaatgtcagtagcaccaargttaagaaaccttggtttacgatggttctggggaagggggtgagaagtgcttagatttgcgaggtattttgaaggtaggaccaacatgattttatgatggacttgatgtgaggcatctgagttcataatgcatgagcaagagtttggatatgagcaactgtgtgcatcacaacaccatttactgagattggggaacactgggagtggagcatattgggggcagggcaaagcttaaagagtttggttttgggcatattaagttggagatggctataaatcatctgagtcaggggaggcaaa

SEQ ID NO: 190866 - DNA, 601 bp, Human
cttgagcctaggagtttgagaccagcctgggcaacatagcaagaccccatctttatttaaaagtagaaaaggaagtaagatcatccataatccttcccaccagaggggaacatttttctttttttaggattaatatatttttatattaaaaattattcatacaggctgggtgcagtggctcactcctgtaatcccagcactttgggaggccaagtggatcagctgaagtcaggagtttgagaccagcctggccaacatggtgaaaccccatctctactaaaaatacaaaattagccgggtmtgttggtgcatacctgtagtcccagctactcgggaggctgaggcaggagaatcacttgaacctgggaggcggaggctgtagtgagccgagatcatgccattgcactccagcctggacaacaagagcaaaaactccgtctaaaaaaaaaattatatatacatacgtatataaacatatatatttatttaattgttgttattgttattagtgtttcttacagctacttcagttctgaactcctgagatcaagccactgagttcatcaagcccacggcttatggtgctgtcatttgtctgttg

SEQ ID NO: 190867 - DNA, 601 bp, Human
tttttaaatttcaaacctgatctgatcaagcctctacattcagttaaccatttatagaaatacaagggaccaagtaagatgttaattgaactatgagggtacaatcgacaaactctagactgtggaaattcttcaggacgaagaaattgcaagtaaaatttttaataattaggagaaaaatagaaagggaaggcagaactaatagacagaaagagacttaagattgcactgtaccgaatttattgggatcctgactcatacaaatgagaagagggtgatggatgaaggaagaaggagggaygaagaggaggagtaggaagagaaagagacacagaggatgagaatgagaacgaatatggaggcaatgggaaccatgactggatagttaatgatattaagaaattatttttttggcaaggcatggtggctcatgcctgtaatcccagcactgtgggaggtcgaggcaggtggatcacctgaggtcaggagttcgagaccagcctggacaacatggtgaaaccgtgtctctataaaaaaaccaaaaattagccaggcgtggtggtgcacgcctgtaattccagctactcatgaaactgaggca

SEQ ID NO: 190868 - DNA, 601 bp, Human
ggaggtcgaggcaggtggatcacctgaggtcaggagttcgagaccagcctggacaacatggtgaaaccgtgtctctataaaaaaaccaaaaattagccaggcgtggtggtgcacgcctgtaattccagctactcatgaaactgaggcaggagaatcacttgaacctgggaggtggaggttgtagtgagccgagatcgtgccactgtactccaggctgggcgacagaacaagactctgtctcagaaaaaaaaaaaaagaaaaaaagaaaagaaaaagaaattatttttaatttgtacaggtrtaataattcaactgtagttagggctttttcaaagaatgtttactttttgtgacacatactgaaatatgggaattaaatgacacatctgcattttgctttgtgggaagcaagtggaagattgtatggatgaaataagagtcgatcattgttgaagctgggagatagatgcatgagtttcaatatactattctctctacttttatttatatttgaaatttttataatgaaaacatttttttaaagtaggccctggcttactttttatacaattgtaattcattcttttagaggttgcaagta

SEQ ID NO: 190869 - DNA, 601 bp, Human; identical to SEQ ID NO: 21380

SEQ ID NO: 190870 - DNA, 601 bp, Human; identical to SEQ ID NO: 21381

SEQ ID NO: 190871 - DNA, 601 bp, Human; identical to SEQ ID NO: 21382

SEQ ID NO: 190872 - DNA, 601 bp, Human; identical to SEQ ID NO: 21383

SEQ ID NO: 190873 - DNA, 601 bp, Human; identical to SEQ ID NO: 21384

SEQ ID NO: 190874 - DNA, 601 bp, Human; identical to SEQ ID NO: 21385

SEQ ID NO: 190875 - DNA, 601 bp, Human; identical to SEQ ID NO: 21386

SEQ ID NO: 190876 - DNA, 601 bp, Human; identical to SEQ ID NO: 21387

SEQ ID NO: 190877 - DNA, 601 bp, Human; identical to SEQ ID NO: 21388

SEQ ID NO: 190878 - DNA, 601 bp, Human; identical to SEQ ID NO: 21389

SEQ ID NO: 190879 - DNA, 601 bp, Human; identical to SEQ ID NO: 21390

SEQ ID NO: 190880 - DNA, 601 bp, Human; identical to SEQ ID NO: 21391

SEQ ID NO: 190881 - DNA, 601 bp, Human; identical to SEQ ID NO: 21392

SEQ ID NO: 190882 - DNA, 601 bp, Human; identical to SEQ ID NO: 21393

SEQ ID NO: 190883 - DNA, 601 bp, Human; identical to SEQ ID NO: 21394

SEQ ID NO: 190884 - DNA, 601 bp, Human; identical to SEQ ID NO: 21395

SEQ ID NO: 190885 - DNA, 601 bp, Human; identical to SEQ ID NO: 21396

SEQ ID NO: 190886 - DNA, 601 bp, Human
ggctcacacctgtaatcccagcactttgggaagccgaggcaggtggatcacttgagttcaggagttcgagaacagcctggcgaaaccccgtctctactaaaaatagaaaaatcagccgggcctggtggcaggcgcctataatcccagctacttggaaggctgaggcaggagaattgcttgaactcaggaggcaaaggttacagtgagtgaagatggcgccacagcactccagcctgggtgacagagagagagactccttctcaaaaaaaaaaaaaagaagaaaaataaaaagaaagtgggycagaccgagagaacaggaagcctgatggagtgggcaagattgacaggcccaaggctgaaaggcccagaaggtagaaaggtgagctgaggacaggcagatctggaagtggaactaggttgagggttgggacacagatcagcatggctaaatgggaggccagtcctgatcccacatccttgctgatcccttacttcacaaagtatctggcccaggtctggtggtagatgtctccgggctgtcccttgagtgaccccttcccattcaccgctccattggtcttgagccaagtgggtgatgtcc

SEQ ID NO: 190887 - DNA, 601 bp, Human
ggcagctaaggtcctggttggtatacttttctctcagtatcaggaaccctgcctgccctttggaccagtcatggagaggtcacctcagtaccacacaagatcatcacccaccttcaaaaagaggtgggtgatttggatagagggggctgccagtgagagaagttcagtcaattctgtacaatacacatttattgagcactagatatatgccatgctagatgcaggtgacccagagcatcaaggagcaatagtctggtggcagagacacacacaatgtcactgtgatgtattaaagcagtcrgcaagagatgcagctcagggcactgtggggatatccagaggcacagtaccttctgcctgtcagtcagggagggagaggagcacaggctgaaggagactggaagacagcagttggcctctgatagtgggactggagagagatttctaagggccacttcttgttttcagggactaggttgggctagatatggggctcaggatggacaaggcttagagccaggttggagaagatgaaagagcattactagaggagtggggaggcctaggctatgctctttactctgccattgactgcgtgatc

SEQ ID NO: 190888 - DNA, 601 bp, Human
acaagatcagcaacccctggcagagcccttcaggtacccagtatcccttgggggtgaggaagggtgtgtacaagaggagaagcaggagataggcaggaatgtgttgcaactacgtatggataggcagctaaggtcctggttggtatacttttctctcagtatcaggaaccctgcctgccctttggaccagtcatggagaggtcacctcagtaccacacaagatcatcacccaccttcaaaaagaggtgggtgatttggatagagggggctgccagtgagagaagttcagtcaattctgtacaatacacatttattgagcactagatatatgccatgctagatgcaggtgacccagagcatcaaggagcaatagtctggtggcagagacacacacaatgtcactgtgatgtattaaagcagtcagcaagagatgcagctcagggcactgtggggatatccagaggcacagtaccttctgcctgtcagtcagggagggagaggagcacaggctgaaggagactggaagacagcagttggcctctgatagtgggactggagagagatttctaagggccacttcttgttttcagggactaggttg

SEQ ID NO: 190889 - DNA, 601 bp, Human
gggagcagtggctcacgcctgtaatcccagcattttgggaggctgaggtgggcagatcacgaggtcaggagatcgagaccatcctggctaacatggtgataccctgtctctgttaaaaatacagaaaattagccaggcatggtggcaggcacctgtagtcccagctactcgggaggctgaggcaggagaatagcatgaacctgggaggcagagcttgcagtgagccgagatcgtgcaactgcactccagcccgggcaacagagcaagactccgtctcaaaaaaatatataaaaaataaaakaaaagaaaaaaaacaaaaacaaagaaggcttacgtgagacccttggggccctctactgttaaccagttcaggagaggtgtaaaagtttgtaaaggataaccagagcacaaagtagaagagcaatgtcctcaaagggaaaaattcaagaagatgctgattatggagattaattgctgcttcaaggtcaagtgaaatgcaggcagagaaatggtcactgggtctgacaccacttttggtcactcaaattttggtcagagcagtggctgaagaaacacaggggaaggagtctgatgggggtgg

SEQ ID NO: 190890 - DNA, 601 bp, Human
aagtagaaaagagggcttacggtgggcaatgtggttcacgcctctaatcccagcactttggaaggtcaaggcaggcacatcatttgaggtcaggagtttgagaccatcctggacaacatggtgaaaccccgtctctactaaaaatacaaaaactagccgggtgtggtggcatgcacctgtagtcccagctactcaggaggctgaggcaggagaatcgcttgaacccaagaggcggaggttgcaatgagccaagattgcactgttacactccaacctgggtgacagagcaagactccatttaaaaaaaaaaaaaattgatggccgggtgcagtggctcatgcctgtaatcccagcactttgggaggccgacgcaggcagatcacgaggtcagcagatcgagaccatcctggctaacaaggtgaaaacctgtctcaactaaaaatacagaaaattagccaggcatggtgacaggcacctgtagtcccagccactcaggaggctgaggcaggagaatcgcttgaacctgggaggcgggggttgcaatgagccgagatcgcaccatgcactccagcctggcaaaagagcaagactccatctcaaa

SEQ ID NO: 190891 - DNA, 601 bp, Human
gtagggccacctacagaaagagtggaagtagaaaagagggcttacggtgggcaatgtggttcacgcctctaatcccagcactttggaaggtcaaggcaggcacatcatttgaggtcaggagtttgagaccatcctggacaacatggtgaaaccccgtctctactaaaaatacaaaaactagccgggtgtggtggcatgcacctgtagtcccagctactcaggaggctgaggcaggagaatcgcttgaacccaagaggcggaggttgcaatgagccaagattgcactgttacactccaaccygggtgacagagcaagactccatttaaaaaaaaaaaaaattgatggccgggtgcagtggctcatgcctgtaatcccagcactttgggaggccgacgcaggcagatcacgaggtcagcagatcgagaccatcctggctaacaaggtgaaaacctgtctcaactaaaaatacagaaaattagccaggcatggtgacaggcacctgtagtcccagccactcaggaggctgaggcaggagaatcgcttgaacctgggaggcgggggttgcaatgagccgagatcgcaccatgcactccagcctgg

SEQ ID NO: 190892 - DNA, 601 bp, Human
caatatggcaacaccctgtctctactaaaaatacaaaaacattagccgggtagcggggcctataatcccatctactcgggaggctgaggcaggagaatcgcttgaaccctggaggcagaggttgcagtgagccaagatctcgccattgcactccagcctgggcaacaagagcaaaactctgcctaaaaaaaaaaaagagttcagttagttcagttgtggccatgttgaatttgaaatactcattagacatccaaccagatatgctgagttggatggcgctcaagagaggtcaaggctggasttatgcattaacacatagaaagatggtacttaaagccatggacgttagtagtagggccacctacagaaagagtggaagtagaaaagagggcttacggtgggcaatgtggttcacgcctctaatcccagcactttggaaggtcaaggcaggcacatcatttgaggtcaggagtttgagaccatcctggacaacatggtgaaaccccgtctctactaaaaatacaaaaactagccgggtgtggtggcatgcacctgtagtcccagctactcaggaggctgaggcaggagaatcgcttgaacc

SEQ ID NO: 190893 - DNA, 601 bp, Human
caccacccgtgccgcgagaaaagcagccctggggaggcggggcggggcctcacttggaaaagagacggtcactcatccagaggcgggactcagagcccctccacaagtctcattggtccatttgaagacggacaactctccctgaccatccgtagcacagatggggcgcaagcgtattggaaagggagcgggtgccagacgcgagaactacgcatgcgtctcagcgctttcccgccagcacacccttagtgggtggggggggcgattgaattcccacagtgagtccagcccaccgaagctsagaggattcctaaccttcctcttcagagagcctcaggttagggaacgtccagtgcccaaaagctgccctgtgggaatcccattgtccaccgcctcttacctaatgtttcgttctggccttgccccatctcttcctgaggctgggttgttacgatggtgaattattcaagatgtcttgcagcctgacgccatctctgggcagtgctcctgcatcctccctgtcttccttgggagggcaccacgttgctcttacaagcacagggtcctgaaactgtttacaaggccccactctgccacgtta

SEQ ID NO: 190894 - DNA, 601 bp, Human
tgccttttcagtcttccttaaaggttgcaaacagttgcaaagcaaatttcatggttcctgtttcttcaaaatctcaaagctcttcattcagccaggcatggtcgctggagcgtgtatattcaaccacttgagaagatgaggatcttttgagcccaggagtttgagacgaacctgggcaacatagggaaagccctgtcacctaaaaaaataaataatacaaccagctcttcatttagaggcaagcacaaaataggtgctcaatgtttgttgaatgagtgagttgttaccaaccataccccaytattcaaggtcctgcttgtcagtgtttcaggaagtgttcttggcaaaggagtggtgaacttcaggaagaatgatgctgactccgaacacaattatttatttatttatttatttatttatttatttatttatttacttattgagacagagtctcgctctgtagcccaggctggagtgcaatgacgtgatctccgctcactgcaacctctgcctcccaggttcaagcaattctcctgcttcagcctcccaagtagctgggattacaggcgcccgccactacgatcggagaatgttttgtatt

SEQ ID NO: 190895 - DNA, 601 bp, Human
taaagacatttgttcattccatgcacagcacagagtaggtgctcaaaaaagtactttttatacagatgaatgaacaactactaccagttaacctagaacctgtcctttcagctctagtttttaattgtaattttattttattttagagacagggtcttggcacaatcacaattcactgcagctttgacctctcaggctcaattggatcctcccacctcagcctccatagtagctgggactacaggtacatgccaccatgcccaactaatttttgaaatttatttttagagatggggtcttsctatgttgcccaggctggtctcgaattcctgaggtcaagcaatccacctgcctcagcctcccaaggtgctgggattataggcgtgagccatcactcacctctagtttctggcctgagggtatattactctccctgattactgacaccaaaaatgatttcactcttgggtgggacctctgctgccccttacccactagggtgtgggtttttttggtttgtttttgtcttttttaagacagggcctcacactgtcatccaggctggaatgcaatggtgtgatcctggctcactgcagcctcg

SEQ ID NO: 190896 - DNA, 601 bp, Human
acagatcagcatggccaaaggggaggccagtcctgatcccacatccttgctgatcccttacttcacaatgtatctggcccaggtctggtggtagatgtctctgggctgtcccttgagtggccccttcccattccccgctcccctggtcttgagccaagtgggtgatgtccaggggctggcaaggagtgaaacgggacgctgggccaactgcagggctcggtgaatcaggggtatctagagacaaaggtagtgaagagagaagcacccagagttggaacacatactagcccaaccagtgctwccggttcagccattagcccccaccctcccacccccaggacaaaacagcaggggacaaaatgtctgtacaagcagacctaccctacagtttctcaacccccagacatcagggccctcagggcctgaaaaagctagaatgcctaccttgagcttggtatcttccttctgggaggctgaagttgtgcaactggaaatcatcaggggtgtctgcataggtgtaggtgcggatggagaagtcacagctggccatgggtacccagatgatgttatatccgattcctacagaaaaggatgatcaaga

SEQ ID NO: 190897 - DNA, 601 bp, Human
cacagatcagcatggccaaaggggaggccagtcctgatcccacatccttgctgatcccttacttcacaatgtatctggcccaggtctggtggtagatgtctctgggctgtcccttgagtggccccttcccattccccgctcccctggtcttgagccaagtgggtgatgtccaggggctggcaaggagtgaaacgggacgctgggccaactgcagggctcggtgaatcaggggtatctagagacaaaggtagtgaagagagaagcacccagagttggaacacatactagcccaaccagtgcwaccggttcagccattagcccccaccctcccacccccaggacaaaacagcaggggacaaaatgtctgtacaagcagacctaccctacagtttctcaacccccagacatcagggccctcagggcctgaaaaagctagaatgcctaccttgagcttggtatcttccttctgggaggctgaagttgtgcaactggaaatcatcaggggtgtctgcataggtgtaggtgcggatggagaagtcacagctggccatgggtacccagatgatgttatatccgattcctacagaaaaggatgatcaag

SEQ ID NO: 190898 - DNA, 601 bp, Human
ggaggagaagctgagagtgtgatcctgccaaggcccccaacgctgtcttcagcccacttcccagacctcaccattgccctcaccggtttaggacgaccacaacaggagagccatcgggatgcatcagtgccactgcgtccgggtcgttcttctgactggcaaccagccccactctctgggagccctcaggaatgaacttgctgaatgtgggaacagatggtcagagtccctcggggtacctcccatgaaaccctcatctaagaagtcacccacccacggacccaccccataactcctgcaraggctctgccctggctctctaggcctggagccatgctgctgggcactgaccctgcttttctgcatcgcagtccagcctcaggcattggggttttctgttgctacctagtcacttcctgcctccatggtgcaaaaggggatgggtgtgcctcttccgaggttccaccctgaacaccttcctgctccctcgtggtgtagagtgatgtaagccatccgatgtaggagatgataggcctggtatggaatgggggtgcccgccctccactcacctgaagtggccaaggtggtagaacatgggctg

SEQ ID NO: 190899 - DNA, 601 bp, Human
aatgcccaggctgagcccagtgcctccttgagtatctgctccatcactggcgacgccacaggtaggtgtgaatggagtagccaggtgagattgtctccaggaagcccacagcaggatccttgatggtaagaggcacatccttagaggagctagggagcagggaggagaagctgagagtgtgatcctgccaaggcccccaacgctgtcttcagcccacttcccagacctcaccattgccctcaccggtttaggacgaccacaacaggagagccatcgggatgcatcagtgccactgcgtccrggtcgttcttctgactggcaaccagccccactctctgggagccctcaggaatgaacttgctgaatgtgggaacagatggtcagagtccctcggggtacctcccatgaaaccctcatctaagaagtcacccacccacggacccaccccataactcctgcagaggctctgccctggctctctaggcctggagccatgctgctgggcactgaccctgcttttctgcatcgcagtccagcctcaggcattggggttttctgttgctacctagtcacttcctgcctccatggtgcaaaaggggat

SEQ ID NO: 190900 - DNA, 601 bp, Human
gtcacagacagcgtgtgagctgactctgtccctttaatgcccaggctgagcccagtgcctccttgagtatctgctccatcactggcgacgccacaggtaggtgtgaatggagtagccaggtgagattgtctccaggaagcccacagcaggatccttgatggtaagaggcacatccttagaggagctagggagcagggaggagaagctgagagtgtgatcctgccaaggcccccaacgctgtcttcagcccacttcccagacctcaccattgccctcaccggtttaggacgaccacaacagsagagccatcgggatgcatcagtgccactgcgtccgggtcgttcttctgactggcaaccagccccactctctgggagccctcaggaatgaacttgctgaatgtgggaacagatggtcagagtccctcggggtacctcccatgaaaccctcatctaagaagtcacccacccacggacccaccccataactcctgcagaggctctgccctggctctctaggcctggagccatgctgctgggcactgaccctgcttttctgcatcgcagtccagcctcaggcattggggttttctgttgctacc

SEQ ID NO: 190901 - DNA, 601 bp, Human
ttgtgccctctttagtcacagacagcgtgtgagctgactctgtccctttaatgcccaggctgagcccagtgcctccttgagtatctgctccatcactggcgacgccacaggtaggtgtgaatggagtagccaggtgagattgtctccaggaagcccacagcaggatccttgatggtaagaggcacatccttagaggagctagggagcagggaggagaagctgagagtgtgatcctgccaaggcccccaacgctgtcttcagcccacttcccagacctcaccattgccctcaccggtttagsacgaccacaacaggagagccatcgggatgcatcagtgccactgcgtccgggtcgttcttctgactggcaaccagccccactctctgggagccctcaggaatgaacttgctgaatgtgggaacagatggtcagagtccctcggggtacctcccatgaaaccctcatctaagaagtcacccacccacggacccaccccataactcctgcagaggctctgccctggctctctaggcctggagccatgctgctgggcactgaccctgcttttctgcatcgcagtccagcctcaggcattggggt

SEQ ID NO: 190902 - DNA, 601 bp, Human
ggaaagacaaacagtctccagttttgggcccagctttcctagtctcttcttttccttaccctcagccctgatcttgtgtttgtacggacagtgagctcaccctaggcctggacccaggcccagtttccaaagcaagcagcacacagcgcatgttcacataagcatgggggctggggggacactggggcttactgatctttttctaggggcctccagcccctggcaccacctagaggggaaagtgagtcacccaaaccattgcccctgggcttacgtcgctgtaagctcacactggccctgytgtgccctctttagtcacagacagcgtgtgagctgactctgtccctttaatgcccaggctgagcccagtgcctccttgagtatctgctccatcactggcgacgccacaggtaggtgtgaatggagtagccaggtgagattgtctccaggaagcccacagcaggatccttgatggtaagaggcacatccttagaggagctagggagcagggaggagaagctgagagtgtgatcctgccaaggcccccaacgctgtcttcagcccacttcccagacctcaccattgccctcaccggtttagg

SEQ ID NO: 190903 - DNA, 601 bp, Human
tgcatctccaggaaagacaaacagtctccagttttgggcccagctttcctagtctcttcttttccttaccctcagccctgatcttgtgtttgtacggacagtgagctcaccctaggcctggacccaggcccagtttccaaagcaagcagcacacagcgcatgttcacataagcatgggggctggggggacactggggcttactgatctttttctaggggcctccagcccctggcaccacctagaggggaaagtgagtcacccaaaccattgcccctgggcttacgtcgctgtaagctcacrctggccctgttgtgccctctttagtcacagacagcgtgtgagctgactctgtccctttaatgcccaggctgagcccagtgcctccttgagtatctgctccatcactggcgacgccacaggtaggtgtgaatggagtagccaggtgagattgtctccaggaagcccacagcaggatccttgatggtaagaggcacatccttagaggagctagggagcagggaggagaagctgagagtgtgatcctgccaaggcccccaacgctgtcttcagcccacttcccagacctcaccattgccctca

SEQ ID NO: 190904 - DNA, 601 bp, Human
cacccgctgctgctttaaggcttccgccctgatgctgacactgctgctccacgggcccagttctgcatctccaggaaagacaaacagtctccagttttgggcccagctttcctagtctcttcttttccttaccctcagccctgatcttgtgtttgtacggacagtgagctcaccctaggcctggacccaggcccagtttccaaagcaagcagcacacagcgcatgttcacataagcatgggggctggggggacactggggcttactgatctttttctaggggcctccagcccctggcaccrcctagaggggaaagtgagtcacccaaaccattgcccctgggcttacgtcgctgtaagctcacactggccctgttgtgccctctttagtcacagacagcgtgtgagctgactctgtccctttaatgcccaggctgagcccagtgcctccttgagtatctgctccatcactggcgacgccacaggtaggtgtgaatggagtagccaggtgagattgtctccaggaagcccacagcaggatccttgatggtaagaggcacatccttagaggagctagggagcagggaggagaagctgagagtg

SEQ ID NO: 190905 - DNA, 601 bp, Human
caggtgagagaggatgtgtgctgggccttggaggaagggggccgagaccgggccttacttctgtaacgatactgtgaggcatcggaaggccagcctgttgtgtccgttttgaaggtcggtgggctagactggctggccttctaggggtgtggagacttcccaactctgcccttgtgctttcctggaatccccaatatgcccggaccccggtttactcctttgctgcgagcccttctctcccgtccagagttgctccgagcctatctgctcagtcctagcgattcctgtggggcttgggacgcgcggttcaagcaccccggaccatatggatgcagcacccatgggttctcgctccaatgcttctttcctccttggggcgtaactcagaccctgggcacccctctccactgcccaggggagacctgggttctagatttggctctgcctctactatcttcctacctcctagagcctcagtttggcttgtgtaaaataggatgacttaagggtcctttcagcccctaatcctggggtactttactctgtaccgcctccttacccagccttgtgcacgccatcttgaaggcactgagttctagcc

SEQ ID NO: 190906 - DNA, 601 bp, Human
tctagatttggctctgcctctactatcttcctacctcctagagcctcagtttggcttgtgtaaaataggatgacttaagggtcctttcagcccctaatcctggggtactttactctgtaccgcctccttacccagccttgtgcacgccatcttgaaggcactgagttctagcctgtttattgtaagtggtgattagttgggtctcagtcacccagccatacttttttgttccctgcgtatccttcctgtaattgtccccaagcacattccacaagagggaggggcactctgggctaaggckggggtgggagttatctggggagctgccaccatgcctctgcctttggtgcttgcccctgcagggagtgcttagtgccccctccctatgccactcccaggatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcggtgagtgtggttggggtgaggggcct

SEQ ID NO: 190907 - DNA, 601 bp, Human
ttttcttctacttagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtgagggattcatgacttgggggagtaaggctttggttcagttgctctgtacctgtgtggcattcacctgtggcttatgggggacttttgacagatgtgagagaaagctttttttttttttttgagacagagccttgctctgtcacctgggctggagtgcgatggtgtgatctcggcttgctgcaacctccacctcctgggttcaagtgattctcctgcctcagccttctgagtagctgggattacaggtgcgtgccaccacatccagcaaacttttgtatttttaatagagacggggtttcactgtgttgaccaggctggtctcgaactcctgacctcaggtgatccacccacctcggcctcccaaagtgctgggattacaggtgtgagccaccgcgcctggccgagaaagcttttacctga

SEQ ID NO: 190908 - DNA, 601 bp, Human
agaccagaattcagatgtttatgcccaagaaaagcaggatttcgttcagcacttctcccagatcgttagggtgctgactgaggatgagatggggcacccagagataggagatgctattgcccggctcaaggaggtgagggattcatgacttgggggagtaaggctttggttcagttgctctgtacctgtgtggcattcacctgtggcttatgggggacttttgacagatgtgagagaaagctttttttttttttttgagacagagccttgctctgtcacctgggctggagtgcgatggtgygatctcggcttgctgcaacctccacctcctgggttcaagtgattctcctgcctcagccttctgagtagctgggattacaggtgcgtgccaccacatccagcaaacttttgtatttttaatagagacggggtttcactgtgttgaccaggctggtctcgaactcctgacctcaggtgatccacccacctcggcctcccaaagtgctgggattacaggtgtgagccaccgcgcctggccgagaaagcttttacctgagggactcgagtctgctctggagaggttggggcctgggcaagtata

SEQ ID NO: 190909 - DNA, 601 bp, Human
tgcctcccaggttcaagcaattctcctgcctcagtctcctaagtagctgggattataggcacatgccaccatccctggctaatttttgtatttttagtagagacggggtttcaccatattggtcaggctggtctggaactcctgaccttgtgatccatctgcctcgccctcctaaagcgctgggattacaggcgttacaggtgtgagccactgcacctggcctagaatcagttcttaaccctagcagcaccctagtttcacctgtaagtttttaaaaatttttaattttttttttttttttgatacagggtcttactctgttacccaggctggagtgcagtggcatgatcttggctcactgcaatctctgcctctggagcggaagccacccttccaccgcctcagcctcccaagtagctgagactacaggagcgagcctctacttggctttttttttttagagactaggtttcaccatgttgctgaggctggtcttgaacttgtggcatcgagtgatctgcccatctcggcctcctaaagtgttgggattacaggcgtgagccaccacgcctggtctaaatttttttttagagacaaagcc

SEQ ID NO: 190910 - DNA, 601 bp, Human
ctagaatcagttcttaaccctagcagcaccctagtttcacctgtaagtttttaaaaatttttaattttttttttttttttgatacagggtcttactctgttacccaggctggagtgcagtggcatgatcttggctcactgcaatctctgcctctggagcggaagccacccttccaccgcctcagcctcccaagtagctgagactacaggagcgagcctctacttggctttttttttttagagactaggtttcaccatgttgctgaggctggtcttgaacttgtggcatcgagtgatctgcycatctcggcctcctaaagtgttgggattacaggcgtgagccaccacgcctggtctaaatttttttttagagacaaagcctcattctgttgcccaggcttgagtgtagtggtgcaatcatggtgtactgtagcctcgacctcctgggctcaagcgatccttccacctcagcctcccaagtagctgagactacaggtgcctaccaccacgcccggctttttaaatagttttttggtagagatggagtgtcactatgttgcccaggctggtcttgaactcccgggctcaagtgatctgcctgc

SEQ ID NO: 190911 - DNA, 601 bp, Human
gtttttaaaaatttttaattttttttttttttttgatacagggtcttactctgttacccaggctggagtgcagtggcatgatcttggctcactgcaatctctgcctctggagcggaagccacccttccaccgcctcagcctcccaagtagctgagactacaggagcgagcctctacttggctttttttttttagagactaggtttcaccatgttgctgaggctggtcttgaacttgtggcatcgagtgatctgcccatctcggcctcctaaagtgttgggattacaggcgtgagccaccaygcctggtctaaatttttttttagagacaaagcctcattctgttgcccaggcttgagtgtagtggtgcaatcatggtgtactgtagcctcgacctcctgggctcaagcgatccttccacctcagcctcccaagtagctgagactacaggtgcctaccaccacgcccggctttttaaatagttttttggtagagatggagtgtcactatgttgcccaggctggtcttgaactcccgggctcaagtgatctgcctgcctcggcctcccagagtactgggataacaggtgtgagccactgtgcc

SEQ ID NO: 190912 - DNA, 601 bp, Human
atcgcgtgaacccgggaggcggaggttgcagtgagccgagattgcgccattgcactccagcctggacaatgagagtgaaactccatctcaaaaacaaaaacctgggtatgtatctagaagtggaaaaacaaaaaaaggaaataagttatgaaaataaaaaccatgtcttgagctgggtgcgctggtgtgtgcctatatccctagattctcaagagttgagacaggaggatcacttgagcccaggagttcaagtccaacttgggcaacatgacaagacccttgtctctttaaaaaagcaacycaaaccatgtcttgaaaagctatttaatggtcagacacgatggctcacgcctgtaatcccagcactttgggaggccgaggcaggcggatcacttgaggtcaggagttcaagaccagcctggccaacatggcaaaacccagtctctactgaatgaaaatacaaaaattagctggcctagcagttggtggtggcaggtgcctgtagtcccagctacttgggaggctgaggcaggagaatcgcttgaatttgggaggcggaggttacagtgaacccacatggcgccactgcactccagcttgg

SEQ ID NO: 190913 - DNA, 601 bp, Human
gaccatcagtcaggactgtctaggtcagggaagccaagatgtctgaagagagaggaaagatttggggctgcagtagggcaagaccccatgggaggaagcagccaggaagatgccggcacccctggggtttggcttattaacccccctttccctgcaggcaggaattgatggcgagaaggagcacgccaatgccaagaagatcctgctggagatgggggagttctttcagattcaggtaagaaggcaggaggcagtagcagagaacaggcaccagcttcactcctcctctgcccaggaacckcatccttcctcttttgctgccctccccctccctgcccaggatgattaccttgacctctttggggaccccagtgtgaccggcaaaattggcactgacatccaggacaacaaatgcagctggctggtggttcagtgtctgcaacgggccactccagaacagtaccagatcctgaaggtgcctgagagagggtggtgggtccctgagttggtggaaagggatagagcagtggttctcaactagaggcagttttcctcccgaggggacatttggcaatgtcagcagacattttttgccattgtc

SEQ ID NO: 190914 - DNA, 601 bp, Human
gaagacattatttaatggttatggagttttaatttgggataatgaaaaaggtttagaagtaaattattttggctgggtacagtggctcacacctgtaatcccagtactttgggaggctgaggtggctggatcacctgaagtcaggagttcgagaccagcctggccaacatggtgaaacctcatctctactaaaaatacaaaaattagctgggtgcggtggtgggcgcctgtaatcccagctactcagggggctgaggcaggagaataggagaatcgcttgaacccaggaggcggaggttgtggtgagccgagatcgcaccactgcactccagtctgggcgacagagtaagactccatctcaaaaaaaaaaaaaaaaaaaaaaaaagaaagaaagaaatgatttcacataaatttttaaagctaataatgaaataccctaaaaatcactgaatttaaatgggcaaactgtatggtatatgaatcatatctcaataaagatttctcttttttcggtcagacacagtggcttacacctgtaatcccagcactttggagttttgcctttaaaaactgcataaataggccaggcgtggtggctcat

SEQ ID NO: 190915 - DNA, 601 bp, Human
gaagaaatggaagacattatttaatggttatggagttttaatttgggataatgaaaaaggtttagaagtaaattattttggctgggtacagtggctcacacctgtaatcccagtactttgggaggctgaggtggctggatcacctgaagtcaggagttcgagaccagcctggccaacatggtgaaacctcatctctactaaaaatacaaaaattagctgggtgcggtggtgggcgcctgtaatcccagctactcagggggctgaggcaggagaataggagaatcgcttgaacccaggaggtggaggttgcggtgagccgagatcgcaccactgcactccagtctgggcgacagagtaagactccatctcaaaaaaaaaaaaaaaaaaaaaaaaagaaagaaagaaatgatttcacataaatttttaaagctaataatgaaataccctaaaaatcactgaatttaaatgggcaaactgtatggtatatgaatcatatctcaataaagatttctcttttttcggtcagacacagtggcttacacctgtaatcccagcactttggagttttgcctttaaaaactgcataaataggccaggcgtg

SEQ ID NO: 190916 - DNA, 601 bp, Human
acatagggggaagactttcacaacattggatttggcagtgatttctaggctatgacactaataatacaggtaataaaggaaaaaataaactggacctggttttcatcaaaattgaaaacttttttttgcatcagaggacacaaaaggaaattaaaagactatccacagaatgagagaaaatatttttaaaatcctatatacagattatataaagaacctggacaattcaacaacaaaacacaattcaaaagtagtcaaataatttgaacaaacatttcttcaaagaagatacacaaatggscaataagcacatgaaaaattgttcaacatcattagttgttaagaaaatgcaaatcaaaaaccacaatgtgctacagcttgagaacgggggcggtgggggggcggtgggaggaaggaaagagagagaagggaaggaagaaaacaaaaggaaggggagggaagagagggggagaggcagagacagggagcaggagaggtagaggggagacggggagaggaaggaagaaagaaaagaaggaaggaatggagggagggagggagggaagaaaaattaagaaaacctcatgaagactcagagaaa

SEQ ID NO: 190917 - DNA, 601 bp, Human
agtaatagctgaacaaatctagaaattaatagttgacaatcacattaacctaaaaattcacaaacagcttctgaatctgacatatccatagaatgaacaaaatttggtatatacatacactggaatattattcagccttaaaaacgaaagcaactctgacatactccaagatggacaaccttgaggacattatgctaagggaaataaggcagttacctaaggacaaatattgtatgattctacttatatgtggtaattacagtagtcaaattcaaagacagaaagtagaatagtggtttcrctaggggctgcaggagggagaatgaagagttaatagagtgtcagctggaaaatgtcaaaaaaagatccagagctggtgggtgggcatggtcgcacaaaaagtgcatctacctaatgccacaaaattatacacttacaaatggttaaaatggaaaaagttcaggttatatgcagcctaccacagtttatatatacggatatacatacatatacacacatttattttttaaaactatataattgttataaactataaataaaacaggtaatactggtgtaaaagtaactacagtttttgcac

SEQ ID NO: 190918 - DNA, 601 bp, Human
aagaagctccaacaggaccaaaagaaaagaataaaaagggctgacctaaataggcacaataatacagtgggtaagtgcatcaagtcatgcgctaggggcaaaatagagaccccaggaaaggtgtcagtaacgtaccctaactcctggaaaactaaagtcaaagcctctcaaagtagtcatcatcaaattaggctccaaattcaaccacagataaagatgaacaatatacaaactttataatcagccacattctagaaaaaaaaaattattttcactgaaattacattgtttataaattaayaggcaaaagtacagggagcacactaaaatacaagttaggaggatggattagtcctacctataaaacaaaatacttaaaactgtatcatggtggccgggtgccatggctcacacctgtaatcctaatgatttgccaggctgggacaggaagatagcttgatccccaggatgatccccaggagttcaaggttacagtgagctatgatcacaccaccgcaccacagcctggttaaaaaagacaagactcagactcttaaaaataaacaaacaaaaaatgtaaataaacagaaacatcattgat

SEQ ID NO: 190919 - DNA, 601 bp, Human
aaataaactatccaatgacaaaaatgttagtcaacaaagcaccaaatttcaatgctatttgactaatacgtaatctgctcatcataatcatgagacatggtataatgatatgaccaaatgcagtggctcacgcctgtaatcccagtatgttgggaggacaaggcaggaggatcgattcagcacaggagttcgagaacagcctgggcaacacaacaagacactgtctctataaaaaataaaataaaattagccaagtgcggtggcacacacctgtggtcctagtgattccggaagctgagaygggaggatcacctaagcccatgggagccaagactgctgtgaaccatgatcatgccactgcacagccttgggcaacagactgcctctttagaagaagaccgtgtctcttaaaaaatgttatgtatccaccatttgtgcatttttgccaagatgcctttgtgtacctcctcaactctgacttcctaatatagtagaactttttattgcaagcttgtatacttgactttttttttttttttggctaagcatactaaatgaactacaatcacgtattatgtaactccaaaaacggaattttctt

SEQ ID NO: 190920 - DNA, 601 bp, Human
gtttaaaaagtaataataattctccaaaaaaatcacttaggccaggcgcagtggctcacgcctgtaatcccagcactttgggaggccaaggcgggcaggccacctgaggtcaggagttcgaaatgagcctgaccaacatggagaaaccctgtctattaaaaatacaaaattagccagacatggtggtgcgtgcctgcaatgccagctactcgggaggctgaggcaggagaatcgcttgaacccaggaggtggaggttgcggtgtgccgagatcgcgccatggcactccagcctggccaacragagcgaaactccgtctcaaaaaaaaaaaaaaacgcttcactgaaattcaaaattatttcttcaacgaactgcttcttaaatctattaagatggcatagaattttcttttctaaacagaaaaccatttttggactggaaattataattatggctataaattttacttgtaattcattgtgctcatgaaatccactcatctagactaaagtaacatcaaataaactatccaatgacaaaaatgttagtcaacaaagcaccaaatttcaatgctatttgactaatacgtaatctgctcatca

SEQ ID NO: 190921 - DNA, 601 bp, Human
tggctgggcgcggtggctcaggcctgtaatcccagcactttgggaggccaaggcagtcggatcacctgaggtcaggagttcaagaccagcctgaccaacatggtgaaaccgcatctctactaaaaatacaaaaattagccaggcatggtggcacacaactgtaatcccagctactcgggaggctgaggcaggataatctcttgaacccaggaggcagaggttgcagtgagctgagataacaccattgtctccagcctgggcaaccaagactgaaactccatctcaaaaaaaaaaaaaaaaagatttaccattacagctataaatgacagggcccctacttaccaaagcaaacccaaatttctgaaacagaaaaatagtccaaaaaagtggttttatcttttaatttttcctctaagaggaatcctactacaaagtaggaccacaaacttaaaaacaaacaaacaaacaaaaaaccaaagaaaaatcctaagaaaaaataagtatggtcatgcaattctttttgtttttttccactgcgcccggcctcattatttatattttcttactatttacctacagtaaagaactgtcaaattcttgt

SEQ ID NO: 190922 - DNA, 601 bp, Human
gtaattcaatgtagcttcactcaatacagctaaaatattctagtgtatctaccatctgtgcatttttgtcaaaatgcctttgtgtacctcctaaactctgacttcctaatatagtagaactttttattgcaagcttgtatactttgatatgttttccaaaaataaaagtaaaatatacatagtaaattaggacttggctgttaaaaaataaacactagttcagtacctgttttgtttcaaaagtgagttctggttacaatttcaccttaataacatttctgacatctttgttgacattatyttcttttaataatcagtattctctcaatttaggtcattgattttagagaaactaaagcattagtatgcataatccagattatagaaagatccgtatttacattaagcagttccagggaagccacagttaatatgtaaactaccaccctcttccctgtaagtccttatccaatcatatattccacttcatctctctatcacctaggctgcagtacagtggcatgaacacaacttactgcagcctcgacctcctgtgctcaagtgatcctcctgcctcagcatcctgagtagctgggacaac

SEQ ID NO: 190923 - DNA, 601 bp, Human
tttttagtagaaatggggtttcaccatgttggccaggatagtctcgatctcttgatcttgtgattcgcccgccttggcctcccaaagtgctgggattacaggcatgagccaccgcgcccggcagatagtgtattcaaaagcaaaatcttaggaataaggaaataaatactcacattctcaagctatattttaagcactgaatttttggtaatgatgatggtatttgttttatgcttacagatcttttcttcagtcttactgaactgtttttaaagcattttctgtgttgctcataaaaagyacaaacttaaaagatcaccctgacactgaaggagccaaagaaatagagaaatcaattaataattattatacaatgtgctatatgttaaaaacagaaatatatgcaatggaaacacagaggatagagtaacctcctagaaaggttcagggaacgtttcacagaattgggggatgtctaagctgagtctttccattccctcatcctccttcctttctccttgcacagtgaaacttttttatcctttttgctttttatttagaaatttagtgattaaatttgcttttctaatttttctcattt

SEQ ID NO: 190924 - DNA, 601 bp, Human
atgttggtcaggctggtcttgaactcccgaactcaggtaatctgcctgcctcagcctcccaaagtgctgggattacaggcataagccactgtgcctgaccagccggctagtttttaaaaatgttttgtagagacagggtctctctatgttgcccaggctggtcttgaactccttggcatcagccactgcgcctggcccagaaaacactttcaagaaaagtacgcttcagtttgtggcatataatcaaaagagaaccaaaacatctgagaacaggagtaaaaaaaaaaaaaaaaagccaaamagaaatattaaagaaaattaaacatataggtcaagaatgcattttaatagaaagtcaccaaatattttcttttcaaaagcagaccacaatgggcttttcttaaattacaaaaccattagatgctgaacttgaattttatattccacactgaagccccaaattctatcctcattatatggccctcataggatcaagagtaagccaaaacatgttactagcataatttcttaaataaattatgataaaataatggcaatactaatatagaaatcatcatgtgatgtaaacttccaccaccca

SEQ ID NO: 190925 - DNA, 601 bp, Human
cagtggcaagaacgtggctcattgtagccttgacctcctgggctcaagcaatccttccacctcagcctcctgagtagctgggatcacaagcatgtgcaatcacgcttggctattttttttttttaatttttgtagagaggtgggggtctcactatgttgcccaggctggtctcaaactcccgggctcgggcaattctcccgtcacaacctcccaaagtgctgagattacaggtgtaagccaccccacccagccaattattagattttctattcggcgtcagtgattttccgtctgccagtscaccacaaccacaatattctaacccttttaatttctgttttattatctaataagcctgatttctagttactgttcttttcagaaaagttgtggctactcttgcttatttttccatacaaaccttacaagtaacttatctagtgccaatttgatttgtttaaaattttgattcttaaacttgcagacacccagaagaagtgaaagcaggaactggaacaggtatttgtaaatccatgttcatggaagcattagttagtcacaacagccaaaagcaggctgcttcacagttcatcaatggat

SEQ ID NO: 190926 - DNA, 601 bp, Human
agcctgggcaacaagagcaagactgtctcaattaaaaaaaaataaataaataaaacaaaacaaattaaccttagcttccttttttactttattaccttttacatttttttactttctgactcttttgtagtaacagcttaaaatgcaaatataacatacagctgtacaaaatcttttctttgtatctttacaattatttatttaaaaatttttaaatttgtttttaccttttcaacttttttgttaaaaactaaaacacaaacaaacattagcttaagtctacacagggtcaggatcatcragacatcattaggtgacaggaatttttcagctccattatactcttatgggaccaccaaaatgtgatctgtcattgatccaaacatgattacgcagcacgcgactgtagtttcttttgaatgtggaaaatgacatctttgtcttctcaaagtaaatgtagccataaaaagaaaaaagacatgcactcatgaagtttaatatatatgtatgcatgtatatgcgtgtatggtaatataaaatctactacagaactaccggttctaatggaattgactgaataattccatctttcatcctctga

SEQ ID NO: 190927 - DNA, 601 bp, Human
tcatgcctgtaatccttgcactttggaaggccaaggtgggtggataatttgaggtcaggagttccagaccagcttggccaacatggtgaaaccccatctctactaaaaatacaaaaaaaaaaaatccagctggaagtggcagcacatacctgtaatcccagcttctgaggtaggctgaggcagaattgcttgaacccaggagacggagattgcagtgagcaaagatcgcaccacggcactccagtatgggctacacagccagactacgtcacacacacacacacacacacacacacacacctacacacacactctctctctctctttttctggccaggcctcgtggctcacacctgtaatcccaacactttgggaagctgaggcaggaggattacttgaacctaagagtttgagactaccctgtgcaacacagggagacccccttctctacaaaaaataaatctccaaaattagctgggcacagtggtgcatgcctgtagtttcaggtacatgggaggctgaagtggagaatggcttgagccaggaggtcaaggctgcagtgagccatgagccatgatcacaccactgcactctaacctgg

SEQ ID NO: 190928 - DNA, 601 bp, Human
aaggcaggtggatcacgaggtcaggagatcaagaccacagtgaaaccccgtctttacgaaaaatacaaaaaattagacgggcatggtggcgggtgcctgtagtcccagctactcgggaggctgaggcaggagaatggtgtgaacctgggaggcggagcttgcggtgagctgacattgcaccactgcactccagcctgggcaacagagggagacactgtctcaaaaaaaataaataaataaatggggagacactgtctcaaaataaataaataaataaataaataaataaataaataaatatcaatatggtaaacatccaattgcatttttctttccatacttgttcaattacttccttcaggtaaatttttaaaggtgaaagtacaaagctgaagggcatatgcattagttacacactagacaatgacatgtaagactttttttttttttgagacggagtctcgctctgttgcccagggtggagtgcagtggtgccatctcggctcactgcaaactccgcctcccaggttcacaccactctcctgcctcagcctcccaagtagctgggactacgcccgccaccatgcccggctgatttttt

SEQ ID NO: 190929 - DNA, 601 bp, Human
cagatattttaccatatacatcaaaataaacaagtgtacattcttttatacaaatggagccaacaatgcttgctgttttgtagcccatttgctttaaatgatatgacacctttatgtgtaaataagagttagatgttaaattcaacagtttcacaatagttcataattcataaaatcaaccacctactgactgtaattaaatagtttctggctttttgttactataaataatatgtgggcgcggtggctcacacctgtaatcctagcactttgggaggccgaggagggcagaacatcaggycaggagtttgagaccagcctgatcaatatggtgaaaacaccatctctactaaaaatacaaaaaaattagctgggtgtggtggtgcgcacctgtaatcctagctactcaggaggctgaggcaggacaatcactagaactcgggaggcagaggttgcagtgagccgagattgtgtcactgtactccagcctgggagacagaccgaggctctgtctcaaaaaaaaaaaaaagggctgggcacggtggctcacacctgtaatcccagcactttgtgaggccaaggcaggtggatcacgaggtca

SEQ ID NO: 190930 - DNA, 601 bp, Human
ctcatgcctgtaatcccaccacttttggaggccgaggtgggcagatcacctgaggtcaggagtttgagaccagcctggccaacatggtgaaaccccatctctactaaaactacaaatatcagccggacgtggtggcgggcgcctgtaatcccagctacttgggaggctaaggtatgagaattgcttgaacctgggagggggaggttgcagtgagccaagatcgtaccactgcactttagcctaggtgacagagtgatgctctgtctcaaaaaaaaaaaaaaacaaaaacaaaaacaaaaamaaaaaccaaccaaccacccggtgcagtggctcatgcctgtaatcccagcactttgtgaggccaagacgggtggatcacctgaggtcaggagtttgagagcagtcgaacatggtgaaaccccatctctggtaaaaatacaaaaaattagctgggcatggtggcgcatgcctgtagtcccagctactcagcaggctgaagcaggagaatcacttgaacctgggacggggaggttgcagtgagccaagatagcaccactgtactccagcctgggcgaaagagcgagattccgtctcaaaaaaa

SEQ ID NO: 190931 - DNA, 601 bp, Human
gccagccaggcgcagtggctcatgcctgtaatcccaccacttttggaggccgaggtgggcagatcacctgaggtcaggagtttgagaccagcctggccaacatggtgaaaccccatctctactaaaactacaaatatcagccggacgtggtggcgggcgcctgtaatcccagctacttgggaggctaaggtatgagaattgcttgaacctgggagggggaggttgcagtgagccaagatcgtaccactgcactttagcctaggtgacagagtgatgctctgtctcaaaaaaaaaaaaaaamaaaaacaaaaacaaaaacaaaaaccaaccaaccacccggtgcagtggctcatgcctgtaatcccagcactttgtgaggccaagacgggtggatcacctgaggtcaggagtttgagagcagtcgaacatggtgaaaccccatctctggtaaaaatacaaaaaattagctgggcatggtggcgcatgcctgtagtcccagctactcagcaggctgaagcaggagaatcacttgaacctgggacggggaggttgcagtgagccaagatagcaccactgtactccagcctgggcgaaagagcga

SEQ ID NO: 190932 - DNA, 601 bp, Human
agccagccaggcgcagtggctcatgcctgtaatcccaccacttttggaggccgaggtgggcagatcacctgaggtcaggagtttgagaccagcctggccaacatggtgaaaccccatctctactaaaactacaaatatcagccggacgtggtggcgggcgcctgtaatcccagctacttgggaggctaaggtatgagaattgcttgaacctgggagggggaggttgcagtgagccaagatcgtaccactgcactttagcctaggtgacagagtgatgctctgtctcaaaaaaaaaaaaaaacaaaaacaaaaacaaaaacaaaaaccaaccaaccacccggtgcagtggctcatgcctgtaatcccagcactttgtgaggccaagacgggtggatcacctgaggtcaggagtttgagagcagtcgaacatggtgaaaccccatctctggtaaaaatacaaaaaattagctgggcatggtggcgcatgcctgtagtcccagctactcagcaggctgaagcaggagaatcacttgaacctgggacggggaggttgcagtgagccaagatagcaccactgtactccagcctgggcgaaagagcg

SEQ ID NO: 190933 - DNA, 601 bp, Human
ctgtttatccagttaaatgttgcacatctgccaggtctcagtttaggatcaccttctcaggaaagacttctctgggttaggctccccatttcatgctgtactctctcccttttacagtccttatcacaattttaacaacacgtaatgtgattttttgtttattatctacctcctctactataatctccatgactcaatgaacctgtgtgcctcattctctattatataacaagggcccacaaagtagaatgcctggtaaatacctgatattcagtaactattactgattaaataaactatktgttgaatggacctaagcataagactttttctctctttacgttgttaaaagctggccgggtgcagtggctcaagcctgtaatcccagcactttgggaggccgaggtgggcggatcacgaggtcaggagttcgagaccatcctggctaacacggtgaaaccctgtctctactagaaatataaaaaactagccgggtgtggtggcatgcacctgtagtcccagctacttcgggagggtgaggcaggagaatcgcttgaacccgggaggcggaggttgcagtgagccgagattgcaccattgc

SEQ ID NO: 190934 - DNA, 601 bp, Human
aaacactgaggaaaaaatagcaaaatgtaaaggtgtaagaattttaattgtctgcatttcctaacttccattcctcagcctccagaaatctaacatttgccactatacaaatggctctcagacacaagacaaactaaccgccaaagccaatcatccactttcagtacttacctaaccaatctcccataacacttgacactcttttttttaattaattaattttttttttttgagacggagtttctctccttgcccaggctggagtgcaatggcgtgatctcagctcaccacaacctccacytcccaggttcaagcaattctcctgcctcagcctcctgaatagctgggattataggcatgtgccaccacgtccggctattatttgtatttttagtagagatggggtttcgtcatgttggtaaggctggccttgaactcccgacctcaggtgatctgcccgcctcagcctcccaaagttctgggattacaggcgtgagccaccacgtccacccacttgacactcttgactataataaactcacttaagaaacccactgaattcaccataaatattgtcattccttctcatagccttaataat

SEQ ID NO: 190935 - DNA, 601 bp, Human
acccaacatcccccaatgttaacatcttacataactacagtacatttgtcacaaccaagaaattaatattggaataatactattaacaaaattccagactttgtttagatttagccaatttttttccactcatgtccttttttcactgtcaatctgggatatcacattgtatttagttgtcatgtctccttagtcttctctgttctgtaaaagcttctcagactttccttgttttttcaggtccttgatactttttagtactggtcaagtatttgtagaatgccctttattattattattwtttttttttttctgcttagatttaacacattctatcagagagtacatgatatcaccatgccttatcattggtgaagttaaccttgaacttggttaaggtgctgtctgccaggcctcttcactgtaaagttactgcttttccctcttcatactctgttctttaaaagtcagcagtccagtccatattcaagaagaggtaaattaagttccacctcctgaaagtgtgttctacatatattatttggaatttttctgtaaggaagatttgcttcttttctgccaagtatttatttagtcaatc

SEQ ID NO: 190936 - DNA, 601 bp, Human
gaagggttaaatgccttggtccaagctacacattccagtgtccctaatctggtttcatttatttttcctgaaatttatatcaacatgatttatcaaatatgcctgttttacccccaaccaacacttatgaggaatccactcaatacaaatagtaaataacctttatttcttatttcatcaattatcagtttgagatatgttttacttaacaatttgtattctgctgtattaaaaaaactcattattctggaataaattcagatttacataaaagttacaaagatagtacagagaatactcrtatgtcctttacccaacatcccccaatgttaacatcttacataactacagtacatttgtcacaaccaagaaattaatattggaataatactattaacaaaattccagactttgtttagatttagccaatttttttccactcatgtccttttttcactgtcaatctgggatatcacattgtatttagttgtcatgtctccttagtcttctctgttctgtaaaagcttctcagactttccttgttttttcaggtccttgatactttttagtactggtcaagtatttgtagaatgccctttat

SEQ ID NO: 190937 - DNA, 601 bp, Human
agtgataagtcagtttgattccccatttttgaaacaaggagagaagggttaaatgccttggtccaagctacacattccagtgtccctaatctggtttcatttatttttcctgaaatttatatcaacatgatttatcaaatatgcctgttttacccccaaccaacacttatgaggaatccactcaatacaaatagtaaataacctttatttcttatttcatcaattatcagtttgagatatgttttacttaacaatttgtattctgctgtattaaaaaaactcattattctggaataaattyagatttacataaaagttacaaagatagtacagagaatactcgtatgtcctttacccaacatcccccaatgttaacatcttacataactacagtacatttgtcacaaccaagaaattaatattggaataatactattaacaaaattccagactttgtttagatttagccaatttttttccactcatgtccttttttcactgtcaatctgggatatcacattgtatttagttgtcatgtctccttagtcttctctgttctgtaaaagcttctcagactttccttgttttttcaggtccttga

SEQ ID NO: 190938 - DNA, 601 bp, Human
tagaactaacctattaacatcaagcatttaccttaaacatagagtgaatccaattaagaagtactactcatataggcacctccagggctggtaggtacttgcagggtaggaaaaagttactctgagtgaatcttctaattcactgactcttcgccatagcttttgcagagtatgcccaagagatgagtcagaaccagaagacgtctggctttctgctcagttttttcccaagggagaaagtagttttctgcttcccctacttagcccttttccttgctgtctccatcatgtgacaaatgtytgctcatgtctcaagagtagccattttagatctgcctggaaggatgtgtggaggctccccattccacaaaggacaagaggtttatatgaattctagttcaagaaaatctgacacttcctcaaagcatacacacaaagaacacaattgtagatatcaaagagttcccatcatttttcatttcaaaatactataaagcagaataagtatttcagaagtgaataaagactacaaataggaattccttagttcacaatattactacgtagaccaccgctgtgtctcatcactcagatgatgaca

SEQ ID NO: 190939 - DNA, 601 bp, Human
gacagtataataaatcctcctcgagtgtggttcagatgagatatttccattaaataactgaatgtcgcaatgaaacatctaagaaataaaaagcccaggcatcagagaagacataactttaagtattaatactgaaaacttaatatacagacagatacatatttcctacccaacacatagtcaagacagaagacaatagtggccaagaagcctgagataatagtcaactgtatcaccattcctgatcatggattaagtactaagaaaagaggggtttgagggtttttttttttttttttttgggagacggactctgtctcccaggctggagagcagtggtgcaatcttggctcactgaaacctctgcctcccgggttcaagtgtttctcttgcctcagcctcctgagtagctgggattacaggcatgggccaccatgcccagctaattttttgtatttttagtagagacggggttccatcatgttggccaggctggtgtcaaactccttacctcaagtgatccgcccgcctcagcctcccaaagtgctgggattataggcatgagccactgcgcccagccctaagagcactttttatatag

SEQ ID NO: 190940 - DNA, 601 bp, Human
attgcactgcagcctgggcaacagagcaagactccatctcaaaaaaaagaaagtaaagcctcaaaccttaaacccacacatcctatccaattcacagaaattattttcagattctatgtttttcttccttttgcaaattctagaaaaactggtaattaatttatccatgaaatacagtaagtttcttttaaagctgtacacttaaggatccttggctatatacataaaagcttatgaagacaaagaaactcaatttcctttcaaaaactttcatgcttttagcaaaaccgcaaatctataragcatattacatctcccgctcaaaagaaaagtatgttgttgatgtaagattattttcctgaataaaatatacttgattcttatattggattctttataatctaaaatgccagctattaagagttggtaatgaatgtctacctcatgtttgtcaaaaaactagtaatctgaaatgcttattgatgggaaaaaattacaaataaaaaaacttacatgtaactggagccgcaaaaggtacaataaatcaaaaagttgaagattttcaagatctgcctctaaatgaaagttcactcctaaaaga

SEQ ID NO: 190941 - DNA, 601 bp, Human
tctctgtgtcatagcattttgtacactgctctgttacagaatttaatacattgcttttcagtgaatatgtctgaattattgagggcagtaactcaatcttactcgtatttgtattcccagtgctcactactcacagcaaccctcaacagaaatctaattcaatgaacagaatagtctcattgcaaaagaaacattatgaatttagatattctttcttttgtttacaaaagtaaaatattttggtgattttcaacattgatatgtcccttatcaaaatctcattcatttgttcaggggttgrtgaactttttctgtaaaaggccagagagtaaatattttaggcttttgaggacatatataatgcttacctcatattatacttcatcttttctccccaagcctttaaaaacctaaaaataattcttagcttgagggctacacaaaaacaggccttggactgcatttggcccataggctgagtttccttaccctggtctaggtaaacatcagagaaattaagtcacttcttgttagagtacaaaagtctctccatggtagtataaaaacaaagcaccaagagagatacaactatcacttgctg

SEQ ID NO: 190942 - DNA, 601 bp, Human
tttaatgcagaaattttaatagccacttagtgctttactatggccctttcccctccgccagaagacaagcaacattcaaggtacaggttctctgttagccggggtcctagagggaaggcaacatggagtggactcttgatggtcacacagcatgaacaaaaaataagcctttgttgttttaagcctctgagatttggggatcattttttaacactccaagacctatcctattcttactgatagagcatatcaaataatttatcttccttgttagaaattgttcagtagctcccaattgcawgtacaatgaagttccaactcctctgaatgaaaaaaacataccatatatgatatagtccccattattgcttttacaacctccttttccaaccaccatcaccaccacttatgtacattagtcatatccaacaatgggttattcttcaaaaacactatgctatttcatggttttgtgcctttcttcgaaagtgctgttgttactgtgctacattattaccctttatgttgtcccacttgcctacttaagtaaattcaatatacagtagtgtgcgtgacttattcagtgatatcttcttcagtc

SEQ ID NO: 190943 - DNA, 601 bp, Human
aggcgcccgtagtcccagctactcgggaagctgaggcaggagaatggcatgaacctgggaggcggagcttgcagtgagccgagatcgcaccactgcactccagcctgagcgacggagcaagactccatctcaaaaaataagagaagttaccatttactcaaaaactaattcagtgataagaatttcttatccacttactctaattcccactagtctgcaagataaatagaagtagtagcctcatgttacagataagaaagccatgggttgaatggtttatgtaacttccacaaggttacaygatattgctaaatgtgaatcaactagatctaagtcaaaagtacatagttttcccattacatcaaaatgccttctcctcttctcccacttacctcttcagtcatggcatatgtatgatgtcttttaaacctcaatacaaagattatggaagcattttctgattaactttccatcatttcagcattcggttatgtgtagaataatactatacaggtcaggagtggtggctcaggcctgtaatcccagcactttcggaggccgaggtgggctgattacttgaggtcaggagttcgagaccagc

SEQ ID NO: 190944 - DNA, 601 bp, Human
atgtaaatgtacttaacactagtgaattaactgtacacttagaaatggggagtctaggcagcgccgggtggctcacgcccgtaatcacagcactttgggaggccaaggccagcggatcaccctgaggtcaggagttcaagaccagcctggccagcatggcaaaaccccatctctactaaaaatacaaaaattggctggcgtggtggtggacacctgtaatcccagttacttggaggctgaggcaggagaatcgcttgtacttggaatccagcctgggcgacaggagcgagactctgaaaamaaaaaagaaaagaaaagaaatggggagtctagctccatctcctaggctggagtgcactggtgtgatctcagctcacggcagcctccgcctccaagttcatacgattctcttgcctcagcctcctgagtagctgggactacaggcatgtgtcaccatggccggctaatttttatatttttagtagagatggggtctcaccatgttggccagactagtcttgaactcctgacctcaggtgatccgcctgcctcagcctcccaaagtgctgggattacagacgtgagccattgcacacggctt

SEQ ID NO: 190945 - DNA, 601 bp, Human
agactttaatggcttttaatacaactgtaaatagtattatttatatttcaattaattaattaaattttttttttttttttttgagacaaggtcttgctctcatccaagctggagtgcagtggcatgatcttggttcactgcaacctccacctcccgggttcaagcaattctcatgtctcagcctcccgagtagctgagactacaggtgtgcggcaccacgcccggctaatttttgtaatttttgcagagatggggtttcaccatgttgcctagactggtctggaacttctgggctcaagcratccacacacttctgtctcccaaagtgctggtattacaggtgtgagccaccatgcctggctacatttcagtttcttttttttttttttctttttttttttttgagacggagtctcgctctgtcgcctaggctggactgcagtggcgcgatctcggctcactgcaagctccgcctcctgggttcacaccattctcctgcctcagcctccccagcagctgggacttcaggcgcccgccaccgcgcccggctaattttttttgtatttttagtagagacggggtttcatcgtgatcctgacct

SEQ ID NO: 190946 - DNA, 601 bp, Human
actgggcctacactgtactttttttttttttttttttggtatttttagtagagacggggtttcaccatgttggccaggctggtctcgaactcctgacctcaaatgatccatctgcctcggcctcccaaactgctgggattacaggcgtgagccaccgcacccggccactgtactttttattatacagatcccgtacatgtttttctaaatttatcgttaagactttaatggcttttaatacaactgtaaatagtattatttatatttcaattaattaattaaattttttttttttttttttgagacaaggtcttgctctcatccaagctggagtgcagtggcatgatcttggttcactgcaacctccacctcccgggttcaagcaattctcatgtctcagcctcccgagtagctgagactacaggtgtgcggcaccacgcccggctaatttttgtaatttttgcagagatggggtttcaccatgttgcctagactggtctggaacttctgggctcaagcgatccacacacttctgtctcccaaagtgctggtattacaggtgtgagccaccatgcctggctacatttcagtttcttttttt

SEQ ID NO: 190947 - DNA, 601 bp, Human
gtcagtgatctttttattccataaggatatccagtagttacagcaccatttgttgaaaagactatccttgtcccattgaaatagtcacatttgtcaaaaatcaattgaaagttagcggagtttcactcttgttgcccaggctggagtgcaatagcgtgatcactgctcactgcaacctccacctcccaggttcaagcaattctcctgcctcagcctcccgagtagctgggattacatgcacccaccaccatgcccagctaatgttttgtatttttagtagagatggggttttgccatgttrgccaggctggtctcgaactcctgacctcaggtgatctgcccacctcagcattccaaagtgctgagattacaggggtgagccactacacctggtctaaatttcatttttaataattaaaaaaaaataagccacgaagtgtctgtcgcccaggctggtctttaacttctgggctcaagtgatcttcctgcagtggcctccgaaagtgctgcgattatgtgtgagccaccacggctggcctctatgtaaattttagaatcagtctgccagtttatattaaaatcctgttgcaactgtattgag

SEQ ID NO: 190948 - DNA, 601 bp, Human
gcaatcttggctcactgcaacctccacctcccggggttcacgggattcctgtgcctcagcctcctgaggagctgagattacaggtgcctgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggccaagtcaaatttttttaaatggcccttgctttttatactatttaagaaatctttgaccatcycccaaggtcttaaagattttttcctattcttctaaaagttttattatttccgaaatttcataggggtatatgatcttttttgatttaaatttttcatgtggtatgaaacagggtcagtgatctttttattccataaggatatccagtagttacagcaccatttgttgaaaagactatccttgtcccattgaaatagtcacatttgtcaaaaatcaattgaaagttagcggagtttcactcttgttgcccaggctggagtgcaatagcgtgatcactgctcactgcaacctccacctccca

SEQ ID NO: 190949 - DNA, 601 bp, Human
tgaagtctcgctttatcacccaggccggagtacagtggtgcaatcttggctcactgcaacctccacctcccggggttcacgggattcctgtgcctcagcctcctgaggagctgagattacaggtgcctgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggccaagtcaaatttttttaaatggyccttgctttttatactatttaagaaatctttgaccatctcccaaggtcttaaagattttttcctattcttctaaaagttttattatttccgaaatttcataggggtatatgatcttttttgatttaaatttttcatgtggtatgaaacagggtcagtgatctttttattccataaggatatccagtagttacagcaccatttgttgaaaagactatccttgtcccattgaaatagtcacatttgtcaaaaatcaattgaaagttagcggagtttcactcttgttgcccaggctggagtgc

SEQ ID NO: 190950 - DNA, 601 bp, Human
tgcatttaatccatgaatatcagtttaaaagagaatcctaaaatgggtacacacttttgaagcctccttcctgggccattcacctagagctattaatacctcacacttcatttttgaattgttcctatcttcacaaattctggcctgccaatttatgtttcttggtagtctaggacatgatgctgcacactatattttagatgtaacttattttcaaaattaacttcactgtggtaaagtaccacataaaattcaatgcatgttttttatatatacatttttgagttttgaaaaatttacmatgtagccatcatcataaccaatatatagaacatttctgtcaccctaaaaagttactgtgtgtcctttccaagaaaataaattgcctgtcatccacagcctcagagaagaaacaactgatctgcttcctgttatatattaagtttgcttttctagaagttcatatacatgaaaagaaagaatatgtattttattgtacggcttcattcacacagcataaatctgagaatcattcacattgccacatttctttttactgttcctttttactattcacatatttctttttacaactgaatta

SEQ ID NO: 190951 - DNA, 601 bp, Human
ctttctccacaaattcatctgcttaatgactattcattctttagtttacagtgaggacataatttcctgaaaggttatttacctgaccaggaagcaccctcttcattcttaatttaggtcccctattaagaattatcctaatactttctcctttcctaacactaatcacacttcaaattagtggtttaatgtatgtaattctcaaacaatgtttggtccattaacgcggtgactatattcaccaaaatcactttttatctccaatgaccaggacataattcattaacacgtagttgaagartgaatcctgggatcaaaatcttggaattatttttatctcctctatcccttcatcaactactcagagctaccaatgcatttaatccatgaatatcagtttaaaagagaatcctaaaatgggtacacacttttgaagcctccttcctgggccattcacctagagctattaatacctcacacttcatttttgaattgttcctatcttcacaaattctggcctgccaatttatgtttcttggtagtctaggacatgatgctgcacactatattttagatgtaacttattttcaaaattaacttc

SEQ ID NO: 190952 - DNA, 601 bp, Human
tactccagcctgggcaacagagcaagatgccgtctcaacaacaacaaaaatatatatatatataatatttacatataatatacattataagatacatatttttagagacaaagtcttgctataatatatatgtatttttagaggcaaggtcacactctgtcaccaaggctggagtgcagtgaaggaacacagctcattgcagcctcaacctcctgagtgcaagtgatcctcccacctcagcctcccaagtagctagaaccacagacacgagccaccacgctcatttaatttttaaatgttytgtagagatggaccaggtgcggtgctcacacctgtaatcttagcactttgggaggtcaagttgagaggatcgcttgagtgcaggagttcaaaaccagcctgggtaacatagtgagaccccatctctacaaaaaacacaaaaattagccaggcctggtggcccccgcctgcagtcccagccactgtgggggagggatgggggtggagacgcttgagcccgggaggtggaggttgcagtgaactgagattgtgccactgtagtccagcctgggggacgcagcaagaccctgtctaaaataaa

SEQ ID NO: 190953 - DNA, 601 bp, Human
ggcatggtggcaggacctgtaatcccagctactccagaggctgaggcaggaaaatcgctagaacccaagaggtggaggttgcagtgagccaagccattgtactccagcctgggcaacagagcaagatgccgtctcaacaacaacaaaaatatatatatatataatatttacatataatatacattataagatacatatttttagagacaaagtcttgctataatatatatgtatttttagaggcaaggtcacactctgtcaccaaggctggagtgcagtgaaggaacacagctcattgcakcctcaacctcctgagtgcaagtgatcctcccacctcagcctcccaagtagctagaaccacagacacgagccaccacgctcatttaatttttaaatgttttgtagagatggaccaggtgcggtgctcacacctgtaatcttagcactttgggaggtcaagttgagaggatcgcttgagtgcaggagttcaaaaccagcctgggtaacatagtgagaccccatctctacaaaaaacacaaaaattagccaggcctggtggcccccgcctgcagtcccagccactgtgggggagggatggggg

SEQ ID NO: 190954 - DNA, 601 bp, Human
tgcttaattttttgtatttttagtagagaccaggtttcaccatgttggtcaggctggtcttgaactcctgacctcatgatctgcctgccttggcctcccaaagtgctgggattacaggcgtgagccaccacacccggccaagcagggctaatttttttatttttagtagagaagaggtttcaccacgttggccaggctggctcgaactcctgacctcaggtgatccacccacctcagcctcccaaagtaccaggattacaggtgggagcccccatgcctggcctaattttttttgtggtgtttttttttttttgagacggagtctcgctctgtcacccaggctgcagtgcagtggcgcgatctcggctcactgcaagctctgcctcctgggttcacgccattctcctgcctcagcctcccaagtagctgggactacaggcgcctgccaccatgcccggctaattttatttatttatttatttattttttaagacagggtctcactctgtcacccaggctggagtgcaatggcacgatcttggctcactgcaacctctgcctcccaggttcaagtgattctcctgcctcagcctccctagta

SEQ ID NO: 190955 - DNA, 601 bp, Human
ctaaaaactctggaaattgtctataaaataaacataagcaaatgtactggcaatgaccaggcaggaagtttcccagatatttgatttgcctcatatgtacaggttaaattgcataaagtttccctattattaaggacaaggcaaacatatgctttcatcatatatgttcagtatcataacagaggtcctagccagtgcaaaaaggccagaaaaagaaaacaatattgaaaaggaagaattacaaactatctctactcacacattgtgtgattgtctatataaaaacacccaaagactctayaaaagagaaagtactacaattagtgaaatacacaacaatgttgcagaatccaaggtcaaattcaactgtatttgtatgttctatcaatgagaaaactgaaatcaaaattaaacaatgctacttaaacagtagaatagtagccaggcagggtgactcactcctataatcccaacactgtgggaggatgaggcgggcggaccacctaaggtcaggagtttgagaccagcctggtgaacatggtgaaaccccgtctctacttaaaatacaaaatacaaaaattagctgggtgtggtggcacac

SEQ ID NO: 190956 - DNA, 601 bp, Human
acttaaaaaataatacaggtgattcttgttccacacaaaaatcgaacagatgcacatctacctctcattttactaagtacaactaaaaactctggaaattgtctataaaataaacataagcaaatgtactggcaatgaccaggcaggaagtttcccagatatttgatttgcctcatatgtacaggttaaattgcataaagtttccctattattaaggacaaggcaaacatatgctttcatcatatatgttcagtatcataacagaggtcctagccagtgcaaaaaggccagaaaaagaaamcaatattgaaaaggaagaattacaaactatctctactcacacattgtgtgattgtctatataaaaacacccaaagactctacaaaagagaaagtactacaattagtgaaatacacaacaatgttgcagaatccaaggtcaaattcaactgtatttgtatgttctatcaatgagaaaactgaaatcaaaattaaacaatgctacttaaacagtagaatagtagccaggcagggtgactcactcctataatcccaacactgtgggaggatgaggcgggcggaccacctaaggtcaggagttt

SEQ ID NO: 190957 - DNA, 601 bp, Human
tgatgaagaaaacaaaagaagctaaagaggctgggcgcagtggctcacgcctgtaatcccagcactttgggaggccgaggtgggtggatcacgaggtcaggagattgtgaccatcctggctaacacggcgaaaccccgactctactaaaaataaaaaagaaattagccaggcgtggtggtgggtgcctgtagtcccagctactcgggaggctgaggcaggagaatggtgtgaacccgagagcttgcagtgagctgagatcgcaccactgcactccagcctgggagggcaaataaataaatwaattaattaattaaacaaaaaagcagcagctaaagagaaaacacacgttataaaaaggggccgagcacagtggctcatgcctgtaatcccagcactttgtgtggctgacgcaggaggattgcttgagcccaggagttcaagaccagcctgggcaacatagcaagacccatttcttaaaaaaataataataataaaaaagtttagatctcatatccaaaacagtgcaaaccagaagacaatgtaatgacatcaaacagtgttaaaaggagaggcaaaggggaagcttatcaaaatagaaat

SEQ ID NO: 190958 - DNA, 601 bp, Human
ggaggcagagcctgcagtgagccaagatcataccattgcactccagcctggttgacaagagcgaaaccccatctcaaaaaaacaaacaaaaccacaaaaaacaaaactcaaaaagaaaggttcagagagtttctggatagctgaacatgtggaggttcctggagggtagtgcgcccaaggagggaatgaaagctctatgctccttccccagtatatgtcttcatctatagcgtctgtaatatcctttataacaaaccagtaaatggaagtacatgtttccttgagttttgtgagccattcyagcaaattaatcaaacccaaaggggggattgtggaaaccccaacttgaagctggttggtcagaagttctagagagccagagttgtgactggtctaaagggagggtggcggtcttgggaactgagcacccaacctataggatctgaccctatatccaggaaaacagtgacagaattgaattgaggacacccagctgctgcctattgcttggtgtatgggaaaaccctcatacctttggttacagaagtcttctgtgtgttttttttttttttaattttattgaaaaaaatggtttttttta

SEQ ID NO: 190959 - DNA, 601 bp, Human
aggcgtggtggtgcacacctgtggtcccagctactcgggaggttcgggcaggagaattgcttgaacccgggaggcagaggttgcagtgagccaagattgcgccactgcactccagcctgggagacagagcgagactccgtctcaaaaaaaaaagtaaattgaaattcctcacctattagattaataaacatataatcgtttgacaacataggacgggctgtggaaaagtaagacagactcataaatttctaggactacaaaaggatacaattcccatggaagcagaatttagcaatatttmcaatattatatatacaattactatttaacccagtaattcaatttctaggaacttacccttaagatatacctccaaaatatcaaacaatgtgtggataaatttattcactgggcattatctataggagcaaatattagaacaacccttccttactagactggttagatagactatgaagtatctatataatctaatatcatacagctataaaaaataaaaacgtggatgtacacaaatgttcatagcagcattacttgtgatagccaaaagcagaaacaacccaaatgttcattaactgat

SEQ ID NO: 190960 - DNA, 601 bp, Human
tgctgtagctcacgtctgtaatcccagcggtttgggaggccgaggcggatggatcacttgaggtccggagttcgagaccagcctggccaacatggcaaaaccctggatctactaaaaatacaaaaagtagatgggcatggtagcacatgcctgtaatccaaactactagggaggctgacagaagagaattgcttaaacccagggggcgaaggttgcagtgagctaagatggtgccactgcactccagcctgggcgacagagtgagactctgtctcaaaaaaaaaaaaaaaaaaaaagatgmcaaaacttcccaaattgatctagagtctgtgaagattccagttgcattttttgcagaaatagataagctgatcctaaaaaatcacagagaaatggcaaggaatccaggaatagccaaaacaatcttgaaaaagaacaaagttgaaggaatcacactttctgatttcaggctttcttacaaaactccggtatttggccaggagcagtggctcacgcctataatcctagcactttgggaagccaagaggggaggattgcttgaggccaagagttcgagacagcctgggcaacataatgaggc

SEQ ID NO: 190961 - DNA, 601 bp, Human
taatcccagctactcaagaggctgaggcaggagaattgcctgaacctgggaggcggagattgcagcgagccaaagtcatgccactggactccagcctgggtgacacagcaagactccatctcaaaaaaaaaaaaaaaaaagattggtagggcacggtggctcacgcctgtaatcccagcacactggaaggccaaggtgggtggatcaccagaggtcaggtcaagaggtggagaccaacctggcgaacatggtgatatcttgtctctactaaaaatacaaaaaattagccgggagtggtggygggcacctgtaatctcacctacttgggaggctgaggtaggagaattgcctgaaccccggaggtggaggttacagaaagccaagatcgtgctattgcacaccagcctgggtgacagagtgagactctaagaaaaaaaaagagcatactggcttccgggaacagtggctcatgcctgtaatcccagcactttgggaggccaaggcaggtggatcacctgaggtcaggagtttgagaccagcctggccaacatggtgaaaccccgcctctactaaagatacaaaaaattagctgggcgtggtg

SEQ ID NO: 190962 - DNA, 601 bp, Human
catactacacagagcagacatctaggataaaccccaggagaaaagtgtaggatggaggaagtaaggaaaatgatcagatgtggctaaaggaacaagtatttgaggactatgactggacaaataactagaaaaataggttacacaagataagggtgggacttaaatattatgcaacagttctgcaggaagtaacaagatttcaaaggaatctgggtagggaataacgaccccaatgaggacatatgctgggcgtggtggctcacgcctgtaatcccaacagtttgggaggctgaggcgggcraatcacgaggtcaggagattgagaccatcctggctaacacggtgaaaccccgtctctactaaaattataaaaaattagccaggcatgtagtcccagctacctgggaggctgagaaggagaatcgcttgaatctaggaggcagaggttgtagtgagccgagatcgcatcactgcaatccagcctgggtgatagagcgagactgtctcaaaaaaaaaaaaaagaggacatattacttctaaagaggaagagtcttagaggagtaatttgtccaaggtcacaatatagtgattgtggagtaag

SEQ ID NO: 190963 - DNA, 601 bp, Human
tcatactacacagagcagacatctaggataaaccccaggagaaaagtgtaggatggaggaagtaaggaaaatgatcagatgtggctaaaggaacaagtatttgaggactatgactggacaaataactagaaaaataggttacacaagataagggtgggacttaaatattatgcaacagttctgcaggaagtaacaagatttcaaaggaatctgggtagggaataacgaccccaatgaggacatatgctgggcgtggtggctcacgcctgtaatcccaacagtttgggaggctgaggcgggyaaatcacgaggtcaggagattgagaccatcctggctaacacggtgaaaccccgtctctactaaaattataaaaaattagccaggcatgtagtcccagctacctgggaggctgagaaggagaatcgcttgaatctaggaggcagaggttgtagtgagccgagatcgcatcactgcaatccagcctgggtgatagagcgagactgtctcaaaaaaaaaaaaaagaggacatattacttctaaagaggaagagtcttagaggagtaatttgtccaaggtcacaatatagtgattgtggagtaa

SEQ ID NO: 190964 - DNA, 601 bp, Human
agttcatactacacagagcagacatctaggataaaccccaggagaaaagtgtaggatggaggaagtaaggaaaatgatcagatgtggctaaaggaacaagtatttgaggactatgactggacaaataactagaaaaataggttacacaagataagggtgggacttaaatattatgcaacagttctgcaggaagtaacaagatttcaaaggaatctgggtagggaataacgaccccaatgaggacatatgctgggcgtggtggctcacgcctgtaatcccaacagtttgggaggctgaggcrggcaaatcacgaggtcaggagattgagaccatcctggctaacacggtgaaaccccgtctctactaaaattataaaaaattagccaggcatgtagtcccagctacctgggaggctgagaaggagaatcgcttgaatctaggaggcagaggttgtagtgagccgagatcgcatcactgcaatccagcctgggtgatagagcgagactgtctcaaaaaaaaaaaaaagaggacatattacttctaaagaggaagagtcttagaggagtaatttgtccaaggtcacaatatagtgattgtggag

SEQ ID NO: 190965 - DNA, 601 bp, Human
gaaaatgctgctgggttctacaaggcatccaagttgaacaaagggtggccctggccataagaagtttacaatttggtgggacaacaagtatgtatgtagatatctagattatctatcagaatgtgataaaactttgaggccgggagcagtggctcacatatgtaatccaagcatgtaatccaagcactttgggaagtaggggcgggcagattacctgaggtcgggagttcaagaccagactggctaacatggctaaaccttatctctactaaaaatacaaaaattagctaggcgtggtggyacctgtaatttcagctacttgggaggctgaggcatgagaactgcttgaacacaggagacagaggttgcagtgagctgagatggcaccaccgcactccagtctgggtgataaagtgaggctgtcccaccccaacccccaccccccaaaaaaaacagaatgtgataaaactcataacactacttactaggaggagatactaagttctacaaaaggagaaagaaaagtaattgtaattaggaaagaattaagaaaacttatttgaaaagataaatgggattttgacaaggaaaggtgaagtag

SEQ ID NO: 190966 - DNA, 601 bp, Human
taacaagattaaaaagacatttccctcaaacccaggaaatactgtttcttctcagcaatacattgtgtggactcggtacttaccaacatgaatgggcgctggaaataatccatattcatgctctcctggagtatactccagcttctctttctttaattggatcaatcgactctttgggctgtgataaaaaaagaatgggaaacagtcaagaggcaaagaaatttcctcctgtggtcaaatacagataacagatcatcctatgaggagagggtaccaagtacattgataaattaaaaaaaamaatctttacttctgaaactgtccttaagaaagaggctcctggctgggcgtgggggttcacgcctgtaatcccaatacttttggaagctgaggtggaaggactgcctgagcccaggaatttgagactggcctgggtaacaagtgagaccctgtctctacttttaaaaaaaaagaaagaaaagaaagatgctcttttattttctccaacagttttggagaaggaacacaaattttagatcggattataatgactgccttatatttggttactttatatcaatactgtgaagtaggtaagagg

SEQ ID NO: 190967 - DNA, 601 bp, Human
ccatgcccagctaattttttatatttttagtagagacagggtttcactgttagtcaggatagtctcaatctcgtgacctcgtgatccacctgcctaggtctcccaaactgctggggttacaggtgtgagccaccgcacccagccttctccttttctttcatttgtacggcaaatatttgataaacttctattatgtaccaggtgctgggaaatccagggagagtaagaaagacaatgatcctgtactgccggagattataatctaatggaggagccaaataaatattgtaattatagatayagagagtgatgttatctagaacaaagagagacgaagcctcttttgatgagactatcaggaaaattattttaaagaaaataaatcgtattgaagctgatactaacattaagatcatccttaaaagatgagcagaaaccaaccatgggaagactgaaaaagagcttttcaggcaatgggaataacaagtataatgaccctccagtgggaaaaagcttgctatgttctaaaaactgaaagaaggccagtatgacacaatatagtgaataaggttgagatgggaatgaataaaaggagagagat

SEQ ID NO: 190968 - DNA, 601 bp, Human
tatgcctaatacaaaacttgacaaagactttaaaagaaaaaacaactatagaacaaaattaattctaaagacttctgcagaaagctctcagaactaaaaaggaatttccttatcttattaaagatatctgtagttaatatcattctccccccccccccttttttctttcttttttttgagacggagtctcgctctgtcacccaggctggagtgcagtggcgtgatctcggctcactgcaagctccacctcccgggttcacaccattctcctgcctcagcctcctgagtagctgggactacrtgcgcccgccaccacgcctggctaattatttttttgtatttttagtagagacgtggtttcaccgtgttagccaggatggtttcgatctcctgacctcatgatctgcccgccttggcttcccaaagtgctgggattataggcgtgagccaccacacctgcctgtgttttttttttttgagacggagtcttgctctgttgcccaggctggagtacagtggcgcaatctctgctcactgtaacctctgcctcctgggttcaagcgattgtcctgcctcagcctcctgagtagctgggaataca

SEQ ID NO: 190969 - DNA, 601 bp, Human
tttcaaattatttgagaaaataccaaggagcatgactgccacatcaaatgttcagagtatattaagttttataagaatacaattgattttttaatactgatgattttccagtaaccttgctgctactactaccagtagctttttttttttttttttggtgtggatctctttggattttttttttatataaacaatcatgtcatctataaacagaaacagtttcatttcttccttcctgatcattatgatgactcttactcatcttcttgacttaatacactgcctagaacatccatgtaaygctgagtcagagtggacaactctatcttcttcccaatcttaggaggaaacattcaacatttcaccattaagaatgatattaggccaggtgtggtggcttaccagtatccaaaataaaaaaagttgatctcactataggtcctagactcattaagagactaataagggaatgttataaataatgttatgccagtatctttaataatttagataaaatggacaaattcctttagaaatacaacgtatcaaaactgagtcaagatgaacatctgaatagtctagatcttttaaataaattgag

SEQ ID NO: 190970 - DNA, 601 bp, Human
cgaattcctgagctcaagcaatccaacagcctcagcctcagcctcccaaagtgctgggattataggcttgagccactgggcctggctgaccttcttccaaccttcctcttttgctcaatacaaccccagcctttctctttgtttttcagacacacttagggactaccctggtctatgtgtcctgaattgcgattctttttttttttttttttcatagaaaacagggacttgatccatcacccaggctggagtgcgctggtgcaatcataactcactgcagcctcgatctcctgggctcaartgatcctcctgcctcagcctcctgagtaggcatgtaccaccgcacccagcaaatgttgttattgctttatagagagaggttctcactacattgcctaagttggtctcaaactcctggcctcaagcgatcttctctcctcggcctcccaaagtgctgggattacaggcatgagccaccatgcctggactaattctttttttttgagacagagtcttgctctgtcacgcaggctggagtgcaatggtgtgatcctggctcattgcaacctccacctcctgagttcaagtgatcctcctgtct

SEQ ID NO: 190971 - DNA, 601 bp, Human
ctgttttgattactgtagccctgtagtatagtttgaagtcaggtagcatgatgccttcagctttgttctttttttgtgtgtaggattgccttggctatttaggttcttttttggttccatatgaatgttaaaatagtttttttctagctctatgaagaatttcaatggtagtttaatgggaatagcattgaatctataaattgctttgggcaatatggccattttaacggtatttattcttccaatccataagcatggaatatttttccatttgtgtcttcgctgatttctttgagcagtrgtttgtagttctccttatagagatccttcgcttccctagttagctgtattcctaggtattttattctttttgtggcaattgtgaatgagagttcaatcatgatttggctcttggcttaactgttattggtgtataggaatgctagtgatttttgtacattgattttgtatcctgagactttgctaaagttgtttatcagcttaaggaacttttgcttaagcaaacactccccagtgggtgtttgctggtgtaagtttgagagaggtgtgaaagttgattagacaaaacggaatcattcat

SEQ ID NO: 190972 - DNA, 601 bp, Human
tttcagggtttttatagttttgggttttacaattaagtctttttttttttttgagacagagttttgctgtgttgcccaggctggagtgcagcgatctcagctcaatgcaacctccacctccagggttcaagtgattctcatgcctcagcctctcaagtagctgggattataggcatgtgccaccacacccagctaatttttgcatttttgttagagatgggattttgccatgttgatcaggctggtctcgaactgctggcctcaagtgatccacgtgcctcagcctcccaaagtgctgggwttacaggcgtgagccaccacgcctggcctacattgaagtttttaatccatattttgtttttgtatatgctgtaaggaaggggtccagtttcaaccttctgcatatggctaaccagttatcccagcaccatttactgaatagggaatccttacccaattgcttgtttttgtcaggtttgttaaagatcacgcagttgtaggtgtgcagtcttatttctgggttctctattctgtttcactggtctatgtgtctgctcttgtatcagtaccatgctgttttgattactgtagccctgtagta

SEQ ID NO: 190973 - DNA, 601 bp, Human
tctcccaagtagcaccatcacacccagctaatatttaaattttatctttaaatttttgttgagacaggtctcaccatcttgcctaggctggtcttgaactcctgggctcaagcaatcctcccacctctacctcccaaagtgctgggattgcaggtgtgagccactgcacccagcctatttgttctttaagtatgtggaagaattatcagtgaagacatctggttctccaggttcttttgttagatattttagttacattttcaattttgggggtacatgtgcagattttctattttgtctyatgtcagttttggaaaggtatgtttttctttttctttcttcttttttttttttgagactgagtctcactctgttgcccaggctggggtgtagtggcaccatcttggctcactgcaacctccgcctcgcgggttcaagcaattctctgccacagcctcctgagcagctgggattacaagcgcctaccaccacgcccggctaatttttgtatttttggtagagatggggtttcaccgtcttggccaggctggtcttgaactcctgaccttgtgatccacccacctcggcctcccaaagtgct

SEQ ID NO: 190974 - DNA, 601 bp, Human
cacttattaaatgagttaaaattactttttatggcttacctatacaaatcttccagttctaccaatctctatcacatgagtgcctctcttgttctattatatgtaaggtaatgatcatttaggattttaggtgtttttttgtttattgtttttgagacatagtcttgctctgtccccaggctggagtgcagtggcagaatctcggctcactgcaacctccaactcccgggttcaagagattctcctacctcagcttcctgagtagctggaatataggcacgtgccaccacgcccagctackttttcatatttttagtagagacagggtttcatcatgttggccagtacggtctcaatctcctgagctcgtgatccgcccgccttggcctcccaaagtgctgagattacaggcatgagccaccgtgcttgactttgttttaggtgttcaggagtttgtgactcgcctgggcaacatagtgagaccttatcttaatatattaaaaaaaaaaaaagaatatagtcattatcattatagctaacatttactgaatgctttttataacattttatattatttcatcctcctaacaattatataaaa

SEQ ID NO: 190975 - DNA, 601 bp, Human
tttcttcaaagtaattgggcactatgtatctcagacaggtggagtacagagtaaaaaactgtcctctcctatatacttctttaaaaaaaaattttaaaaaggccaggcatggtggctcatgcctgtaatccagcactttgggaggccaaggcgggcggatcacaaggtcagcagatcgagaccatcctggctaacatggtaaaacccagtctctactaaaaaaaatacaaaaaattagctgggtgtggtgacaggcacctgtagtcccagctactcggtaggctgaggcaggagaatggcrtgaacctgggaggcggagcttgcagcaagccgagatcacgccactgcactctagcctgggagacagagtgagactccacctcaaaaaaaaattaataaaaaaaaaaaaaaacatgaaatgcttcagtaatctgtttgtcatccttgcacaggggccatgctaatcttctctgtatcattccaattttagtatatatgctgtcaaagcaagcacttaattaaaaaatttggctgggcatggtggctcaggtctgtagtcccagcactgtgggaggctgaggtgggaggatcgcttaagtcc

SEQ ID NO: 190976 - DNA, 601 bp, Human
tttgggaatgtaaatggaataggtgcctcaaaattcaaaactttacatcttacatcttagggcagtttggtccccatttttctctttatatccttaggttaagaaaactgcaaaaagccactataatatcaaagataatcaggagacagaaaaagaaatgaaaaagaaaagaaatgcccacgagcagtagctcatacctgtaatcccagcactttgggaggcctagacagaaggatcacttgagcccaggagtctgagactagcctgggcaatatagcaagaccctatctctatttatttaaaaaaaaaagaaaaagaaaaagaaaaaaagaacgaatttgaaggtggttatagtcacctttataagagatgataccatcacaaatttctttgaagatctgggctaggcgggctgcccgagccacttcaatattttcctctgcagctgccaaccgtcttgttcgaacagatcgagctgtctgcagggcagagaactgggtcatgaagacatctggaaaaataaagtgaaaattaagttacaggaaacaaggagctctacatgtctttctctttcccaatggattcctgccatttgctctat

SEQ ID NO: 190977 - DNA, 601 bp, Human
ccatacttaatttctggcaatttcactagcagagtaaaagagcccgtgtttcatgctcagaatgcagtgacatggtagacatacttactgcagtttcatgttcggtgagatgagcctacttgagaatgcaagacagacatggtggctcatgcttataatcccagaactttgggaggtcgaggcagaaggatcgcttgaggccaggagttcaagaccagcctgggcaacatagcgagacctccatctcaaaaaaaaaaaaaaaaaaaaaaaagacagaatgcagagagtgtgatttattttrggaatgtaaatggaataggtgcctcaaaattcaaaactttacatcttacatcttagggcagtttggtccccatttttctctttatatccttaggttaagaaaactgcaaaaagccactataatatcaaagataatcaggagacagaaaaagaaatgaaaaagaaaagaaatgcccacgagcagtagctcatacctgtaatcccagcactttgggaggcctagacagaaggatcacttgagcccaggagtctgagactagcctgggcaatatagcaagaccctatctctatttatttaaaa

SEQ ID NO: 190978 - DNA, 601 bp, Human
acgcctgtaatcccatcactttgggaggccgaggcaggtggatcacgaggtcaggagttcaagaccagcctggccaatatggtgaaacactgtctctactaaaaaatacaaaacttaggcaggtgtggtggtgtgcgcctgtagtcccagctactcaagaaggctgaggcaggagaatcgctggaacccaggaggtggaggttgcagtgagccgagatcatgccactgcactccagcctgcgtgacagagtgagactttgtctcaaaaaaaaaaaagtaaaataaaataaataaataaatwaattaattactattactctgttgggtatggatccaattaaattccagatattgaataatttagtactgtactgtgaatattttctgtaattgatttttcctgtaacagttactctgtattatgaaaatggaatttacggtgaggggccacttctcatttgctaccatacttaatttctggcaatttcactagcagagtaaaagagcccgtgtttcatgctcagaatgcagtgacatggtagacatacttactgcagtttcatgttcggtgagatgagcctacttgagaatgcaagacaga

SEQ ID NO: 190979 - DNA, 601 bp, Human
tgggagaatcatctgaacccttgaggcggaggatgtggtgagccaagattgcaccactgaactccaacctgggcgacagactgagaccctgtctaaaacaataaaaataaaggccgggcatgctggctcacgcctgtaatcccatcactttgggaggccgaggcaggtggatcacgaggtcaggagttcaagaccagcctggccaatatggtgaaacactgtctctactaaaaaatacaaaacttaggcaggtgtggtggtgtgcgcctgtagtcccagctactcaagaaggctgaggcargagaatcgctggaacccaggaggtggaggttgcagtgagccgagatcatgccactgcactccagcctgcgtgacagagtgagactttgtctcaaaaaaaaaaaagtaaaataaaataaataaataaataaattaattactattactctgttgggtatggatccaattaaattccagatattgaataatttagtactgtactgtgaatattttctgtaattgatttttcctgtaacagttactctgtattatgaaaatggaatttacggtgaggggccacttctcatttgctaccatactt

SEQ ID NO: 190980 - DNA, 601 bp, Human
actggccaggagccgtggctcacgcctgtaatcccaacactctgggaggccaaggcaggcagatcacctgaggtcaggagttcaagaccagcctggccaacatggtgaaaccctgtctctactaaaaatacaaaattagccaggcatggtggcaggcgcctataatcccagctactcaggaggctgaggcaggagaatcgcttgaacccgggaggtggaggttgcagtgagctgagatcacgctattgcgctccagcctgggtgacagagcaagattctgtctcatttaaaaaaaaaaaawatatatatatatatatacacacacacacacacacacacacacacacacacatataaacatttacctatgcatatttctgtatatttcacatgtacttattttcttgaggaaagaaactacagatattagttaaatgtattaaaatatctatataacgcagtcataaaggtttaatactaaattagttttttacaaaaattatttttttgggggggaatgatttaaccttccattctagtcctatcaatgtcttcatagatagccttctataatatttagtatactgtaacacatacccca

SEQ ID NO: 190981 - DNA, 601 bp, Human
tactgtagaagttcaacatacacctttgtcttgtggatatctgtgacagatctacaggtgttgaatctatgtggaagctgggtttcagtaggaagaatgttacaatttaagattgctctaactcttctcccgcttgtctatttttctttctcattttgtctttcaacttctattattcctttatctagtaggatcttttgtcttccaaacacctctccaaggcatgtcaaaattactgaataatttcctctcttctatgcaccatacaatagtccatcctgtcctttaaatcagttcaagsccactttctctccaatgagcttcagctattccataatctatcactgtgatactcctcaattccatcctcaagatatattactggccaggagccgtggctcacgcctgtaatcccaacactctgggaggccaaggcaggcagatcacctgaggtcaggagttcaagaccagcctggccaacatggtgaaaccctgtctctactaaaaatacaaaattagccaggcatggtggcaggcgcctataatcccagctactcaggaggctgaggcaggagaatcgcttgaacccgggaggtggagg

SEQ ID NO: 190982 - DNA, 601 bp, Human
gctggtatcgcaccagtactgcccaggaggggagatcagtatgggcgctatcccccaccccctgcctcccagctgagccttggatcaactctgctagataccacatctctagggcccctatccctaattctactatgtggctctcaacaccttgtatttaataggtacacaataaatgtttttgaaattgctttagaggccaggcacggtggctcacacctgtaatcccagcactttagaaggccaaggtgggcagatcacttgaggtcagaagttcgagaacagcctggtcaacatggcraaaccctgtttctactaaaaatacaaaagttagccaggcatggtggtgggcacctgtagtcccagctactcaggaggctgagataggagaattgcttgaacccaggaggcagaggttgcagtgagctgagattgtaccactgcactccagcctaggtgacaaagcaagactccatttaaaaaaataattggtttagagacaaatactttcttagtcttcattggtatcagatgactgtatcctctcctagggtgacagctggttttgtggccactgacctgttccagggatctgaaagac

SEQ ID NO: 190983 - DNA, 601 bp, Human
gcccacaccagacacctgtgtgcccttgtaccctcgaggacaggcctcacagtggaagccgggcatggtgttgatgcagctggagcccgggaaacaggggtcagcgtgagcacactggggaccagatgagaaggcagaggtcaggccgccctctgggaaactcaggtccctgcctgtgatccaggaaccattgctccaggtctcccctttgtgcagctctccccacacaactgccttgtgctcctggtccccaccccacttccctcggggttccctctctccctccccatgccactggtcrccatctcaagcctcccctgcagtttccccagctccttccctgtatggccttcagtctttgccccaggccttctgtctctcccatcttgcatttctcttgcctctgacctctcctaaactccagattcctctcctccggaccagcatttatcccaccctcttgggtgcctcctgacatcctcaccccagttttctgtacccttctgggctctgacctccctcacctcattgatgtcactgcagtgggtgccgttgccctgcaggccaggggggcagggcccacagcggtagcctgggtact

SEQ ID NO: 190984 - DNA, 601 bp, Human
atgactgtaagaataaattcctgctgaatagcaatagagaattaaggctaaatcatagaaggaatttagaatatactatggcctgggcacagtggctcatgcctgtattcccagtactttgggaggccaaggcgggcagatcacctgaggtcaggagttcgagaccagcctggccaacacgatgaaaccctgtctctactaaaaacacaaaaattagctgagcttggtagcacgcgcctgtaatcccagctactcgggaggctgaggcaggaaaatcgcttgaaccctggaggtggaggtygcagtgagccgatatcactgcactccagcttgagtgacagagcaagactccatctcaaaaaaaaaaaggaggccgggcacagtggctcacgcctgtaatcccagcactttgggaggctgaggcaggcaaatcacgagatcaggagatcgagaccatcctggttaacacagtgaaaccccgtctctactaaaaacacaaaaaattagccgggcgtggtggcaggcgcctgtagtcccagctacttgggaggctgaggcagaagaatggcgtgaactcgggaggtggagcttgcagtgagcc

SEQ ID NO: 190985 - DNA, 601 bp, Human
ctcagggtctccaggatggaccccaaggccaaagggtctaaaattctgaattctgaatctggtggcctcctcctcacacccttccctggagcagctgcctccggaatggctcaaagtcctcaggcactgtgtctgaagaaggggaaataagtaaggtcagaggatgtggctctcccacaaggcatgaaggattaggttgatctcaatcagccacctcaccattgcatcgatactggagattggaccaaattatgttttcttgggagaagcagaatacaccaagacgcccccctcgcatgggtgtgtcaatgatcaccccagaatccgccacaagctggggtccctcatagagcttcaccctgtccaggattccaggataggagtatccattggtgctagggtgccagtgggcactgtgccaccatgcctggggccttgcttttccccagccccccttgagctcaccaggcctgagagagaagggagggagggaaagggaggcaggaaggagagggaaggggggtgcttttctcaggcctggggcccctagctctttgtccagctccttttgcatctcaaagcaccagccgcattccaagcg

SEQ ID NO: 190986 - DNA, 601 bp, Human
cagcatttactgaggctattgtttgttagaccaaacgactcacagccaggctttgtataaagagcttagcaatcagacttcctttgcttcatttattcattgactccttgctttaaagaggatctattagatttcttccaaatattaaacattgccaggcaaagatgaataaaatttggttcctcccttcgagtttacagaaaggcagataggtaagcaaataaatataataaaatattcacatataagttaaagtaggaacagaccacagatactgccaaagagaagggcattatcagtgcttccaagaagagggatactggttaggaaaagcttctgaggatagatgttcaccaggtagatggcaagagaggagatagaggaaaggattttcctggctgtcctgtaatcacagacatgtccggaatctctctgagccctgtgttgtccatttgtaaaatagaaatggtagtgactcccccttttttttcgagactaagatactaagtatagggaatggcacataaggtattcaataaatgttatttctcttcttgataccactgtgggggacatggctctgcctctctgacttctgctt

SEQ ID NO: 190987 - DNA, 601 bp, Human
aggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacrgggtgctgccacccagaataaagccactcacactgactgggctcaaacattttctcctttaagagctgccatttttcctggctggtgccataggaatcatctgggtgcctgggcacacccgctgctgctttaaggcttccgccctgatgctgacactgctgctccacgggcccagttctgcatctccaggaaagacaaacagtctccagttttgggcccagctttcctagtctcttcttttccttaccctcagccctgatcttgtgtttgtacggacagtgagctcaccctaggcctgga

SEQ ID NO: 190988 - DNA, 601 bp, Human; identical to SEQ ID NO: 190904

SEQ ID NO: 190989 - DNA, 601 bp, Human; identical to SEQ ID NO: 190903

SEQ ID NO: 190990 - DNA, 601 bp, Human; identical to SEQ ID NO: 190902

SEQ ID NO: 190991 - DNA, 601 bp, Human; identical to SEQ ID NO: 190901

SEQ ID NO: 190992 - DNA, 601 bp, Human; identical to SEQ ID NO: 190900

SEQ ID NO: 190993 - DNA, 601 bp, Human; identical to SEQ ID NO: 190899

SEQ ID NO: 190994 - DNA, 601 bp, Human; identical to SEQ ID NO: 190898

SEQ ID NO: 190995 - DNA, 601 bp, Human; identical to SEQ ID NO: 18426

SEQ ID NO: 190996 - DNA, 601 bp, Human; identical to SEQ ID NO: 18427

SEQ ID NO: 190997 - DNA, 601 bp, Human; identical to SEQ ID NO: 18428

SEQ ID NO: 190998 - DNA, 601 bp, Human; identical to SEQ ID NO: 18429

SEQ ID NO: 190999 - DNA, 601 bp, Human; identical to SEQ ID NO: 18430

SEQ ID NO: 191000 - DNA, 601 bp, Human; identical to SEQ ID NO: 18431

SEQ ID NO: 191001 - DNA, 601 bp, Human; identical to SEQ ID NO: 18432

SEQ ID NO: 191002 - DNA, 601 bp, Human
acaactgctattaattccagtactgtgtggttcacataacaggcaccactacttttcagggttctatagccactatataaaaaaaactcctttgaagtatatttaccaaagaaaaggcatattggcacatctattcattttgcatttcttacaaaagaaaatgggtgacacttatgattaaaactttcagccttcctttagttaacattcactgcgtgcttacttctcattaggactttacatggccttttttttttttttttttttttgagaaaactgcattctgtcacccaggctggartgcagcggtatgatcactgctcactgtaacctctgcctcctagggattcttgtgtctcagcctcccaagtagctgggagtgcaacactacgcccagctaatttttttttttttttttagtagaggcagagttttgccatgttggccaggctggtcttgaactcctggcctcaagtgatctacctgcatcggcctcccaaaatgctgggattacaggcgtgagccactgtgcccggccaatgaatatatatcttagcactcacaaccaacccgggaggattggtacatattatctctgtca

SEQ ID NO: 191003 - DNA, 601 bp, Human
agaaaggtagggcaagtattaagtagaccaagtcaggagtaaagatacttcacacaactgctattaattccagtactgtgtggttcacataacaggcaccactacttttcagggttctatagccactatataaaaaaaactcctttgaagtatatttaccaaagaaaaggcatattggcacatctattcattttgcatttcttacaaaagaaaatgggtgacacttatgattaaaactttcagccttcctttagttaacattcactgcgtgcttacttctcattaggactttacatggccttttttttttttttttttttttgagaaaactgcattctgtcacccaggctggagtgcagcggtatgatcactgctcactgtaacctctgcctcctagggattcttgtgtctcagcctcccaagtagctgggagtgcaacactacgcccagctaatttttttttttttttttagtagaggcagagttttgccatgttggccaggctggtcttgaactcctggcctcaagtgatctacctgcatcggcctcccaaaatgctgggattacaggcgtgagccactgtgcccggccaatgaatata

SEQ ID NO: 191004 - DNA, 601 bp, Human
ggaaaaaccaccatcatacgatgtaacttcctatagaatagtatttccaatagaataaaaaaaggtatttttaaaaaacccaaaaattgaatcacaaggattaaagatagtttatataattaggtttgactctttatttttctcatattttctttctacatgcctgctactcttgccctagaaaggtagggcaagtattaagtagaccaagtcaggagtaaagatacttcacacaactgctattaattccagtactgtgtggttcacataacaggcaccactacttttcagggttctatarccactatataaaaaaaactcctttgaagtatatttaccaaagaaaaggcatattggcacatctattcattttgcatttcttacaaaagaaaatgggtgacacttatgattaaaactttcagccttcctttagttaacattcactgcgtgcttacttctcattaggactttacatggccttttttttttttttttttttttgagaaaactgcattctgtcacccaggctggagtgcagcggtatgatcactgctcactgtaacctctgcctcctagggattcttgtgtctcagcctcccaa

SEQ ID NO: 191005 - DNA, 601 bp, Human
acaagaggagtcaaattcacaattagcttcaaaagctggattgctaatttaagctagtgttaagagctagtcttctcagaagacatgccttgctattttatgcaaacaatttttcactaggcagaaattaaccttggaagccagacacaccataccattcatactctttattttttgtagtcattcacccactggcactaggatagattttatttttgcaactacctcaaaataggcctttactagtactactctggtcttgatttcagtggactccttcagctttctttttttggagacrgagtctcactctgtcgcccaggctggaatgcagtggcgatctcggctcactgcaacttctgcctcctgggttcaagcaattctcctgcctcagcctcccgagtagctgggactacaggcacacaccgccatgcccggctaattttttgtattttagtagagatagggttttaccatgttgcccgtgctggtctcgaactcctgagctcagacaatccgcccacctcgacctcccaaagtgctaggattacaggggtgagccaccatgaccagccgactccttcagtttttaggcaatctg

SEQ ID NO: 191006 - DNA, 601 bp, Human
cgccaggacttagaaacatttccatcagttcaatataaaatttacatatttatacttctacacaagcctcgacatttttctcaatacgtactttataatcatcagaataaagatctgccagcacacacattggctgaatttccctccccacctaaagaatcatcaccaaggttcttcagttataaaatttaacaggtcaaagagcttaaaatttttactctttctgagacaacagttaaatatagttctagtcacagagtgtcctgagcagtgccagcctggctctcttggcacacaatcytctaaaataactgcatactgctgatgcaggaatgaatcacagaagcaatttctctgcacacacaagaggagtcaaattcacaattagcttcaaaagctggattgctaatttaagctagtgttaagagctagtcttctcagaagacatgccttgctattttatgcaaacaatttttcactaggcagaaattaaccttggaagccagacacaccataccattcatactctttattttttgtagtcattcacccactggcactaggatagattttatttttgcaactacctcaaaataggcct

SEQ ID NO: 191007 - DNA, 601 bp, Human
ttcactttatctacttaggtaaatatcttatggcaagggtatattattgttaaagggcagtattaagtattaaatatatttacctagtcatatatatttgacacgtcatatataaagtagagaaatgtaacaaagtccactttcccgccattagcaatagttcatgctagtctagtttggtttaatttctttacctgtccactaagaggctggcttagcaaggaaaacaatgatttgttcagtcactagaattgggtcttgaccctctatttcactgtaatcatgccattcttcattatastaagaaaggagctattttatcactgcattttagattttatcaatggaccaccaaagctggcactaatttttgttcgagggaaattaaaaatggaagtaccagttaggcattttgcctgtcaagaccactatttttattttttaagctgtaatcaatcacagaaagtaatctaaaaaaattttctcaattcacaaaaatcactcatttttaccagaatctaatcttcattaagatggttttgggtattcaggaacaagcatactatttcacattaggaatgaagtcatatcctaaagttat

SEQ ID NO: 191008 - DNA, 601 bp, Human
attttgagctgggcgcagtggctcacgcctgcaatcccagcactttgggaggctgaggcaggcaggtcacaaggtcaggagatccgagaccatcctggctcacatggtgaaactccatctctattaaaaacacaaaaaattagccgggagtggtggcaggcacctgtagtcccagctactcgggaggctggggcaggtgaatggcatgaacccggtaggcggagcttgcagtgaaccgagatggcaccactgcactccagcctggatgacagagagagagactccatcacaaaaaaacaamaaaaaagagattttgagcaaaattaaactacagcctacacaccgtatcctgcatattaaaaaaaatccaactatgctaaaaagttaattcaaataagcttttttctaagattgaataggtgagaacacttaaattcaccactgtatcccagtctcaacataaaaacgattgtctttgtataaaatattcacttaatagatctccaatggagtcttccacatttttggtgtaacatgatgctattataacgcaagtcaggaatctcaggttgcacctcaggattgtcttttaattcatttg

SEQ ID NO: 191009 - DNA, 601 bp, Human
aaattatttccctctctataagatgggattttgagctgggcgcagtggctcacgcctgcaatcccagcactttgggaggctgaggcaggcaggtcacaaggtcaggagatccgagaccatcctggctcacatggtgaaactccatctctattaaaaacacaaaaaattagccgggagtggtggcaggcacctgtagtcccagctactcgggaggctggggcaggtgaatggcatgaacccggtaggcggagcttgcagtgaaccgagatggcaccactgcactccagcctggatgacagasagagagactccatcacaaaaaaacaaaaaaaaagagattttgagcaaaattaaactacagcctacacaccgtatcctgcatattaaaaaaaatccaactatgctaaaaagttaattcaaataagcttttttctaagattgaataggtgagaacacttaaattcaccactgtatcccagtctcaacataaaaacgattgtctttgtataaaatattcacttaatagatctccaatggagtcttccacatttttggtgtaacatgatgctattataacgcaagtcaggaatctcaggttgca

SEQ ID NO: 191010 - DNA, 601 bp, Human
ttctgactgcacctctaacctcccttaatttctgcaaaatgctcatgcttggttctccagcttttcttttgattctaggctaccatgtattcttctacaaatgccttttctgcttatagcctggtaggattcccaagagttatggacaatgtagcccatactttcttctccttgcttgtaattaattagaatgagattatatgcaatgaagtcttccagaaaacatgggttctcttcagttttaatctaattgtgtaatcttaaggcctttatacccttcagtttcttttcctgagatcacaaattaaacaataattttaccagaagccaagtttattccacaaaacagctcccaatacaccacaaacattctgcacaccacatattttttgcatatgaagaacatggctgaggagattatatacagaaacataatggttgtctgggaggtaggagggcaggggacaggaatggtgggtagagtgcatttgctttccttgctacctttctgaggtgcttgcacaaattttctttgagacagggtctcgctctgttgcccaggctggagtgcagtggtgtgaacgtagctcactgcagcctc

SEQ ID NO: 191011 - DNA, 601 bp, Human
attacaaagttaaaactatcatttcttatctattaaaagaaaatttggggaaaaaaacacttgaaaagtgccttataaaagcgtatgtgaaaaccaaaccacgagataacactttcattagaaaggctataataaaaaagacagttaataagtgttgcaaacatgtggataaactggaaccctcatacactgctggtggaaatgcaaaatggtgcagctgctgtggaaaactgtctggcagttcctccaaagttaaacctaaaattaccatgtaatccagcagttccactcctaggtatayactcaagagaaatgaaatccagtttatacatgttcatggcagcattattaataacagccaaaaagtagaaaccaccagatattgatcaaccgatgaatggacataacatattcatacaatggaatagtcactcagctatgaagaaatgaagtactgatacatgctacaactttgaagacattatggtaagtgcaagaagtcagtcacaaatgatcacataatgtacaattccatttacatgaaatgtccagaataggcaaatcttcaaggcagaaggtctgtgttttaaaaagaataatc

SEQ ID NO: 191012 - DNA, 601 bp, Human; identical to SEQ ID NO: 29430

SEQ ID NO: 191013 - DNA, 601 bp, Human; identical to SEQ ID NO: 29431

SEQ ID NO: 191014 - DNA, 601 bp, Human; identical to SEQ ID NO: 29432

SEQ ID NO: 191015 - DNA, 601 bp, Human; identical to SEQ ID NO: 29433

SEQ ID NO: 191016 - DNA, 601 bp, Human
tcgcttgaaccagggacgtggagcttgcagtaagccaagatcgcgccactgcactccagcccgggcgacagtgcgagactccgtctcagaaaaaaaaaaaaaaaaaaaaagtaaataaagccgtacagtttacaacaaactaaatgcttacagtatttgaccctcgcaactctaggagcaaacaggtattagtgttattcctattttaatacgtgaaatctgaagtgaagctgtctggttaaggtcgcacagatggaagagccagggccaggaaccaaacctcctgactcctaactcaagkgctccttacaccagacctggaacgctggtaaaggcctttaaaacaaaggccacctgtgaggttcgggaacgttcaaaggcatctagagcagaaagcttcgcaatgtctgtctttcaccatcacgtgctccgcctaacttttcctcctttttcaaagactacccaatatgtgtactaagttttagatctctggacccccctatggagtaaacaggctacatcaccatgtccattttacaattaaacaaaaccacaactcaaggagttggctggttcctccgtgggcagacacggaaaaccc

SEQ ID NO: 191017 - DNA, 601 bp, Human
gccactgccctccagcctgggggatacagcaaaactctgtctcaaaaaaaaaaaaaaagtctacagaaaatttccaatttggagggaggtggtttgaggcaacttctatgttgtggttgttgtttgtctagttctaaaattacaactcaaagcaatttcactacaaccagggaagctacaggtcaaccaacaagaattctaaacacacctctcttctgaactctgctagaaccctacagagggtctatgaagacctcaagctgactatataaatgaatttgacactgttaagactagtgtsagctgggaggaaaaagactcatactttgaaagcttttaagcacagatagctcaataaatatttgttaaatgaacaacacatggaacatcatctttaaattgctctggtcccattattactggtttcacaagcctttattaaatatcttgtttgtgaggcactgtgctctaagctttgaaaggttacggaagataaatccttgtctacatgctgcttagatttgagaaaatggaagcattgagctaaaaattttaaatataagcattgataagaaataatcagactgaatttcaattaagg

SEQ ID NO: 191018 - DNA, 601 bp, Human
ttcttctttgacgatgatgatgatgactcagaagatgctgaacgtttttctactacaggagtagaaagagctcgttttttgaacagctccctttctctcaacaggcttggatccataatgctacaaagaaaaaataagtgtctttaatacaaattcaagtcactcaaacctgcactccaaatccacagatctcaacaagttacttcccaaacaaaattaccttttattattagttctctagcacttgcatttattcacttattcaagtactcaagaaatatttcattagcgcttattacaygccaagcactgtactagccattataggaaaaaaagaggccaggcatagtggctgaagcactttgggaagccgaggtgggcagactgcctgagcccaggagttggagaccagcctggacaacatggtaatacctcctgtctacaaaaatacaaaaaatcaggcaggcatggtgatgtgtgcttacagtcccagctactcgggaggcggaagtgggaggatcacttcagcctggaaggtcaaggctgcagtgagctgtgataatgccactgcactctagcctgggtgacagaccaagaccct

SEQ ID NO: 191019 - DNA, 601 bp, Human
tacatacaaagacactattaagaagataaaatgacaagcacttgcttggagaaaatatttgcaaatgtataccagatcaaagaatggtagccagaatatatgaagaattattaaatcaatagagagaggaaatatacctcagttttttttatgggcaaaaaaaaattgaatagacatttcaccaaggaatacacatggtcaataagcacatgaaacaatgttcaacatcattactcattaaggaaatgcgtattaaagccacaatgatagaacttcacaactatagaaatagctatgattaaaaaaaaaaaaacagaatttcaagcgttagcaaggatgagaaaaaactagaaccctgatacattgctggaggaaatataaaatggtacagctattttagcagtttcttaacaagttaaatataaatttgacatatgacccagaaatctacttctaggtctctatccaaaagagataaaaagatatgtctacacaaagacttgtacatgaatattcataccaacactattcaaaacagccaaaaagtgaaaataatccaaataaccgtttattggtgaatggataaacaaactgtggtaca

SEQ ID NO: 191020 - DNA, 601 bp, Human
tcagctacccgggagactgaggcttgcttgagctggggagtttcgaggctgcagtgagccatgatcacgccagcagtgagccatgatcatgcccgtactccagcctgggcaacagagtaagacgcagtctcgaaagaaaacaaacaaaaggctgggtgcggtggctcacgcctgtaatcccagcactttgggaggccaaggcgggtggatcacaaggtcaggagatcgagaccatcctggctaacagtgtaaccccatctctactaaaaagacaaaaaaattagccagccatggcgatggrtgcctgtagtcccagctactagggaggctgaggcaggagaacggcatgaacccgggaggtggagcttgcactgagctgagattgcgccactgcactccagcctgggcaacagagcaagactccgtctcaaaaaaaaaaaaaaccacctctcaacaaactagaaatagaaaggaacttcttcaactggaaagggcatgtacaaaaacctgcagtaatatcatgcgtaagagtgaaaaaccgaatgctttgcccctaagatcaggaacaaggcaaaggtagctacttttactattcaatgta

SEQ ID NO: 191021 - DNA, 601 bp, Human
cagatgcagtagcttatgcctataatcccagcactttgggaggctaagggggatggatcccttgaagcggggagtttgagacccacctgggcaacaaagtaaaaccccatctctaccaaaaaaaaaaaaaaaaaagttttaattagccaaatgtggtgggcatgtgcttgtagtctcagctacccgggagactgaggcttgcttgagctggggagtttcgaggctgcagtgagccatgatcacgccagcagtgagccatgatcatgcccgtactccagcctgggcaacagagtaagacgcwgtctcgaaagaaaacaaacaaaaggctgggtgcggtggctcacgcctgtaatcccagcactttgggaggccaaggcgggtggatcacaaggtcaggagatcgagaccatcctggctaacagtgtaaccccatctctactaaaaagacaaaaaaattagccagccatggcgatgggtgcctgtagtcccagctactagggaggctgaggcaggagaacggcatgaacccgggaggtggagcttgcactgagctgagattgcgccactgcactccagcctgggcaacagagcaagactccgt

SEQ ID NO: 191022 - DNA, 601 bp, Human
attgagtaccacaacaaataaaaatgattatacaccataaccaagtaggatttatttcaggaataaatgcaaggttgtttgaacatctaaatatcaattaatgttaatatatcatattaatagactaaagagtgagaacatgctcatctcattagatacataaaaagcatcagacaacatccagtacccatttatgactaaaaactctcagtcagatgcagtagcttatgcctataatcccagcactttgggaggctaagggggatggatcccttgaagcggggagtttgagacccacctrggcaacaaagtaaaaccccatctctaccaaaaaaaaaaaaaaaaaagttttaattagccaaatgtggtgggcatgtgcttgtagtctcagctacccgggagactgaggcttgcttgagctggggagtttcgaggctgcagtgagccatgatcacgccagcagtgagccatgatcatgcccgtactccagcctgggcaacagagtaagacgcagtctcgaaagaaaacaaacaaaaggctgggtgcggtggctcacgcctgtaatcccagcactttgggaggccaaggcgggtggatcaca

SEQ ID NO: 191023 - DNA, 601 bp, Human
aagctctgtcaaaaagagtagtgatatgggaactcaaaggttatacagtgaattcacactgaagaatgagaataatatgacttttaagctgaaacttaaaagaacaggacagaaccaaaagagggtaggaggtaagaaagaatattccaggaagaagaaataatacgaataaaagccaagaggcaagagagaataaagcatgttggaggagctacaagtcagtatcactaggacagagtacaaggagaacagtatgataccacacctaagagataattagaggccagatgaggcaggcacrcaggctgcagtaaaacatggactttatctgaaaaacagtaacaatcagcttgagctgaaagcaacatgatctaatgagaaaaatcacagctgtatgaagaatgaacactaaagcagctaaaccaggagacctggtcaacagctaacctagcaatccaatgaccgtggcctgaactagagtggcatggtagcctttagttgttacacccaatatttccagctctcttcattaaggaaagcattcacttcagagccccctatggctgggaacataactttggccaatgagtgacttgtgact

SEQ ID NO: 191024 - DNA, 601 bp, Human
atttacagtggtatctttagtggtgctggctttcctttatgaagtgcttgactgctgctgctgtgtaaaaaacaaaaccgtgaaagacttgaaaagtgaacccaaccctcttagaagtatgatggacaacatcagaaaacgtgaaactgaagtggtctaacactctatagaagatgaacaaaatctctgaaagcagctcaacctcttctgagaaaaaaaatatattctgaggccaactgttgctacaaaacaaattctgactgaatggttaaaacatttctagtagaaggggaaaaaaaarttaaacatgcactgtttgtgtgtatagccatttcattaaatatacagtaaaacttcatgaatgtgaatttactaatctgtttaatactgacacttcaaaaactggataaaagattcctagagttcaatattaagcagcaaaagataagctggaaaagacaagcaaggctaatgatgctaaaatgattttataactaaccaattcatgtagacaaaaaatagtgtgttggtaacaaaaaggctatttaaaacatgtttctaagtctgaagtaaaatacttccacttatatatataaagttc

SEQ ID NO: 191025 - DNA, 601 bp, Human
aaatttaccctttccatgacaactggaacactgcctgctttgtcatcctgcttttatttatatttacagtggtatctttagtggtgctggctttcctttatgaagtgcttgactgctgctgctgtgtaaaaaacaaaaccgtgaaagacttgaaaagtgaacccaaccctcttagaagtatgatggacaacatcagaaaacgtgaaactgaagtggtctaacactctatagaagatgaacaaaatctctgaaagcagctcaacctcttctgagaaaaaaaatatattctgaggccaactgytgctacaaaacaaattctgactgaatggttaaaacatttctagtagaaggggaaaaaaaagttaaacatgcactgtttgtgtgtatagccatttcattaaatatacagtaaaacttcatgaatgtgaatttactaatctgtttaatactgacacttcaaaaactggataaaagattcctagagttcaatattaagcagcaaaagataagctggaaaagacaagcaaggctaatgatgctaaaatgattttataactaaccaattcatgtagacaaaaaatagtgtgttggtaacaaaaag

SEQ ID NO: 191026 - DNA, 601 bp, Human
tggcattatttggttttctttctctactatttttcactcagccactatttctgattcagatcacctgtcatcgaagtttaaagaaggggaaacaggagacagaaatacactgaaccaaaaaggtaagaagaatccacaaggctaatgataaaagcttttccaggggcagtttgaagaacataaccttaaaacgccaaggttttttgtagataacagctcactgaccactgctttaatcaagttttaaaccaattcagctgccttttccccttccattagcagttaatttcggtatatgaattttttttttttttttgagaaacggtttcattcccattgtccaggctagaatgcagtggcacgatcttagctcaccacaacctgcgcctccctggctcaagcaatcttcccggcttagcctcccaagcagctgggactataggcacacaccaccatgcctggctaatttttgtatgttttgtagagacgggtttcgccatgttgaccaggctggtcttgaactcctgggctcaagtgatctgcccacatcactctcccaaagtgttgggattacaggcgtgagccaccatgcctggcctga

SEQ ID NO: 191027 - DNA, 601 bp, Human
caggaggccaaggaaggtggatcacaaggtcaggagtttgagaccagcctgaccaacatggtaaaacccgtttctactaaaaatacaaaaattagccaggtgtggtggcacatgcctgtaatcccagctactcaggaggctgaggcaggagaatcacttgaacccaggaggcggaggttgcagtgagctgagattgcatcattcattgcactccagcctgggcaacagagcaagactctgcctaaaaaaaaaaaaaaaaaagacagtacatgggatactctggtttctcttcagatcatayaaatctctcaccttttactaaagatttcttcagagagtaataattctaagtcttaacccaatttttgaggccctgcatctgcaaggctagtaagaaagaaaaaaaaaaaagtacatggggttcatactactttgtagttttcgttaaatgaaacactctcacacaaaaggtatctccagaatttacaaaaatatttggtacacattaggtaatcaataaacatttgttataaaaataaaatcctgtttacaactatgtagtaaaggaaaagcatacagaatgacaaccgataaattaatg

SEQ ID NO: 191028 - DNA, 601 bp, Human
aaggggacctgaaaatattttaagcagttcacttatacctcaaaagtagatgagatatctcttttttggaaatgggagtttcactcttgttgcccacgctggagtgcaatgtgcattttccttcaaaatgcaggaaaaaaggaggcaagtccatccagagaggtgaagtgacttaccaagcaaacctaagaaaacaaaaaccttagaaaacataattttatcaaccccaaagattttattaagaaaacaaaaaaatttaaggaattatattgttatggctttgagtttggggtgtgaaaayaatattgtggttatgtttaaaaatagagtcctcaccattgggagatatatattgaaatatttctaggtgaacgatgccttgaatttgctttaaaacaaccaatggggtggaagcaaacaggtacaggtagagatgggccaagagttgatgaatgaagttgcattataagtacatgggaggccaggcgcagtggctcacgcctgtaatcccagcacttcaggaggccaaggaaggtggatcacaaggtcaggagtttgagaccagcctgaccaacatggtaaaacccgtttctactaaaaa

SEQ ID NO: 191029 - DNA, 601 bp, Human
atgacagtgtttcctaatcccaatttgaattttttggaatccagaatactcaataaatgtattaaatagatacataaacaacaggctcttttaagtgaaagtaagtttattaagaaagcaaaggaatactcagcagcactttagaagttttattaggctaacgttttgtattacagtgcattaaataagtcaatattgacagctgatttaactagatgtgttacattttgaaagcacaaagggattttatctttttgaattaaaggagaaaagccaaaaaaaaaaaaaaaaggaaaggaayaaaagaatggttactccatactactccataagcaggaataaaagaatggttactccatactaatccatattgttggctaacaatagacttttaagagagccaagaataaggaatagtgctttttatttctctttttaaaatagatgatttactttggtttcaaataaataatatatttaaattgttgaaaaaacaaaagaacacaaggtacaggttaagaagcctcaaacatatccctgtgcctcactctcctcccgatggatccccatccacaccatcattgtgattaatttcttgtag

SEQ ID NO: 191030 - DNA, 601 bp, Human
catctctactaaaaagacaaaaattagctgggtgtgactgtacatacctgtaatcccaactattcgggaggctgaggcaggagaatcacttgaaccaggatgcagaggttgcagtgagtcaagattgtgccactgccatccagcctgggtgacagaacgagactctgtctcaaaccaaaaacaaactcctgtgctcaagtgatcctcctgcctcagcctcccaaagtgtgggggtgaaggcataggccacagcacccagccaagcataattattaaaagcatttttatgtgtgaataaagyatacagtctaacaaaaatgacagtgtttcctaatcccaatttgaattttttggaatccagaatactcaataaatgtattaaatagatacataaacaacaggctcttttaagtgaaagtaagtttattaagaaagcaaaggaatactcagcagcactttagaagttttattaggctaacgttttgtattacagtgcattaaataagtcaatattgacagctgatttaactagatgtgttacattttgaaagcacaaagggattttatctttttgaattaaaggagaaaagccaaaaaaaaa

SEQ ID NO: 191031 - DNA, 601 bp, Human
tttgggagtaaacatatcaaatgggagtaaacatatcaaaatgggagtaaacatatcaaatgggagtaaacataccaaaattaacataaaacaaaactaaaacacatatgctaaaaaaaaattatgtgatttactttaaagctccccattcctgtaatcaaattttaaggcatgggtagggaagtccagaaaaagattgttttacctttttttatatacaccattttctcttgcttttcataaagaatgtttacagcatttgcttaatataaacttacattttaatttcaaaactaagtcrcaggataggagaaaatcctaatgatgtatttctattttttggcggggggacggagtctcactctatcgcccaggctagagtgcagtggcgcaatcttggctcactgcaacctctgccgcccaggttcatgagattctcctgccttggcttcctgagaaactgggattacacacacccgccaccacaactggctaatttttgtgtttttagcagagacggagtttcgccatgttggtcaggccagtcttgaacttatgacctcaggtgatctgcctgcctcagcctcccagagtgctagga

SEQ ID NO: 191032 - DNA, 601 bp, Human
aggttcagcacagtggggttaattatctagaaaccatttgtgcttgctacagaaagtacagaagcaccaaacaaaagtctcagataaaataaaaataactttgtcaaataaaacagttaacttacaaatcaaatttcaggtaaactgtcaacagaaacccctaccacccacattgttttaacactctatcatcagcctgcattttgcttggaatatgtctattgttagcacagatggaggctcattgctgtttcaccaaactgactggagacatggcctaagttccagagcttaaattaaktgagttgctctatatttacaggctattaggattaactgatcacatttcaaagtgatatgcttaaaagcacctgagaattcaattcaaaggcttttaccataaatacagcaaaagcataactttattctcatctggcaacccaaaggttccagaacagttccaagtcccatccccattaacactgcactggggcctttgggagtaaacatatcaaatgggagtaaacatatcaaaatgggagtaaacatatcaaatgggagtaaacataccaaaattaacataaaacaaaactaaaacaca

SEQ ID NO: 191033 - DNA, 601 bp, Human
gatgcttgatgataaaatcactagtgatttttgacatataacttggaagattctgatatcacaaaatttccattagaattaacttatatatttgaacatttatgtctaagcacttaaattctacaaaatctcaaaacacgaacagatttgccaaacacaagaactaatgaaggaagagaggagacagctgcattcatttaagaataaatttctgatacaaagtgaatttaatcaaaattttaatctatgtatgttattctaatcaactgtgcaccaataattgtaaaaataactcaaaccrtaagttatttttaacacttagagctttacggtcataggaaaaacattttaaattttgatttatatttcaatttatttacatattattgtggcagaaaagtttgatagatgatcaataaatgatttgaaagataaaaatacataacatttggataaaattcaaagggagtaacagatgggacacaaatattcaaagaaaaaataattaaaattcccaatcattaagggagtttgtttttatacttttaaataatgacatttagattccattagataaatttaaaagtgatatattttattg

SEQ ID NO: 191034 - DNA, 601 bp, Human
aattgtttaaagtttcctctaacaaccattccccctacacccccacctccattcagtattgtccaagaacgcattgctcttaggggacagtatgataaaagtaatgcacagagaacactggttaaaaaaaagataaaaagaaatatttttttcaagaattcttatttttttattagcgacaaggtctcaatgtgtcgcccaggctggagtacagtggtgcaatcttggctcattgcaacttccacctcccaggctcatgtgattctcagcctctaaagtagctgcggttacaggcatgtgmcaacacacctggttaatttctttttgtatttttagtagagacggggtttcaccatgttggccaggctggtctcaaactcaagtgatccacctgcctcagcctcccaaagcgctgagaatacaggtgtgagccactgtgctgggccgagaatttaaatgtaagtaattctcaaaactcattccctgaatatttattagcttgaagaaaaagcatatttagagagctggaacaatatcaattagggaggctgattcctttaaatataaaagaaatactttctaggactgccaagtcattcaa

SEQ ID NO: 191035 - DNA, 601 bp, Human
cagataccttccaaatgtacttcttccctttcaaaataagcccttctctttaccttccacctccccccgccatgaaaaagtaatctcgcctccattcagaatttgtgatgcagagcctgaaggaataataaactccagggacccaaacaaacagacacgccaaaaaaatggtttcagggaagcattcgtgaatggtaactgaggtgccgtaaactatccattactgggcttcttgtcttttccagtcacatatttttcaaagagtttaaaatattttggcccctgctggaacattctaatmtatcataatctgtgagcaattgtttaaagtttcctctaacaaccattccccctacacccccacctccattcagtattgtccaagaacgcattgctcttaggggacagtatgataaaagtaatgcacagagaacactggttaaaaaaaagataaaaagaaatatttttttcaagaattcttatttttttattagcgacaaggtctcaatgtgtcgcccaggctggagtacagtggtgcaatcttggctcattgcaacttccacctcccaggctcatgtgattctcagcctctaaagtagct

SEQ ID NO: 191036 - DNA, 601 bp, Human
cctgtatttagtagagatattgtcatataatttaaatacttttatttaaaactggaaatagatccatattcttgacccagtcctactatggaccagaactgtgtctatgagccagtcatttaatgtctatggactccagagtttctaaattcaaaaataattgtcagaagtaattcagacagaagttaggccagtgattctcaaacttcagcatgtatcacaatcacttgaagggcttttttaaaaacagactgttgctcacgcctgtaatcccagcactttgggaggctgagacgggcagatcacaaggtcaggagatccagaccatcctggctaacacggtgaaaccccgtctctactaaaaaaatacaaaaaaattagccaggcgtggtggcaggcgcctgtagtcccagctcctcgggaggctaaggcaggagaatggcgtgaacccaggaggtagagcttgcaatgagccaagatcgcaccactgcactccagcctgggtgacagagcaagattccatctcaaaaaaaaaaaaaaaaaaaagactgttgagctatactcccagagtttcaaattcaataggtctggaaaggggccc

SEQ ID NO: 191037 - DNA, 601 bp, Human
gttaccctgttcttttttcaaggtgcccagatttcatattgttcaaacacacatgctctacaatttgtgcagttaacgcaattatcacagggtcctgaagcgacatacatcctcctcagctgacaggattaagagattaaagtaaagacaggcataggaaatcacaagggtattgactggggaagtgataagtgtccatgaaatcttcacaatttatgtttagagactggagtaaagaaaggcataagaaattataaaagtattaaattggggaactaataaatgtccatgaaatcttcamaatccacgttcttctgccatggtttcagtcggtccctccatttggggtccctgacttcccgcaacacaagtgttctcactgttcaattcccacctatgagtgagaacatgcagtgtttggtttttcgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgagtgctgcaataaacatatgcg

SEQ ID NO: 191038 - DNA, 601 bp, Human
cacaacaggccccggtgtgtgatgttccccttcctgtgtccaagggtattagggaacctgccccaatagtcatgtaggttcttttctattttccctaagtgttggccagtttgaaaaataaagggacagagtacaaaagagagaaattttaaagctgggcgtccaggggagacatcacatgtcagtaggttccgtgatgccccacaagctgcaaaaccagcaagtttttactagggactttcaaaaggggagggagtgtacaaatagggtgtgggtcacagagatcatgtgcttcacaagrtaatagagtatcacaaggcaaatggaggcagggcgagatcacaggaccacaggaccagggtgaaattaaaattgctaatgaagtttcaggcaccattgtcattggtaacatcttatcaggagacagggttttgagagcaaccggtatgaccaaaatttattgggcgggaatttcctcgtcctaataagcctgggagcactatgggagactggggcttatttcatccctacagctcgaccatagaagatggccacagccaggggggccgtctacagacctacccccaggcacgtatttgct

SEQ ID NO: 191039 - DNA, 601 bp, Human
gaaataaattcatgccatggaaagagcattttgaaaagactgggaaatatttccatcattatgtgatttctgagtttaaaaggtataagaataaaaactgtcatatctgcatatcttaaaattttgataaactattttctaaccttcactattatcttctttgagatgtagtctcgccttgtcaccgggctagagtgcagtggtgcaatcttgggtcactgcaacctccacctcccgggttcaagtgatcctcctgcctcagcctccgagtagctgagactacaggcatgtgccaccacaycatgctaatttttgtatttttagtaaagacgaggtttcaccatgttgtccaggatggtctcgatctcctgacttcatgatccacctgcctcagcctcccgaagtgttgggattacaggcatgagccaccgtgcccagtctacttcaatagttttacagtactttgagtgctgttttataatctttatttttaaaaagtcttccagacaaaacccttctatgagtttaaaatcaaaattgtcagtaatttaaaaattataatccattttgatatattttgcataaactgactttttttttt

SEQ ID NO: 191040 - DNA, 601 bp, Human
atctgtctctattaaaaatacaaaaaattagccgaacatggtggcacatgcccgtaatcccagctactcaggaggctgaggaaggagaatcgcttcaactgaggaggcagaggttgcggtgagccgaggttgcactattgcactccagcctgggcaacagagcaacactctgtctcggggggcgggggggagttacgctttactaatagtgaatatgtggactgacaaatactattagtaaagtggctccttcatcactagtagtaaagtggctccttcgcttcatgtcaggacatccacrtttccaatcgtgacatgcatgtaggaatcctgaggcgggcctgggaatctcacatgacaaagggcccagcatgcatggcctcgctcattccttcactttcaggattctgcaacacagtgagactggcctgttataagatggattgtggagaatttttttttaaagacctttcaaaggtagacattgtacaatggtttcacaaagctgtaagaaatgaattacaaatttctccttacaaaaaggcaaaatgtttcaaatctgctcaatattctatgattatagcagctatttacagtttgc

SEQ ID NO: 191041 - DNA, 601 bp, Human
gtaaacaactatctgtcaggaaggcatcttcaatcagaagaaatgaaagagaaaactggacagaccttgaatgacgacatgattaactagaatacggggaaacgccgggcagctatagtacagcagtggtctcctacgtggggtgtacacaccccagggacacaaaagtgggtacctcgtgatgattctttagaacatttattaaaattgtctttaatttccatttaaaagttatgctttacttaggctgggcacagtggctcatgcctgtaatcccagcactttgggaggccgaggcagrtggatcttgaggccaggagttcaagaccagcctgaccaacatagtgaaatctgtctctattaaaaatacaaaaaattagccgaacatggtggcacatgcccgtaatcccagctactcaggaggctgaggaaggagaatcgcttcaactgaggaggcagaggttgcggtgagccgaggttgcactattgcactccagcctgggcaacagagcaacactctgtctcggggggcgggggggagttacgctttactaatagtgaatatgtggactgacaaatactattagtaaagtggctcctt

SEQ ID NO: 191042 - DNA, 601 bp, Human
gtaaggagatcgagaccatcctggccaacatggtgaaatcccatctctactaaaatacaaaaaattagccaggcgtggtagcgggtgcctgtagtctcagctactcgggaggctgaggcaggggaatcacttgaacctgggaggcggaggttgcagtgagccaagatcaagccattgcattccagcctggcaacagagcaagactctgttttaaaaataaataaataattttaaaaattaaaaattaaaaaaagtttagtggctgccaagggttgaggggagagaaggatgaacaagcagagccctgagaatttttagggcagtgaaaatactcaggaggatactagagtggtggacataggtcattatacacttgtccaaacccacagaaagaacaccactaagggtgaactcatgtaaactatggactttgagtggtaatttgtcaacgtaggttcattgactgtcacaaatgtactcttctggtgcaggatgttgatagtggaggaagctgtggggggatgggcagggaatggatgagaattctgtattttccaatcaattttgctgtgaacctaaaactgctctaaaaaaaaagtgt

SEQ ID NO: 191043 - DNA, 601 bp, Human
tatagtgacgaagagccatagaccatgaaatcagaatggggttgaaactcattgctctataaaatcaaaagacaaactgacaaaaaaatatatgcaactcgtatcaccaagagctatattcttcctaacatttcaagagcttcaaaaaactaacaaaatagaccaggcacagtggctcatggctgtaatcccagcactctgggggactaaggcaggtgggatcacttcaggtcaggtgttcgagaccagcctggccaacatggtgaaaccccatgtctactaaaaatataaaaatcagccrtgcatggtggtgcatgcttgtaatcccagctacttgggaggctgaggcaggagaatcgcttgaacctgggaagaggaggctgcagtgagctgagatcatgccactgcactccagcctgggaggcaagagcaagactctgtcttgaaaaaacacaaaactaacagaaaatgacccaaagacagaaacgcgcagattgcaaaaaatgaccttaaacataggaaaagacactcaactttcaccaaacaatcctatttctagaaacttatcctacagaaataccagtaccacacagaaaagtga

SEQ ID NO: 191044 - DNA, 601 bp, Human
ttaaaaaaaaaagaaaattctagttacaggaaatctctcttgataatcaactaaattcttacctcagtcattagccattgtttctgcttgagtccaatatctaaatgttgtgtttcatccaaaatttcatctaaggttagaggatgcgtatctcctcgctgatgccgtgtctatcaagtgaagaaattgttattagaagacagtttcaaaatgctagatgcattaaatcatagttacatgtaaacaaaccttcaggaatgaaaaacatgtattattccaggtagcataattatagtgacgcagagccatagaccatgaaatcagaatggggttgaaactcattgctctataaaatcaaaagacaaactgacaaaaaaatatatgcaactcgtatcaccaagagctatattcttcctaacatttcaagagcttcaaaaaactaacaaaatagaccaggcacagtggctcatggctgtaatcccagcactctgggggactaaggcaggtgggatcacttcaggtcaggtgttcgagaccagcctggccaacatggtgaaaccccatgtctactaaaaatataaaaatcagccgtgcatggtgg

SEQ ID NO: 191045 - DNA, 601 bp, Human
tgaattctcaaggttagctaaaccagcaaatttaaatgtggattaccattgtttgtatatcactaatacaatgaactacaattatactgattaatggtcatgttacattataaaagtcaagacctgtattttgcttggtaaaaaaataaatgaattgtatgttaggaattttacatttggtttctagaatctatctctggtcctagaaagtagtcttcttagttttcacttcatattttaaagcggtaaacatttgaatttttaaatgctattcatttccaaattagcatggtcactgackgcgttggggtttcttcaaatgatgtgtgttcatacacagcattcgtgactttttttccacatcaagccataatagcagtaattgtgcaacaaaatatcttcctatccctgcagtaccttatgctttaaatttcctaaaacaaaaacaattcaatttacaagcacacaaactataaatctggcaatacaaaataagcattaatctgtaaaaacattaagtcgaattggtacaatgacttctttacaactattacacaaagtcttacctttaacattttgaaacagataacataaaattata

SEQ ID NO: 191046 - DNA, 601 bp, Human
aatataattatgtttctagtcagttctgttgtacagttagtatcagaaggaaagctcttcaaaaagagcaaccctatatattttcttctgcagctgccagcctgaccctgaaaggagaaagagaagaaacacagaaagaagaaaaaagggagaatagaatagtaaaatgatcaaagtcattgttaactaaatgttggtagtctatgaattctcaaggttagctaaaccagcaaatttaaatgtggattaccattgtttgtatatcactaatacaatgaactacaattatactgattaatgrtcatgttacattataaaagtcaagacctgtattttgcttggtaaaaaaataaatgaattgtatgttaggaattttacatttggtttctagaatctatctctggtcctagaaagtagtcttcttagttttcacttcatattttaaagcggtaaacatttgaatttttaaatgctattcatttccaaattagcatggtcactgactgcgttggggtttcttcaaatgatgtgtgttcatacacagcattcgtgactttttttccacatcaagccataatagcagtaattgtgcaacaaaata

SEQ ID NO: 191047 - DNA, 601 bp, Human
agcttgagaatgaaactgagtaggaatgcaggaattactgaatataattatgtttctagtcagttctgttgtacagttagtatcagaaggaaagctcttcaaaaagagcaaccctatatattttcttctgcagctgccagcctgaccctgaaaggagaaagagaagaaacacagaaagaagaaaaaagggagaatagaatagtaaaatgatcaaagtcattgttaactaaatgttggtagtctatgaattctcaaggttagctaaaccagcaaatttaaatgtggattaccattgtttgtrtatcactaatacaatgaactacaattatactgattaatggtcatgttacattataaaagtcaagacctgtattttgcttggtaaaaaaataaatgaattgtatgttaggaattttacatttggtttctagaatctatctctggtcctagaaagtagtcttcttagttttcacttcatattttaaagcggtaaacatttgaatttttaaatgctattcatttccaaattagcatggtcactgactgcgttggggtttcttcaaatgatgtgtgttcatacacagcattcgtgacttttttt

SEQ ID NO: 191048 - DNA, 601 bp, Human
actcttatttacaaacagagcttacaagagaaactctattgcctttgaggaaaattttccagaaatagcctgaacaatcaaacaatcatatagtaacagcaacaagaacccgtcaaagttacacagagatggctgctccctttcctgctaggtggcacaagacaaatttcaaaccttcaagtggctcactgtaacccatgtgtatataatagaagctttaaaaacaattgtaaaatgtttgatatttttaaaaccaagaagtcattattcattcaaattatattaagacatagaaagaaamgagagattaccttgacagctttctgggaattgggcagtgcttcttctatgtcttctaaaagaattcctcctaatcctcgctggtcatgctgatctaagagcctaagtagggccttcttatctctcacgttgtacttgggcttgaaagcatacttcccatctattacttcaattttgggattgttgactaaagcctgtaacagtgatacaattggaatatattaacaaatggaacataaatatatatatatatttttgaaacgtaatcttgctctgtcgcccaggctggagtgcagtggcg

SEQ ID NO: 191049 - DNA, 601 bp, Human
tacagagctacattaatcaggccaggtgcagtggctcacacctggaatgccaccactttgggaagccgagggtgggcagatcacttgaggtcaggagttcgagaccagactggccaacatggtaaaaccacatctctaccaaaaataaaaaaattagttgggtgtggtggtgtgtgcctataatcccagctaatcaggaggctgaggcaggactactgcttgaacctgggaggcagaggttgcagtgacccaagattgcatcactgcactccagcatgggtgacagtgtgactctgtctcaaaaaaaaaaaaaaaaaaaaggctacattaatcaaaacattgtagtgctggcatgaagaaagacatacaggcagaatagagggcccagaaataaaccttcacatatatggtcaaatgatcttccacatgagtaccaagactaagactattcaatgggcaaaggacggtctcttcatcaagacactgagaaaactggatatccacatgaaaaggaataaagttggactcttacaccatatacaaaaattaactctaaatacctaagacccaaaactataaaactcctagaagaaaacatagg

SEQ ID NO: 191050 - DNA, 601 bp, Human
agaaaaattagctgaacacggtggcaggtgtctgtaatcccagctacttgggaggctgagacaggagaatctcttaaaccaaggagacagaggttgcagtgagctgagatcaccccactgcacaccagccagggcaacagaaagagactccgcctcaaaaaaaaaaaaaaaagaaagaaagaaagaaagaaatactcactggagcattttggatttcagattttcaactctggaatgtttaactggtataatgaaaatatcccaaaatttgaaaaaaatcccaaaatctgaaacagttctrgtcccaagcattacagataagggacagtcaaattgtacatacataaaataaatgaaagaacctgaaggcattgctaaaaaaaattaaagacatgaataaatgaattctgtgctcatgtattaaaaaacttaatacagttacgatggcaatactacccaaagttacctattcaaggtaatccctatcaaaatcccaatggcattttttgcagaaatggaaaaatccatccaaaaatttatatcaaatctcaagggacctcaaaaagcctgaaatggtttagatctgtgtccccatcaaatc

SEQ ID NO: 191051 - DNA, 601 bp, Human
cctcgtgatccacccgcctcggcctcccaaagtgctgggattacaggcgtgagccactgcactcggccgaggtcaggagttttgagaccagcctggtcaacatggtgaaaccccatctctactaaaaatagaaaaattagctgaacacggtggcaggtgtctgtaatcccagctacttgggaggctgagacaggagaatctcttaaaccaaggagacagaggttgcagtgagctgagatcaccccactgcacaccagccagggcaacagaaagagactccgcctcaaaaaaaaaaaaaaaagaaagaaagaaagaaagaaatactcactggagcattttggatttcagattttcaactctggaatgtttaactggtataatgaaaatatcccaaaatttgaaaaaaatcccaaaatctgaaacagttctggtcccaagcattacagataagggacagtcaaattgtacatacataaaataaatgaaagaacctgaaggcattgctaaaaaaaattaaagacatgaataaatgaattctgtgctcatgtattaaaaaacttaatacagttacgatggcaatactacccaaagttacctattc

SEQ ID NO: 191052 - DNA, 601 bp, Human
gatggctcacacctataatcccagcactttgggaggcaggaggatcatttggggtcaggagtttgtttgttttgagacggagtctcactctgtcaaccaggctggagtgcagtgacgcgatcttggctcactgcaagctccgcacggtggctcacgccattctcctgcctcagcctcccgagtagctgggactacaggtgcccgccaccacgcccggctaattttttgtactttttagtagagacagcgtttcaccatgttagccaggacggtctcaatctcctgacctcgtgatccaccygcctcggcctcccaaagtgctgggattacaggcgtgagccactgcactcggccgaggtcaggagttttgagaccagcctggtcaacatggtgaaaccccatctctactaaaaatagaaaaattagctgaacacggtggcaggtgtctgtaatcccagctacttgggaggctgagacaggagaatctcttaaaccaaggagacagaggttgcagtgagctgagatcaccccactgcacaccagccagggcaacagaaagagactccgcctcaaaaaaaaaaaaaaaagaaagaaagaaaga

SEQ ID NO: 191053 - DNA, 601 bp, Human
ctagctaatgttttcaattttttgtagacaaagggtctcactatgttgccagggctggtcttgaactcctgggctcaagcgatcttcccacctcagcatcagaaagtacagggactataggtgtgagccactgcactcagccccaattttagtttttgagtttctttcttgagtagttcaattttttaaaaattgatatttccagacttgtattcttagaggtcttccaaagaacaaaaataaaacgtgtttcacttaaaacggaaaattcaatctttgctgcaattactatttgggtccmtggggctctttcactaatctaagacacataatagaatcttggtgttcttacttttcctctaccttgagatatttcgctccttactcatcattacccatcaattatttccaattgtgcttttaaaacgctaaaataataagaaaatagaagaatgattaaatcacctagaaatgtgatgcaatagtgaaatacatgggcatccttcagttttcttactgcattgcccaaaggattacattactccttttcaagagatataaaagattggaagagtcttcttgttgtcttttaactttcatt

SEQ ID NO: 191054 - DNA, 601 bp, Human
actggctgggcacagtggctcacgcctgttatcccagcactttgggcggctgaggcaggcaaatcacttgaggtcaggagttcaagaactagcctggccaacatggtgaaaccctgtctctactaaaaacacaaaaaattagccaggcatggtggtacgtacttctaatcccagctactcgggagtctgagacaggagaatcgcttcaacctgggaggcagaggttgcagtaagccgagactgtgccattgcactccagcctgggcaacagagcgagagtttgtctcacaaaaaaaaaaamaaaaacttcccatctgtggagtttgtatacctggaaatgggccagaaaaaattgttttagagtatatcaacaaaatagaataccatgtagccatttaaaaaataacgatcaggcagggcacggtggctcacacctgtaatcccagtactttgggaggccaaggtgggcagatcactaggtcaagagatcgagaccatcctggccaacactgtgaaaccccatctctactaaaaatacaaaaattagctgggcgtggtggcacccacctgcagtcccagctactagggaggctgaggcaga

SEQ ID NO: 191055 - DNA, 601 bp, Human
tgtctatcttttgatccagcaattcaacctcaagaaaatgtacacacagcactatctgtaacagcatagagcaaaaaaataaaaccaaaaaaataaataaataactggctgggcacagtggctcacgcctgttatcccagcactttgggcggctgaggcaggcaaatcacttgaggtcaggagttcaagaactagcctggccaacatggtgaaaccctgtctctactaaaaacacaaaaaattagccaggcatggtggtacgtacttctaatcccagctactcgggagtctgagacaggaraatcgcttcaacctgggaggcagaggttgcagtaagccgagactgtgccattgcactccagcctgggcaacagagcgagagtttgtctcacaaaaaaaaaaaaaaaaacttcccatctgtggagtttgtatacctggaaatgggccagaaaaaattgttttagagtatatcaacaaaatagaataccatgtagccatttaaaaaataacgatcaggcagggcacggtggctcacacctgtaatcccagtactttgggaggccaaggtgggcagatcactaggtcaagagatcgagaccat

SEQ ID NO: 191056 - DNA, 601 bp, Human
tggtttgccagaggatgttttcctcagtgtctgttcgaccttcagcttttttggtcttccttttacgctgcatctgagctggtctgcctccacgttcttgcgccttacaccgatctccagtgtcacctgtcagtccacagctgttagcctcgtatgggtgggaagattctctgacattaggattaagccttggtcttgggcaaacactgtcttccttggtgactggggtgtggccttctcagtgctcctgccctttctcctccactaaagttctgggcctagcacatattcctgtccctcrccaaggacgaaagactttttttctgttctctttccacagtggtttaaggctcttatctcataggagcaaagaagggaagaaggactcagacagggcttcgtgtctttccaaaaggatctactgtccctctcctccagggggaacagtaagggacactttctcagtacccacacccttgcctcaatcttttttgtaagcatccaatgaaatctgtggagaagagcctgtgagtggatacaaactccccctgtgtctgcagccccccaggcgatctctgttttcttgctggtccacactaag

SEQ ID NO: 191057 - DNA, 601 bp, Human
tgttgaagacatttttcacctatgttactgtcattttcatttttagcatttattttattttcttacagtgtctatctctctgctgaaatatcctacctgaccatacaagttgcctgccttttctactagagattttaacatactgaacagttattttagattccatgtctggtagttccaaagaatttggtcttaaaaatgtcctgtctcaattccatgtctggtagttccaaagaatttggtcttaaaagtgtcctgtctcaatagtgtgttgttcttccttccttctttttatgcctcaaaacttttttgaaagcaggatatcctttgtaagacagctaagactgaggtaaatagtttttatgcctgggaaatgggcccgcctttccttctgccagatctttagtgtgtggaggttgagtcaatctattgtcagaacagaagcgtggtttggaatttgttgctgccatggttacccacaatgtaccaccagcttcgaactgtgttagggtagtggctggtttgccagaggatgttttcctcagtgtctgttcgaccttcagcttttttggtcttccttttacgctgcatctgagctggt

SEQ ID NO: 191058 - DNA, 601 bp, Human
tagtgtgtttagaccatttacatttaacacaatgattaatgtagttggaataaaggctataatcttcaccactgtctctatctgttccatctgctccttgtgttttccttctgtctccgtgttcatttagattagctggatacatttgtatgattccattttatctccactattggcttattacatttttttcaaaaaatgtttttagtggttgacctaggtttacaacatacatatttaattaatcagagcctagcttagagtaagtcatagcatttcatatgtcatgtaaagacattaraacagtatactagaccaattattgatcccttctgacctttaagctaatttgtcataaattttatttcccataacacgccctaaacacaaaatatattgttaatatttttgatttatggtcatctttcagagaaattagaaaaatatttttaaataataaaaactctatctcctagaaacgtatttgtatagatccaaatgtctaatgtcatacctcttcttcctgaacaacttcctttaatatttccagtagtgcaggtctgatggcaatgaattctctccatttctgtttctctgagag

SEQ ID NO: 191059 - DNA, 601 bp, Human
tgtgcccagggaggtcaaggctgcagtgagctgtgatcatgccactgcactccagcctatacagtgagactctgtctcaaaaaatacataaataaaataatttccaaatggacagtctccaaatatagctactagctctgttattgatttctagcctaattccattacggctcacacacatcgttcacgtatagtcagcctttggtatccatgggggattggttccaggactcatacagataccaaaatctacagatgctcaagtctctgatatcaaatggtatagtatctacatataacytatgcctatcctcccatgcactttaaataatctctggattacttacaatgcctggtacaatttaaacaccatgtaaatagttatactgtattgtttagggaataatgacaaggaaaacgtctgtatgtgtttaataaagacaaaatttttttccaaatattttcagtctatagttggttgaatccacagatgcagaaccaaaagacatggagggccaatgatactttcaattctttcaaatacaattaaagcttgttttgtgggccagaataccatccatcttggtgaatattccagatg

SEQ ID NO: 191060 - DNA, 601 bp, Human
ttcctcaaaaagttaaccacagaactaccatatgatgtagcaattctactcctaggtatatacctaagagaaatgaaaacacatgtccacacaaaaacttgtataggtatgttaatagcagtattattcacaacagccaaaaagtggaaaaacccaaatatccatcaactgatacatgaaaagtgtatggccatacaatagaatttttttttttactataagcacttaatgctctttatttccctataagcactgctatagctgcatcccatgaattttgatacactgtgctttcactttyatttaatgcaacaatgtttttacctccctgtgatttcctccttgaaccataggttacttaaaggtatttaatttcaggctgggtgtggtggctcacatctgtaatcctagcactctgggaagctgaggtaggcagatcacttgagcctaggggttcaagaccagactgggcaacactgcaaaatcccatctctacaaaaaaatacaaacattagccaggcatggtgacacacacctgtagtcctagctactggggaggctgagataggaggatcgcctgtgcccagggaggtcaaggctg

SEQ ID NO: 191061 - DNA, 601 bp, Human
aagaggcaggcaagagagcctgagtcaaggtggaagcagaggtcagagtgatgctgggacacaagccaagaaattcgggtagcctctggaagctgaaaaggcaagaaaacgaattcttcccatgagtatccagaagtgcagccctttttacccatttaagacttctgacctccagaacagtaagataatacgtttgtgttgttttaagccatgaagtttgtagtaacatcttacagcagcaacaggaaactaatacacactgcttgaaaattttctttttaaaaaagtactggcctggccrggcacagtggctcacgcctgtaatcccagcacttttggaggctgagggaggcggatcacgaggtcaggagtttgagaccagcctgaccaacatggtgaaaccccatctctactaaaaatgcaaaaaaaaaattatccgggcgtggtggcacacgcctgtaatcacagctactcaggaggctgaggcaggagaatcacttgaatccaggaagcagaggttgcagtaaccaagatcgcactactgcactcaagcctgctgacaaagcgagactccacctcaaaaaaaagaaaaaagtattgg

SEQ ID NO: 191062 - DNA, 601 bp, Human
ttgaccccaaaagttcaggcaacaaaagcaaacatagacaactgggattacaacaaaccaaaaagctgcagcatggcaaagtaaacagactgaagagacaacctacaaactgggagaatatatttgcaagcaatacatctaatatgggtttaatatacaaaatatagggcaggtgccacaactcatgcctataatcccagcactttgggagggcgaggcaggaagattgcttgagcctaggagtttgagaccagcctgggcaatatagtgagacctcgtctctacaaaaaatgttttaagwttagccaagtttggcagtacatatctgcagtcccagctacttaggaggctaagatgacaggatcacttcagcctgggaggtggaggctgcagttagctgagatcatgccgctgcattacaatctgggcaacaaaatgagacgctgcctctaaaaaagaaaaaaaaattatatatattttccatatatatggaactcaaaataatagcaaaaaaaaaaaataacctgatttaaaaattggcaaaagatctgaatattgtctgaaaattcagaaatcctgaaatgtcagaaatattcagaca

SEQ ID NO: 191063 - DNA, 601 bp, Human
tggattctgaattggaagaattaatactgttaaaatgtccatactatccaaagtgatccacagattcaatgcaatccctataaaaattccaatgtcatttttcacataaatagaaaaaataattctaaaagtctaatggaaacacacaaaaaaactgaatagccaaggcaatcttgagcgaaacaaacaaaactagaggtaccacactacttcaaactatattacaatgctacggtaatcaaaacagcatgggactggcataaacaaaagcccagtaatgaacccatgcatttacaatccrctgatctttgacaaaggtgccaagaacacacaatgggaaaaggacagtctcttcaataaagggtgtcgggaaaactgaatatccacatgcaggagaatgaaatgaggccactgtctcacaccatatagaaaaatcaactcaaaatggattgaagacttaaacataagacctgaacctgtgaaaatactacaagaaaacacagggaaaacaacacaacactggtcagggcaatcattttttggatttgaccccaaaagttcaggcaacaaaagcaaacatagacaactgggattacaacaa

SEQ ID NO: 191064 - DNA, 601 bp, Human
ttccctttttttttttttcctccagtttttcttctttctctcactttctggcggtactaaaagatgttccaggctcatcttgtatttcccctcatttggaatcaatgatttcttcaaggattcctgacttgttttattatagaatggtatttaaaaaccaagatctacatattttgggtttttaaaaatagcaatctcttttttgaaaacaaaatgatcaagggacatcaaatttaaaggcagacactttattatggcagaagacagccaagtatcatgaaagtcaggcacactctaaacygtaagggtaaataaaatcagaactgatttagaaatctactctcttagcagaaaagaggagaaaacagactagaatttaaaagctcagatttgatcctttcatttcaaaagacccttccttgtcccacatgagttaagaataaaaaactgtgtaactgccatagaagggaagaaaatgagccaacttaccaatgaggctttgcttaaaattcccaaataacgcactcacattttgtctgtgcttagccctttcccgtaaatgcaaaagtagcacaacagtgtggtgcaggcctcagagcca

SEQ ID NO: 191065 - DNA, 601 bp, Human
agggtttcatcatgttgccaaggctggtctcgaacgtctagactcaagcgatccacctgccttggcctcccaaagtactgggattaccagcctgagccactgtgcccaacctccaacttgtttttcaattatttaatttagcagactcatggatattactgtacagatttatatctacatatttattacacagataatccatgacgatcagtatttatttatttatttattttatttatttattttatttattttgagatggagtctcgcactgtcacccaggctggagtgcagtggtgcratctcggctcactgcaagctccacctcccgggttcacgccattctcctgtctcagcctcccgagtagctgggactacaggcgccagccaccacgcccagttaactttttgtattttttagtagagacagggtttcaccgtgttatccaggatggtctcgatctcctgatcttgtgatctgcccgcctcagcctcccaaagtgctgggattacaggcgtgagccaccgtgcccagccgacgatcagtatttattttgtggttcaaacatcccagctctaatcactaagatttccttcatgt

SEQ ID NO: 191066 - DNA, 601 bp, Human
caagtggctggggactacaggcacataccaccacaccaggctaacttttgtatttttagtaaagacagggtttcatcatgttgccaaggctggtctcgaacgtctagactcaagcgatccacctgccttggcctcccaaagtactgggattaccagcctgagccactgtgcccaacctccaacttgtttttcaattatttaatttagcagactcatggatattactgtacagatttatatctacatatttattacacagataatccatgacgatcagtatttatttatttatttattttatttatttattttatttattttgagatggagtctcgcactgtcacccaggctggagtgcagtggtgcgatctcggctcactgcaagctccacctcccgggttcacgccattctcctgtctcagcctcccgagtagctgggactacaggcgccagccaccacgcccagttaactttttgtattttttagtagagacagggtttcaccgtgttatccaggatggtctcgatctcctgatcttgtgatctgcccgcctcagcctcccaaagtgctgggattacaggcgtgagccaccgtgcccag

SEQ ID NO: 191067 - DNA, 601 bp, Human
cctcccaagtggctggggactacaggcacataccaccacaccaggctaacttttgtatttttagtaaagacagggtttcatcatgttgccaaggctggtctcgaacgtctagactcaagcgatccacctgccttggcctcccaaagtactgggattaccagcctgagccactgtgcccaacctccaacttgtttttcaattatttaatttagcagactcatggatattactgtacagatttatatctacatatttattacacagataatccatgacgatcagtatttatttatttatttattttatttatttattttatttattttgagatggagtctcgcactgtcacccaggctggagtgcagtggtgcgatctcggctcactgcaagctccacctcccgggttcacgccattctcctgtctcagcctcccgagtagctgggactacaggcgccagccaccacgcccagttaactttttgtattttttagtagagacagggtttcaccgtgttatccaggatggtctcgatctcctgatcttgtgatctgcccgcctcagcctcccaaagtgctgggattacaggcgtgagccaccgtg

SEQ ID NO: 191068 - DNA, 601 bp, Human
aggaacgaaaaaaggaaaagctctctgagccccgaggcttcacagagcctcacactcacaactgccccacgcactgaggggatgcaccttcccttcctttcttcccaccccagaccctcacccagcgccgccctccttttcttccagagccaagaacttcccacggtccgtttacaaatgataaatgaagtaggcatctgatactgtgctaggccagatttctttccttttccccttttccttccttccccctttctctctcatttcagtacacgctgcataaagcaaatgatgcccacayaggcaggactctggtgataccatggaaatcggtttactgccacctaccctgaagcttttcattgcaggtgaccaatggcaaaagtggcaaaatctactacaaagaattcaacctgagcataaagttatttaaatccaaaatgtctctaaataagattttttaatttccatagatacattaggggttctttctactacacacccactgaacgttcatctgcacacattatggacatgacctaactgataacaactgtgtgcatgattgtctcggcctctctaagctccttgagagcaggga

SEQ ID NO: 191069 - DNA, 601 bp, Human
attataatccccattttacagttgagggaactaaaatttagggaggttaagtgacttccctaagttttaaaaaggtcactcgattctgtatggagaatgctttggacagaagctatggtggaagcagtgaggcacatcaggctttggaagttgacaagtggtgatgatggcctggactagaacaataacaggagatgaaatgtagacagaattgggatattgacggagtaggatcaaccaacaggctttgtttatgggttgatgtttggggcaagggaaaggaaggattcaaggacgactrcctcatgggggactgagcaaacctaggtatttggtagtgctactggtaaaggggaaatggaaagaaaaactgtggagatgctgagaatcatgagttgatttttggacatttcagtgatcagtttacatgtctgtctccctttttaaggtcaattctaaagttagagaccataatgaaacttggctttgtgtactccctctctttctccacattttctccctgctcacaaggagtcagatgcctagaaatgttgcgtgcaataagaaatgaaaataaaatgctttaaaaaaatgtacaaag

SEQ ID NO: 191070 - DNA, 601 bp, Human
actggtgtgcaccactgtgcctggctaatgtttgtatttttagtagagacggggtttcaccatgttgcccaggctggttacaaactcctgagttcaagtgatccactcacctcagcttctcaaagtgctgggattatagacgtgagccactgcgcctggcctcaatggtttctttacataccaatactctagatattaaactacttttgtattggccagagataaaatagattaaattatgtgttgtattgaataacacctgaatcaacagttaatactggcaagttggaggagccgtgattttttttttaaagtcatacttcttctctaagcaactttaaattgctagggtttttaaagaatattgggccaagcaaggtggctcatgcctgtaatcccagcactttgggaggccaagttttctttttttaatatatattttttcttttttttttttttttttttttttgctacctttggattcttgatagtgagcttccaataattatttcttaacagcatttaagtctgatttacacatcatactttataccagcagcagggctggttatgcctgtactaatattcagacatatattga

SEQ ID NO: 191071 - DNA, 601 bp, Human
gctggttatgcctgtactaatattcagacatatattgaaaaactagccttgtctttttctactgtgtaaaaacctttattgtcaatacattttacttgtacttaagctaaattttttttctttttttttttgagatggagtctcactctgtcacccaggctggagcgcagtggtgcagtctcagctcactgcaacttccgccttctgggttcaagtgattctcctgcctcagcctcctgagtagctgggactacaggcatgaaccaccatgcccaagaaaggaggatcatttggaaaaaawatatatatattatctgatggcccacatctgtggtcccagctacttgggaggctgacatgggacgactgcttgagccctggaggttgtggctgcagtgagctgttatcaactgctgcactccagcctgggcaagagagtgagaggccatctgaaagaaaaaaaaaaaaaaggcaagaatatacatctatctgttttcagtttaaaataaaacatttaagtctatatatgtttttttctttttttttgagacagagtttcactctgttgcccaggctagagtgcaatggcatgatctctgct

SEQ ID NO: 191072 - DNA, 601 bp, Human
agcgagactctgtctcaaaaaaaaaaagaagagcaacaccctgtctcttaaaaaaagaaggaaaaaaaaaagaaaatattcaggaaaaaaatggataaatggatgtttgtctgtctgtcccgaacatctacaggcttttttccccgtcgttagtccataaacaataaagtatagcaactatttatagagcctttacattgtattgggtagtatatgagtcatctatagatgatttaaagtatgtgggagcatagactgtatgcaaacactgtgccattttatatcagggacttgagcatcygtggattttggtatactcaggagtcctggaaccaataccccatgaatactgagggatgactattatatgaacaaaatcataagacagttgtataacttctactatacttttccagtacaaataatcttctaatgtgttataatttattaggagtatcaagaaaaatgttttgggttgggcatgttggctcatgcctgtaatcctagcactttgggaggccaaggcaggaggatcacgtgagctcaggagttcgagaccagcctagtcaacatagtgagacctcatctcttaaaaaaaaag

SEQ ID NO: 191073 - DNA, 601 bp, Human
ttgtattgggtagtatatgagtcatctatagatgatttaaagtatgtgggagcatagactgtatgcaaacactgtgccattttatatcagggacttgagcatccgtggattttggtatactcaggagtcctggaaccaataccccatgaatactgagggatgactattatatgaacaaaatcataagacagttgtataacttctactatacttttccagtacaaataatcttctaatgtgttataatttattaggagtatcaagaaaaatgttttgggttgggcatgttggctcatgcctrtaatcctagcactttgggaggccaaggcaggaggatcacgtgagctcaggagttcgagaccagcctagtcaacatagtgagacctcatctcttaaaaaaaaagttttgaattttaattttagtttttttcctttatcaggaatcaaggattttcttttgctttgtggccggattttgctactgcttgctcttcttactttaattatttctgtgactacctcatggcttaactcatttaaatctccccaagtttatctgaagggtaagtttattatttattctaccctgttataccattct

SEQ ID NO: 191074 - DNA, 601 bp, Human
cctagcactttgggaggccaaggcaggaggatcacgtgagctcaggagttcgagaccagcctagtcaacatagtgagacctcatctcttaaaaaaaaagttttgaattttaattttagtttttttcctttatcaggaatcaaggattttcttttgctttgtggccggattttgctactgcttgctcttcttactttaattatttctgtgactacctcatggcttaactcatttaaatctccccaagtttatctgaagggtaagtttattatttattctaccctgttataccattctactcwaatttatttattctagaactttgcacagtaagagccattttactattaatttgtgatgtgtagtttcagggagagtaatcagtacaactttagtcatgattttttgtgttggtttttaaacattagtgatgattgttttgcatggagtatatcccaacatttttatgagaaattgtacatttttcttatatatgtgttttaaagctatatcatttctaagttgttatatggtaaattccctaattttaaattgtgtgtttgtgctgcttaactgccatttgatacctacagtttatgagc

SEQ ID NO: 191075 - DNA, 601 bp, Human
tgctgggattacaggcatgagccaccatgcccagccaaaactgaccaagctgttcagtgacatttagtacattcacaaggctgtacaactaccacctctgttccatcttctgtaaagaaaaccgtatactctttaaacagtcactccccactctgccctcatcccatcctctgaaaaccaccaatctgctttctgttggtatggatttacctattgtggatgaataatattccattgaatagatataccacttttttttttttttttttttgagactgggcctctctctgttgcccaggcyggggtggagtggtacaaccatacctcactgtcgcctcaaattcctgggttcatgggatcttcctgcctcagcttcctgggtagctggaactacaggcacacacacaccaccatgctcagctaatttttaaaaaattttgggccaggcgtggtggtgcacgcctgtaatcccagcactttgagaggctgagacgggtggatcacgaggtcaagagatcgagactatcctggccaacaaggtgaaaccctgtctctactaaaaatacaaaaattagctgggcgtggtggcaggcacctgtag

SEQ ID NO: 191076 - DNA, 601 bp, Human
agcagccaaacagggtggcagtggctctgttcagccagcagggttcttacttggttcttatttacaactttatagacagtgtacatttttaggaacattaatggatagtaacaacacctaatttgttgttttcaacaggccagcagatacatagagaatgttttaaaacctcaccaggaaatgaaattgagaaaactggaggagcgcttttatcaaatgacgggtgaagcctggaaattaagcagtggtcacaaacttggggttggaaaatattctcattttatattttgaatcctcttastatgtttcctattacatgattgatttttaattgaaaatgatgttagactgcttttaggagtttttattgataatgattatcagtttttgttcagcatacttgtttattacatggttaaggggttggtcgttttttttttttttttgagatggagtcttgctttgttcccctaggctggagttcagtggcacaatctcggctcactgcaagctccgcctcccaggttcatgccattctcctgcctcagcctcccgagtagctgggactacaggcgcctgccaccatgcccagctaattttt

SEQ ID NO: 191077 - DNA, 601 bp, Human
ttcaacaggccagcagatacatagagaatgttttaaaacctcaccaggaaatgaaattgagaaaactggaggagcgcttttatcaaatgacgggtgaagcctggaaattaagcagtggtcacaaacttggggttggaaaatattctcattttatattttgaatcctcttactatgtttcctattacatgattgatttttaattgaaaatgatgttagactgcttttaggagtttttattgataatgattatcagtttttgttcagcatacttgtttattacatggttaaggggttggtcgttttttttttttttttgagatggagtcttgctttgttcccctaggctggagttcagtggcacaatctcggctcactgcaagctccgcctcccaggttcatgccattctcctgcctcagcctcccgagtagctgggactacaggcgcctgccaccatgcccagctaattttttgtatttttagtagagatggggtctcaccgtgttagccaggatggtctcaatctcctgacctcatgatccgcccgcctcaccctcccaaagtgctgggattacaggcgtgagccactgagcccagctggt

SEQ ID NO: 191078 - DNA, 601 bp, Human
tttttttttttgagatggagtcttgctttgttcccctaggctggagttcagtggcacaatctcggctcactgcaagctccgcctcccaggttcatgccattctcctgcctcagcctcccgagtagctgggactacaggcgcctgccaccatgcccagctaattttttgtatttttagtagagatggggtctcaccgtgttagccaggatggtctcaatctcctgacctcatgatccgcccgcctcaccctcccaaagtgctgggattacaggcgtgagccactgagcccagctggtctttrtttttaaaagacagtctctctctcttgccctggctggggtgcagtggcacgatcatagctcactgcagcctcaaactccagggctcaagggatcctcctgcctcagcttcttaagtagctgggactataggtgcaccctaccatggactgcacctggctggttaagtggtttttggtgcctaaagagcatataacttggttccttaaaaagctgttgtggtggctaacgcctgtaatcccagcaatttggaaggatgaggcaggcagattgcttgagacgaggagtttgagaccagcctg

SEQ ID NO: 191079 - DNA, 601 bp, Human
agtggagattgagcaggggaatcagattattgaactatcactgacctttgaaaaagatcgatatgaactaaacggactgattaaaaattcatgtttgtgttttgttaatgacactgtcttatgctgatggcagattttacttgacagtcacatatgcttttgataccaaaggaaaacaaatgagttatttagcaaatgcaggtaaggttagattaaatgttataaaatatactctatggtattaataaagagttcctggagatgaagtcattggtaacaaatgttttttttttttgttttktttttttttgtttttttttttgagacggagtctcactttgtcacccaggctggagtgcagtggcgtgatctcggctcactgcaagctcctcctcccggcttcacgccattctcctgcctcagcctcccgggtagctgggactacaggtgcccgccaccacgcccggctaattttttgtatttttagtagagacagggttccatcgtgttggccaggatggtctcgatctcctgacctcatgatctgccctcctcggcctcccaaagtgctgggattacaggcgtgagccaccacgcccgg

SEQ ID NO: 191080 - DNA, 601 bp, Human
aactctttatagatgtatgaagaaaagatataagtaagcttagatgtgtgtctaaactctgtattgagaggaactcttctcattgacacttttgcttgttgaacatgtttacattcctcttaccaatacttttctttagattcctgatttacctgaagaaccttctcaaacagcagaagaagtaagtctatttttctcttcgaaaattaaacttattttctattttctttgcttaacatccattaaatatgtcttatctaaacttgggtttagaaagaagtgatagcataagtgttcatgkgattatactgtaactaggtcttttttagaacatagagacagggtctcactatgttgcctaggctggccttgaactcctgggctcaagtgatccacccgcctcagcctcctgggtagctgggtcttacttggaatgtagtgtagtatcaaattcctcaacatgagtactattttgcaagcctgctgtctgctgagttgtctttttttttttttgagatgaagtcttgctcttgtcacccaggctagagtgcaatggcatgatctcagctcactgcagcgtccgcctcctgagttcaagtga

SEQ ID NO: 191081 - DNA, 601 bp, Human
atgagtactattttgcaagcctgctgtctgctgagttgtctttttttttttttgagatgaagtcttgctcttgtcacccaggctagagtgcaatggcatgatctcagctcactgcagcgtccgcctcctgagttcaagtgattctcctgcctcagcctcccaagtagctgggattacaggcatctgccaccacatcgggctagtttttgtatttttagtagagacggggttttaccatgttggccaggctggcctggaactcctgacctcaagtgatctgcctgtcttgacctcccaaagygctgggattacacccacccactgcctcaggcataggacacgtgggcttttccagaactttaggtcagaaaatgcgttgcttactaaaacagaatcaaaataggcatatgtccgagcactttgggaggccaagaggggaggattacttcagcttaggaattcaagaccagcctgggcaacatagtgagacgctgtcgctacaaaaaggaaaaaaaaaaggaaaaaaaactaggcaaatgacttcaaattgcagttctccttttcaaaggagaaaatgaagagggcgactactttgtagatg

SEQ ID NO: 191082 - DNA, 601 bp, Human
tttactatttatgtatgatagttattttttataaggaacttaaatcaaggaagagataaacatctcagaagactggcagggaaagaaacacatgaatatcatgatttcccgaagaagactcagtgatagataaatatatgaaaaaaatgtttggcctcacatagaatcaatgaagtacaaataaaatgaaacagtattttctacttaactagactgtcaaagattaaaaagaaatagtacccagatttggcaaatgtgttgggaaaacagggattcttaaaactttaatagttttttggcygggtaccatggctcacgcctgtaatcccagcactttgggaggctgaggcaagcggatcatgaggtcaagagatcaagaccatcctggccaacatggtgaaaccttgtctctactaaaaatacaaaaattagccggacgtggtggtgcgtgcctgtagtcccagctactcaggaggctgaggcaggagaatcgcttgaacccaggaggcagaggttgcagtgagccaagatcgtgccactgcactccagtctgggagacagcaagactccatcacaaaaaacaaaacaaaacaaaaccttt

SEQ ID NO: 191083 - DNA, 601 bp, Human
ttaatggattttatttaggaaagaactcatgggagaaccaatcttaaacttctgccgtgcacagtggctcacgcctgtaatcctaacactttcggagaccaaagcaggaggattgcttgagtccaggagttcaataccagcctaggcaatgtagtgagaccctatctctataaactgaaaggaaaagaaaaagaaaaagacagaaagacaaacttctattgggcatcgccaagggtgagatctcaatcctatggcttaccacaaaactactttcactgagtcactggtttgctcaaacccrcccctgcccccatagttcactgtgtgtccagaaactccacatttttcaaaccacaacctacccatcagcttctcatctcttatttctattaaagagacactctgtgctccaaatttgattacacaacatatcccgttttgatgcctaggcctgggacccatcttttgaggttccgaatgtcaaagaatactacccaaccccccaccttttttttttttttttttttttttgagacagagtctcactctgttgcccacactggagtgcagaggcatgatcttggctcactgcaacctctgc

SEQ ID NO: 191084 - DNA, 601 bp, Human
ctagacacacattctaatttgaaccttccgtgtgagttcattcaccacaactttaaaacttccccaagcgttagaaattaatggattttatttaggaaagaactcatgggagaaccaatcttaaacttctgccgtgcacagtggctcacgcctgtaatcctaacactttcggagaccaaagcaggaggattgcttgagtccaggagttcaataccagcctaggcaatgtagtgagaccctatctctataaactgaaaggaaaagaaaaagaaaaagacagaaagacaaacttctattgggyatcgccaagggtgagatctcaatcctatggcttaccacaaaactactttcactgagtcactggtttgctcaaacccgcccctgcccccatagttcactgtgtgtccagaaactccacatttttcaaaccacaacctacccatcagcttctcatctcttatttctattaaagagacactctgtgctccaaatttgattacacaacatatcccgttttgatgcctaggcctgggacccatcttttgaggttccgaatgtcaaagaatactacccaaccccccaccttttttttttttttttt

SEQ ID NO: 191085 - DNA, 601 bp, Human
ggtgacagagcaacaaacacacacacacacacacacacacccccaggtctgctgggacctagtacaggagactggtccaaaacaatggcctcccataaactttaacggttgaacaattaaatgaaggaacactgataaaacaatgaaaaaccaaccaatctcactacctgtaaatgaccactgctagacacacattctaatttgaaccttccgtgtgagttcattcaccacaactttaaaacttccccaagcgttagaaattaatggattttatttaggaaagaactcatgggagaaccartcttaaacttctgccgtgcacagtggctcacgcctgtaatcctaacactttcggagaccaaagcaggaggattgcttgagtccaggagttcaataccagcctaggcaatgtagtgagaccctatctctataaactgaaaggaaaagaaaaagaaaaagacagaaagacaaacttctattgggcatcgccaagggtgagatctcaatcctatggcttaccacaaaactactttcactgagtcactggtttgctcaaacccgcccctgcccccatagttcactgtgtgtccagaaactccac

SEQ ID NO: 191086 - DNA, 601 bp, Human
cccagctacttacgaggctgaggcacatgaattccttgaacccaggagacggaggttgcagtgagccgagatcaccccactgcactccagcctgggtgacagagcaacaaacacacacacacacacacacacacccccaggtctgctgggacctagtacaggagactggtccaaaacaatggcctcccataaactttaacggttgaacaattaaatgaaggaacactgataaaacaatgaaaaaccaaccaatctcactacctgtaaatgaccactgctagacacacattctaatttgaamcttccgtgtgagttcattcaccacaactttaaaacttccccaagcgttagaaattaatggattttatttaggaaagaactcatgggagaaccaatcttaaacttctgccgtgcacagtggctcacgcctgtaatcctaacactttcggagaccaaagcaggaggattgcttgagtccaggagttcaataccagcctaggcaatgtagtgagaccctatctctataaactgaaaggaaaagaaaaagaaaaagacagaaagacaaacttctattgggcatcgccaagggtgagatctcaat

SEQ ID NO: 191087 - DNA, 601 bp, Human
cagcctgctgttcactgatctttcaaagcccctacctctctctcccctaggcctctccaactgctgctgtgcagcatagttcactgtgacttggcaatcatgaacttttgtcacatgatcaacccttactacccaactctcattggtaagtactactcgccaaaaccacaagaacctagttattcttatcacagaatcagtacactcagcaggaacccaggaccgcaagttccccaggccctggggcaaagggagcagcaatttagaaacaacttttccttaagctgactctcccatcacrtgtgtaggcagagaagcgaaccacagaggcaaagctcccagaaggctctaattcaccttgactttgggcgatctttgcatttctctccagtctacacgagatcatgagataagcaatatacttaaccttttggagacttgaaatgctgaattcaagcaaggctcagtggtatctacctgcagaaccagctagtcgggaggttgaggtgggaggatcgcttgagcccaggagtttgaggctacagtgagctgagatcacaccactgccctccagcctgggaaacagagggagaccctgtct

SEQ ID NO: 191088 - DNA, 601 bp, Human
ttcagctttatcagggtatagacatcataatatcaaagtacacagtatcacttccaaatgaggttatgatttacatgttgctgggtaattgttttcagcctagatgaacaatgattcactgagcagcctgctgttcactgatctttcaaagcccctacctctctctcccctaggcctctccaactgctgctgtgcagcatagttcactgtgacttggcaatcatgaacttttgtcacatgatcaacccttactacccaactctcattggtaagtactactcgccaaaaccacaagaacctrgttattcttatcacagaatcagtacactcagcaggaacccaggaccgcaagttccccaggccctggggcaaagggagcagcaatttagaaacaacttttccttaagctgactctcccatcacatgtgtaggcagagaagcgaaccacagaggcaaagctcccagaaggctctaattcaccttgactttgggcgatctttgcatttctctccagtctacacgagatcatgagataagcaatatacttaaccttttggagacttgaaatgctgaattcaagcaaggctcagtggtatctacc

SEQ ID NO: 191089 - DNA, 601 bp, Human
tccagtgttcagctttatcagggtatagacatcataatatcaaagtacacagtatcacttccaaatgaggttatgatttacatgttgctgggtaattgttttcagcctagatgaacaatgattcactgagcagcctgctgttcactgatctttcaaagcccctacctctctctcccctaggcctctccaactgctgctgtgcagcatagttcactgtgacttggcaatcatgaacttttgtcacatgatcaacccttactacccaactctcattggtaagtactactcgccaaaaccacargaacctagttattcttatcacagaatcagtacactcagcaggaacccaggaccgcaagttccccaggccctggggcaaagggagcagcaatttagaaacaacttttccttaagctgactctcccatcacatgtgtaggcagagaagcgaaccacagaggcaaagctcccagaaggctctaattcaccttgactttgggcgatctttgcatttctctccagtctacacgagatcatgagataagcaatatacttaaccttttggagacttgaaatgctgaattcaagcaaggctcagtggt

SEQ ID NO: 191090 - DNA, 601 bp, Human
tgagaggctaaggtgggaggactgcttgagctcaggagttcgagaccagcagttcgagaccagcctgggcaacaaagcaagaccttgtctctactaaaaatttaaaaaatcagccagggcttggtggtggccatgtgcctgtggtcctgactactggggagactgaggtgggagggtcacttgagcttgggagttcaaggttgcagtgagctatgatcatgcccctgaactccagcctgggtgacacaatgagaccctgtctcaaaaaaaaaaaaaaagcatgtccagtgttcagctttaycagggtatagacatcataatatcaaagtacacagtatcacttccaaatgaggttatgatttacatgttgctgggtaattgttttcagcctagatgaacaatgattcactgagcagcctgctgttcactgatctttcaaagcccctacctctctctcccctaggcctctccaactgctgctgtgcagcatagttcactgtgacttggcaatcatgaacttttgtcacatgatcaacccttactacccaactctcattggtaagtactactcgccaaaaccacaagaacctagttattctta

SEQ ID NO: 191091 - DNA, 601 bp, Human
cttttagtaaattgcatttaataatgcatgttcaggctgggcacggtggctcatgcctgtaatcccagcactttgagaggctaaggtgggaggactgcttgagctcaggagttcgagaccagcagttcgagaccagcctgggcaacaaagcaagaccttgtctctactaaaaatttaaaaaatcagccagggcttggtggtggccatgtgcctgtggtcctgactactggggagactgaggtgggagggtcacttgagcttgggagttcaaggttgcagtgagctatgatcatgcccctgmactccagcctgggtgacacaatgagaccctgtctcaaaaaaaaaaaaaaagcatgtccagtgttcagctttatcagggtatagacatcataatatcaaagtacacagtatcacttccaaatgaggttatgatttacatgttgctgggtaattgttttcagcctagatgaacaatgattcactgagcagcctgctgttcactgatctttcaaagcccctacctctctctcccctaggcctctccaactgctgctgtgcagcatagttcactgtgacttggcaatcatgaacttttgtcaca

SEQ ID NO: 191092 - DNA, 601 bp, Human
tctatttcggagggctatctgtcaatattgcaggaactgatgacagagttcctttaaactgacctccttttagtaaattgcatttaataatgcatgttcaggctgggcacggtggctcatgcctgtaatcccagcactttgagaggctaaggtgggaggactgcttgagctcaggagttcgagaccagcagttcgagaccagcctgggcaacaaagcaagaccttgtctctactaaaaatttaaaaaatcagccagggcttggtggtggccatgtgcctgtggtcctgactactggggagrctgaggtgggagggtcacttgagcttgggagttcaaggttgcagtgagctatgatcatgcccctgaactccagcctgggtgacacaatgagaccctgtctcaaaaaaaaaaaaaaagcatgtccagtgttcagctttatcagggtatagacatcataatatcaaagtacacagtatcacttccaaatgaggttatgatttacatgttgctgggtaattgttttcagcctagatgaacaatgattcactgagcagcctgctgttcactgatctttcaaagcccctacctctctctccccta

SEQ ID NO: 191093 - DNA, 601 bp, Human
tctatgaaattctaaacccaggagacacattagggtaaccttctatttcggagggctatctgtcaatattgcaggaactgatgacagagttcctttaaactgacctccttttagtaaattgcatttaataatgcatgttcaggctgggcacggtggctcatgcctgtaatcccagcactttgagaggctaaggtgggaggactgcttgagctcaggagttcgagaccagcagttcgagaccagcctgggcaacaaagcaagaccttgtctctactaaaaatttaaaaaatcagccagggcwtggtggtggccatgtgcctgtggtcctgactactggggagactgaggtgggagggtcacttgagcttgggagttcaaggttgcagtgagctatgatcatgcccctgaactccagcctgggtgacacaatgagaccctgtctcaaaaaaaaaaaaaaagcatgtccagtgttcagctttatcagggtatagacatcataatatcaaagtacacagtatcacttccaaatgaggttatgatttacatgttgctgggtaattgttttcagcctagatgaacaatgattcactgagcagcctgc

SEQ ID NO: 191094 - DNA, 601 bp, Human
aacacgggaggcagaggttacagtgagccaagatggtaccactacactccagcctgggtgacagccagactctgtctcaaaaaaaaaaaaaagcattctctgtggttacttttcaaagtatgttttacaaagaaatagacaccctgaaggattcagaggcagtctatcttttcctagccctgcagatttagtgggttttgaggcagatggcaaagcaacagtatatgaagactagtacaaaaaaaggaagcagtcaacaaggtaagttaaaagccaaatttcaacaatagcatttgcttgytttaactagccccaccctttatggccactcctttatttgtcacttatgaatatgggtgggccccattctatgaaattctaaacccaggagacacattagggtaaccttctatttcggagggctatctgtcaatattgcaggaactgatgacagagttcctttaaactgacctccttttagtaaattgcatttaataatgcatgttcaggctgggcacggtggctcatgcctgtaatcccagcactttgagaggctaaggtgggaggactgcttgagctcaggagttcgagaccagcagtt

SEQ ID NO: 191095 - DNA, 601 bp, Human
gtgagacttcgtgtcaagaagaaaaaaaaaagccaaagggtatcagtatttccatatcattcctttagtttccctctataaaaaaagttcttggattcttggacagacacggtggctcatttctataattccagcactttggaaggccgaggtgggtggatcggttgaggtcaggagttcgagaccagcctggccaacgtggtgaaacctcatctctacaaaaaaaaaattagctgggtgtagtggcacacgcctgtagtcccagctactcaggaggctgggcaggagaatcgcttgaacmcgggaggcagaggttacagtgagccaagatggtaccactacactccagcctgggtgacagccagactctgtctcaaaaaaaaaaaaaagcattctctgtggttacttttcaaagtatgttttacaaagaaatagacaccctgaaggattcagaggcagtctatcttttcctagccctgcagatttagtgggttttgaggcagatggcaaagcaacagtatatgaagactagtacaaaaaaaggaagcagtcaacaaggtaagttaaaagccaaatttcaacaatagcatttgcttgtttt

SEQ ID NO: 191096 - DNA, 601 bp, Human
aatagcctgtagtctcagccagttgggaagctgaggcaggaggatcacctgaacccaggatattgaggctgcagtgagccatgatcgtgccactgcactacagcctgggcgacagagtgagaccctgcctcaaaaaacaaaaaaatttaaaaaataaaaataattgttactctggggcatccggggagaagaagagttttgtgagacaactcttctggatgtcagtccccactattacctgatacccaccatctcccgtcccccaaaaagaaaaggacctaggacctccacatcctattargctggtgcaaaagtaactgcagtaatatttaatgttgcaacacctagtgaatagaaggtaatgaattctcactgactggaagccacttacaaatgccaaagtggtccgggcatggtggttcaggcctgtaatcccagcactttgggaggccaaggcgggcggatcacttgaagtcaggagtttgacaccagcttggccaacatggcaaaactcagtctctactaaaaatataaaaaaattagccaggtgtggtggcgggcacctgtaatcccagctactcaggaggctgaggtaggagaa

SEQ ID NO: 191097 - DNA, 601 bp, Human
ttgttcaattcttagctaagcagaacattaacctgaaccttccagtctcaggaaatcaccagatttttaaaaagtgtgactgggtgccgtggctcacacctgtaatcctagcacttttgacgggtcaagactggaggatcctttgagcccaggagtttgagaggagcctggacaacacagcgagaccccatcaccacaaataatagcctgtagtctcagccagttgggaagctgaggcaggaggatcacctgaacccaggatattgaggctgcagtgagccatgatcgtgccactgcactmcagcctgggcgacagagtgagaccctgcctcaaaaaacaaaaaaatttaaaaaataaaaataattgttactctggggcatccggggagaagaagagttttgtgagacaactcttctggatgtcagtccccactattacctgatacccaccatctcccgtcccccaaaaagaaaaggacctaggacctccacatcctattaggctggtgcaaaagtaactgcagtaatatttaatgttgcaacacctagtgaatagaaggtaatgaattctcactgactggaagccacttacaaatgccaa

SEQ ID NO: 191098 - DNA, 601 bp, Human
aagcaagaaaatcaatggatacatttgcaagagatattaacaaaggctgtttttgttcaattcttagctaagcagaacattaacctgaaccttccagtctcaggaaatcaccagatttttaaaaagtgtgactgggtgccgtggctcacacctgtaatcctagcacttttgacgggtcaagactggaggatcctttgagcccaggagtttgagaggagcctggacaacacagcgagaccccatcaccacaaataatagcctgtagtctcagccagttgggaagctgaggcaggaggatcayctgaacccaggatattgaggctgcagtgagccatgatcgtgccactgcactacagcctgggcgacagagtgagaccctgcctcaaaaaacaaaaaaatttaaaaaataaaaataattgttactctggggcatccggggagaagaagagttttgtgagacaactcttctggatgtcagtccccactattacctgatacccaccatctcccgtcccccaaaaagaaaaggacctaggacctccacatcctattaggctggtgcaaaagtaactgcagtaatatttaatgttgcaacacctag

SEQ ID NO: 191099 - DNA, 601 bp, Human
aaaagagaaaaaaaaaaaagcagtctgtgtaaagcagaatctaaagcaagaaaatcaatggatacatttgcaagagatattaacaaaggctgtttttgttcaattcttagctaagcagaacattaacctgaaccttccagtctcaggaaatcaccagatttttaaaaagtgtgactgggtgccgtggctcacacctgtaatcctagcacttttgacgggtcaagactggaggatcctttgagcccaggagtttgagaggagcctggacaacacagcgagaccccatcaccacaaataatarcctgtagtctcagccagttgggaagctgaggcaggaggatcacctgaacccaggatattgaggctgcagtgagccatgatcgtgccactgcactacagcctgggcgacagagtgagaccctgcctcaaaaaacaaaaaaatttaaaaaataaaaataattgttactctggggcatccggggagaagaagagttttgtgagacaactcttctggatgtcagtccccactattacctgatacccaccatctcccgtcccccaaaaagaaaaggacctaggacctccacatcctattaggctg

SEQ ID NO: 191100 - DNA, 601 bp, Human
gaaaaagagaaaaaaaaaaaagcagtctgtgtaaagcagaatctaaagcaagaaaatcaatggatacatttgcaagagatattaacaaaggctgtttttgttcaattcttagctaagcagaacattaacctgaaccttccagtctcaggaaatcaccagatttttaaaaagtgtgactgggtgccgtggctcacacctgtaatcctagcacttttgacgggtcaagactggaggatcctttgagcccaggagtttgagaggagcctggacaacacagcgagaccccatcaccacaaataayagcctgtagtctcagccagttgggaagctgaggcaggaggatcacctgaacccaggatattgaggctgcagtgagccatgatcgtgccactgcactacagcctgggcgacagagtgagaccctgcctcaaaaaacaaaaaaatttaaaaaataaaaataattgttactctggggcatccggggagaagaagagttttgtgagacaactcttctggatgtcagtccccactattacctgatacccaccatctcccgtcccccaaaaagaaaaggacctaggacctccacatcctattaggc

SEQ ID NO: 191101 - DNA, 601 bp, Human
gtccctggcacatattcactattcaatatccatgtctccaccttcaaagtcttttttttcatttcagatgaaggttagttcagggaggcatcaagcttgagaaaaagagaaaaaaaaaaaagcagtctgtgtaaagcagaatctaaagcaagaaaatcaatggatacatttgcaagagatattaacaaaggctgtttttgttcaattcttagctaagcagaacattaacctgaaccttccagtctcaggaaatcaccagatttttaaaaagtgtgactgggtgccgtggctcacacctgtaatcctagcacttttgacgggtcaagactggaggatcctttgagcccaggagtttgagaggagcctggacaacacagcgagaccccatcaccacaaataatagcctgtagtctcagccagttgggaagctgaggcaggaggatcacctgaacccaggatattgaggctgcagtgagccatgatcgtgccactgcactacagcctgggcgacagagtgagaccctgcctcaaaaaacaaaaaaatttaaaaaataaaaataattgttactctggggcatccggggagaagaagagttttgtg

SEQ ID NO: 191102 - DNA, 601 bp, Human
ccctgtccctggcacatattcactattcaatatccatgtctccaccttcaaagtcttttttttcatttcagatgaaggttagttcagggaggcatcaagcttgagaaaaagagaaaaaaaaaaaagcagtctgtgtaaagcagaatctaaagcaagaaaatcaatggatacatttgcaagagatattaacaaaggctgtttttgttcaattcttagctaagcagaacattaacctgaaccttccagtctcaggaaatcaccagatttttaaaaagtgtgactgggtgccgtggctcacacatgtaatcctagcacttttgacgggtcaagactggaggatcctttgagcccaggagtttgagaggagcctggacaacacagcgagaccccatcaccacaaataatagcctgtagtctcagccagttgggaagctgaggcaggaggatcacctgaacccaggatattgaggctgcagtgagccatgatcgtgccactgcactacagcctgggcgacagagtgagaccctgcctcaaaaaacaaaaaaatttaaaaaataaaaataattgttactctggggcatccggggagaagaagagttt

SEQ ID NO: 191103 - DNA, 601 bp, Human
gtcataatttccaaggcaaaacactatcgattcatcaactcaattatttcagcaactatatactgagtacttgctatgtgcaaaacactgttctaggggcttggactatactgatgacttaaacagataaagatccctgtctctgttgcatttcatcagctttacaccaaccatgactaaatataatgctgtctggacatggccctgtccctggcacatattcactattcaatatccatgtctccaccttcaaagtcttttttttcatttcagatgaaggttagttcagggaggcatcaarcttgagaaaaagagaaaaaaaaaaaagcagtctgtgtaaagcagaatctaaagcaagaaaatcaatggatacatttgcaagagatattaacaaaggctgtttttgttcaattcttagctaagcagaacattaacctgaaccttccagtctcaggaaatcaccagatttttaaaaagtgtgactgggtgccgtggctcacacctgtaatcctagcacttttgacgggtcaagactggaggatcctttgagcccaggagtttgagaggagcctggacaacacagcgagaccccatcaccaca

SEQ ID NO: 191104 - DNA, 601 bp, Human
gtggtgccatctcggttcatcacaacctctgcctcctgagttcaagcaattctccagcttcagcctcccgagtacctgggattacaggtgcccgccaccacgcccagctaatttttaaattttttttttttttttttttgagacgaggtctcactctgtcatcaggctgaagtgcagtggtgcgatctcggctcactgcaacctctgcctcctgggttcaagcaattctcctgcctcagcctcccgagtagctgggacaacaggtgtgtactaccacacctggataaattttttttttttwatgtatttttagtagagacggagtttcaccatgttagccaggatggtgtcgatctactgacctcatgatccgcccacctcggcctcccaaagtgctgggattactggcctgagccaccgcgcctggccaatttttgaatttttaggagagatggggtttcaccatgttgaccaggctggtctcaaactcctggcctcaagtgatccacccacttcagcctcccaaagtgctgggataacaggcgtgagccaccacacccagctaagaaacaaaatttcacaggccgttcagtaaatacat

SEQ ID NO: 191105 - DNA, 601 bp, Human
tgcagtgacacaatctcagctcactgcaacttctgcctcccaggttccagtgattcttagcttcccgagtagctgagattataggcacgcaccactatgccctgctaaggtgttttgttttgttttttgctttgttttgttttgagatggagtctcactcttgttgcccagctggagtccagtggtgccatctcggttcatcacaacctctgcctcctgagttcaagcaattctccagcttcagcctcccgagtacctgggattacaggtgcccgccaccacgcccagctaatttttaaattttttttttttttttttttgagacgaggtctcactctgtcatcaggctgaagtgcagtggtgcgatctcggctcactgcaacctctgcctcctgggttcaagcaattctcctgcctcagcctcccgagtagctgggacaacaggtgtgtactaccacacctggataaattttttttttttaatgtatttttagtagagacggagtttcaccatgttagccaggatggtgtcgatctactgacctcatgatccgcccacctcggcctcccaaagtgctgggattactggcctgagccaccg

SEQ ID NO: 191106 - DNA, 601 bp, Human
attgcactccagcctgggcaacaagagtgaaattctgtctcaaaaaaataaaaataaataaataaataaataaataaataaataaatgtgattcacttgaatcctgaatcatcctgaaaccataccccactgctggtccgtggaaaaattgtcttccacaaaactggttcctggtgccaaaaaggctggggactgctgctctagctgacctgtgcatcaggttgtcagagggagcacaggcctcaagtcagacagataggagtttgactctcagctctcccatttagtggctagaggtggstgagtttccaaatttctcctagctcagttaagggaagaatgcttccattatggagattttgagcaggtcagagataaggtatataaagcatctatttctaatctatgatagatgtgatggtgactctgatacctctgaattatttctgcgtctgctggctccccacacgcacacaaggcatacggaaaggcggagataaattccccaggggccttcctacctaaaacacatcagctgatcacaaaggaagtttgcctcccagactggagcattatcagatgagttctcagggctctggtt

SEQ ID NO: 191107 - DNA, 601 bp, Human
agctacttggaaggctgaggcaggagaatcgcttgaacccaggaggcagaggctgcagtgagccgagatcatgccattgcactccagcctgggcaacaagagtgaaattctgtctcaaaaaaataaaaataaataaataaataaataaataaataaataaatgtgattcacttgaatcctgaatcatcctgaaaccataccccactgctggtccgtggaaaaattgtcttccacaaaactggttcctggtgccaaaaaggctggggactgctgctctagctgacctgtgcatcaggttgtyagagggagcacaggcctcaagtcagacagataggagtttgactctcagctctcccatttagtggctagaggtggctgagtttccaaatttctcctagctcagttaagggaagaatgcttccattatggagattttgagcaggtcagagataaggtatataaagcatctatttctaatctatgatagatgtgatggtgactctgatacctctgaattatttctgcgtctgctggctccccacacgcacacaaggcatacggaaaggcggagataaattccccaggggccttcctacctaaa

SEQ ID NO: 191108 - DNA, 601 bp, Human
ttagattctcataggagcgtgaaccctattgtgaactgtgcatgcaagggatgtaggttgcacactccttatgagaatctaattgctgatgatctgtcactgtctcccatcagccccagatgggaccaactagttgcaggaaaacaagctcagggctccgtcggagtctagtttatggtgagttgcataattatttcattatatattacaacataataataatagaaataaagtgcacaataaatgtgatgcaggctgggcgtggtgccgcaagcctgtaattgcagcactttgggaggcygaggcgggcaattacctgaggtcaggagttcaagaccagcctggccaacatggtgaaacctccgtctctaataaaaatacaaaaattagccaggtgtggtggtgggtgcctgtaatcccagctacttggaaggctgaggcaggagaatcgcttgaacccaggaggcagaggctgcagtgagccgagatcatgccattgcactccagcctgggcaacaagagtgaaattctgtctcaaaaaaataaaaataaataaataaataaataaataaataaataaatgtgattcacttgaatcctg

SEQ ID NO: 191109 - DNA, 601 bp, Human
aacaaacaaacaaacaaacaaacacattagagacagggtcttactatgttgcgcaggctggtctcaaaatgctgggctgaagcagtcctctcacgttagcctcccaaaagttggaattacaagcatgagccaccgcactcagccttctttcccctttctctagctcagggctccctgacccccaggtgcctattaggaaccaggctgcagcaggaggtgagtggcgggcaagtgagcgaagcttcatatgtatttatagctgctccccgtcgctagcattactgcctgagctccacccacytcctttcagatcagtggcggcattagattctcataggagcgtgaaccctattgtgaactgtgcatgcaagggatgtaggttgcacactccttatgagaatctaattgctgatgatctgtcactgtctcccatcagccccagatgggaccaactagttgcaggaaaacaagctcagggctccgtcggagtctagtttatggtgagttgcataattatttcattatatattacaacataataataatagaaataaagtgcacaataaatgtgatgcaggctgggcgtggtgccgcaagcctg

SEQ ID NO: 191110 - DNA, 601 bp, Human
ttctttttttggaatatgtttcttctaagcgccaaggtgggctttcactggtgcctggtgtctataactctggtttgtttttttagaagtttctgccttttttgcttctacgtcgtcttagcttgcaggcattcattcagaggtactgagtaagcactcacttgtgccaggcattatgcaaggtaaggcactaaacagatacagtccctgctcttggggactgtatcagtatcttggcctacagtgccagccagagagaggctctgagcctgtccaagatactgactcaaggggcagcagmagaatctccacattccctaaaattgaagagcactgggccagaaaccagaggaagaggatggtggaaaattgtggccttgttgggccagagaagctgcgccccagcacaacacactttggggcctggggcactggttgaaaggaagcctatgaccctgaaataccactgtcctattttgccagctcctgtgaacaggcctccagggatttccactgcttttagaggcctatttacatgccagcaacatgacatgacttcagcgcctctgacttggaaggaacgaaaagcacatttaggctg

SEQ ID NO: 191111 - DNA, 601 bp, Human
aaaagcaattttcccaaaggtagagatgatttgtctgctacataaatactgctggtcttccagtcaccatttctggcttcccaagaatcatcaaaagcaatccaagggtgtcataaagcactcaatgttctaaactactctcacataccatcagtttgttcctcatgtatatttgaagctactttaaagttatttaaggcttctttttctaattttaaaaatatgtttttaaaaaaagtttttaaaaaatatgtttaattttaaaacatattctttttttggaatatgtttcttctaagcrccaaggtgggctttcactggtgcctggtgtctataactctggtttgtttttttagaagtttctgccttttttgcttctacgtcgtcttagcttgcaggcattcattcagaggtactgagtaagcactcacttgtgccaggcattatgcaaggtaaggcactaaacagatacagtccctgctcttggggactgtatcagtatcttggcctacagtgccagccagagagaggctctgagcctgtccaagatactgactcaaggggcagcagcagaatctccacattccctaaaattgaagag

SEQ ID NO: 191112 - DNA, 601 bp, Human
ccacccacacctttataccctgcagttcaccatttaagttcactaagtggcttcaactaggacagactccaaaagcaattttcccaaaggtagagatgatttgtctgctacataaatactgctggtcttccagtcaccatttctggcttcccaagaatcatcaaaagcaatccaagggtgtcataaagcactcaatgttctaaactactctcacataccatcagtttgttcctcatgtatatttgaagctactttaaagttatttaaggcttctttttctaattttaaaaatatgtttttwaaaaaagtttttaaaaaatatgtttaattttaaaacatattctttttttggaatatgtttcttctaagcgccaaggtgggctttcactggtgcctggtgtctataactctggtttgtttttttagaagtttctgccttttttgcttctacgtcgtcttagcttgcaggcattcattcagaggtactgagtaagcactcacttgtgccaggcattatgcaaggtaaggcactaaacagatacagtccctgctcttggggactgtatcagtatcttggcctacagtgccagccagagagagg

SEQ ID NO: 191113 - DNA, 601 bp, Human
tttttttttttttttttttttgagacagagtcttgctctgtcactcaggctggagtgccatggtgcaatctcagctcactgcaacctccgctccccgggatcaaacaattctccctcctcagcccccgagtagctgggaccacaggcgttcaccgccatgcctggtatttttagtagagacagagtcgcaccatgttgcccaggctggtcttaaactcctgagctcaagtgatccactcgccttggcatcccaaagtgctgggattacaggcgtgagccatcacgcctggatatacttttwaaaaaaaaataaaaaatatttttctaaaaatatagagacagggtctcactatgttgcccaggctggtctcaaactcctgggctcaagcaatcctcctaactcggcctcccaaagtgttgagattacaggtgtgagctaccatacgtggcctgtatatgctttttattttattttttaaataaaaattaaaaatactttataaaaatagagacaaggtctcagtatattgcccaggctggtcttgaactcctgagatcaagtgattctcctgcctcagcctcccaaagtgctgagattata

SEQ ID NO: 191114 - DNA, 601 bp, Human
aggttaaatatccatcggcagggaagtagtaaatagttatacattgagtctgtggaatattctgcagccatttaaaagggcaaggtagatttctatgcactatatggaaagagttctaacatacactgttatgcatcaaaaagaaagttgcagaatagtagttatgccacaacccaattcgtattcatatgcagtatgtgtgtatgtatatatgggtgtaaacacagtttggctatactccaagcagtcaacagtgtttctctggagagggagaaaactttcacattttgttctatatgcttttttttttttttttttttttttttgagacagagtcttgctctgtcactcaggctggagtgccatggtgcaatctcagctcactgcaacctccgctccccgggatcaaacaattctccctcctcagcccccgagtagctgggaccacaggcgttcaccgccatgcctggtatttttagtagagacagagtcgcaccatgttgcccaggctggtcttaaactcctgagctcaagtgatccactcgccttggcatcccaaagtgctgggattacaggcgtgagccatcacgcctggatatac

SEQ ID NO: 191115 - DNA, 601 bp, Human
tgcaatggtgcgatcacagcttactgcaaactccacctcccagattcaagcgattctcctgcctcagcctcttgaatagttgggactgtaggtgtgcaccaccatgcccagctaatttttgtattttcagtagagatggggttttgccatgttggccatgctggtctcgaactactgacctcaggtgatccacctgcctcagcctcccaaagtgctgggattacagtcatgagccactgtgcccagccagaaaactacattatttttttgtttggttgttttttttttgagactgagtctyactatatcgcgcaggctggagtatagtggcaagatctcagctcactgcaacctctgcctcccaggctcaagcaattctcatgcctcagcctcccgagtagctgagattacaggcgcctgccatcctgcctggctaatttttgtatttttagtagagatggggattcgccttgttggccaggctggtctcgaactcatgacctcaagtgatccacacaccttggcctcccaaagtgctggaattacaggcatgagccaccacgcccagacgaaatctacattttttaaaagtaaagataaa

SEQ ID NO: 191116 - DNA, 601 bp, Human
ggtgtggtggtgcatgcctgtggtcccagctactcaggaggctgaggtggggggaccctttgagcctggaaagacaaggctgcagtaagccatgatcatgatcatgccactgcactccagcctgggtgacactgaaagactctgcctcaaaaaagaaacacacacacaaagaaaggctgaacattgagatactggtgaatactcaccaaaagcacaaaaatttaaagtacatggcatggaacttaggatattgattaaccattagtacagaaacttgagaaaacctaaataaatattagakctcataaaatgactttgatttataactactaggcatttggcctaaagaagtaaccaaagatgtagaaaagcgaaatgcacaaatgcacagattatcatgttatgtacaaatacatatttggttacaatcatttccatttcactcttagttaatatatagaaatacacttatggaataaaagtagaaaaagcaagactcagaaaactacttttttttttttttgagacggagtctcgctttgttgcccaggctggagtgcaatggtgcgatcacagcttactgcaaactccacctcccaga

SEQ ID NO: 191117 - DNA, 601 bp, Human
attattttccttctgtaatgagggagagaagttcattcatcagcatttttcttggacagagaaagaacaatcagcccatttgagctgctgtctaagaggacttctcgggaaagtactgcagaatacatggataaacacccaagatgggccagggcttggtagttcacacctgtaattccagcactttgggagctgaggcagttggattgcttaagcccatgaattcgagaccagcctgggcaacaagcgagaccacgtctctacaaaaaaaagtagctgggtgtggtggtgcatgcctgtrgtcccagctactcaggaggctgaggtggggggaccctttgagcctggaaagacaaggctgcagtaagccatgatcatgatcatgccactgcactccagcctgggtgacactgaaagactctgcctcaaaaaagaaacacacacacaaagaaaggctgaacattgagatactggtgaatactcaccaaaagcacaaaaatttaaagtacatggcatggaacttaggatattgattaaccattagtacagaaacttgagaaaacctaaataaatattagagctcataaaatgactttgattt

SEQ ID NO: 191118 - DNA, 601 bp, Human
aacactttgggaggctaaggcaggagtttaaagaccagcctaggcaacacagtgagaaatctctacaaaatattttaaaaattagccaggtgtggtggtgcatgcctacagtcctagttactaaggagactgaggtgggaggactgcttgagcccaggacttggaggctacagtgagctatcattgcaccaccgtactccagcctggcgacagatagagacctggtcgttaaaaataaaatagggccgggcgcagtggctcatgcctgtaatctcagcactttgagaggacaaggtgggcrgatcacctgaggtcaggagttcgagaccagcctggccaacatggtgaaaccctgtttctactaaaaaaatacaaaaattcgatgggtgtggtggcacacgcctgtagtcccagctactcaggaggctgaggcaggagaattgcttgaactcaggaggcggaggttgcagtgagccgagattgcgcccctgcactccagcctgggcgacagagcgagaccctgtctccaaaaaaataataataaaaataaataaataaatagggctacagtctggcaagacttagctgagtactcaagaag

SEQ ID NO: 191119 - DNA, 601 bp, Human
tctgcagaagagactggccatctaggtcagaggcttctgctctgacaggtcaatttcaataatagaaaaagtaagaggccaggcacagtggctcatctctataatcccaacactttgggaggctaaggcaggagtttaaagaccagcctaggcaacacagtgagaaatctctacaaaatattttaaaaattagccaggtgtggtggtgcatgcctacagtcctagttactaaggagactgaggtgggaggactgcttgagcccaggacttggaggctacagtgagctatcattgcaccacygtactccagcctggcgacagatagagacctggtcgttaaaaataaaatagggccgggcgcagtggctcatgcctgtaatctcagcactttgagaggacaaggtgggcagatcacctgaggtcaggagttcgagaccagcctggccaacatggtgaaaccctgtttctactaaaaaaatacaaaaattcgatgggtgtggtggcacacgcctgtagtcccagctactcaggaggctgaggcaggagaattgcttgaactcaggaggcggaggttgcagtgagccgagattgcgcccctgca

SEQ ID NO: 191120 - DNA, 601 bp, Human
attacaaaatgctggttcctgaataattttcctacctcttttgcaaaagtatttcagtcagctccattaaaaaaaaaaaaggccagatgcagtggtttatgcctataattcccatattttgggaggacaaggcagaagggttgcttgagtccaggagttcaagatcagcgtgggcaacatagcaagacctcatctctacaaaaaaaatttttttttttgagacagagtcttgcatttttgcccaggctggagtgcagtggtgtgatctcagctcactgcaagctccgcctccagggttcaygccattctcctgcctcagccttccaaatagctgggaatacaggcgcccgccaccacacctggtcaatttttgtattttttagtagggctggggtttcaccgtgttagccaggatggtctcaatctcctgacctcatgatccactcgcttcggcctcccaaagtactgggattacaggtgtgagccaccgcgcccggcctctacaaacgttttttaaaagtagtagggtgtggtgggacagtgcttatagcccaagctactcagggggctgaggtgggaggattgcttgagcctgggaggt

SEQ ID NO: 191121 - DNA, 601 bp, Human
cttccccataagatcaccataagctatagtacacaccaagatttctaagtattacaaaatgctggttcctgaataattttcctacctcttttgcaaaagtatttcagtcagctccattaaaaaaaaaaaaggccagatgcagtggtttatgcctataattcccatattttgggaggacaaggcagaagggttgcttgagtccaggagttcaagatcagcgtgggcaacatagcaagacctcatctctacaaaaaaaatttttttttttgagacagagtcttgcatttttgcccaggctggrgtgcagtggtgtgatctcagctcactgcaagctccgcctccagggttcacgccattctcctgcctcagccttccaaatagctgggaatacaggcgcccgccaccacacctggtcaatttttgtattttttagtagggctggggtttcaccgtgttagccaggatggtctcaatctcctgacctcatgatccactcgcttcggcctcccaaagtactgggattacaggtgtgagccaccgcgcccggcctctacaaacgttttttaaaagtagtagggtgtggtgggacagtgcttatagc

SEQ ID NO: 191122 - DNA, 601 bp, Human
gacagagacaagaccctctctcaaaaagactggtgtgtctggaggagaggcagaaggctaagaaagacaacaggataatggtgaaatgaacagaggcaagagcaagagaggaatactctggccaagggagggaaacgcaatgcttgtgctttcgtaaaatgggaagaataccacaaaagtacatgacactgaagttctacgctggagacggtgagaactcagactcttacttttggatttgctcttactggaatcctctgtacccaggccttcacttaggggctgctggcacgctttcgcyagccatgatacatgcaggggcatgcaaatgtggtcaacttacaagaataatggaaccatgtaagcatgattacaaagtggaatgctttaacatattggaacgtgcttgattctgaattgagttatcttcttctttccctgcaccctccaggcctgttcctgcaggtgccaggcttaatcaagctgaatcaaggtcaaagacaaaatccacaggcctccagaacaccattccctcaggtcttaatgacttcatctgcaatgctagacaaaaaggagtatggctcgcgtggcgataggacag

SEQ ID NO: 191123 - DNA, 601 bp, Human
taatcccagctgctcaggaggctgaggcacgagaattccttgaacctgggaggcagaggttgcagtgagccgagattacgccactgcactccatcctgggcgacagagacaagaccctctctcaaaaagactggtgtgtctggaggagaggcagaaggctaagaaagacaacaggataatggtgaaatgaacagaggcaagagcaagagaggaatactctggccaagggagggaaacgcaatgcttgtgctttcgtaaaatgggaagaataccacaaaagtacatgacactgaagttctaygctggagacggtgagaactcagactcttacttttggatttgctcttactggaatcctctgtacccaggccttcacttaggggctgctggcacgctttcgccagccatgatacatgcaggggcatgcaaatgtggtcaacttacaagaataatggaaccatgtaagcatgattacaaagtggaatgctttaacatattggaacgtgcttgattctgaattgagttatcttcttctttccctgcaccctccaggcctgttcctgcaggtgccaggcttaatcaagctgaatcaaggtcaaag

SEQ ID NO: 191124 - DNA, 601 bp, Human
ctttgaagcagggagtgttactcatttctgtcccccagtaagcccctcatacagttctcaaacctagggaaagtgaaataaataaatggctatagctttatataattcaatcaccttttcagtttatttggggcaataccttttccctcaaataccctaataattgaagcaacattggattattttggcttgttatccagtaactaacatggataacagtatccatttacacgtcctcagtatccatttgatttcctcatcctttttttcttcaaaaaaaaaatctaggaagtgcaaacctttttttttctcctgtcctcttcccttctctctaccctgcctgtcctctgtcacccaccctcccctccaccaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctacttt

SEQ ID NO: 191125 - DNA, 601 bp, Human
caactatcctattagggaaaagtattttccattttattagagatgataagaacatgaatagtaagacatttagatgtgaatttaactaggtatccagcattatagagaccctaggccctcttcccttagagcctgggtgcaaaagctagggaaaagaagtagttagctacttcttacaaagaactcttgcttccctcctagttacaggtgttagtgggatggggtgtttagctgggtagagatggcctgaagcaatctgttgtgccagagaaagttttggcttctataggttgaaccataygaaattgccactttaaaagtcaaaaacagtccaatgttagcagtttcgtatgtttcaacgaatagttacagccttttatttagactgcataacctcgtgcaggatcatctgaggctcggcctcagttcggtcctccataaaaaaaggtaaccgcgtagcataatactcctgctccactgcgcccttcttgtttcgcagttgggcagtccatgaattacttggttaattgccccagttcttcactgaccttgaactaatggagtaggaatgacaggagacccagcctgccagtgaagcaag

SEQ ID NO: 191126 - DNA, 601 bp, Human
tgagaaaaagtaagaaataatttactatctcctttaccctagcaagcaaaagttatttaactaaatgaacgactcatctataaataaaaaagagtacactattactactctgcaaatctttaaaagcagatgttttcatctaagatggttgtagaacagctttacctcaagatacatggatatccctcctctaaggaccaaaaattcttttttagtgggatttgcatggtatattttcaagaacctcagagcactgaagacactaatttttctccccaaacctcctgaatgacaagcatgrttattagttctattttccaatgaaaaaaaaatcaagcactaataaattacagaacaagttaacaggtaccttctgacctgatgcaacaggaagtacacaacattgcctatgtagctttcttgccaaatatatttattctgaatctaaacatgaggaaacaattagacaaatctagattgcaagactttctaaaagacatctaacctaggctttgaaaaatgtctcaagaacaacaacaaaaagggtagagggacatttttagagaggctaaaaaaaattaaagagaataaagagacatga

SEQ ID NO: 191127 - DNA, 601 bp, Human
ctaagtaaaaagatacatgatgcctgatacggtcacctgatgtccaccctcccaggagaccagccaaccatccaaaagttgaaacaaagccctcatcctgttgctatggaatcattactgagctccaagactaagctctcctttcagtgggagaccttctatatctcagagccagagaatgttgcacctagctgtgctcaatttctttttgtagaataaccatgaaatccatgctattgtcagcctagaggttttgacctttgggcaaaatattttgtagagaaggctaaagaaatgtgcmgaaagttttcctagaaattattacaaaattcctatcattatcaggtttatttttggaaaaatggcctactaatccaatgcagcagagagaaaaatatcttgagtatcccagaagtaatgaaaacatacttagtaaaatctattccttttgccaagcccataactcctctgattaaactgctatcaagatagtgggaaaggaagaagcaatgagaaaaagtaagaaataatttactatctcctttaccctagcaagcaaaagttatttaactaaatgaacgactcatctataaataaaaaa

SEQ ID NO: 191128 - DNA, 601 bp, Human
aaggctgggcctaagcctcaggggctcttcctcatgacctgtggagagatctttaggaaagtcaaataacttctctaagaatggatagattctaaactccttaattcatatgttctatttgcctttggtttttgaccaaacaagtcactaaaaagagcctttgcaaaagatatcctatgggaaatgaagttaataataccatctatttcacttcatagtttctcacatttactgccttctgcacatttgcgtgactaattatcaatatctgctaagtaaaaagatacatgatgcctgatayggtcacctgatgtccaccctcccaggagaccagccaaccatccaaaagttgaaacaaagccctcatcctgttgctatggaatcattactgagctccaagactaagctctcctttcagtgggagaccttctatatctcagagccagagaatgttgcacctagctgtgctcaatttctttttgtagaataaccatgaaatccatgctattgtcagcctagaggttttgacctttgggcaaaatattttgtagagaaggctaaagaaatgtgcagaaagttttcctagaaattattacaaaat

SEQ ID NO: 191129 - DNA, 601 bp, Human
acctttatcacttccttgtgtcgggaacattcaatacccttctagctatttgaaattttatcttattgttaactgtagtcatcctacagtggtccagaacactagaatttatccccctatctagctgtaattttgtatcctttgacagatctcacttgcatttctaaccaaacggggtgcgcttctgccttctactatgccattcacttatccattcattctacaagcatttactaagcactgcctatgtatcagatatgatgttcggtgttaggaactgaaaggtaaataagatattgcrgtaatgaaatcccaatctctgaagacagtctactttacagggtcaataatgagaaaagatagtgaactagttggaggaaaaggtcctattttaatatactatattatgtgtctttgaacaaaattctcagagtaaatgtgtgtgaggtgaaaactttgctttgttctggtctcttttttaattgtgaaagtaatacatggtcattacagaaaacactgctgacagctaacttctattccaggggtatattccagaggtaacttcctcaccccatccttgcctctttacagtcatatgatt

SEQ ID NO: 191130 - DNA, 601 bp, Human
tcattttgattagaaccaaaatacctttctctactttccccactttgatagacctgatgcccattctatcatgtttcactttctaagtgattccatggcatttctacaagagtcaggcggcttgattttgcttccctaaccttaaggcaagaacagaaatgaactcctagtctccttgggggattatccatacgttcaccactcactgctgtattctcaaatgtgactgatcgtggaccattttacaacataacttttactctattttaagaccagagtgggtgttgaattttatggattwgggaaaatgaaggctcatttgtatttagattatgttgatttctttccttctttctctatttcattctttctttttattttttgagacagagacactctgtcacccagggtggactcaagtagtcctcctacctcagcctctcaagtagctgagactccaggtgcataccaccacacctggctaattttatattttttgtagagattgggtctcactatgttgcacaggctggtctcaaactcctggactcaaaacaatccacccgccttggcctcccaaagtgccaggattacaggcatg

SEQ ID NO: 191131 - DNA, 601 bp, Human
tctatggctttgcctattctggacatttcatataaatagaatcatacagcatatggtcttttgtatctggcttctttcacttagcatagtgttctcaaagcttctccatctataaataaatgtagttttacctctttgcataatttattatgcaaataatattttattgcatagatattgtttattgtttatccatctatcagttgataaacatttgagttgtttcctgctatgaacaagtgtacaagtttttatgtacacatatgtttccatttctctcgagtatatacctcagagtggrgtttttgtcatatgaaaaacaacaaaaaaatgctccatgtttaaccctttcactgctatactgttttccactgtgaatgcatcagttttgcaatcccatcagcaatgtatgagggtttcaatttctccacatctttgccaacacctattatgatctttcttttggttatagccatcctactgggcatgaattggtacctcatcatgatttttatttgcattttcctaataactaatgatgctgagcgtcttttaatgtgtttattatccattagtatgttttctttggaaaaatgtctac

SEQ ID NO: 191132 - DNA, 601 bp, Human
ctatatgtaggcctatgacacattttgagtttttgtacacggtgtgaggcagggagttcaacttcattcttttgcatgtgaacttccactgtttccagcactatttgttaaaaagactattctttcccccatgtagttgccttggcatacttcttgaagatcaattgatcataaatgtaagagtttatttctttaatctcaattttattccattgatctacacttctaagcttatactggtataacactgtcttgaatactatataactttgtagtaagttttgagattggaacatttaartcctcctattttgttcttcttgttcaagattgctttgggtatcctggatgccttgaattctcatgctgattttaggaccagtttgtcaatttctatttttaaaaaggcagttggaaatttgatacatttgattgcattgaatctgtacatcaacgttgaaagtactgtcatcttaacaatattaagttttcaattccatgaatatgtggtatctttccatttgtttagaactcatttaatttctttcaacaaagttttgtagttttcagtgtacaaaactttcatttattttggtcaatt

SEQ ID NO: 191133 - DNA, 601 bp, Human
cacttataaagtccctttgtgatccactccagtgtcagcgccaggtaggcctatgaactttggtagctcagcaaatcctagctagggtgggagtggccagatctccttggtgcaagtacctgcagtttctccagaaggttctctgagagcccctcctctttgtgacttggtgatgaagagaaggaaaaggctgaagcaccattccccagacacttcatactttaatggcttttcccactttaaggaatttctagtctttttttcatatgctctggagctgagtgacaaagtaatatttagscaatctgtttagacactttttttctttttgtagatttagggatacaagtgcagttttcttacattaatatattgcatagcggtgaagtctgggcttttagtgtatccatcacccaaatagtgtacattgtattcagggtggtttttgttttttgtttttttttctctttttgagacagaattttgctctgtcgcccaggctggagtacagtggcgcaatctcagcttcctgcaaacctccacctcctgggttcaagcgattctcctgcctcaacaacccaagtatctgggactacaggca

SEQ ID NO: 191134 - DNA, 601 bp, Human
ttcacatatttgctattatgaatagtgctgtgataaatatacaagtgcagttgtctttttcttatagtagtttctttgttggcgggggtggggggggggggtaaatcaccagctgtgggattgctggatcaaatggtagttctatttttagtttatttttagataaatttagtaaattttatgtggatatacttaagagctcttctttagaaattgaggcaacattttattataacattctatttatgcttgaaaatgtacatacagtatgactctaaaattcctcttctaggaatttatyctaaggaagtaactaggaatacatgaaaagatatagcttcaatgtttaaacaacagaaaaattagattcaatctagctgtccaacaaaagagagcttgttaaacatcacagaggaatactatgtagccattattttaaaaaccctagaagatcattcaatgccataagagggtttttacaatatattgttaagtgacaaaatagagttataaagtaatatatatataatatgactctattttgtagaagaaaaatgtatatgcatagaaaaaaagactggaaggaaggaaatcaaatcac

SEQ ID NO: 191135 - DNA, 601 bp, Human; identical to SEQ ID NO: 20574

SEQ ID NO: 191136 - DNA, 601 bp, Human; identical to SEQ ID NO: 20575

SEQ ID NO: 191137 - DNA, 601 bp, Human; identical to SEQ ID NO: 20576

SEQ ID NO: 191138 - DNA, 601 bp, Human; identical to SEQ ID NO: 20577

SEQ ID NO: 191139 - DNA, 601 bp, Human; identical to SEQ ID NO: 20578

SEQ ID NO: 191140 - DNA, 601 bp, Human; identical to SEQ ID NO: 20579

SEQ ID NO: 191141 - DNA, 601 bp, Human; identical to SEQ ID NO: 20580

SEQ ID NO: 191142 - DNA, 601 bp, Human; identical to SEQ ID NO: 20581

SEQ ID NO: 191143 - DNA, 601 bp, Human
ctgaaacagctgcaaccttgactactaagcaccctgactatgctatcctggcagccaggatcgctgtctctaacttgcacaaagaaacaaagaaagtgttcagtggtaagtctggggtgaaaaagtaaaaatttagtactctcagaaaagtaataagggtactagaaataaatcttgactgtttaaagaagcaaatatggctagatggggtggcttacacctcgaatcccagcaatttgggaggccaaggcaggcaaatcgcttgagtccaggagtttgagaccagcctgggcaatgtggsgaaaccccatctctacgttttaagaaaaatctaaaattataaaatagactaggtgcagtggctcacgcctgtaatcccagtgctttgggaggctgaggcaggtggatcgctgaggtcaggagtttgagaccagcctggccaacatggcgaaaccctttctctactaaaaatacaaaaaattagctgggcgtggtggtgggggcctgtaatcccagctactggggaggctgaggcaggagaattgcttgaacccgggaggcggaggttgcagtgagctgagactgtgccactgcactcctg

SEQ ID NO: 191144 - DNA, 526 bp, Human
caggctcccatcaccacgcccggctaatttttttgtatttttagtagagacgggtttcaccgtgttagccaggatggtctcaatctcctgacctcgtgatccacccgcctcggcctcccaaagtcctgggattacaggcgtgagcccccccggcgccggcccaggaatctattttaaactacaagaacttataatcactttaactctagaagattgtttccttaartgaggcattacatatttcttcaacatatatgtgtttattgagcactttatatgctaggcattgaggtgggttgagatgacaaaaagggttgagaaccactgttttcaactattacctaaagattgaattagctgttaagtggtcttgatatattttcattttttgttgtattttttagatgtgatggaagacctctataactacataaatccacataatggcaaacactctcccatggtggccaagtcaacattggatattgttctggccaataaagatgtatgtataacacttatctgg

SEQ ID NO: 191145 - DNA, 601 bp, Human; identical to SEQ ID NO: 20582

SEQ ID NO: 191146 - DNA, 601 bp, Human; identical to SEQ ID NO: 20583

SEQ ID NO: 191147 - DNA, 601 bp, Human; identical to SEQ ID NO: 20584

SEQ ID NO: 191148 - DNA, 601 bp, Human; identical to SEQ ID NO: 20585

SEQ ID NO: 191149 - DNA, 601 bp, Human
tccagaaattttcatgcagtctctgccgaaacaaaagtgccagtgaggaggctgagatgggaggattccttgagcttaggagtttgacaccagcctgggcaacacagggagaccatgtctctacaaaacgttttaaaaagttttttttaaaaaaagtgccaatgataattctggctaacatgacgaaaccctgtctctactaaaaatagaaaaaaaaaattagctgggcctggtggtgggcgcctgtagtcccagctactcggtagcctgaggcaggagaatggcatgaacccgggaggcrgagcttgcagtgagctgagattgcgccactgcaccccagcctgggcgacagagcgagactctgtctcaaaaaaaaaaaaaaaagtgccaatgataatgttccagatgaagctaggaagagtaaatgtgctattcttttcatttgaaattttatagaaacggcgaagatttaaagagattgccttattgtggatgatatatccactgcgtctttaaaaacggtgctctgaaaattttttgttgtttctctctttctagacgctagagcggtcttatttgttgaagatcaatggaaaaggtg

SEQ ID NO: 191150 - DNA, 601 bp, Human
aattatattatttgtgaattatattcctttttttttttgttgttgagacaaagtctcactctgtcacccaggctggagcgcagtgttgcgatcttggctcactgcaacctgtgcctccttggtacaagcaattctcttgcctcagcctcctgagtagctgggattacaggtgcccgccaccacacccagccaatttttgtatttttagtagagatggggtttcaccatgttggtcaggctggtcttaaactcctgacctcaggtgatccacccgccttggcctcccaaagtgctgggattrtaggcatgagccaccacgcttggtgtgaattatatttcaataaggttgttttaaaaagaaggtaagtgccaagaactagttaggggactcttatagcagtttatataagaaattgtggtagtctagattagggaggtgaaagtagaaattgacagaagcagatagatcaaaagatatttagggccaggcatggtggctcacatctgtaattccaacactttggaaggctgaggtgggaagatcacttgaggtcagaagttcaaggctgccgtgagccatgattatgccactgcactgtag

SEQ ID NO: 191151 - DNA, 601 bp, Human
atggtggctcacatctgtaattccaacactttggaaggctgaggtgggaagatcacttgaggtcagaagttcaaggctgccgtgagccatgattatgccactgcactgtagcctgggcaacacagtgataccttgattaagataaaaatatatataaaagatatttaggctgtcaaattgacagaatatgggtcaagaatggttcttgcatttatggatacagtaagtaacaggattaatgatgatgccatttgttgagaaaaggaacactaacggtctggtaatacattaaaaaaaaaaatatgccattatcaagttggtttgtttcaggaattcaagaacatggtaacatcaaaaaatacattaatgtaattcattgcattaacattttatgcagtttaatgctctttcataataaacactttagcaaaattgatatagaaaataacttccttaatttggcaaaagatacccaataaaaacctagatgtatcgtctcttttttcagcatggtagtggaggcctgagccagcattgtaaaataagaaaaagaaaagattggaaatcagggaacaaaactgtaatgatttgaagaaatgat

SEQ ID NO: 191152 - DNA, 601 bp, Human
gccactaaaagctggacaaagcaaggaacagattctccctcaaaacctctggagggagcactccaaaaaaaaaaaaaaaagtgagttgcagacattgtgactcttgatacctccacttacctttttttttgagatggagtttcgctcttgtcaccgaggctggagtgcagtggcacgattttggcttactgcaacctctgcctcccgggttcaagcaattctcctgcctcagcctcctgagtagctgggattacaggcacgcgccaccacacccagctaatttttgtatttttagtacagrtggggtttgtccatgttggccaggctggtctcgaactcctgacctcaggtgatccacctgcctgggcctcccaaagtgctgggattagaggtgtgagccactgcgcctggccctacttccacttatatctcgataggagaatatataatatgacctcagagcaaaacaccatagagcaaaacattggaaaaattgactacaattaaaaacttctgtgtgaaaggcaatggaagggcaccgtggatcaataaggccgagaggcgagacaaagagggcaaaaatcttctttattgagctctc

SEQ ID NO: 191153 - DNA, 601 bp, Human
gcacgcgccaccacacccagctaatttttgtatttttagtacagatggggtttgtccatgttggccaggctggtctcgaactcctgacctcaggtgatccacctgcctgggcctcccaaagtgctgggattagaggtgtgagccactgcgcctggccctacttccacttatatctcgataggagaatatataatatgacctcagagcaaaacaccatagagcaaaacattggaaaaattgactacaattaaaaacttctgtgtgaaaggcaatggaagggcaccgtggatcaataaggccragaggcgagacaaagagggcaaaaatcttctttattgagctctcgggcgaggttcactggtccgcagggggagggccagggaagtctcgctgtgccaaaggtgcagcgcgcttttatggatgctgggtgaggagtggtcagggtaggggcagggtcggttgagtttcacgcttctgagtgtgacacgccctagtgggcatgtgcgttagtcggggtggcaggaacaggaaaggtgaacccggaaatgctgagtcagggtgtccgaggtggcgatcgccatcttggagtcttcaccggagt

SEQ ID NO: 191154 - DNA, 601 bp, Human
ataagaaaaacaaggccaggtgcagtggcttctgcctgtaattccaacactctgggaggccaaagcaaaggctggcttgagggcagaatttgaaaccagcctgggcaacataatgagagcctgtctctacaaaagtagaaaattagccaggcgtggtggtgcacacctgtagatttagctacttgaaaggctgaggtgggaggatcgctcgagcccaggaggtcaaagctgctgtgagctatgatcatgccactgcactccagcctgggtaacagagttaaaccctgtctcaaaaaaaaaraaaagaaaagaaaagaaaaacagaaagccaaatagaaacatgggcaagggctataaacaaataatgcatggaagaagaaacttgattggctaataaacgtctgagatgttaaactgtgcaataggaaaatgaaaattatgtatatatatatttgataaaaatgaaaaggctgacaattccaagcactgataagaatgtggagcacaaggaaatctcatacattgctagaaatagatttgtccatccactttggagaatctttagtaaagtgaaacgtgtatatcttttgacccagcagtt

SEQ ID NO: 191155 - DNA, 601 bp, Human
gcctgggcaacataatgagagcctgtctctacaaaagtagaaaattagccaggcgtggtggtgcacacctgtagatttagctacttgaaaggctgaggtgggaggatcgctcgagcccaggaggtcaaagctgctgtgagctatgatcatgccactgcactccagcctgggtaacagagttaaaccctgtctcaaaaaaaaagaaaagaaaagaaaagaaaaacagaaagccaaatagaaacatgggcaagggctataaacaaataatgcatggaagaagaaacttgattggctaataaaygtctgagatgttaaactgtgcaataggaaaatgaaaattatgtatatatatatttgataaaaatgaaaaggctgacaattccaagcactgataagaatgtggagcacaaggaaatctcatacattgctagaaatagatttgtccatccactttggagaatctttagtaaagtgaaacgtgtatatcttttgacccagcagttcctctcctaggttcatattctacagaaatgcttagagataaacacaaggtgttgtgttcaagaatttttatagcagcattgtttggaattgcaaatga

SEQ ID NO: 191156 - DNA, 601 bp, Human; identical to SEQ ID NO: 20586

SEQ ID NO: 191157 - DNA, 601 bp, Human; identical to SEQ ID NO: 20587

SEQ ID NO: 191158 - DNA, 601 bp, Human; identical to SEQ ID NO: 20588

SEQ ID NO: 191159 - DNA, 601 bp, Human; identical to SEQ ID NO: 20589

SEQ ID NO: 191160 - DNA, 601 bp, Human; identical to SEQ ID NO: 20590

SEQ ID NO: 191161 - DNA, 601 bp, Human; identical to SEQ ID NO: 20591

SEQ ID NO: 191162 - DNA, 601 bp, Human; identical to SEQ ID NO: 20592

SEQ ID NO: 191163 - DNA, 601 bp, Human; identical to SEQ ID NO: 20593

SEQ ID NO: 191164 - DNA, 601 bp, Human; identical to SEQ ID NO: 20594

SEQ ID NO: 191165 - DNA, 601 bp, Human; identical to SEQ ID NO: 20595

SEQ ID NO: 191166 - DNA, 601 bp, Human; identical to SEQ ID NO: 20596

SEQ ID NO: 191167 - DNA, 601 bp, Human; identical to SEQ ID NO: 20597

SEQ ID NO: 191168 - DNA, 601 bp, Human; identical to SEQ ID NO: 20598

SEQ ID NO: 191169 - DNA, 601 bp, Human; identical to SEQ ID NO: 20599

SEQ ID NO: 191170 - DNA, 601 bp, Human; identical to SEQ ID NO: 20600

SEQ ID NO: 191171 - DNA, 601 bp, Human; identical to SEQ ID NO: 20601

SEQ ID NO: 191172 - DNA, 601 bp, Human; identical to SEQ ID NO: 20602

SEQ ID NO: 191173 - DNA, 601 bp, Human; identical to SEQ ID NO: 20603

SEQ ID NO: 191174 - DNA, 601 bp, Human; identical to SEQ ID NO: 20604

SEQ ID NO: 191175 - DNA, 601 bp, Human; identical to SEQ ID NO: 20605

SEQ ID NO: 191176 - DNA, 601 bp, Human; identical to SEQ ID NO: 20606

SEQ ID NO: 191177 - DNA, 601 bp, Human; identical to SEQ ID NO: 20607

SEQ ID NO: 191178 - DNA, 601 bp, Human; identical to SEQ ID NO: 20608

SEQ ID NO: 191179 - DNA, 601 bp, Human; identical to SEQ ID NO: 20609

SEQ ID NO: 191180 - DNA, 601 bp, Human; identical to SEQ ID NO: 20610

SEQ ID NO: 191181 - DNA, 601 bp, Human; identical to SEQ ID NO: 20611

SEQ ID NO: 191182 - DNA, 601 bp, Human; identical to SEQ ID NO: 20612

SEQ ID NO: 191183 - DNA, 601 bp, Human
aacaaaaacttgtcagggactatcagtacctctgaatgagagtccttccacttccagttacagggcaagaccaagttactcccaaaagagcaaggccaggctctggtcagctaggaacagcgtctgctcactaaatacctactgcttggctccaggtaaggtcgggactcaggaaaacagacatacagacaacgactggggtcggcggggctcccccacccaacccgggtcctcctgagtgcagagggccttggggctgcagaccgagtgtgggtctgtattagcatccatctgacagggwgagagctttcggaggccccagacaccgcccctctcaccccaagtgtcacaactgccagagcagagggagcgccttttccagcccagaagccctctcccctcacgcacttctcaacaccccccccaccaacttctgaggacaccccacctgcgtccgatctcccagctctgagctcttccacttcagagacacttatcttggagcccgggaccctccgacctcaggggtccctctcggctccctagaggcggtacagccgccgggaagccaccctcgccgagcctccgccggctcgcagtg

SEQ ID NO: 191184 - DNA, 601 bp, Human
acccatcttgtctttaccatcagagccctgtgggtttgctcagttacgcagaatactaaagtaactactggtttgccagcctaggaactgggactcctggggtttttattaagctgtgatgctgggaaagtgccttgtatgcacatccttctctaacctgggctcttatgtaggtccctgggatttcttcccggacccaaacttctgtacctccaagaaatgggaagagagacaagtggttggaagggcaggactggaagaagaacaattcatgggagagggacgactgtgacatgggaaagatgacagaatggggaacagggagagcccttaaatttagctgtagcacttactcccctctacttctctttttttctagtggagagaaatgaatacagatgactagaggaggtagacaggagcaagatcctcagatgcaccccaaaagcttgaggatggagctctagagtggaaacaagagcctccatagccaggatggactgaagttaaatttgggaggaattcctgagaaggaatagggtcctaggtgagatggggagtattaaggatgcctgaaggcagaggggtcagtagaactcca

SEQ ID NO: 191185 - DNA, 601 bp, Human
gccagatctcacctgggagaatccctgtctcacccatcttgtctttaccatcagagccctgtgggtttgctcagttacgcagaatactaaagtaactactggtttgccagcctaggaactgggactcctggggtttttattaagctgtgatgctgggaaagtgccttgtatgcacatccttctctaacctgggctcttatgtaggtccctgggatttcttcccggacccaaacttctgtacctccaagaaatgggaagagagacaagtggttggaagggcaggactggaagaagaacaatwcatgggagagggacgactgtgacatgggaaagatgacagaatggggaacagggagagcccttaaatttagctgtagcacttactcccctctacttctctttttttctagtggagagaaatgaatacagatgactagaggaggtagacaggagcaagatcctcagatgcaccccaaaagcttgaggatggagctctagagtggaaacaagagcctccatagccaggatggactgaagttaaatttgggaggaattcctgagaaggaatagggtcctaggtgagatggggagtattaaggat

SEQ ID NO: 191186 - DNA, 601 bp, Human
cttcatgtcacaaccttgaccatacctgtttagccaagacttcagcggcagcctcctaggttgtagccaccacctccctttaccccccaatattttcccattaaaatctctcccgccctggtcacattttttccaatgatgccttttttgcaattagctcaaacttccaatggggccagatctcacctgggagaatccctgtctcacccatcttgtctttaccatcagagccctgtgggtttgctcagttacgcagaatactaaagtaactactggtttgccagcctaggaactgggactyctggggtttttattaagctgtgatgctgggaaagtgccttgtatgcacatccttctctaacctgggctcttatgtaggtccctgggatttcttcccggacccaaacttctgtacctccaagaaatgggaagagagacaagtggttggaagggcaggactggaagaagaacaattcatgggagagggacgactgtgacatgggaaagatgacagaatggggaacagggagagcccttaaatttagctgtagcacttactcccctctacttctctttttttctagtggagagaaatgaatac

SEQ ID NO: 191187 - DNA, 601 bp, Human
gcacttcctttgcctttgctaatttcacatgaggctgtacagaagtgccatcctgcaaatcctggcacccccacctgaaaatacccacagagagacccagggctgcccagtccctttagccccgcccgaggcctgagggggtttccacaagggaaaataacaccagggaggaaactccggcatctattttccactgtcagtgaggcagagctggagtaggagacagggtactcccccatcttactaccccctggcaaaatccccaacattctctgccttcttatctctcaagctctaacartccttgtgcttggggaaagggcagtactatccctggacagatatgtatgtacagactactcggacctgtcaaattgaggctggtaagacacaagggcccagagtgaggggcactgctatgagcagtctcttgggggaggaagagtcagagccatgatgttcactgttgcctttggaggtactgatatgcaactccttaatgctaaaatagagccaagagaaaccaagttgaccaggtagcaaatctacgacaaggatccggatcttctagcctccacccttatgctacttctacaaagga

SEQ ID NO: 191188 - DNA, 601 bp, Human
cactaagtcctagttcccaaccttcttccctcactgtcccagcaccctaagtgttccataaaaggtgagcctcagctgggcatggtggctcacatctgtaatcccagcactttgggaggctgaggctggcagatcacttgaggtcaggaattcgagaccagcctggccagcatggtgaaaccccatctctactaaaaaatacaaaaaaaattagctgggcctggtggtgcatgccggtagtccccgctacctgggaggctgacacaggagaatggcttgaacccgggaggtggaggttgtrgtgagctgagatcgcgccattgcactccagcctgggtgacagagcaagactccatctcaaaaaaaaaaaaaaaaaaaaaaaaaaaaagctgagcctcaggaccaggacagctctggctgggggagccaaggaagctgccccctcccccacgcagcacagaggaagggtgcacactggcttcctcctccccgcctagcagcagctcagcagtccctgggccccaccaaaggcctgtgaagtggcacttcctttgcctttgctaatttcacatgaggctgtacagaagtgccatcctgcaaa

SEQ ID NO: 191189 - DNA, 601 bp, Human
aggatcctacattgcagcagcaggtaggaaaagagaagagttgatgccacccactaggaaacgagacagtggtagctgggaaggctgggggcagtctaggaccctttcactaagtcctagttcccaaccttcttccctcactgtcccagcaccctaagtgttccataaaaggtgagcctcagctgggcatggtggctcacatctgtaatcccagcactttgggaggctgaggctggcagatcacttgaggtcaggaattcgagaccagcctggccagcatggtgaaaccccatctctactraaaaatacaaaaaaaattagctgggcctggtggtgcatgccggtagtccccgctacctgggaggctgacacaggagaatggcttgaacccgggaggtggaggttgtggtgagctgagatcgcgccattgcactccagcctgggtgacagagcaagactccatctcaaaaaaaaaaaaaaaaaaaaaaaaaaaaagctgagcctcaggaccaggacagctctggctgggggagccaaggaagctgccccctcccccacgcagcacagaggaagggtgcacactggcttcctcctccccgcc

SEQ ID NO: 191190 - DNA, 601 bp, Human
aggttgcagtgagcagagatcatgctactgcattccagcctgggccacagagcaagactccatctccaaaaaaaaaaaaaaaagaaagaaaaaatccatgctggaggactctccacctcttgtcattcatccttcagcctttggagaggatcctacattgcagcagcaggtaggaaaagagaagagttgatgccacccactaggaaacgagacagtggtagctgggaaggctgggggcagtctaggaccctttcactaagtcctagttcccaaccttcttccctcactgtcccagcacccyaagtgttccataaaaggtgagcctcagctgggcatggtggctcacatctgtaatcccagcactttgggaggctgaggctggcagatcacttgaggtcaggaattcgagaccagcctggccagcatggtgaaaccccatctctactaaaaaatacaaaaaaaattagctgggcctggtggtgcatgccggtagtccccgctacctgggaggctgacacaggagaatggcttgaacccgggaggtggaggttgtggtgagctgagatcgcgccattgcactccagcctgggtgacagagcaa

SEQ ID NO: 191191 - DNA, 601 bp, Human
atgggagtgtctagagggcaaggtcctggttgactggaccttgctgagcaccctaagctgagcacaccatgtagtagctgtcagtaaatgactgaatgaagtcgatgcaatcatgtctttgcatatgggagttcctcttcctggaatgcgactcaccccccttcagatccttcctgtccttcaggtccagtactgttccccagcttctccaggacatcacagcaatcccctcttctgccttacctttcccagcattgaccgtacttttcattgtgctgaactaactggatgcttcaggggragggtagtctgaccttctgtttatttccagaagcccagggaagggctgagcaaaagctgtagaatgacatacccctcctcccccatcaatccacagactctgatgctgggaacaaggaagaacctctaggaccagaagacacaagacataagtaaccaacttctttctcattcaccctgaagagcccaaagttggggtaataaacacataagctatactgtcttgtcttcaactggaagggtgagaggtgaagctggcagatctagctcagagatgatgaggaagatgggaaggaaaagt

SEQ ID NO: 191192 - DNA, 601 bp, Human
cctatccaaagtctggtccctgtctctctcacaggcttggagaggctgatgtgaatcttatctcttgttattagaatgggagtgtctagagggcaaggtcctggttgactggaccttgctgagcaccctaagctgagcacaccatgtagtagctgtcagtaaatgactgaatgaagtcgatgcaatcatgtctttgcatatgggagttcctcttcctggaatgcgactcaccccccttcagatccttcctgtccttcaggtccagtactgttccccagcttctccaggacatcacagcaaycccctcttctgccttacctttcccagcattgaccgtacttttcattgtgctgaactaactggatgcttcaggggaagggtagtctgaccttctgtttatttccagaagcccagggaagggctgagcaaaagctgtagaatgacatacccctcctcccccatcaatccacagactctgatgctgggaacaaggaagaacctctaggaccagaagacacaagacataagtaaccaacttctttctcattcaccctgaagagcccaaagttggggtaataaacacataagctatactgtcttg

SEQ ID NO: 191193 - DNA, 601 bp, Human
tccaggaaagcgtaaattatccaagtcagaagtgacttatcctatccaaagtctggtccctgtctctctcacaggcttggagaggctgatgtgaatcttatctcttgttattagaatgggagtgtctagagggcaaggtcctggttgactggaccttgctgagcaccctaagctgagcacaccatgtagtagctgtcagtaaatgactgaatgaagtcgatgcaatcatgtctttgcatatgggagttcctcttcctggaatgcgactcaccccccttcagatccttcctgtccttcaggyccagtactgttccccagcttctccaggacatcacagcaatcccctcttctgccttacctttcccagcattgaccgtacttttcattgtgctgaactaactggatgcttcaggggaagggtagtctgaccttctgtttatttccagaagcccagggaagggctgagcaaaagctgtagaatgacatacccctcctcccccatcaatccacagactctgatgctgggaacaaggaagaacctctaggaccagaagacacaagacataagtaaccaacttctttctcattcaccctgaagagc

SEQ ID NO: 191194 - DNA, 601 bp, Human
atttgcctctctaagcttcaatttccttatctttcaaatgcagtggcaacgtacagtacctaccacatagcactgttataaggactaagtgcattaatgtataatatgtgcacaatgtaggtactttgcaagtgtgagttcccagctccctgttccagagggattttcaatgtcctctgcaaacaagccaggatcattcttgcctctgaacttttactctttgtttttccctctgctgccattccctctcccttctctaatcttccttactccttaaggcctaacttaagtctcacagttscataaggttactgaattcttctttggatatccattgcatggctacctgtcgcccaggttagagtgcagtgtcgcgatctcagctcactgcaatctccacctcccgggttcaagtgattctcctgcctcagcctcctgagttattgggattacatgcatgtgccatcatgcccagctaatttttgtatttttagtagagacaggatttcatcatgttggccaggctggtcttgaacacctggcctcaagtgatccacctgccttggcctctgaaagtgctgggattacaggagtaagccac

SEQ ID NO: 191195 - DNA, 601 bp, Human
tgacttattcactaagtggctttttcaaaagaatcattaagcccagctcagtggtgcacctgcagtcccagctactagggaggctgggcccaggagtgaagggttgtagtgtgtacactagtcaaggttatcgtccctgtgagtagccactgcactccagcctgagcaacacagcaagaccccatgtctcaaaaaaaaaaaaagttatttagtaaatcaatggttgccaatctgttttgttttgttttttcttttggagcaaggtcttgttctgttgcccaggctgaaatgcagtggtgcyatcacagctcactgtagtctcaacctcccaggctcaaggcatcctacctcagcctcctgagtagctgggactacaggcaggcaccaccacacctggctaatttttgtatttttaatgcatctttttgtttgtttgtagagacagggtcttgccatgttgcccaggctggtcttgaactcctggtctcaagtgatcctcctgactagccctcccaaagtgctgggattatgggcgtgggccaccatgcctggccagatctgtatgttattagacaaattacaatgacttattctggctttt

SEQ ID NO: 191196 - DNA, 601 bp, Human
gttatcaactagcaatcagtaaatcagctctcaaaggagaggggaaggacagggtagcttccgggctgggaagggaacgaggaccgacactggaaaaggatgatgagtatggtagtgtccagaaacaagcagagcaaaggcagtgtggtatagggccaagagtactggatacctgactctgatgtcttgagtttatctgccgaccttgacccttgataaaaaagccctcatatggtataagcctttataggtcacatgttattatgtcatttgacctttataacaacctgttagtactatkcctattctacagatgaggaaacaaattcagaacagtaaaagtaactcaacatcacacagctagttagtgtgggagccagaacacaaacccagttttgtgacccaaagtcctgtgttttccttggtgcatcatacagtcttcaagttaccccttaccagctaactgtgtgaccttgatcaggtaagttactgcccttcctggagcctctgtttctttatctgtacagtagaagtaataatagtacccctcccagcctcaagggcagcatcaaggaacctgaccatgggaatgaatacactt

SEQ ID NO: 191197 - DNA, 601 bp, Human
taagacttaaagctccttggaggcaggtggcattatttgtgcccagcggattacgtgggaagccttgacattcaaagcagaactcctgggcctgtaatcttcagttccacacagagcaggagagtgggtgttgacagtatgactgaaaagcccagcactgggctggcccaggcaggaaggcaaggagggaactccggctggctgtcacaaggcccaagagagtggaagtacagctctctaaagaggtggttatcaactagcaatcagtaaatcagctctcaaaggagaggggaaggacagsgtagcttccgggctgggaagggaacgaggaccgacactggaaaaggatgatgagtatggtagtgtccagaaacaagcagagcaaaggcagtgtggtatagggccaagagtactggatacctgactctgatgtcttgagtttatctgccgaccttgacccttgataaaaaagccctcatatggtataagcctttataggtcacatgttattatgtcatttgacctttataacaacctgttagtactatgcctattctacagatgaggaaacaaattcagaacagtaaaagtaactcaacat

SEQ ID NO: 191198 - DNA, 601 bp, Human
tacgcttgctgggcctcagttttcctatccaggaattagagattaaaatggttgttacaagagcactaggtggatgaactaagacttaaagctccttggaggcaggtggcattatttgtgcccagcggattacgtgggaagccttgacattcaaagcagaactcctgggcctgtaatcttcagttccacacagagcaggagagtgggtgttgacagtatgactgaaaagcccagcactgggctggcccaggcaggaaggcaaggagggaactccggctggctgtcacaaggcccaagagastggaagtacagctctctaaagaggtggttatcaactagcaatcagtaaatcagctctcaaaggagaggggaaggacagggtagcttccgggctgggaagggaacgaggaccgacactggaaaaggatgatgagtatggtagtgtccagaaacaagcagagcaaaggcagtgtggtatagggccaagagtactggatacctgactctgatgtcttgagtttatctgccgaccttgacccttgataaaaaagccctcatatggtataagcctttataggtcacatgttattatgtcatttga

SEQ ID NO: 191199 - DNA, 601 bp, Human
gtgtgtttgtgcgcgtgcacgtgtgcatgcaacgtcaggacattcagatagagaccctcagacagtgggtcagggaagggcataaggaccctctaggccagtggagagtcaaatagagacctcagactggaagttgagagacctaagttctaaccccagctctgctgactcactataaccaagcatgaggcatttacgcttgctgggcctcagttttcctatccaggaattagagattaaaatggttgttacaagagcactaggtggatgaactaagacttaaagctccttggaggcaggkggcattatttgtgcccagcggattacgtgggaagccttgacattcaaagcagaactcctgggcctgtaatcttcagttccacacagagcaggagagtgggtgttgacagtatgactgaaaagcccagcactgggctggcccaggcaggaaggcaaggagggaactccggctggctgtcacaaggcccaagagagtggaagtacagctctctaaagaggtggttatcaactagcaatcagtaaatcagctctcaaaggagaggggaaggacagggtagcttccgggctgggaagggaacga

SEQ ID NO: 191200 - DNA, 601 bp, Human
gggaaccccttacccccccagcctgggctctcaccactggttcagaagcttcaaaaatcaatgacaagtggggaagaaaatccccactgggaagtggaaaagaaactttcgtcatgtgggggctgcaaaggacccagggcttggtcccacctccctcccaggctacagtttgccttggaatcagctgggagaggaatggtttcactctatgaagttgtgtctctggttcacattaaaaaatatttccatcctatttgcatgaatgagagagagtgtgtgtgtgtgtttgtgcgcgtgcacrtgtgcatgcaacgtcaggacattcagatagagaccctcagacagtgggtcagggaagggcataaggaccctctaggccagtggagagtcaaatagagacctcagactggaagttgagagacctaagttctaaccccagctctgctgactcactataaccaagcatgaggcatttacgcttgctgggcctcagttttcctatccaggaattagagattaaaatggttgttacaagagcactaggtggatgaactaagacttaaagctccttggaggcaggtggcattatttgtgcccagcg

SEQ ID NO: 191201 - DNA, 601 bp, Human
tgggaaccccttacccccccagcctgggctctcaccactggttcagaagcttcaaaaatcaatgacaagtggggaagaaaatccccactgggaagtggaaaagaaactttcgtcatgtgggggctgcaaaggacccagggcttggtcccacctccctcccaggctacagtttgccttggaatcagctgggagaggaatggtttcactctatgaagttgtgtctctggttcacattaaaaaatatttccatcctatttgcatgaatgagagagagtgtgtgtgtgtgtttgtgcgcgtgcaygtgtgcatgcaacgtcaggacattcagatagagaccctcagacagtgggtcagggaagggcataaggaccctctaggccagtggagagtcaaatagagacctcagactggaagttgagagacctaagttctaaccccagctctgctgactcactataaccaagcatgaggcatttacgcttgctgggcctcagttttcctatccaggaattagagattaaaatggttgttacaagagcactaggtggatgaactaagacttaaagctccttggaggcaggtggcattatttgtgcccagc

SEQ ID NO: 191202 - DNA, 601 bp, Human
ctgggaaccccttacccccccagcctgggctctcaccactggttcagaagcttcaaaaatcaatgacaagtggggaagaaaatccccactgggaagtggaaaagaaactttcgtcatgtgggggctgcaaaggacccagggcttggtcccacctccctcccaggctacagtttgccttggaatcagctgggagaggaatggtttcactctatgaagttgtgtctctggttcacattaaaaaatatttccatcctatttgcatgaatgagagagagtgtgtgtgtgtgtttgtgcgcgtgcrcgtgtgcatgcaacgtcaggacattcagatagagaccctcagacagtgggtcagggaagggcataaggaccctctaggccagtggagagtcaaatagagacctcagactggaagttgagagacctaagttctaaccccagctctgctgactcactataaccaagcatgaggcatttacgcttgctgggcctcagttttcctatccaggaattagagattaaaatggttgttacaagagcactaggtggatgaactaagacttaaagctccttggaggcaggtggcattatttgtgcccag

SEQ ID NO: 191203 - DNA, 601 bp, Human
tttcttaccagtaaaatgaggataaaataatatctacctcactgggtcattgtgagcattatataatacatgtaaagcatttaaaacagtgcctcgtccacaagtattagctatttttttttttttttttttgagacagagtctcactctgtcacccaggctggagtgcagtggcgtcatctcggcttactgcaagctccgcctcctgggttcacgccattctgcctcagcctctcgagtagctgggactacaggcacccaccaccacgcccggctaattttttgtatttttagtagagayggggtttcaccgtgttagccaggatggtctcgatctcctgacctcgtgatccgcccgccttggcctcctaaagtgctgggattacaggcgtgagccactgcgcctggccagtattagctattttttttttccaggctatacagacacaaaaggagagtgcacaaatttagggatctactagatcctctactaaatatggaccctttccaccaggagactggaaagtgttttggcacaggacagctgtcccaggtcactctgtgatgcagccataagtagaacctctctcaactcagggcc

SEQ ID NO: 191204 - DNA, 601 bp, Human
gggcgtggcagcaggcgcctgtaatcccagttacttgggaggctgaggcaggagaattgcttgaccgcaggaagcggaggttgcagtgagccaaaattgcgccactgcactccaacctgagcaacacagcgagactccatctcaaaaaaaaaaaaatgcatattctggcttggcgtggtggcttatgcctgtaatcccagcagtttgagaggccgaggggggtggattgtttgagtccaggagttttagaccagcctgggcaacatggcaaaaccctgttgctactaaaaaaaaaaaaaaatccaaaaaattagccaggcatggtggtggctacttgggaggctaaggtgggagaatcacctgagcccagaaagtagaggctgcagtgagccgagatcgggctatggcactccagcctgggcaaccgaagtgagaccctgtctccaaaaacaaaagcaaaaacaaaacggccgggcgcggtggctcacgtctgtaattccagcactttgggaggccgaggtgggcggatcacgaggtcaggagattgagaccatcctggctaacacggtgaaaccccgtctctactaaaaatacaaaaaat

SEQ ID NO: 191205 - DNA, 601 bp, Human
gtctgtgactcatccctgtcctctggactgaatctgaggccttggaactcacccagggtcttagtggaggcacagctctgagctatgggtgtagagcatctgaacccatctacacattgaccaaacacaggcaggttccagtctgcgggggagatggagaaggtgccaccatgctgctgcacaaatcccaggatagctggggaatgagaatccagcactttgggcctaggacctggaaggagaggtcttttgggagaggtatggggacatctgaaggaggacttcttggaaggggaggggytggagcagaggcaagagtgattttgtcagatggagagaaggttctccacatgggcggggctggcagaggcagatgcccagacaggtcacaactctctaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtg

SEQ ID NO: 191206 - DNA, 601 bp, Human
tcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcggg

SEQ ID NO: 191207 - DNA, 601 bp, Human
aaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggygggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaa

SEQ ID NO: 191208 - DNA, 601 bp, Human
aaagcagtggtgcaatcacagcactgcagtctcaatcttccaggctctgatgtttctttgatttcagcctcctaagtagctggagtacaggtgcatgccaccatacctgcctaatttttgtatttttcgtagagacagggtttccccatgttgcccaggctagtcttgaacttctgggctcaggaaatccacctgccttgacctttgaagtgctgggattacagtagtcagtcaccatgctcagccaatacttatccttaaatctctgagtttcttagttccctaacctttcaacaaattmcataactgcatagtctcattattggaaattaaacattagtaccatcattctttactttccaggttaactaccaccacataaatcatattacaagaaaataatataattttttcaaagccgtaaatttagttccttaaaaattctacttgcacttagttatctaggacctagtagacataaagtcaggtactggctgggcacagtggctcatacctgtaatcccagcactttgggaggccgaggtgggggatggcttgagcccaggaattcgataccagcctgggcaacatagcgaaaccc

SEQ ID NO: 191209 - DNA, 601 bp, Human
tttcactaaagtagtagtctcaatcaagggcaattctgacaatttcttcagacattcctgatcgttacaacctgcagaggatgtgttatgggtatctaatgggtagaggtaggaatgttgctaaatatcctacaatatacaacagagcccccacgataattatctggcccaaagtctcaaagttccaaagctgagaaacctttctctagagccatactgtgccaaatacttacggtcaatttcaaacaaaaagaatgcaccaagttctcaggaaatgtttacctaccttgcctctaatacrtactgttttgttttgtttcttttctttttttcttgagtcagagtctcgctgtcgcccaggctggagtgcagtggcacaatcttggctcactgcaacctccgcctcccgagttcaagcaattctcctccctcagcctcccgagtagctggggcaatgggcgcatgctgccacgcccagctaatttttcatatttttttttaagtacagatggggtttcaccatgttgcccaggctggtctcaaactcctgagctcaggcaatccacccgcctcggcctcccaaagtgctaggattacaggc

SEQ ID NO: 191210 - DNA, 601 bp, Human
aaaaaactgcaagtatttcccattacactgaattaagtacaaattcctcaatgtggtaattatggctgggcatggtggctcacgcctgtaatcccagcactttgggaggccaaagcgggtggattgcttgaggtcacgagttccagatcagcctggccaacatggtgaaagcctgtctctactaaaaatacaaaattagctgggtgtggtggcacgcacctgtaatccagctactcgggaggctgaggcaagagaattgcttgaacccacgaggcggaggttgcggtgagccaagatcacrtcattgcactccagccggggcaacaagagcgaaactctgtctcaaaaaataaataaataaataaatacatgtgaaatattttcactaaagtagtagtctcaatcaagggcaattctgacaatttcttcagacattcctgatcgttacaacctgcagaggatgtgttatgggtatctaatgggtagaggtaggaatgttgctaaatatcctacaatatacaacagagcccccacgataattatctggcccaaagtctcaaagttccaaagctgagaaacctttctctagagccatactgtg

SEQ ID NO: 191211 - DNA, 601 bp, Human
ttttcttcacatacttcaaagaaaacaacataatatatgtcagaatgcaaagactggtacatttagaggtcttctttttatgatatggagtcttgctctgtcacccaggatgaagcacagtggtgcaatctgcgctcactgcaacctctgcctcctgggttcaagcgattctctgcctcagcctcccagtagctgggactacaggtgcgtgtcactgtgcccaactaatttttctatttttagtagattcagggtttcaccatattagccaggatggtctcaaactcctaaccttgtgatycacccgcttcagcctcccaaagtgctggattacaggtgtgagccaccacacccggccagctaccactatatttttaagaatttttctttccttactaaaaaaaactgcaagtatttcccattacactgaattaagtacaaattcctcaatgtggtaattatggctgggcatggtggctcacgcctgtaatcccagcactttgggaggccaaagcgggtggattgcttgaggtcacgagttccagatcagcctggccaacatggtgaaagcctgtctctactaaaaatacaaaattagctg

SEQ ID NO: 191212 - DNA, 601 bp, Human
taaaaatacaaaaaattagcccagcgtggtgatgtgcacctgtagtcccagcaactcaggaggctgaggcaggagaattgcttgaacctgggaggcggaggttggagtacgctgagatagcgccactgcactccgacttgggcgacagagcacgactccgtctcaaaaaaacaaacaaataaaaaggtttgactgtagtgtcaaagagcagttagaattatctgaaaaggccattaaaatactcctctcttttccaactatgtatctgtatgaggctagattttcttcacatacttcaaasaaaacaacataatatatgtcagaatgcaaagactggtacatttagaggtcttctttttatgatatggagtcttgctctgtcacccaggatgaagcacagtggtgcaatctgcgctcactgcaacctctgcctcctgggttcaagcgattctctgcctcagcctcccagtagctgggactacaggtgcgtgtcactgtgcccaactaatttttctatttttagtagattcagggtttcaccatattagccaggatggtctcaaactcctaaccttgtgatccacccgcttcagcctcccaa

SEQ ID NO: 191213 - DNA, 601 bp, Human
gaactaacactcactgaattcttcactgtcacccatttacaatataaaaaattccactttcacttaaaagggtccttaatgaagcagcaaaaattattagttgtattatttctcaacactacagcacaattctttttaattcagtattgggaaatactcaaaaacttctgcttactgaaatacaaaggatatcaaggggcaaaccacctgtaattacttttgaaagctaaatgtagttgtttttctcatggaacaccattttaatttttttttttttttgagacagagtctggctctgtcrcccaggctggagtgaagtgacgcaatctcggctgactgcaagctctgcctcccaggttcacgacattctcctgcgtcagccttccgagtaactgggattacaggcgcccgccaccacgcccagctaattttttgtatttttagtagagacgggttttcaccgtgttagccaggatggtcttgatctcctgaccttgtgatccgcccccctcagcctcccaaagtgctgggattacaggcgtgagccactgcgccccgcccaccattttaatttcaaagaatgattgacaaactaggttat

SEQ ID NO: 191214 - DNA, 601 bp, Human
tgaactaacactcactgaattcttcactgtcacccatttacaatataaaaaattccactttcacttaaaagggtccttaatgaagcagcaaaaattattagttgtattatttctcaacactacagcacaattctttttaattcagtattgggaaatactcaaaaacttctgcttactgaaatacaaaggatatcaaggggcaaaccacctgtaattacttttgaaagctaaatgtagttgtttttctcatggaacaccattttaatttttttttttttttgagacagagtctggctctgtyacccaggctggagtgaagtgacgcaatctcggctgactgcaagctctgcctcccaggttcacgacattctcctgcgtcagccttccgagtaactgggattacaggcgcccgccaccacgcccagctaattttttgtatttttagtagagacgggttttcaccgtgttagccaggatggtcttgatctcctgaccttgtgatccgcccccctcagcctcccaaagtgctgggattacaggcgtgagccactgcgccccgcccaccattttaatttcaaagaatgattgacaaactaggtta

SEQ ID NO: 191215 - DNA, 601 bp, Human
ggatggtctcgatcttccgacctcgtgatccgcccacctcagcctcccaaagtgctagcattacaggcgtgagccacggcacacagccccatttacctatcaagaaggttgagtgtgcaaatactagtaagctctgtgtcaaacgaagtaaaattaaagatgtgaagtgatgagtgactgtaacatttactgaggatgaactgttcccttcacgaacagaccagccctaattcaggtgctcaattcttttccccttgactaatgattttcaaatattttttagccatgaaacccgacatayaaaacagacataagcagaagctgctctggctgaagtgaagagggagtaggtacagtagaaccccaccagctctgccctatgaagcagcttagggctctatgaaccaatgtgaaatattgttctagattagtggttctcaaagtgtgacccaaagacccctaaaagtccccaacacttcttccaggggttcaatgaaatcaaaaccattttcacaataaaactaagacactttgccctttttctttactgttctgacctctgtgctgacgtgcaaaatcaatggtgtgcaaaaatgctggg

SEQ ID NO: 191216 - DNA, 601 bp, Human
agcctgggtgacaagagtgaaattctgtctccaaaaataaataaataaataaatttctaaaagtgaaaggatatatacctaactattaagaatcactgtataaggctgggcacggtggctcacgcatgtaatcgcaccattttgggaggcccaaagtgggcggatcacctgaggtcgggagttcaagaccagcctgagaagcaaggagaaaccccgtctctactaaaaaatacataattagccagttgtcgtgacgcatgcctgtcatcccagctattcgggaggctgaggcaggagaatygcttgaacccaggaggcagagattgcagtgagccgagatcgtgccactgcactccagcctggataacaacagtgaaactccatctcaaaaaaacaaccaaaaaaaaacctgtcagttaccatcattgactcttaaaatctaaagttaattcaaaataaaaagttaaaaaaataaaaaattcctctgccacttgctactgtaagtcataatattcaatctctcagacctcaatttctacatctgaacaatagggattgtacagcctacaccaaaagactggtaggaggacaaagctgcctc

SEQ ID NO: 191217 - DNA, 601 bp, Human
ctgaaagactatgcaagcttcccaagacatttccaatttgctgctaactccagacgtaaatgggaagtagttttttcctttccacttcattaaactcctttgtatcaaagccagcaaacagcaaaaacaataaatatttgttagatgaatggactgtatagtacttcctactttacaaagcattttttcatacatcctctcatctaaccttcacaaaaatactagaagagccagggattatcacacacagttaaactgaatgaaaatttttgccctagataagaaaagagggctgggaaasgaggctgggtggaattccaggaagaagagattcattagcctagtgtaacctaataacatatcccaacaaaactatctggaaccttctgttttacagtatcctccctaggatagatctttgatcaagccattcccttggttagaacatcatatcctctctaaggccgggcacggtggctcaaggtctgtaatcccggcactttggaaggccaaggtgggcagatcaactaaggtcaggagttcgagaccagactggccaatagggtgaaacccccgtctctaataaaaatacaaacattag

SEQ ID NO: 191218 - DNA, 601 bp, Human
ttttacatatcttaacttttgtgatctctgtgaactctgggtacaatgacaaaacttagttttctacccagaaaagtagtggatatcctgaaatgtggtcaaaacgtttacaactccaggcaactgtcaactttaagactatctgaaagactatgcaagcttcccaagacatttccaatttgctgctaactccagacgtaaatgggaagtagttttttcctttccacttcattaaactcctttgtatcaaagccagcaaacagcaaaaacaataaatatttgttagatgaatggactgtakagtacttcctactttacaaagcattttttcatacatcctctcatctaaccttcacaaaaatactagaagagccagggattatcacacacagttaaactgaatgaaaatttttgccctagataagaaaagagggctgggaaacgaggctgggtggaattccaggaagaagagattcattagcctagtgtaacctaataacatatcccaacaaaactatctggaaccttctgttttacagtatcctccctaggatagatctttgatcaagccattcccttggttagaacatcatatcctctc

SEQ ID NO: 191219 - DNA, 601 bp, Human
gccttataatacacccagtagtccaatcaatggacagacatatattctgacactgtccaaactgaagttctatacactgatatactgttttacatatcttaacttttgtgatctctgtgaactctgggtacaatgacaaaacttagttttctacccagaaaagtagtggatatcctgaaatgtggtcaaaacgtttacaactccaggcaactgtcaactttaagactatctgaaagactatgcaagcttcccaagacatttccaatttgctgctaactccagacgtaaatgggaagtagtkttttcctttccacttcattaaactcctttgtatcaaagccagcaaacagcaaaaacaataaatatttgttagatgaatggactgtatagtacttcctactttacaaagcattttttcatacatcctctcatctaaccttcacaaaaatactagaagagccagggattatcacacacagttaaactgaatgaaaatttttgccctagataagaaaagagggctgggaaacgaggctgggtggaattccaggaagaagagattcattagcctagtgtaacctaataacatatcccaacaaaa

SEQ ID NO: 191220 - DNA, 601 bp, Human
aaatattctctctcctgaaatttcctaggaaaaaaaatcaaatacttaagttctttatctcaatatccaaaaactgagtaactcctttgattaaacaaagctcactaaaaccagtggttctagagggccacatcagaattaggtggcaagcttttcaaaatacaaactctggctggttacactggctcacatctgtagatcccaatgctttgggaagctgaggcaggatgatctgcttaaagccagacaagcttggacaacacagcaagactctgtctctattaaaaaaaacaaaaaaaamaaaaaaaaccaaaaaacatggtgcacacctgtacgaagctccagctactagtgaggttgaagctagagaatcactttagcccaggagttcaggcctgcagcaaggtacaatggtgccactgcactccagcaagcaagcaaacaaacaaaaatacaaacccccaggctccattctagaaatattgaacaaaaatgtctagggctggggtacagacatttgcattcagaaaaagttcaagttactctaaagcacacccttggccgggcgcggtggctcacacctgtaattccaacactttgg

SEQ ID NO: 191221 - DNA, 601 bp, Human
gctttacagaaatattctctctcctgaaatttcctaggaaaaaaaatcaaatacttaagttctttatctcaatatccaaaaactgagtaactcctttgattaaacaaagctcactaaaaccagtggttctagagggccacatcagaattaggtggcaagcttttcaaaatacaaactctggctggttacactggctcacatctgtagatcccaatgctttgggaagctgaggcaggatgatctgcttaaagccagacaagcttggacaacacagcaagactctgtctctattaaaaaaaacaaaaaaaacaaaaaaaaccaaaaaacatggtgcacacctgtacgaagctccagctactagtgaggttgaagctagagaatcactttagcccaggagttcaggcctgcagcaaggtacaatggtgccactgcactccagcaagcaagcaaacaaacaaaaatacaaacccccaggctccattctagaaatattgaacaaaaatgtctagggctggggtacagacatttgcattcagaaaaagttcaagttactctaaagcacacccttggccgggcgcggtggctcacacctgtaattcca

SEQ ID NO: 191222 - DNA, 601 bp, Human
atataatagaattaaatattgcattttgaggtcttccccaaattctagtatcccactaacacttccagtcattctaataaccaaacattttgtgcaacactgaaaaagataaggctgtcccttaaataaatgctttacagaaatattctctctcctgaaatttcctaggaaaaaaaatcaaatacttaagttctttatctcaatatccaaaaactgagtaactcctttgattaaacaaagctcactaaaaccagtggttctagagggccacatcagaattaggtggcaagcttttcaaaayacaaactctggctggttacactggctcacatctgtagatcccaatgctttgggaagctgaggcaggatgatctgcttaaagccagacaagcttggacaacacagcaagactctgtctctattaaaaaaaacaaaaaaaacaaaaaaaaccaaaaaacatggtgcacacctgtacgaagctccagctactagtgaggttgaagctagagaatcactttagcccaggagttcaggcctgcagcaaggtacaatggtgccactgcactccagcaagcaagcaaacaaacaaaaatacaaaccc

SEQ ID NO: 191223 - DNA, 601 bp, Human
tgtatccaaactatgcacccggtcatttaaggaactgaaccaaactgttccaagaacgcctacacagaaaagtttggttccccctgtctgaataagaatagcttcatagtgaaacacccaagaatgatcaattaaaaaaaaataaataaaataaaaataaaaaatagcttcatagtttactcagagctttccccctccacaaattttccttaaatttagatgcctgctacctcttttctgctagcagacaataaattaataagtaaactactttcagcataaaaactctgaaaacagtcawtcatgctcatctggattctgtgacagagatgatgatttttctattatagccacacaatgtatgtaaagagtagtcttttcttctaggaaactcaggccgtgttcatataatagaattaaatattgcattttgaggtcttccccaaattctagtatcccactaacacttccagtcattctaataaccaaacattttgtgcaacactgaaaaagataaggctgtcccttaaataaatgctttacagaaatattctctctcctgaaatttcctaggaaaaaaaatcaaatacttaagttcttt

SEQ ID NO: 191224 - DNA, 601 bp, Human
aaagtttaaatgtaaataaggattgcttcaggcaattagtcatacacgatactgggtaggaagggaggtagatctccggagggttgatgggaattagacacttccacattttaacatttctgtgacatgaatgtcacatcatgttcacagggtaaattccagggcagttatttcataactgcattttagacttcaacattaagagaattattttctggtctgaaaattagtaacaaattataactttctgtcaaccaaaataatataaatattttaagtatcttctactgacaatcagaakaaggccatgaaaacttagaatttatttctactttcttaaaaactgttaaagagatcttatcctaattattttttcaagacgactttgttataaatatgaaagtaaaaataaaattcccacctaaagcttatcagagtggatttgttcttagtaagggagattaaggtttctccctcttttgtcctttttaaaaacttactctgtccaaatgttgaagttgtgccaaagccacctgtgccacccccaaagggtgttccaaatgatttgttaaacatcttcaaaatgagtctttgtttcaga

SEQ ID NO: 191225 - DNA, 601 bp, Human
aaaagtttaaatgtaaataaggattgcttcaggcaattagtcatacacgatactgggtaggaagggaggtagatctccggagggttgatgggaattagacacttccacattttaacatttctgtgacatgaatgtcacatcatgttcacagggtaaattccagggcagttatttcataactgcattttagacttcaacattaagagaattattttctggtctgaaaattagtaacaaattataactttctgtcaaccaaaataatataaatattttaagtatcttctactgacaatcagargaaggccatgaaaacttagaatttatttctactttcttaaaaactgttaaagagatcttatcctaattattttttcaagacgactttgttataaatatgaaagtaaaaataaaattcccacctaaagcttatcagagtggatttgttcttagtaagggagattaaggtttctccctcttttgtcctttttaaaaacttactctgtccaaatgttgaagttgtgccaaagccacctgtgccacccccaaagggtgttccaaatgatttgttaaacatcttcaaaatgagtctttgtttcag

SEQ ID NO: 191226 - DNA, 601 bp, Human
tccctattaaaaatataaaaattagccgggcatggtgccatacacctgtcatcccagctactcggggggctgaggcaggagaactgcttgaacccaggaggcagaagttacagcgagctgagaaaaatgagccaggcgtggtggtgtgcaactgtggtcctagctacttaggaggctgaggtatgaggagtgcttgggtctgggaggttgaggctgtagtgaaccataatagagccaatgcactccagcctcggtgacagtgcaggatcctatctcaaaaaaaaaaaaaaaaaaaaaaaaattttcatcaattagagaaaagtttctgggatttaatttattctgttaagatgctctcctcctcctggaaagaaagagataaaaacaagtctgggaaaatgctgattgttaaagttgggatataagtacatgagagttcattataccattctttccagacttggatgagtataaacatttttaacaaagtgtcacagctcttttagaatttgtctagcagggtttctggttttcaccaggaaacaaaattttttttttgcagagggggtggactttctggttaaaaaaaaaaaaaaaaaaa

SEQ ID NO: 191227 - DNA, 601 bp, Human
aggccgaggtgggcgaatcatttgaggtcaggagttcaagaccagcctaaccaacatggtgaaatcccgcctctactaaaaattcagaaaaattagtgacactccgtagtcactgagataaatggtctttcattagcggaacacatcagaacaacctgggaagctttttcaaaatatacatgttcaggtttcaactccagagattctaattccatagtttttgatgagagatacatattttgaataaaaacttccaaaggtgactgtgatgggcacttttagttaaaaaccacagacatgkacgtagaattctttaaaaaggagatcaggagccacttaagaaaacttccctgccaggtgcggggaagttacaggctcacgcctgtaaccccagcactttgggaggccgaggcaagcagatcatgaggtcaggagatcaagaccatcctggctaacacggtgaaaccctgtctccacttaaaatacaaaaaaaaaaaaaaaaaattagccgggcctggtggagggtgcctgtagtcccagctaccggggaggctgaggcaggagaattgcttgaacccaggaggcggaagtcgccgtgagc

SEQ ID NO: 191228 - DNA, 601 bp, Human
ttcctgctctagtctcttcataccaaatataaaacagagacaagaagaaggtgcctctgcagcacaatatggctgactgtaacacactcctccttgaaattctcccatcttaacatgaactacactactctgacctggcttttcatcctttctctagccattttgcatcaggaagctcttcctctgcatatcccttaaataacagtgcttcaaatttctatccttatagaaatgtacatactctcttcctttccagcctattaaccttttcagtacatattgaagttttcctcttcccttrtttttgccatttagtaggaaaagaaggtagatgaacacagaaaaacggagaaaagacaacacattcaataagcaaaccaaattattagatgcagaactccagtgatgtcccacttactgccaaagccagttggtttattttgtgcaaaggcattgttttgggatgagaagagactggtccctgtgcttgcagttccaaacaaggtatttgctgttcctgttgacgtaccaaacccaaagccagtgcttgtggaggtagctggctggctaaatgaactggttccaaacaatcctcctgagg

SEQ ID NO: 191229 - DNA, 601 bp, Human
tatggtggtggactcttgtaatcacagctactcaggaggcggaggcaggagaatcacttgaacccaggaggtagaggttgcagtgagctgagattgcaccaccacactccagcctgggcaacaagagcgaaactccatcttaaaaaaacaaaataacaaaaaaaaaaaagaaaattgaacagttgaccattcagaagcaaattcttaacacagtaaattcaaattctaccttacaccagattataataaagttttatgaatacaaattttattgggatgagcctaattcaaatatacatcrtaatctagatttacatttcacaagtgttcctgtctactatacaactatttatagattttgtttttaacacatcgttcaggcagtgtcaagctaagctggaaagagaagcaattttacaattcatcctgcaaagaaatatacatgcgggaaaaaacattccacaaagattggaagaaaatacatacgttaaatttaatagtagtcccagtaggagcagctgtaaaactacttggcccaaagagggagccagatgtgctgccaaaaggattagaggtggtatttgtggttccaaagagtcct

SEQ ID NO: 191230 - DNA, 601 bp, Human
tcaaattcggggttgtaaatttagtactatgaattaaccaatttacctgacaaattcttcattttctggagtatattttaacaagttttatttctgccaaagatttccattaggctaactgcacctccagcataccctaagaatcccccaaacatttacatcaagtggcattccacatgtttctgtaaacaaaatcctccactctagccctccacccaatccctctcaaaaaaagaacacatacacaataaactttacagccccatttagccatttcatcaacaaaacctgtatttttcaktgggtacagaatgctgatgagttactcttatttgccccctattctttattcccataaagattagttgaccaggccgggcatggtggctcatgcctgtaatcccaacactttgggaggcagaggtgggcagatcacctgaggtcagcagttcgagaccagcctggccaccatggtgaaacgccatctctactacaaaaaactacaaaaaaattagctgggtatggtggtggactcttgtaatcacagctactcaggaggcggaggcaggagaatcacttgaacccaggaggtagaggttgc

SEQ ID NO: 191231 - DNA, 601 bp, Human
aaatcgatcttagtaacaaagtaatcacaaacgcagggattaatcccataacccaagccatccaattacatggtaaaatacatgtaatattatgcataaagaaagctttacccaatatatacctttaaacctctatatctaagttctcctttctactccgccctgtaatgctgcattaaaaaaatacggagggccaggagcggtggctcacgcctgtaatcctagcactctgggaggccgaggcgggtggatcatgaggtcaggagttcgagaccagcctggctaatatggtgaaaccccrtctctactaaaaaataaaaaaataaaaaataaaaatgagccaggcgtggtagcgtgcacctgtagtcccagctactcaggaggctgaggcaggagaatcgcttgaatccgagaagcggaggttgcagtgagccaagaccgtgccactgcactctggcctgggcgacagagtgagactccatctcaaaaaacagcaacaacaaaaaaacagaaactggccaggcgcagtggctcacacctgcagtcccagcactttgggaggccgaggcgggtggatcacttgaggtcaggagttgaagac

SEQ ID NO: 191232 - DNA, 601 bp, Human
aataaatcgatcttagtaacaaagtaatcacaaacgcagggattaatcccataacccaagccatccaattacatggtaaaatacatgtaatattatgcataaagaaagctttacccaatatatacctttaaacctctatatctaagttctcctttctactccgccctgtaatgctgcattaaaaaaatacggagggccaggagcggtggctcacgcctgtaatcctagcactctgggaggccgaggcgggtggatcatgaggtcaggagttcgagaccagcctggctaatatggtgaaacsccgtctctactaaaaaataaaaaaataaaaaataaaaatgagccaggcgtggtagcgtgcacctgtagtcccagctactcaggaggctgaggcaggagaatcgcttgaatccgagaagcggaggttgcagtgagccaagaccgtgccactgcactctggcctgggcgacagagtgagactccatctcaaaaaacagcaacaacaaaaaaacagaaactggccaggcgcagtggctcacacctgcagtcccagcactttgggaggccgaggcgggtggatcacttgaggtcaggagttgaa

SEQ ID NO: 191233 - DNA, 601 bp, Human
ataatgtgcctgggtgctgcagctcatgcctgtaatcccagcactttgggaggctgaggtggacggatcacaaggccagggttcaagaacagcccggccaacgtagcaaaatcccatctctactaaaaatacaaaaattagctgggcatagtggcgtgcagctgcaatcccagctactcaggaggctgaggcaggagactgcttaaatccaggaggcagagattgtagtgagctgagatcacgccactgcactccagcctaggcaacagagcaagactcgtctcaaaaaaaaaaaaaaaaattagctgtgtgtggtggcccacacctgtaatccaagctactagggaggctgaggcacgagaattgcttgaacctaggaggtggaggttgtagtgagccaagatgtgccactgcacaccagactgggtgacggagtgagatgctgtctcaaaaacaaacaaacaaaaaaaacaaaaaaaaaccaacttttattaagctgtactttgcataattttactaaaaacaccttcatatgcatgcatacacattgcccagtgtaacagaagcaacatccaatcagaacagatgattagactgggct

SEQ ID NO: 191234 - DNA, 601 bp, Human
cctcttttccatccttgtccaagacactaacacctcttatgttgataatagctttctaagtaatttgtttctactcttacaatctactgtcaatataggagacttcagaatcatccttcactcacaatcacatgacttctctttcaaaacaactttcaggatttcctaaatcaaataaaaattcaagtcttgatattggcctacaaagtcgtataaaatatggcccctatatcccccagtattttcccttgccctctcttcaaatggcaaaaactcagagtttttagactcagtttccacyagctggaatgttcttcccccagaaatctgtacaacttgctccttcatcttcttcagatacgtcactgctcaaacatcaccttctcctctgaagcattccttagtcgtcttcatcttaaactgtctttctccctttccccacatacatccaggcattcctccctattcctatggtatccctgaattattatttttctccatagcacttatcccaaaatggcaattatgttttagttttagttatctgtctctcctcagtataatctaacatgatatcaagtgcttactagttccaaaggca

SEQ ID NO: 191235 - DNA, 601 bp, Human
caagagttcaaggctgcagtgagctatgattgctccactgcactccagcctggtcaacaaagtgggattctgtctcaaaaaaaaaaaaaaaaaaaaaagcatactaaactaaatcatggaatatcaagattgaaaagtacgttaggctggacatggtggttcacactgggaggctgagacgggtgatcacctgagatcaggagttcgagaccagcatggccaatatggtgaaaccccgtccctgctaaaaattagggctggacggccagccatggtggctcatgcctgtaatcccagcacyttgagaggccgaggcgggtggatcataaggtctggagttcagatcagcctggccaagacggtaaaaccccatctgtactaaaaatacaaaaaaatcagccaggcatggtggtgggcatctgtaatcccagctacttcagatgctgaggcagagaatcgcttgaacccaggaggtggaggatgcagtgagccgagatcacaccactgcactccagcctgggtgacagagcgaaactccatctcaaaaaaaaaaaaaaacaattagggctggcaccatggctcacgcctataatcccagcgc

SEQ ID NO: 191236 - DNA, 601 bp, Human
aattatgaaacattagccaggcagaatggtgggaatattacttgggcccaagagttcaaggctgcagtgagctatgattgctccactgcactccagcctggtcaacaaagtgggattctgtctcaaaaaaaaaaaaaaaaaaaaaagcatactaaactaaatcatggaatatcaagattgaaaagtacgttaggctggacatggtggttcacactgggaggctgagacgggtgatcacctgagatcaggagttcgagaccagcatggccaatatggtgaaaccccgtccctgctaaaaatyagggctggacggccagccatggtggctcatgcctgtaatcccagcactttgagaggccgaggcgggtggatcataaggtctggagttcagatcagcctggccaagacggtaaaaccccatctgtactaaaaatacaaaaaaatcagccaggcatggtggtgggcatctgtaatcccagctacttcagatgctgaggcagagaatcgcttgaacccaggaggtggaggatgcagtgagccgagatcacaccactgcactccagcctgggtgacagagcgaaactccatctcaaaaaaaaaa

SEQ ID NO: 191237 - DNA, 601 bp, Human
gtaaagagtagagcccaggctagaatctaggtcttaattattctaagactttgttctcggccgggcacggtggctcatgcctataatcccagcactttgggaggccgaggtgggcggatcacgaggtcaggagatcgagaccatcctggcaaacacggtgaaaccccatctgtactaaaaacacaaaaaattagctggacatggtggtggacacctgtagtcccagctactcgggaggctgaggcaggagaatggcatgaacctgggaggcggagcttgcagtgagctgagactgggccamtgcactacagcctgggtgacagagcgagactccatctcaaaaaaaaaaaaaaaaactttgttctcttcccttcattaaataccctcaactcttaagatttgcagtacaggtagaatttgctagtttgacatgattagaatcctcattacttaactctaaaaataagacatggaggtaagtaagggtctgtttccttaccatggtgttggtgcttggctgtcctatggtgctggtattaccaaaggaaaagccagtgttctgggtggttgtagcctggccaaatggtttgctgaagaggct

SEQ ID NO: 191238 - DNA, 601 bp, Human
tgaaatatagtcagtaatgaataagtattttctcctataccctatagaatggctgtagtcaattttccaaggtatagctttaagagggccaagtccagcccactaagtagttcctacttagtaatgagaaaaatactttcagaaaggataagtgatcgcctcaatagcatctcaacaagtaaagagtagagcccaggctagaatctaggtcttaattattctaagactttgttctcggccgggcacggtggctcatgcctataatcccagcactttgggaggccgaggtgggcggatcacraggtcaggagatcgagaccatcctggcaaacacggtgaaaccccatctgtactaaaaacacaaaaaattagctggacatggtggtggacacctgtagtcccagctactcgggaggctgaggcaggagaatggcatgaacctgggaggcggagcttgcagtgagctgagactgggccactgcactacagcctgggtgacagagcgagactccatctcaaaaaaaaaaaaaaaaactttgttctcttcccttcattaaataccctcaactcttaagatttgcagtacaggtagaatttgcta

SEQ ID NO: 191239 - DNA, 601 bp, Human
acccagcccagctaatttttgtatttttggtagagacggggtttcaccatgtttgccaggctggtctcgaactcctgacctcatgatccgcccacctcagcctcccaaagtgctgggattacaggcaggagccagcatgcccggctgatccttttcatatgttactgaaatcagtcatctagtattttgaagacatggcggtacaagcatacttttttttttattttttttgggatgaagtctctcttcgtcgcccaggttggagtgccatggagcaatctcagctcactgcaacctctgyctccccctgggttcaaggctattcttgtgcctcagcctcccaagtagtcaggattacaggcaccaaccactgtgcctggctaagttttgtatttttagcagagacggggtttcaccatgttggccaggctagtctcaaactcctgatctcacaccttggcctcccaaagtgctgggattacaggcataagctactgtgcccagcccatacttgttttttaatcagtaaaagtatctctaattttaagacgaggtaaattccaagtcctgatcaattactcatacatcacttccttcttta

SEQ ID NO: 191240 - DNA, 601 bp, Human
actcatttccaatgagcagtctgcatcatcctatgtttaacaatgtattttacttatgcattaataaaggaaaaatattgtgctaatagacttgctgaatagggaattcactttttaaagttttattgagacacaattcaaacatcataaaattcactcatttacagtggactattccgtgatgttctgcaaccatccctactatctaaattcttacaccccccaaagaaatcccagacccatcagtgattactccccatccctagggaaccattcatctttttctatggattttttttttattctgaacatttaatgtgaatggagtcataaaaaatgtggtctttggtgacgggcttctttcagttagcacattttcaaggttcatctgtgttgtagcatatattagtacttcattccaatttatggttgaacaatattccattgtatgcatataccacaattggttacccattcattgttaatagatctttaggttatttctacattttagtcattatgaataatgctgttatgttcacttgtgtacaagtctatgtcttatttttcttcggtaaatcccaagatgtgcaattgctgg

SEQ ID NO: 191241 - DNA, 601 bp, Human
taactcttgtgctctaagagatgtcagggttgcaacactgagaagcaaaatagtatgtctaggtccttcattttcaacgatttaggtgaaaagaactaatcagtatcaagctggggagtgaacttagaatcaagtaaccaaaaataatcagcgaaaataaatcaacacggaccgaggtacgagtgttatgttaaagagccttaattcctttttttgatacggagtttcgttctgttgcccaggctgaagtacagtggcacaatctcggctcactgcagcctctgttcaagtgattctctcrcctcagcctcccaagtagctgggactacaagggcacgccaccaggcctggctaatttttgcatttttagtagagatggggtttcacaatgtgcccaggctggtcacgaactcctgacctcaggggatccacctgcctcagcctcccaaaatgctggcgtgagccactgcacccagccaaaagccttaattctaaatgagaaactatactcatttccaatgagcagtctgcatcatcctatgtttaacaatgtattttacttatgcattaataaaggaaaaatattgtgctaatagacttg

SEQ ID NO: 191242 - DNA, 601 bp, Human
caacaacaacaacaacaacagaagtactagaatgtcttgaagcattatataattttctcaatttcttacctcaattatctgtccaaagtttaaaaaaagaaaagagaaatttcaatctccatgaaaacaggaccatatgttttagggactttgtgttccttttttattttttaagacagagttttgctcttgttgcccaggctagagtgcaatagcgcgatctcgggtcactgcaacctccacttcctgggttcaagtgattctcttgcctcagcatctcaagtagctggtattacaggcrcccaccaccacacccagctagtggttgtttttttttttgtatttttaggagagacggggtttcaccatgttggccagattggtctcgaattcctgacctcaggtgatccacccacctcggcctcccagagtgctgggattacaggcgtgagccaccgcgcctggctcttttttaatttttttaacctactcacaatagcaagttcaaagtttcttccatgagtacctcaacaatttcaacaatttgatcaaccccaaaaacatttcattcccaaacatcataccaatttatcacctacaa

SEQ ID NO: 191243 - DNA, 601 bp, Human
tatttttcttattttattattttttttagagacctactttcactatgttgcctaggctggaatgcagtggcaattcacaagtgtgatcatagcacactgcagccttgaactcctaagtgatactcctgactcagcctccataatggctgggactacaggtgctcaccatgatgcctggcatattttgactttcactaagaataaccaggccaggtgcaatggctcacacctgtaatctcagcactttgggaggctaaggcgatataaagaccctgttctccaccaaaaaaaaaaaaaaaaacaaaaacaaaacaacacaacaaaccaacaacgacaaaaataagaataaccaattatcttctgtatgctaccacaggtttgaaacctggcctcatacaatgtgttacttaaccaaatgtgtttcctttatggtttctcagctattgctgaagtaatccaaagtaaatgaaaggcaatttacatgcctactaattatctcaagccatatccaggactttaaacctttccctctggtacttcacatcaagctaccgcttacctgagaacttttaaatatttccaatcatacgaatcaggagaa

SEQ ID NO: 191244 - DNA, 601 bp, Human
aaaggtttcaactttcttctattatttttcttattttattattttttttagagacctactttcactatgttgcctaggctggaatgcagtggcaattcacaagtgtgatcatagcacactgcagccttgaactcctaagtgatactcctgactcagcctccataatggctgggactacaggtgctcaccatgatgcctggcatattttgactttcactaagaataaccaggccaggtgcaatggctcacacctgtaatctcagcactttgggaggctaaggcgatataaagaccctgttckccaccaaaaaaaaaaaaaaaaacaaaaacaaaacaacacaacaaaccaacaacgacaaaaataagaataaccaattatcttctgtatgctaccacaggtttgaaacctggcctcatacaatgtgttacttaaccaaatgtgtttcctttatggtttctcagctattgctgaagtaatccaaagtaaatgaaaggcaatttacatgcctactaattatctcaagccatatccaggactttaaacctttccctctggtacttcacatcaagctaccgcttacctgagaacttttaaatattt

SEQ ID NO: 191245 - DNA, 601 bp, Human
ctaaaaatacaaagaaaaaattagccgggggtggtggtgggtgcccgtagtcccagctactcgggaggctgaggcaggagaatggcgtgaacccaggaggcagggcttgcagtgagcccatatctggccactgcactcccgcctgggagacagagcgagactccgtctcaaaaaaaaaaaaagaaagaaaaaagaaaaaacagtcccattacagcaggtacaacttaaaaatgaaaaaatagtctacaaacggtccatggggaagggtaagtgataatagaaaaggttgagaaacgctaaytgacccttaactatctttccattttaattttataggaaagaaataagtagggatgggtgcagtggctcacgcctgtaatcccagcactttgggaggccgaggagggcagatcgcctgaggtcaggagttcaaaaccagcctcgccaacacggtgaaaccccatctctactttaaatacaaaaattagctgggcatggtggcaggcgcctgtaatcccacctactcaggaggccgagacaggaaaatcactccaaccagggaggtggaggttgcagtgagccaagattgtgccattgcact

SEQ ID NO: 191246 - DNA, 601 bp, Human
aaattttgtcggctgggcgcagtggctcacgcctgtaatcccaaccttttgggaggccgaggtgagcggatcacgaggtcaggagatcgagaccatcccggctaacatggtgaaaccccgtctctattaagaatacaaaaaaattagccagacgtggcagcatgcgcctacagtcccagctacttgggaggctgaggcagtagaatggtgtgaacccgggaagcggagcttgcagcaaaccgagatcgtgccgctgcactccagcccgggcgacagagcgagactacatctcaaaaaaaawatatatatatatatctatatatctatatctatatctatatgtgtatatatatatatattttatcaagtgtagcctatacaaacacccttatagtgttcagataaaaataacgggctgggcgcagtggctcatgcctgtaatcccagcactttgggaagccaagacaggcagatcacctgagctcaggagttcgaggccagcctgggtgacatggcaaaccctgtctctacaaaaacacaaaaattagccaggtgtggtggtgcatgcctgtagtcccagctactcaggaggctgaggtgg

SEQ ID NO: 191247 - DNA, 601 bp, Human
aatatatctttaaaaaaattttgtcggctgggcgcagtggctcacgcctgtaatcccaaccttttgggaggccgaggtgagcggatcacgaggtcaggagatcgagaccatcccggctaacatggtgaaaccccgtctctattaagaatacaaaaaaattagccagacgtggcagcatgcgcctacagtcccagctacttgggaggctgaggcagtagaatggtgtgaacccgggaagcggagcttgcagcaaaccgagatcgtgccgctgcactccagcccgggcgacagagcgagactmcatctcaaaaaaaatatatatatatatatctatatatctatatctatatctatatgtgtatatatatatatattttatcaagtgtagcctatacaaacacccttatagtgttcagataaaaataacgggctgggcgcagtggctcatgcctgtaatcccagcactttgggaagccaagacaggcagatcacctgagctcaggagttcgaggccagcctgggtgacatggcaaaccctgtctctacaaaaacacaaaaattagccaggtgtggtggtgcatgcctgtagtcccagctactc

SEQ ID NO: 191248 - DNA, 601 bp, Human
ataaagagactattttagaacagatgaaagtatcactaatattatactttgttgtgccagtatttggattattatctcaatgaaaaaaatcaagaagaaagctgaagaatataaaagtttaaaaacaatcgtatttcatgtcattttaaaattcaagcaagcaggccgggcgcagtggctcacgcctgtaatcccgccactttgggaggccaaggcaggtggatcacaaggtcaggtgttcaagaccagcctggccaagatggtgaaaccccatatctaccaaaaaatacaaaaattagcygggtgtggtggcaggcgcctataatcccaactacttgggaggctgaggcagagagctgcttgaacctgggaggcgaaggttgcagtgagccaaaatcacgccactgcactccagcctgggtgacagagaaagactccatctcgaaaaaaataaatacatgaaataaaatccaatcaagtaacctgacttaatcgcaatatatttgacttagacattcattgaatctcttctttaattcttctaatagctatgccacaaaaatggggtgctgcctactcaagcatcatcaattttccttga

SEQ ID NO: 191249 - DNA, 601 bp, Human
tcttttcttcatctatgcccacagtttcattattctttttgtaaataaatatcaacaaaacaattaatgaatatgtcattaatttctcatgagagaaaagaaatcattagccagaaaaccctgtttgtagaacatatgaagtcatttaaaagtcataaagcactgggcatgatggctcacgcctgtaatcccaacacattgggaggcagaggcaggtggatcacttgaggaaaggagtttaagactagcctggccaacatgtgaaacctcttctctactaccacgaaaaaaaaaaaaaaaattagctggctgtggtggtgcacgcttggaatcccagcaatttgggaggctgacgcaggaagatcgcttgaaccaaggaggcagagggttacagtgagctgagatcacaccactgcactccagcctgggcaacagagcaagactccgtctccaaaagaaaaaaaaaatcatggaggaaaaagtagcccaaaaagataacaaacagaataaagagactattttagaacagatgaaagtatcactaatattatactttgttgtgccagtatttggattattatctcaatgaaaaaaatcaaga

SEQ ID NO: 191250 - DNA, 601 bp, Human
aacaggtcgacctcatctctccaaaatattaaaaaactagccaagcatggtggcttgcacctgttgtcccagttactagggaggctgaggtgggaggatggtttgagcctgggaggtagaggttgcagtgagctgtgatcatgccaatgcactccaccctgggtaacagagcaagaacctgtctcaaaataaaacaccttttatcttaaaaagaagactgaaggctgggcgcggtggctcatgtctgtaatcccagcacttagggaggttgaggtgggaggatcacgacgtcaggagttcragaccagcctggccaacatggggaaaccctgtctctactaaaaatacaaaaattagctgggtacggtggcgtgcgactgtagtcccagctactcgggaagtggaggttgcagtgagccgagattatgccactgcactccagcctgggggacggagcaagactccatctcaaaaaaaaaaaagggaaattgaaaaaaataaaaataaaaaccacaaaagcagatcatagtacaaaatgaggttccattaagaaggaaatgacagccaggcacggtggctcacacctgtaatcccagcactt

SEQ ID NO: 191251 - DNA, 601 bp, Human
aaattagctgggcatgtgggcacatgccagtaatcccagctactcgggaggctgaggcaggagaatagcttgaaaccaggaggcggaggctgcggtgagccgagattgtgccattgcactccagcctgggtaacaagagcaaaactccgactcaaaaaacaaacaagaatataatcctaaaccctaaatataaaagacatgtatgtacagacgtgtgtgtgtgtaaacatgtccgaaaaatgcacagaaacgggtctgacaagatacatgccaaacaaccctaatcatttcacagctgaaraagactggacttttcatgaaatttctgaattgttaaaaactttttaccagcacttacatcttttatcttaagcagagagcactgactcatgcctatattcccagcactttaagagctcaaggcaggaggatggcttcagcccaggggttcgagaccagcctgggcaaaacaggtcgacctcatctctccaaaatattaaaaaactagccaagcatggtggcttgcacctgttgtcccagttactagggaggctgaggtgggaggatggtttgagcctgggaggtagaggttgcagtgagc

SEQ ID NO: 191252 - DNA, 601 bp, Human
ctctaaatagcgtttttcaaaatgagattgatatgtatgtactgaccaaaagaaaaactggtattatgtgaaatgaaaatacaagtcacagaacactatgtaagacagtgctttcaaacattttcaactacagcacatgcaatgaaaatcactgagatccgaaacacataaacacaaacacaactgagacaaagtttcataaaaggatactaaccttaacattttaaatgttttttttttgttttttgttttaggacagcgtctcattctgttacccaggctggagtgcagtggtactatygtaacccactgcagcatctacctcccaggctgaagcgatcctcccacagcacatctcattcagctgcttgagtagctaggactacaggcacatgccaccatgcatatctattttattttatttttttgatagcatcttactatgttgctcaagatgatgttaaactcctgacgtcaagcaatcctcctgcctaggcctcccaaagtgctgggattagaagcataacccattaggcccagcctactgatttttaattctacttcattttcttcaaatgctgattgcaggcaactatattaa

SEQ ID NO: 191253 - DNA, 601 bp, Human
gtggtaggtgcagaaaaaaagaaacaataatccaacactatgaacagagaactgacttaaatggcaaataaaaaaaaaaacaaagatattcacctttgccagtaatcagtgaggtgcaaactggaatgtaccaatttctactgtcatgtatgaaaagacaaaaaagcccagtatggaaaatacagaaaaatgggcattgtatataatgtgagcaacacaaactggtatttttgaaaggcaaattagcaaattcaaccaaaatctgaaatatgcgtatattccaacactacaattccaattygatgtatcaatcctacaataaactaacacctgcaaaattatgtaacaaaaaatgttcactgagggttttgccaacatcatcaaataaatgtccatcaataggtgaaatgttaaataatggtatatgtatgatgtgtgtaaattgtgtgtacttaatggaatactaaataattttttttaggaatgagacttttctctggagtgcagcggaatgatcaccgctcactgcagtctcaacttccaaagctcaggtgattctcccacctcagcctcccgagtagcttggactacaggcacatgc

SEQ ID NO: 191254 - DNA, 601 bp, Human
agggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctatagtcccagctactcgggaggctgaggcaggagaatggcgtgaacccgggaagcggagcttgcagtgagccgagattgcaccactgcagtccgcagtccggcctgggcgacagagcgagactccgtctcaaaaaaaaaawaaataaataaattaagaggccgggcacagaggctcacgcctgtaatcccagcactttgggaggccgaggctggtggatcacttgaggtcaggagttcgacaccagcctggccaacatggtgaaaccccatctctaactaaaaaaatacagttagccgggtgcagtggcacatgcctgcaatcccagctacatgggaggctgaggcaggagaatcacttgaacccaggaggcggaggttgccatgagctgagatcacaccattgtactccagcctggcaacgagagaaactcggtctctaa

SEQ ID NO: 191255 - DNA, 601 bp, Human
aaagtaattctgatcacataaaaataaaacttgtggctgggcgcagtggctcatgcctgtaatcccagtactttggaaggccgaggcaggaggatcacgaggtcaggagttccagactagcctggccaaaatggtgaaaccccatttctactaaaaatacaaaaattaggttgaggcacaagaattgcttgagcctgggaggcagaggttgcagtgagccgagatcacaccactacactccagcctgggcaacagagcaagagtccatcttggaaaaaaataaaacttgtggcccagcacmgtggcttatgccgggaggctgaggcaggcagatcacctgaggtcagtcgtccaagaccagcctggccaacatggtgaaaccccatctctattaaaattacaaaaattattaacaacaaaaaaagaaaagccttccttaatttgaatttgagcaaaagaaaaaaaagaaaagaaaagccttccttaatttgcccgtaccaaagctattttttcctacagggttggaagaaaccattatttgatttcagatgatatattctgaatatgtttagggatcacactgtacaacaaaatgagagct

SEQ ID NO: 191256 - DNA, 601 bp, Human
aaagaagctatatggggggcaaaatggtaatagtggccttagaaactccaaagaaaatcaagaaaaaattgaaaatggttattttccttttgagatattccaaaattgttagaatttaaatttatctgaggcatctattagcaccagaaagatttttctatgtctctcttagtattacaatcaaccttcctatatgtagccattacttcaaggaaaacctgtagaacaaaggtttattattattactaaataaccaaggcagtggtgtgcaattgatagtgctaatgatgttaatatcacyataaaacaagaaattgttatgtccatgagttaatgaatgtttcttagtctcaacacatggggcgggagaaaatcacatgccaagggtcagtataaaaccttttatactaagattggtttcttacatcgaagcatacaaaaatatcttatgtatctgtacatttaatatttgtgtaacaactactcattaagtacccaaacgcccacattacaggaggcttgagtttgaatcaccatcactgaaaataagaagctgcagagaaacacccacttagctattgcctcccaaaaatacagcctg

SEQ ID NO: 191257 - DNA, 601 bp, Human
aaaaaagaaatgaagtttatatagaaaactacatattgccattctcctaatcactgatgctcaatacacaggtcaaagtatgcctttctctaagtaaacacataaaaaggagaagggcaactactgtggttactgcaatcatcccagagctaagaatctgacattctaacatttagaggaccctctgataatagccggtttctagattacttactctaaagtaaaacatactgggaaacaagccctactcacgtacaaagagttgccagtgagcttttaaatataaatatatatatatatwtttttttttttggagacagagtctcgcactttcgcccaggctggagtgtagcggcgtgacgtcggctcggtgcaacttccgcctcccaggttcaagcgattctcccgcctcagcctccagagtagctgggattacaggcatgtgccaccatacctggctagtttttctatttgtggtagacatcatggggttttgccatgttggccaggctggtctcgaacgcttgacctcaagcaatccgcctgcctcagcctcccaaagtgctgggattacagtcatgagccaccatgcccagcctat

SEQ ID NO: 191258 - DNA, 601 bp, Human
ggtggcaaatgaacacatgagaaaatctaacaaatttctaggggaaagatgtggacagaggactgatcaagcaggatacagaaaactatagcttagagtacactcaaaagcagttacagctgacctttgaacaacacaagtttgaactgtgtggatccacttatgtgtggatttcctcctctgccacccctgagagagcaagaccaacaccttcctccaccttatgattttcctaataatacattcttttctttagcttactttatagtaagaatatagtacgtactacatataatatacrtaatttgtactgtttatgttgtcagtaaagcttgggaatcaaagattatttgcaaattatcaactgtgtgggggtcagcacccctaaccctcatgttgtccaagggtctactagtatgatcaaatgacgcgtatctaccttggagaatcccagaagtctagggacttcagaataccaggtttgatgaagtagaattgaaaacaggaagaggaaagaattaatggaaagtctaagccaggcgcggtggctcacacctgtaaccccagcactttgggaggccgaagcgagaggattgcttga

SEQ ID NO: 191259 - DNA, 601 bp, Human
aatttgtttcattgtggaaatatgaaattatctttaagtaaaatttccagaataaaaatattatgtacattaaggctacagaggaaggcagcatacaaacaaaaatgtggttttttcttttcccccaaatccaggtgtcttcctgaagaaaatgcttaggctatccttataagtttattatttacatttatttaacattcaaataatataaactgaaagaaaaaagaaatcactaagcctaattttttctcaaagtgtaagaacatctgttatcaattgcagagaatttagggaacagacrtaagtaacaatgaagactattcatgatctaccattgtaccaagtaaaacattaagaaaaaagcaaaaccactacagtataccctgactgaagaagaaacctctttgcaagataaaatctctttccaaaaatactgatcaaaacccaaaacataataaagtcattttacagacaaaaatactacctttttcccttataaacatttacaaataaagttactgccaaaatataatacaataatccacagtaaaggagtgacataaaactttctgaaaagtctcacaatgttgtggggagtggg

SEQ ID NO: 191260 - DNA, 601 bp, Human
gcctgggtgaaagagcgagactctgcctcaaacaaacaaacaaaaaagttgtaaacatcatgacacatcaacataggttatgtagttattaaaaataataatttgtttcattgtggaaatatgaaattatctttaagtaaaatttccagaataaaaatattatgtacattaaggctacagaggaaggcagcatacaaacaaaaatgtggttttttcttttcccccaaatccaggtgtcttcctgaagaaaatgcttaggctatccttataagtttattatttacatttatttaacattcamataatataaactgaaagaaaaaagaaatcactaagcctaattttttctcaaagtgtaagaacatctgttatcaattgcagagaatttagggaacagacgtaagtaacaatgaagactattcatgatctaccattgtaccaagtaaaacattaagaaaaaagcaaaaccactacagtataccctgactgaagaagaaacctctttgcaagataaaatctctttccaaaaatactgatcaaaacccaaaacataataaagtcattttacagacaaaaatactacctttttcccttataaaca

SEQ ID NO: 191261 - DNA, 601 bp, Human
atgaaatcatgtgactttttgtgtctggctcctttcacttaacgttttctttctttttgttttgagacggagtttcgctcttgtcatctgggctggagtgcaatggtgcgatctcagctcactgcaatctccacctcccaggttcaagtgattcgcctgcctcagcctcacgaatagctgggattatgggcacgcaccaccatgcctggctaatttttttttatttagtatagatggggtttcaccatgttggtcaggctggtcttgaactcctgaactcaggtgatctccccacctcggyctcccaaagtgctgggattaaaggcatgagccaccatgcccactgtgcccggccttcacttatgttttcaaggtttcatctatgttatagcatgtatcagtactttactcctatttatggctaaatgatattccattatagacttataaaacattttgtttatccattcgtcattgatagacactcttctattaccacatacactctactgaaccagtgtaaacttaagtgcttgtatgtctgatgtttgtcactggatagcaaccttaataaattcttgtttattttcattttgtatcc

SEQ ID NO: 191262 - DNA, 601 bp, Human
atcacttgagctgcggaggttgaggttgcagtgagcagtaattgcaccactgcattccagcctgggtgacagagtgagacctgaacttttaaaagcaacaacaaaaaaacctaattattcaaaaacaaaacaaaatcatgcatatgtaaaataagaggcatatttatcaaaatatttttatgctaactatgagttatccctgggagtgatcgggtgacttttattcttctttgtgatgttctgtatttttcaaattataaaaaagtggactggctgggcacagcggctcacacctgtaatmccagcactttgggaggccaggcggcagatcatatgcagtcaggggttcaagaccagcctggccaacattgtgaaaccccatttctactaaaaatacaaaattagctgggcgtgatggcacacgcctgtaatcccagctactcaggaggctgaagcaagagaatcgtttgaacctgggaggcaaaggttgcagtgagcaaagatcatgccattgcactccagcctgggtgacagagtaagactctgtctcaaaaacaaaaacaaaaacaaagtggactgtatcacatctataatatattta

SEQ ID NO: 191263 - DNA, 601 bp, Human
aatttgggaatcatcagactatagatgatatttaaagccatgagaataaattgaagcactttggaaataagcatagataaaatgtgatcaacaactgagccaagggcattctaatttacagacggtggaatgaagaggaaccagtaaaggggactgagaagcagcaaccagcaaggcaggaagaaaactaggaaattgtggggtcctggaagacaattatgaaagtgaatcaaggaggagggacaagatcaactgtgtaaaatgcttctgttacattaagacggttgataggtagctgggygtggtagctcatgcctgtaatcctaacaccttgggaggctgaggcttgagcccaggagttcgagaccaccgtgggcaacacagaaagaccctgtatctccaaaaaaaaaaaaaaaaaaaaaaaattactgggcatggtggtgtgggcctgtggtctcagctacttgggaactgaggtgggaggatcacctgagcccaggggtcgaaggtgcagtgatgtatgattgcaccactgcactccagcctgggcaatggcataagactcttgcctcaaaaaaaaaaaaaaaaaaaaaaaaaagga

SEQ ID NO: 191264 - DNA, 601 bp, Human
cactgtgatagcaatgtttagaatcagatgcaaaagagtaagagtaaaaacagaagagtggggctgggtgcggcggctcacgcctgtaatcccagcactttggaaggccgaggcaggcagatcttgaggtcaggagatcaagaccatcctggctaacacagtgaaaccctgtctctactaaaaaaaatacaaaaaaattagctgggcgtggtggtgggcgcctgtagtcccagctacttgggagtctgaagcaggagagtggagtgaacccaggaggcagagcttgcagtgagccgagatsgggccactgcactccagcctgggcaacacagcaagactccatctcaaaataaataaataaataaaaataaaaacaataagaactgaagagtatattgtggtaattcaggcaagagatagtggtggcttgcactagggtaatagcaatgaatgtggtgagaactatacagattctaagtaatttacagggtagaaccaagaggatttgctgataacttagatgaggaatgtgtgacaaagtcaaggaagattccaaaatttctgaccggagcaactagaatgatagtaatgcaatcatctg

SEQ ID NO: 191265 - DNA, 601 bp, Human
tagcatgcctatcgtgtcctaacaggagcaaggaacagtaagtttagagtggagtaagcaatggagagaatcgtagatgtgttcagagcagtaatgggaaatcctacctttgaggactttatatgccaatgtaagcactttggtccttactctgagtaaaaaaatgtgaactaccttagggttttgaggagaaaagggaaatgatctgacttatgcttcaaaatgaccactgtgatagcaatgtttagaatcagatgcaaaagagtaagagtaaaaacagaagagtggggctgggtgcggyggctcacgcctgtaatcccagcactttggaaggccgaggcaggcagatcttgaggtcaggagatcaagaccatcctggctaacacagtgaaaccctgtctctactaaaaaaaatacaaaaaaattagctgggcgtggtggtgggcgcctgtagtcccagctacttgggagtctgaagcaggagagtggagtgaacccaggaggcagagcttgcagtgagccgagatcgggccactgcactccagcctgggcaacacagcaagactccatctcaaaataaataaataaataaaaataaaaa

SEQ ID NO: 191266 - DNA, 601 bp, Human
agagtagtcttcattgatgtgacatgtgagtacagagcgtcagggttaactatatggatatatgaggagaagtgtttcaaagggaacaattggggcaaaggcccaaataaatagcatgcctatcgtgtcctaacaggagcaaggaacagtaagtttagagtggagtaagcaatggagagaatcgtagatgtgttcagagcagtaatgggaaatcctacctttgaggactttatatgccaatgtaagcactttggtccttactctgagtaaaaaaatgtgaactaccttagggttttgaggmgaaaagggaaatgatctgacttatgcttcaaaatgaccactgtgatagcaatgtttagaatcagatgcaaaagagtaagagtaaaaacagaagagtggggctgggtgcggcggctcacgcctgtaatcccagcactttggaaggccgaggcaggcagatcttgaggtcaggagatcaagaccatcctggctaacacagtgaaaccctgtctctactaaaaaaaatacaaaaaaattagctgggcgtggtggtgggcgcctgtagtcccagctacttgggagtctgaagcaggagagtgga

SEQ ID NO: 191267 - DNA, 601 bp, Human
ataaactaacagtatactgggccattaaaggaactctcaaatttctaagaattgctattgctatcgccttttacttttcatctagaagttaataacaaaaacataaaaaaaaagagttgaactaaaaggaaaatttacatatttaaatgcatatatttgaaagaaggaaagctgaaaatcaaaggggagaggagaaaggaacaagataataattaaatattaataagatataataaattaaaaactgatgaaataggaaacaatcacaggagcgagaacatcaataatgccataagttagwtctttgaagttaccagtaatactgggagatccctggtcaaacagaaaaagagaaggcacaataaaagtcaatgttgggaatgaaaaagtaggtgtccctatagacgccactgacattaaaaaaaaaaaaaaagacaagggtatttttaaacaactttatgccaataaatttgaaattttagttattgaaatgaatacatattacaaaaatataacatcaaaagtcactcaaaatataaaataaaaagctgaataatcctctaactcttaaatactttttcccccaaacagtcttataaat

SEQ ID NO: 191268 - DNA, 601 bp, Human
tgaattcaaaagacaaaaatatgatttgatttctaggcgctcataagcttgtaatacttctatgtaatattcatcaaacttcataaattttcataaattcctaagaatgtcttaaaaatgagactataactctctactaagaagaactcaaaacagaattcagtgtacctctctccattttctggatattcagatggtgaagctagattttctgaatcacgattaacaggagaaaagagattgctattattaaggttcttcaaaaccaacttcttaatgctcttcctataaacaagaaacsaaaagaagaagaaaaaaattactcaggcatacagatatgtcccagacattatcttaaaaactggagtccaatggtgcacttctgctcaactcttgtacacctaagaataacctaacaagtttcatttataaacgcttcctaggattgtatagccaaaacacaaggtgtcaaatacattgtactatggtgtttggaagaataaagctgaacaccttcaagtcaaagtggaaaatccccttgaaaactgtcctcctcccagctctgagcactttatccagacacttcgttcactcatcacac

SEQ ID NO: 191269 - DNA, 601 bp, Human
tatactctcctatatggaatcaaataattggttaattttaagattaaaaactgaaaaaaatgttagatttttaagattacaatcaacaaaatgttaaaaaatgctttataaataataataataataaaaaacactagaattttatccaaaagaaaaaaaaaacaggagtacaaaggtgtctatacaaagggtttctttttttttttttctttttcgtgatacagccctcaggaggccctgagaacttgtgccagtatataaggatttttactgaagcactgttttgagtacaggaataccrgataatctaaatgtccactaacaaggaactggtcaagttatcttacattcacaataatgacttatgcaatcattaaaaaagaaaagacaaatatattcatacagataatggaaaggcatttctaataaaataaatggaaataagcaggttacagaatatatcattcgtgcataatctttatataataaaatatatttataaagaaagaaatttcggctgggtgtggtggataacgcttgtaatcccagcactttgtgaggccgaggcgggtggatcgcttgaggtcaggagttcaagacc

SEQ ID NO: 191270 - DNA, 601 bp, Human
cctttactaagtgcctggcactgttctggatagttccatgtattaaaaattcacttaatacttactacagcagtactgtgaaacagataattactatctctattgtatactctcctatatggaatcaaataattggttaattttaagattaaaaactgaaaaaaatgttagatttttaagattacaatcaacaaaatgttaaaaaatgctttataaataataataataataaaaaacactagaattttatccaaaagaaaaaaaaaacaggagtacaaaggtgtctatacaaagggtttctttttttttttttctttttcgtgatacagccctcaggaggccctgagaacttgtgccagtatataaggatttttactgaagcactgttttgagtacaggaataccggataatctaaatgtccactaacaaggaactggtcaagttatcttacattcacaataatgacttatgcaatcattaaaaaagaaaagacaaatatattcatacagataatggaaaggcatttctaataaaataaatggaaataagcaggttacagaatatatcattcgtgcataatctttatataataaaatatat

SEQ ID NO: 191271 - DNA, 601 bp, Human
ggcaaaaatccattatctaccaaaaatacaaaaattagctgggcatggtggcgggtgcttgtaatcccagctactcgggaggttgaggaaggagaatcgcttgaacctgggaggcagaggatgccgtgagctgagatcacaccactgcactccagcctgggcaaccaagagtgaaactcggaaggaagggagggagggaggaaggaagaaaagaagaaagaaagaataaattaaaatagaaaaaaaaataccaaaataaaaaaagcagagcgctgaaaaactcaaggaaagtagtggaacrctggtgtgcttgcttgctctattcactccttgtcctacttgtagtcagatataaggctaacttgctctctgagagaaaagtatttcaggccaacatcagaccaaactccagcctccagcaacacccacttgtatacttgcttcttgggaagggaactctaaattgggtggcagcaaacaaggtaaatgaaaaaactagaatataaaacttcctattaaaaagatatatagtagcataataaattcatgtagagatacatacacaaatacagattaagcacctggaattcttttttttttt

SEQ ID NO: 191272 - DNA, 601 bp, Human
cctgttttgcataaacctcttttatttttcaaatttacactcccaaataaagagctaaaagaaagatgaaaaatccagccaggcaaggtggctcatgcctgtaatccaaggactttgggaggccggggtgagtaaatcacttgaggccaggagtccaagacaagcctggctaacatggcaaaaatccattatctaccaaaaatacaaaaattagctgggcatggtggcgggtgcttgtaatcccagctactcgggaggttgaggaaggagaatcgcttgaacctgggaggcagaggatgcmgtgagctgagatcacaccactgcactccagcctgggcaaccaagagtgaaactcggaaggaagggagggagggaggaaggaagaaaagaagaaagaaagaataaattaaaatagaaaaaaaaataccaaaataaaaaaagcagagcgctgaaaaactcaaggaaagtagtggaacactggtgtgcttgcttgctctattcactccttgtcctacttgtagtcagatataaggctaacttgctctctgagagaaaagtatttcaggccaacatcagaccaaactccagcctccagcaacac

SEQ ID NO: 191273 - DNA, 601 bp, Human
cacgtggtctcgctttgtcacacaggctggagtgcagtggtgtaatctgcaacctccgcctcccaggttcaagccattctctagcctcagcctccggagtagctgggattacaggtatgcgccaccacgtctggcgaatttttgtatttttagtagaggtggggtttcaccatgttggccaggctcacttgtctcaactcctgacctcaagtgatctgcccgcctaggcctcccgaagtgctgggattacaggcacgagccactgcacctagctgaacaatatgaagttttctaactcatragtatggtctgtcttccatttatctgtgtctggtgtactttctttcaaccatgttttgcagttttgtataaacaagtcatttacctccctggttaagtttatttgtgtatattttattctttttgatgctactatatatatgaaatgttttcttaatttttgttgttagtgtatagcagtgcaactgatttttccatgttgattctgtatcctgtaactttgttgaatttgtttataactagtaagtttttttgtgtggcatctttagggatttctacacaagatgtcatcaaagaacag

SEQ ID NO: 191274 - DNA, 601 bp, Human
tgtatatatacccagaagtggagctgctggatcagacagtaattctatttttaactcttccgggaaccaccatactgtcttccacagtggctgcactgttacacattcccaccaatggtgcacaaaggttccaatttctccacattggcagacacatggcaatttgtttcttattagactgagtctcgctctgtcacccaggctggagtgcagtggcacattcttagctcacttcaccctctgcctaccgggttcaagtgagtctcgaacctcagcctcccaagtagctgagagtacaggygcccgccacaacacccagctaatttttgtacttttagtagagacggggttttgccatgttggtcagactgggctcaagctatccacctgcctcggcctcccaaagtgttgggattataggcgtgagccaccacgcccggccattttttttttttctagtaaccatcctaatgggtatggtatctcattgtagtttgatttgcatttctctaatgattagtgatgttgggcatcttttcatgtactccttggtcatttgtatatctttggagaaatgtcgattcaagtcctttgccaatat

SEQ ID NO: 191275 - DNA, 601 bp, Human
ggaaaataccaaaggtctagctttcagcagctgagaggtagaggatgctttacaaagaaatcccgtatcaatgatacaagtaattgcgataaacaatgtaggccctaatctccccaagccaaataataattcatttacattcccaaactatttttcataaagattatgtactattaaaatacaaatatcaaggttacccgaagtataagcaaacaactttaaaaaaatggagattaaaaaccctttcagaaagctaatttaacttttaaaaaaccatggaggtaaagaaaaagattaaacgacatcaggtagtcaataaaggcagaatttactgtgcatgaacccacatgagcaaatcttaagttaatcactgagcagagaattcagcaagtccaaatgagagagaacaaagggtttaaaaatgacaatctgtagaggaataatccaaacagcaagagaattctttaaatctctccagtaaaaagacagatgcctgcaagacctcacgccctcccttgcacttgtttcaacgtgattgccaatgtttgtactcttcaaagttccaagggtcataaaacagctttgtattagctgaatgact

SEQ ID NO: 191276 - DNA, 601 bp, Human
tacaaacattttcctgtctgtccataaatgaagcttttctttttcagctgggccaactggaaagaggttatctttaagatcctacatattacttttgttacagaaaataaggccatctgactctttccctcagaaatacatatatttataataaatatatatataaggttataaaaaattaggaaagaaggagatgatacaaagcatatgacagacaaaatgaatatggataactggaaaaccaagtctatagcatttcatttgtcaatggagatttcttaggggcattctaaatgctacmaagattataaacataaaagtcaatatatttccagtttcccacatttatcataccctcccctcccctgtacgcgcaaacatgtatatacacacattctccagaaatgcctcctaagagattatttaataaatcataaaaaccacacatttcagcagccataagaattatagcatggaaaataccaaaggtctagctttcagcagctgagaggtagaggatgctttacaaagaaatcccgtatcaatgatacaagtaattgcgataaacaatgtaggccctaatctccccaagccaaataat

SEQ ID NO: 191277 - DNA, 601 bp, Human
gctagccatggtgactcacgcctgtagtcccagcactttgggaggccaaggtgggaggatcacttgaggccaggagttcaagacaacatgagttgaggccaacatggcaaaatcccctctctactaaaaatacaaaaaattagatgagtgtggtggtatgccctgtagtcccagctgcttgggaggctgaggaatgaggctgcttgaacctgggaggcagaggccacagagagccgagactgcaccagtgcactacagcctgggcgacaactctttctcaaggaaaaaaaaagctacttgmccattttaaatccttactacctctttttgctagaaccttgatctgaaatttttgggtgctcaatttttcaaagagctctcacaaacacaagtgtcaatataggagtttatagttatttttctactatttctattctggcaattaaagaacctagaaactactgtcaacattacaaacattttcctgtctgtccataaatgaagcttttctttttcagctgggccaactggaaagaggttatctttaagatcctacatattacttttgttacagaaaataaggccatctgactctttccct

SEQ ID NO: 191278 - DNA, 601 bp, Human
ttacacttcagttataaggctgaggtacactctggggactgttgtggggtggggggaggggggagggatagctttaggagatatacctaatgctaaatgacgagttaatgggtgcagcacagcagcatggcacatgtatacatatgtaactaacctgcacactgtgcacatgtaccctaaaacttaaagtacaataataatttaaaaaaaaaaaagtttacaaaaaaaaaaaaaaaggctgaggtaaaaacctacacgtatctctacctgagtgccaaaggcctgaggtctttcaacatasttttgaaacctgattgcacatttcaaccacctggggagaagcattaaaatataaatatgcctgagccccatgccaaatctgtggaatctaagtcaagcttaccagggcattgatgcagccagctggaaattggatcccagaccaggattttgaaactaatgttctaaccacagaacaaaatactctgcaactaccttaattcatctctgtgactaaggtttatctgccaaccaacattttctctaacctaaaaggtacaggagagaagatcacatgaaaatttagttacctttatgtttt

SEQ ID NO: 191279 - DNA, 601 bp, Human
ttaacttaaattcacttagtgaacaatgctaagtttctgagcaagccaattagcctgccttgatgttactgaacacaagttacacttcagttataaggctgaggtacactctggggactgttgtggggtggggggaggggggagggatagctttaggagatatacctaatgctaaatgacgagttaatgggtgcagcacagcagcatggcacatgtatacatatgtaactaacctgcacactgtgcacatgtaccctaaaacttaaagtacaataataatttaaaaaaaaaaaagtttacaaaaaaaaaaaaaaaggctgaggtaaaaacctacacgtatctctacctgagtgccaaaggcctgaggtctttcaacatagttttgaaacctgattgcacatttcaaccacctggggagaagcattaaaatataaatatgcctgagccccatgccaaatctgtggaatctaagtcaagcttaccagggcattgatgcagccagctggaaattggatcccagaccaggattttgaaactaatgttctaaccacagaacaaaatactctgcaactaccttaattcatctctgtgactaaggttt

SEQ ID NO: 191280 - DNA, 601 bp, Human
aatggtttatggctgttttctgtgtctagcacatcactaagttcaacacttatttatttcgttatttctattacctaatgcagtgcttgacacatggtagagaaagcagtaaactataaaaagataaggagagtgagtgggaggaaagaaaaaatggggagggggagagtggttccaatttactatactactcaacaaaggaacactgctaatagcaagagatgcttaccttgaacactgtttcagataacatgagaggatttcgttaaataaccagattagagacctaagggactcgtcrtatgtttacgaagaatgctaaggatcaaggttttatttattctattcacacaaacagacttcaaacctgtaagatatcatctaataagtggacaagggggaagggaattactatgaaactatggttaagtgcctagaatgccctatatgtaaattttgttgaagtatatctaagtaactgcaacatactccccaaagctgtctgtgtacttattttcctggatatcttggcagatcaggtaccctttttaggccagtcctgaaaaaaaaggtgtacttaaaaaaaaaaaaaaaaagatgg

SEQ ID NO: 191281 - DNA, 601 bp, Human
acttgtccctagaagacaataagacagtgctgtaaggactgcacaaaacaagtatagtgcaggacaacttgctgaactaagtaatgttataaaaattgggaagtcagagcttactatctaatccacattcataagcaaacaaaaacatgaacctaaacaaagcacaaatgctttttttctccatacacttctgcatctgcacaaacagaggtaattctagttcttaaaaaccggccactcctgccaggtgcaatgacgcatacctgtaatctcagcactttgggaagctgaggcaggatgmtcagttgaggccagaagttcaagaccagcctggggcaagatagcaagatccatctctataaacatttaaaaaaataattagttgagtagtgggtatatgcccatagtcctagctactcaggaggctgagacaggaggactgcttgagcccaagagttcaaggctgtagtaagtgcgactgcataactgcactccagtctgtgcaacagagagagaccctgtctctaaaaacaaaaaacctggctactcttaatgaatacttataagtacaatttctcttagcacccttatgtcacaggta

SEQ ID NO: 191282 - DNA, 601 bp, Human
gttattaagaatgtttaactgatacttttttggttaatatattttctttctttcctctataccaaagggaagttaaaaatatttttaaaaagcaaagttgataataagggaactcaaaagaattgaaaaatatttagtttttaaagcaatataaacaaatgtctctctgccagttcctctggctttcaaaatatgttgaaactacatctgcttaagttctttgctgatattaaaactttatttccaatcccacatagttacaagcccactagaaaagagaaaactttaaaatcaaatatgwaatcacttccctgggaatttaaaaaggtttagtgaaaagtagaaatctgatgtgctctgtgcattacgagaagcaatacttgtccctagaagacaataagacagtgctgtaaggactgcacaaaacaagtatagtgcaggacaacttgctgaactaagtaatgttataaaaattgggaagtcagagcttactatctaatccacattcataagcaaacaaaaacatgaacctaaacaaagcacaaatgctttttttctccatacacttctgcatctgcacaaacagaggtaattctagttc

SEQ ID NO: 191283 - DNA, 601 bp, Human
atgttatttcatttcactcttcaaaaactttttttttttttttttggagacagagtctcgccctgtagcccaggctagagtgcagtggcatgatcttggctcactgcaacctctgcctcctgggttcaagcaattctctgcctcagcctcccgagtagctgggattacaggtgcccgccaccatgcctggctaacttttctgtatttttagtagagacagagtttcaccatgttggccaggctggtcttgaactcctgacctcgtgatccacctgcctcagcctcctagagtgctgcaatyacaggcatgagccactgcacttggcctcaaaaacttttaaatgattagcattattatcattcctattgtatatatgagaaaactgagctcagataagtgacttgtccaaatctacaaagtgacaggaccaggagacaagccaaggttaagtctggcaccactcctcatgcccttatcagaatcctaaaggtaacgatttcttagcacatataaaagtaagatcaaaactcaaattcctactctactctaaacaatgctacagtcaacgaaataaaaacacactaggtatcttacaattgt

SEQ ID NO: 191284 - DNA, 601 bp, Human
acacagaagtcaggggtggagggacagaccaagaggatgtggatgggatattcattaaagatgctgctctgggagtacgacattcttgcacagagacacttggtgaaagaaaagctccacttgtaaattttgattgtagtaacccaccaactgaaatgaagcgggaatgaaggggagaaagactattacaaaacacaagctattgtttcttgaacaataacaaaaatcagtaaggctgaaatcattcaatgtttaatcaaactacttatatcagatgtggatgaccagaagcaggctaagycagattttgcagaaattactctttgaactaggaaatcaggacaagattctaatgatgatgatgatatctacaacaataataaaagcaacaacactattaatattatttaaaaatatgcagcaggctctgtataagtcatttgtatatgttatttcatttcactcttcaaaaactttttttttttttttttggagacagagtctcgccctgtagcccaggctagagtgcagtggcatgatcttggctcactgcaacctctgcctcctgggttcaagcaattctctgcctcagcctcccgag

SEQ ID NO: 191285 - DNA, 601 bp, Human
cttctagatactaaagaactgattctaaattacaatgagcatatagctaagctaggcttgttccaattttttttttttttttttttgagatggagtttcacactgtcgctgaggttggaatgcagtagcgtgatcttggcttactgcaacctctgcctcctgggttcaagggcgattctcctgcctcagtctcctgagtagctgggattacaaacatgcaccaccaccctgggctaatttttgtaattttagtagagacagggttttaccatgttggccaggctggtctcgaactcctgacctcaagtgatcctcccaaagtgctgggatgacaggtgtgagccaccgtacccggccccttgatctaatttttaagattgatattaataaccttcaaaattcacaagataatgcttaacctagaataactaagtttaggatcagtattcttaattgtgaggttcaagagacattgttgttttttctttttcttttctctcttttttttttttgagactgagtctcattcagttgcccaggctagagtgcaatggcgcgatctcagctcactgcaagctccgcctcccgggttcacaccatt

SEQ ID NO: 191286 - DNA, 601 bp, Human
tcaagggccaaaagctattgtgggatacctgtttctcaaattatacttgggtatcaaaagtcatgaggctaagcttctagatactaaagaactgattctaaattacaatgagcatatagctaagctaggcttgttccaattttttttttttttttttttgagatggagtttcacactgtcgctgaggttggaatgcagtagcgtgatcttggcttactgcaacctctgcctcctgggttcaagggcgattctcctgcctcagtctcctgagtagctgggattacaaacatgcaccaccacsctgggctaatttttgtaattttagtagagacagggttttaccatgttggccaggctggtctcgaactcctgacctcaagtgatcctcccaaagtgctgggatgacaggtgtgagccaccgtacccggccccttgatctaatttttaagattgatattaataaccttcaaaattcacaagataatgcttaacctagaataactaagtttaggatcagtattcttaattgtgaggttcaagagacattgttgttttttctttttcttttctctcttttttttttttgagactgagtctcatt

SEQ ID NO: 191287 - DNA, 601 bp, Human
tcatctggctttctttgtctcaaactgagtttttctaagtgaactttgaatggggactcagttaggctacaagagcaaatgaggaatagaatagaaaatgaacctaagacagaagctaggatttttacttcaaccaaaccactgtttctttttatgattacaaacggaatgcaaacatttcactgtagttttaaagaaattttgtttcttaaactatactgaacttatctgctatatactggggaaaaaaaatcatctgatcagtgcattcagaacacaaaggcttcttaggccaggttayaacaagcatgagaatcctaacagatttagaactggctaaaactcaagggccaaaagctattgtgggatacctgtttctcaaattatacttgggtatcaaaagtcatgaggctaagcttctagatactaaagaactgattctaaattacaatgagcatatagctaagctaggcttgttccaattttttttttttttttttttgagatggagtttcacactgtcgctgaggttggaatgcagtagcgtgatcttggcttactgcaacctctgcctcctgggttcaagggcgattctcctgcc

SEQ ID NO: 191288 - DNA, 601 bp, Human
atcaaagtattgattcagaaaaacatggtcatgatagatgagaaaggtaatcttgaaagaagccaggaagaggaattacaacaaagctgttgagaagaccaacagtacttgagctggatatggaagaatggataggatttagaaaagcaagaaggggccgggctcgatggctcacgcctgtaatcccagcactttggaaagtcgaggcaggcagatcacgaggtcaagagatcgagacaatcctggccaatatggtgaaaccctgtctctactaagaatacaaaaattagctgggtgtggkggcgcgcgcctatactcccggctacagtgacagagtgagactccgtctcaaaaaaaaaaaaaaaaaaaaaagtaaagcaagaaggaatgtatttctctccctatgttctctggattaggtaagaaattcaattttataaatccaaggatttgacttgctacagttctttgtggaagaatttgtacattaatgggtaaaagaacaaagtgacaagaacatagtgacaatttcttcttgcttgggaatctgcttagttaaactcaacctcagaaaatgacaagcacaggcatttacctacta

SEQ ID NO: 191289 - DNA, 601 bp, Human
aacaaatgtaaccgttaaacaggttccccaagcctaattatggctagtgtcatctcagatgatatctactttgatcaaattctgtctataaaaatcaatctacaaaagtactgtttatcatttaagccacttacaagtatgcactggtaaaataacttacacatttgaaaagacaatgagacgattaagtaaatacaaagaactgaaggaacataaacaaatctcaaaacgtgtggcataggacattctaaaacagcccatttttcaataaacgtgatttgctaaacaaaatgatttttcyactgtttgaaatattaataaattagataacccctttatcaaagtattgattcagaaaaacatggtcatgatagatgagaaaggtaatcttgaaagaagccaggaagaggaattacaacaaagctgttgagaagaccaacagtacttgagctggatatggaagaatggataggatttagaaaagcaagaaggggccgggctcgatggctcacgcctgtaatcccagcactttggaaagtcgaggcaggcagatcacgaggtcaagagatcgagacaatcctggccaatatggtgaaaccct

SEQ ID NO: 191290 - DNA, 601 bp, Human
aggagttccagaccagcctggccaacatgacgaaacggcatctctactaaatatacaaaagttagccgagtgtggtggcacgttacctgtaatcccagctactcaggaggctgaggcaggagaatcgcttgaacccaggaggcaaacgttgtagtgagccaagattatgccactgcactccatcctggggtacagagcgagactgtctcgaaaacaaaaacaaaaacaaaacaaaaaacaaaaaaaaagggggggagtagtaaagcaaaagcttttagtaacctaaaaggcagtacctttmccagaggtttagccttacagtcaaaataaacaggaagaaagtggagtttatgaatcaacagccctaagaatctgactctggcatgccttaagatcctctcctactacatgttggtgtcctggtgagcataacctttttttaatgattcataataagttcatacaagatcaatcccaaagataaattctcactgtacaaatgcacaaagaccataaatagtaccagacggaggctggatgtggtggctcacgcctctaatcccagcactttgggaggctgaggcaggagggctgcttgacg

SEQ ID NO: 191291 - DNA, 601 bp, Human
cagtggttcacgcctgtaatcccagcactttggaaggctgaggcaggcgcatcacctgaggtcaggagttccagaccagcctggccaacatgacgaaacggcatctctactaaatatacaaaagttagccgagtgtggtggcacgttacctgtaatcccagctactcaggaggctgaggcaggagaatcgcttgaacccaggaggcaaacgttgtagtgagccaagattatgccactgcactccatcctggggtacagagcgagactgtctcgaaaacaaaaacaaaaacaaaacaaaaaacaaaaaaaaagggggggagtagtaaagcaaaagcttttagtaacctaaaaggcagtacctttaccagaggtttagccttacagtcaaaataaacaggaagaaagtggagtttatgaatcaacagccctaagaatctgactctggcatgccttaagatcctctcctactacatgttggtgtcctggtgagcataacctttttttaatgattcataataagttcatacaagatcaatcccaaagataaattctcactgtacaaatgcacaaagaccataaatagtaccagacggaggctgga

SEQ ID NO: 191292 - DNA, 601 bp, Human
gtcaggctgtataacagggaattcccaaagaagtaagacagcattagaaatgaagaagaaccctctgatttagaggcaggaaaacagcagtgagaaagtcaactgtggaatctcatgatattaaataaaataaaaacagacacttggggaagtagccttgtccagaggaaggagtaaaggatagtttcccatcagatttcctggctccgcttcaatttgacaatactttaacacccagcaagatttttgcttggctctattggccacatatacctgaaatgcttcttcatacatgctgagygccctagaaatggaggctgttggtggaagcaaataccaaagatggatagccagggagcgtttccaatccaactgggagcacacgtttatttgcttcttttctgagagctgccacacctgtgcgaaacaaaatcatcaccatggctatattctaccttgttattacctgtgtgtgcaataacactgaagtgaatattcacttattcaaggaacattttaaatgattcagatataaaatatacaaatataataaaatctcacagctagtgagagggaatattatttacttgtttttattgac

SEQ ID NO: 191293 - DNA, 601 bp, Human
gacaaataattctgagagaacaatatgaaagacaagtataaaatatgaacagtaagataattcaagaactgatggcataaaagtaacaatacattaacctcaaaactgacaaggaatataaaatattatatttagaggcaaatttcagaactaagtttgaagataaaccaaatctgaggtcaggctgtataacagggaattcccaaagaagtaagacagcattagaaatgaagaagaaccctctgatttagaggcaggaaaacagcagtgagaaagtcaactgtggaatctcatgatattwaataaaataaaaacagacacttggggaagtagccttgtccagaggaaggagtaaaggatagtttcccatcagatttcctggctccgcttcaatttgacaatactttaacacccagcaagatttttgcttggctctattggccacatatacctgaaatgcttcttcatacatgctgagtgccctagaaatggaggctgttggtggaagcaaataccaaagatggatagccagggagcgtttccaatccaactgggagcacacgtttatttgcttcttttctgagagctgccacacctgtgc

SEQ ID NO: 191294 - DNA, 601 bp, Human
acccgggaggcagaggttgcagtgagccgagatcgcgctactgcactccagcctgggctacacagcgagactccatctcaaaaaaaaaaaaagtaaacagacaacccaaaggatctatcagggattttaaacattttttggtcaatgatgtatttcatctgtcttcaatggactggtaaagatttcaggtagctatcactaaccccccatacttatcttgccacaattcttaatatactcaagtttcaagtgttctcttactcctgacaaataattctgagagaacaatatgaaagacaartataaaatatgaacagtaagataattcaagaactgatggcataaaagtaacaatacattaacctcaaaactgacaaggaatataaaatattatatttagaggcaaatttcagaactaagtttgaagataaaccaaatctgaggtcaggctgtataacagggaattcccaaagaagtaagacagcattagaaatgaagaagaaccctctgatttagaggcaggaaaacagcagtgagaaagtcaactgtggaatctcatgatattaaataaaataaaaacagacacttggggaagtagcct

SEQ ID NO: 191295 - DNA, 601 bp, Human
gacctgatctcgattgaaaaaaaaaaaacaaaaaaaaacacctgggcacggtggctcatgcctgtaatcctagcacttagggaggccgaggcaggcagatcatgaggtcaggagatcgagaccatcctggctaacatggtgaaaccgcgtctctactaaaaatacaaaaaattagccaggcgtagtggcacatgcctgtagtcccagctacccgggaggcagaggttgcagtgagccgagatcgcgctactgcactccagcctgggctacacagcgagactccatctcaaaaaaaaaaaaagtaaacagacaacccaaaggatctatcagggattttaaacattttttggtcaatgatgtatttcatctgtcttcaatggactggtaaagatttcaggtagctatcactaaccccccatacttatcttgccacaattcttaatatactcaagtttcaagtgttctcttactcctgacaaataattctgagagaacaatatgaaagacaagtataaaatatgaacagtaagataattcaagaactgatggcataaaagtaacaatacattaacctcaaaactgacaaggaatataaaatatt

SEQ ID NO: 191296 - DNA, 601 bp, Human
taaaattatatagtttgtagttcatgagcatgatgattgggtgttcatgcatgcgtgtgagatgtgccaccctcgaaccttgtgaagatattggcatattacccgtctgacataaaaagataagaaaaaaaaattttttttttaaattagccaggcatggtggtatgcacctgtggtcccagctactcaggaggctggggcccaggaggtcaaggctgcagtgagctataattgccccactgcatgccactcaagttttgggtgacagactgagacctgatctcgattgaaaaaaaaaaaacaaaaaaaaacacctgggcacggtggctcatgcctgtaatcctagcacttagggaggccgaggcaggcagatcatgaggtcaggagatcgagaccatcctggctaacatggtgaaaccgcgtctctactaaaaatacaaaaaattagccaggcgtagtggcacatgcctgtagtcccagctacccgggaggcagaggttgcagtgagccgagatcgcgctactgcactccagcctgggctacacagcgagactccatctcaaaaaaaaaaaaagtaaacagacaacccaaaggatctatc

SEQ ID NO: 191297 - DNA, 601 bp, Human
tgggattacaggcgtgagccaccgcacccggccgcctgcattttttaataaacatgtacacacagattcacatatacacacacaaaccaagatactacatgcccaataaaatggtaaaatttaaacaactaataataccaaattttaaagaggatttggagcaactagagatattacacattattggtgggaatataaaaatgatataatcacttctggatatgttcatagcagatttatcaataatggccaaaaataagaaaacctaactgtccatcaacaaatgaatagatacataaaycatgtacccccgctaaaaaaaacccaaaactaacttttgatacatataaacatgaaaaaaaatctcacaattattatgcagaatcaaaaaagctaggcacaaggaacatacagtatgatctccacataaaattctagaccagcaaaactaacttatagtaacaaaaaactagtcaataggtatctgactgattgcaaaggggcacacaggcatttttcaatggtagtggaaatatcagcttagctgtaatggtagttacaatgcgatagttactataaaacttatcacactgcatacttt

SEQ ID NO: 191298 - DNA, 601 bp, Human
agataatttttttgtatttttagtagagacagggtttcactgtgttagccaggatggtctcgatctcctgacctcgtgatccgcacaccttggcctccaaaaatgctgggattacaggcgtgagccaccgcacccggccgcctgcattttttaataaacatgtacacacagattcacatatacacacacaaaccaagatactacatgcccaataaaatggtaaaatttaaacaactaataataccaaattttaaagaggatttggagcaactagagatattacacattattggtgggaatrtaaaaatgatataatcacttctggatatgttcatagcagatttatcaataatggccaaaaataagaaaacctaactgtccatcaacaaatgaatagatacataaatcatgtacccccgctaaaaaaaacccaaaactaacttttgatacatataaacatgaaaaaaaatctcacaattattatgcagaatcaaaaaagctaggcacaaggaacatacagtatgatctccacataaaattctagaccagcaaaactaacttatagtaacaaaaaactagtcaataggtatctgactgattg

SEQ ID NO: 191299 - DNA, 601 bp, Human
ttgagactgcaatgagccatgatcattccactgcacaccagcccgggtgacagagcaaaaccctgtctaaaaacaaaacaaggctaggtgcagtggctcgcgcctgtaatcccagcactttgggaggctgaggtgggcagatcacgaggtcaggagatcgagaccatcttggctaacacggtgaaaccctgtctctactaaaaatacaaaaaaattagctgggcgtggtggtgggtgcctctagtcccagctacttgggaggctgaggcaggagaatggcgtgaacctggaaggcagagcytgcagtgagctgagattgcaccactgcactccagcctgggcaactgagcgagagagtctgtctcaaaaaaaaaaccaaaaaacaaaacaccaacactgagatagttctaattacatggttagaaataatagcatgtgttaatatattattgttggacacctaaaccactctgcatttctttcttttttggagacagggtctctctcactcctattgcccaggctggagtacagtgatgcaatcatgtctcactgcaggctcgacttcccaggctcaggtgatcctccaccctcagcctcc

SEQ ID NO: 191300 - DNA, 601 bp, Human
aactgctgggattataggcatgacgcaccatacctggcctgttttcttattactgaattttcagagttcttgatgtattcctggatacaagttctctatcagatctacgaattgcaagtattttctcccaatctatggtttaccttttcattctcttaacagtctttctatgagcagtagttttgaaattttgttgaagtccaatttaccaatttttttctcttatgaattgtgttatttagtgtccacctaagaaatcttctgcctaacctacagttgcaaaaattttctgctttgtttkcttctagaaggtttatagttaagttgaaatttaggtttgtaatccattatgagctggataaacaatagacacaactaatgaggccagaaggtggttctttgaaaaggtcaatatgattgctaaactctaggtacaccaaccaagaaaaaaagaggacgcaattattgaacacaaatgaccagtatcaaaaagaaagagacgttgttaaagatcctacagatatttaaaatggttaataaggaaatgttattaataacttgatgctaataaattttgtgactttaggccgggtgcggtggc

SEQ ID NO: 191301 - DNA, 601 bp, Human
ataaatagagcaaggcgcggtggctcacgcctgtaatcccaacacattggaaggctgaggtgggcggatcacttgaggtcaggagagtttgagaccagcctggccaagatggtgaaactcttgcctctactaaaaatacaaaaattagccaggtgtggtagtgcatgcctgtattcccggctactcaggaggctgtggcacaagaactgctggaacccaggaggcggaggttgtggtgaggtgagatcataccactgcactctgacagggtgagactccaactcaaaataataataataatgatgactcaattgtaacctcaacctcctgggctcatgcgatcctctcacttcagcctcctaagtagctgggactacagatgcatgccaccatgcccacccaatttaagaaatttatttttgtagagatggggtctcattatattgcccaggttggtcttgagctcctgggttcaagtgatcgtcccacttcagcgtcacaaactgctgggattataggcatgacgcaccatacctggcctgttttcttattactgaattttcagagttcttgatgtattcctggatacaagttctctatc

SEQ ID NO: 191302 - DNA, 601 bp, Human
ttttgaagtatccttttctttctttctctgacatatttaaaactgcacgtatctagagtacacaattttaatgagctttaacatatgtagacacctgtaaaaccaccatcacgatcaagaaaataaatagagcaaggcgcggtggctcacgcctgtaatcccaacacattggaaggctgaggtgggcggatcacttgaggtcaggagagtttgagaccagcctggccaagatggtgaaactcttgcctctactaaaaatacaaaaattagccaggtgtggtagtgcatgcctgtattcccrgctactcaggaggctgtggcacaagaactgctggaacccaggaggcggaggttgtggtgaggtgagatcataccactgcactctgacagggtgagactccaactcaaaataataataataatgatgactcaattgtaacctcaacctcctgggctcatgcgatcctctcacttcagcctcctaagtagctgggactacagatgcatgccaccatgcccacccaatttaagaaatttatttttgtagagatggggtctcattatattgcccaggttggtcttgagctcctgggttcaagtg

SEQ ID NO: 191303 - DNA, 601 bp, Human
atgcaacacaacagtgcagcataatgataagagcacagactctggacgaaagttggaaacctcactctgccatttactagctgtgtgaccttggacaaaagttaagctctgtgtcttgggttactgacctgtaaaacagagataataacagtgtctatctcacaggtcataatgaacataaaacagttaatatatatggtatacaatataaacatgtgtaaaagcacttcaagtactacataaatgttcattttgtgtaattactgaaataccatactgctatcattaacaaaaatctccrgccttatcttgttcaaaccgcagtgaaaaggcatttctccagttctctttaaggacagagaatcaagacacatatacctaagcacaaggctgtgttaataaatacaatactatcaagcttaaggaatgggtcggtgacaagggatgaccagagaaaaagcaagccagtggacacagaaaaagcagggacctttttgctaacccattacttccctgccgtggagtcactgaggcagctcagacagcactatttctgtgtaattcctaaacatgccacattcacctgaatctgggattcaga

SEQ ID NO: 191304 - DNA, 601 bp, Human
gcttaggcttagagagttaagagagtatctttatccaaagtcaaaagtaagctttaccctaggtcaaagtgagtacgtggtagatctagaatttagaccctatttccttccataccatgcaacacaacagtgcagcataatgataagagcacagactctggacgaaagttggaaacctcactctgccatttactagctgtgtgaccttggacaaaagttaagctctgtgtcttgggttactgacctgtaaaacagagataataacagtgtctatctcacaggtcataatgaacataaaacmgttaatatatatggtatacaatataaacatgtgtaaaagcacttcaagtactacataaatgttcattttgtgtaattactgaaataccatactgctatcattaacaaaaatctccggccttatcttgttcaaaccgcagtgaaaaggcatttctccagttctctttaaggacagagaatcaagacacatatacctaagcacaaggctgtgttaataaatacaatactatcaagcttaaggaatgggtcggtgacaagggatgaccagagaaaaagcaagccagtggacacagaaaaagca

SEQ ID NO: 191305 - DNA, 601 bp, Human
agtcaactccgaaacattagccatcctatcaagccagtcttttaccatgtgaaatcctttatgactgtgtttaaataaacttaaaaaaatagcctggggtcatttcattccctgttaaaggggaagaagaaagagaaactgcttaaagaaagagaaattgcttaagtcttaataagactatgctagatgctttatacttttactctttttaatttcacaatcacctttaaatagaaactaatgttatgctttcacaggccaaaaaaaaaaaaaaaaaaaaaaaaaaaaaaaaggcttaggyttagagagttaagagagtatctttatccaaagtcaaaagtaagctttaccctaggtcaaagtgagtacgtggtagatctagaatttagaccctatttccttccataccatgcaacacaacagtgcagcataatgataagagcacagactctggacgaaagttggaaacctcactctgccatttactagctgtgtgaccttggacaaaagttaagctctgtgtcttgggttactgacctgtaaaacagagataataacagtgtctatctcacaggtcataatgaacataaaacagttaata

SEQ ID NO: 191306 - DNA, 601 bp, Human
gcttagagtggcccttggggcagtctcttaaactgcaggtcttttttttttttgatggagtttcactcttgttgcccaggctggagtgcaatggtgtcatcttggctcacggcaaattccacctcccaggttcaagtgattctcctgcctcagcctcacaagtagctgggattacaggcatgtgccaccacaccccgctaattttgtaattttagtagaggcagggtttctccatgttggttgggctggtctggaactcccaacctcaggtgatccacccgcctcagcttcccaaagtgcyaggattacaggcgtgagccaccacacctggcctaaactatgggtcttgatcactttaagcttcactaaaaaaatcaaaggtgatctcacaccggtattaatttttaaaaatgacagcactggccaggcacagtgcctcacgcctgtaatcccagcactttgggaggtcaaggtgggtggatcacatgaggtcaggagttcaagaccagcctggccaacatggtgaaaccccgtctctgcaaaaaataattaaaaaaattagctgggtgtggtggcaggcgtctgtaatcccagctactca

SEQ ID NO: 191307 - DNA, 601 bp, Human
ctctcgaacagccttctcacgtatgctacagggagagataagctagaataaatcccatcctcattcatggagaaggctgccccaggcagcttagagtggcccttggggcagtctcttaaactgcaggtcttttttttttttgatggagtttcactcttgttgcccaggctggagtgcaatggtgtcatcttggctcacggcaaattccacctcccaggttcaagtgattctcctgcctcagcctcacaagtagctgggattacaggcatgtgccaccacaccccgctaattttgtaattttagtagaggcagggtttctccatgttggttgggctggtctggaactcccaacctcaggtgatccacccgcctcagcttcccaaagtgccaggattacaggcgtgagccaccacacctggcctaaactatgggtcttgatcactttaagcttcactaaaaaaatcaaaggtgatctcacaccggtattaatttttaaaaatgacagcactggccaggcacagtgcctcacgcctgtaatcccagcactttgggaggtcaaggtgggtggatcacatgaggtcaggagttcaagaccagcctg

SEQ ID NO: 191308 - DNA, 601 bp, Human
ataagcaaagggcctctaagtgcttgtcagattccatgtgtgctcgcacagctttggcctcgtggatccatttggcaggtacacggagcttctgggtaaggaaagtctctttagcccaagattcaggggtctccaacagctggcagtgccgggtaagcagctctcgaacagccttctcacgtatgctacagggagagataagctagaataaatcccatcctcattcatggagaaggctgccccaggcagcttagagtggcccttggggcagtctcttaaactgcaggtcttttttttttttgatggagtttcactcttgttgcccaggctggagtgcaatggtgtcatcttggctcacggcaaattccacctcccaggttcaagtgattctcctgcctcagcctcacaagtagctgggattacaggcatgtgccaccacaccccgctaattttgtaattttagtagaggcagggtttctccatgttggttgggctggtctggaactcccaacctcaggtgatccacccgcctcagcttcccaaagtgccaggattacaggcgtgagccaccacacctggcctaaactatgggtcttgatca

SEQ ID NO: 191309 - DNA, 601 bp, Human
caggagatgtggaacccagcactcaccagaagctaagtgtcggatgatgagcttgtggcagcggttccagtgctcagccttaaataagcaaagggcctctaagtgcttgtcagattccatgtgtgctcgcacagctttggcctcgtggatccatttggcaggtacacggagcttctgggtaaggaaagtctctttagcccaagattcaggggtctccaacagctggcagtgccgggtaagcagctctcgaacagccttctcacgtatgctacagggagagataagctagaataaatcccaycctcattcatggagaaggctgccccaggcagcttagagtggcccttggggcagtctcttaaactgcaggtcttttttttttttgatggagtttcactcttgttgcccaggctggagtgcaatggtgtcatcttggctcacggcaaattccacctcccaggttcaagtgattctcctgcctcagcctcacaagtagctgggattacaggcatgtgccaccacaccccgctaattttgtaattttagtagaggcagggtttctccatgttggttgggctggtctggaactcccaacctcagg

SEQ ID NO: 191310 - DNA, 601 bp, Human
aaagagatggggatgaccagttgatggagcagccagaatatgcacatttatcaactgaccatcttatatggatgcagttggtggcaccccaaaacaaaacagcaacatcaaagattgctactcacagatcaccataacagatatagtaatgaaaaagtctgaaataatgtgagaaccaccaaaatgtgaaacagagacagacatgaagtaaacatatgttggaaaaatggtgctaatatacttgctctgtgcagttttccaaacctttaatttgtaaaaaatgtagtacctgcaaagtacracaaaatgaggtatgcctgtattctgaaattctccaatggaaaatgtgaagaatttctagtttcaggccttaaggagattatttctggtgttgctggagaaaattcccataagtaaacaaattaaaataataataatattagcacacatcaagaatatttctgggaaatgataacaatattgctatctacccctgctcctctagcgcctcatcctggctaagcctcttctgcagagagcttttgcaaagtatgatttgattcaagatggccatgtcctacgttgagtcttatttccagtc

SEQ ID NO: 191311 - DNA, 601 bp, Human
gctttgaagccaggcattgacttctcttctctagctatgaaagtccttggtggcatcttctttcaatagaaggcagtttcatctacactgaaaatctgttgtttagtgtaaccatcttcatcaatgatcttagctagatcttctgggtaacttgctgtaccttctccatcagcacttcctgcttcaccttgcactttaatggaatggaaagacagcttctttccttaaacttcatgaagcaacttctgctagcttcaaacgtttcttctgtagcttcctcacctctctcagccttcacagractgaagggaggttaggcttttgcttaagggaatgttgtggctggtttcatctatccagatcacaaaaactttctccgcatcagccagaaagctgtttcactttcatatcatttatatgttcactggagtagcactttaaatttccttcaagaactttcctttaacacaacttggctgtttggcaaagaggcttatcttttgtcctatcttggctttcaacatgcttctctctgtacacctaatcacttcaagcttttgtttaaagttagagttgtgctacccttcctttcacttgaaca

SEQ ID NO: 191312 - DNA, 601 bp, Human
cgctatctatatggcagctatagtcttatgaaatgtatttcttaaataataaggcttgaaagctgaattactcctttgcccatgggttgcagagtagatgtgttagcaggcataaaaacattaacctccttatacgtcttcatcagaactcttggctgactaggtgcatcatcaatgagcagtaatattttgaaagaaattttttttttttctgagcaggtttcaacagtgggcttaaagtattcagtaaactgagctataaacagatatgctgtcatccaggctttgtttttccgtttayagagcacaggcagagtagattcagcataattcttaagggccctaggatttttagaatggtaaatgagcttctgcttaccatcaccagctgaattagccctaaagggagagttaacttgtcctttgcagctttgaagccaggcattgacttctcttctctagctatgaaagtccttggtggcatcttctttcaatagaaggcagtttcatctacactgaaaatctgttgtttagtgtaaccatcttcatcaatgatcttagctagatcttctgggtaacttgctgtaccttctccatcagc

SEQ ID NO: 191313 - DNA, 601 bp, Human
gttttccagtggatataaaagttatgtttacactataccactgtcacttattaagtgtgcaacagcattatgtctaaaaaaccaatatacataccttaatttaaaaatattttattgctaaaaatgttaatcacttgagccttcagcaagtcatctttctggtggtggagggtctttccttgatgctgatggctgctgactgatcagggtgttgcctgctgaaggttgtgatggctatgctaatttcttaaaataagataactgaagtcagttctctcaaacccagctgctgctttatcarctaagcttaagtaatattccatatcctttgctggcatttcaacaatgttcacagcatcttcaccaggagtagattccatctcaagaaactgctttctttgcttgtctataaagcaaactcctcatgagtgacaccagttcagtcacatcttcaggctccatttctaattctagttatcttgctgtttccatcacatctgcaagtacttcccccactaaagtcttgaacccttcaaactcatccatgagggctggattcaatgccttccatactcctgttatttaatgttgatattttgac

SEQ ID NO: 191314 - DNA, 601 bp, Human
ctcacattaaatgttcttgctacatgaaaaccaaaaacaaaacaaaacaaaataaaaataaaaacaggccaggcacggtggcttatgcctgtaatcccagcactttaggaggccgaggcgggcagcggatcacctgaggtcaggaatttgagaccagcctgaccaacgtggagaaaccccatttctactaaaaatataaaattagccaggcatgatggcacatgcctgtaatcgcaactactggggaggctgaggcggagaattgcttgaacccgggaggcagaggttgcagtgagtcgakattgcaccattgcactccagcctgggcaacgagcaaaactccgtctcaaaaaaaacaaaacaaaacaaaaaaaaaaacgaggctgggtgcggtggctcaggcctataatcccagcactttgaaaggcctgggcaggtggatcacctgaggtcaggagttccagaacagcttggtcaacatggcaaaaccccttctcaactaaatacaaaaattagctgggcgtgcttgtgggcacctgtagtaccagctacttgggaagttgaggtgggagaatcacttgaacccgggaggtagaggttg

SEQ ID NO: 191315 - DNA, 601 bp, Human
gacatgtggaatttggtaaaaactactgctaaccccattgtccagagaagctcatacttcacatttaaattgtgtattggcaattataggatcttagatttgaagattaatgaaattatagacacatagaatcccagtgtcttagagtcactgaactatccaaacttaggtctccccagagccagaggagatgataaagcagcgacgcttaacctaaatgagattgggggcagaggcataaccaccttgatatttatgtaacatttgtgtgaaggcgcatatattcattttctgaagggargtttcagcttttatcagattccaaaacataaagacccattgactatattaccatttgtgtacagaaagaaaacagaggctgggagctgtggctcacgcctgtaatcccagcactttgggaggccaaggtgggtagaatgcttgagcccaggaattcgagatcagcctgggcaacacggcaaaaccccacctctacaaaaaatataaaaataagccaggcatcgtgatgtgtgcctgtactcccagctactcgggaggctgaggcaggaggatcgattgagctcaggaggtcaaggctgca

SEQ ID NO: 191316 - DNA, 601 bp, Human
tgaacactcctggatctgcccctgtcccaaaacccacaacccctgcgaggtgaagcccaggtctctcactgtggctgtcaagtcctttcatgactggcccatcttcccaacgttcctaccccgcaagctctgccagcctagatgacatgtctttctctctttacatcctcagttcccacctccaatacctttgctttttccattcctgctgcacaaaagtcctttcccacccaaacaccagtcttttctctcccagtctccacttgctgacatcttagtctcctgttcatcctacaagacctgttcacgtcactcctccaggaagtcactcatgttcctttcagcaagaagggtcctctctcttctgagcctccatgtctgtcttatgactctcagtgccaagcactaggaatggcacagactaagtgtcgattcatgtttattaaactatacagattaacactgcaattttccagatgaggaaactgagacccaaaaagagacagcaactggcccagggtcaccagcatgcagatgcctgctatgatgtctctgcttcttgtgtctgtgggcctcatggaagcacttcaggtatgggcat

SEQ ID NO: 191317 - DNA, 601 bp, Human; identical to SEQ ID NO: 29579

SEQ ID NO: 191318 - DNA, 601 bp, Human; identical to SEQ ID NO: 29580

SEQ ID NO: 191319 - DNA, 601 bp, Human; identical to SEQ ID NO: 29581

SEQ ID NO: 191320 - DNA, 601 bp, Human; identical to SEQ ID NO: 29582

SEQ ID NO: 191321 - DNA, 601 bp, Human; identical to SEQ ID NO: 29583

SEQ ID NO: 191322 - DNA, 601 bp, Human; identical to SEQ ID NO: 29584

SEQ ID NO: 191323 - DNA, 601 bp, Human; identical to SEQ ID NO: 29585

SEQ ID NO: 191324 - DNA, 601 bp, Human; identical to SEQ ID NO: 29586

SEQ ID NO: 191325 - DNA, 601 bp, Human; identical to SEQ ID NO: 29587

SEQ ID NO: 191326 - DNA, 601 bp, Human; identical to SEQ ID NO: 29588

SEQ ID NO: 191327 - DNA, 601 bp, Human; identical to SEQ ID NO: 29589

SEQ ID NO: 191328 - DNA, 601 bp, Human; identical to SEQ ID NO: 29590

SEQ ID NO: 191329 - DNA, 601 bp, Human; identical to SEQ ID NO: 29591

SEQ ID NO: 191330 - DNA, 601 bp, Human; identical to SEQ ID NO: 29592

SEQ ID NO: 191331 - DNA, 601 bp, Human; identical to SEQ ID NO: 29593

SEQ ID NO: 191332 - DNA, 601 bp, Human; identical to SEQ ID NO: 29594

SEQ ID NO: 191333 - DNA, 601 bp, Human
cgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgac

SEQ ID NO: 191334 - DNA, 601 bp, Human
cgtagtggagaaattcgaggcaggaacaggagttcgcaggtaaaagattgacaaaccctctgagttagaaaactaaatgcaaggtttcagctgaaacgtgcacagaaggacacgttgtggctgggagggcggaggacaggcctgctgtctcccgacggtgaaacctgtcccggacggggcaggctgctctgacatgttgaaacttccgccgaataaaacaacctttcagcaataggtgattcttgaaggaagacttaacaccccggtgcttaaaaaacccaaatacctcgttattctagtwattctgtgaaaatgctcccataagcacctggattttccgcgaatgaagattgcggtttttctcctccaatctgcttcctgtcctggcggcgtttcctgagagggcttctcagtgcgtggccccgcctccggggctcaggaaagccttgtggggtgagctcatccctgtccacgcacgctccctgacagcaggtgtggtcttatttgaggccacggctctggcacgtatcatggggcgttggacacgcatgtgctcagtaaagcatttgaatcaagggtaaatggaaggttccatctcagt

SEQ ID NO: 191335 - DNA, 601 bp, Human
tgcagggcagaggcgggctttccgtggagcccagcgagacccttgatcccaggagaaagccaagccctggcctcctgtgggcagtcagacccttctctcctgagcgtggagccgggccaggccggggtcctccttggcccctcaggtgcccgtctgccctgccgcgtgtctgcccagctcctgacccttctctcctgagcatggagctgggccaggccagggtcctccttggcccctcaggtgcccgcctgccctgtcctgtgagtgcccaagctcctggcccttctctcgcattccttcyttccccctgaattgtgctcacgtttcctttttgcttctgtgtacgtggcctcactgttgagaggctttgctgaacacatgctaagagaggtcctcctgctgctcaggtcacccgctgtgcccggctccccgtctgagatccaccccttcccaccatggctgcctatccctggcctggcagatgggaacctgcagtgggcagccctggtggggtgcagccgggtgagggccctggtggggtgcagccgagtgagggccctgagccctagtggggtacagctgggtaaaggccctgagtcct

SEQ ID NO: 191336 - DNA, 601 bp, Human
agggccctgagccctggtgggctgcagccgagtgagggccctgagccctggtggggtacagctgggtgaaggccctgagtcctggtgggtactgccaggtgagggccctgggccctggtggggtgtagccgggtgggggccctggtggggtgcagccgagtgagggccctgagccctggtggggtacagctgggtgaaggccctgagtcctggagaggtgcagccgagtgagggccttggtggggtgcagccgggtgagggccctggtggggtacagctgggtgagggccctgagccctgsaggggtgcagtcaggtgaaggccctggtgggatgcagccgagtgagggccctgagccctggtggggtacagccaggtgagggccctggtgggtgcagccggatgtgggccctgagcctccagtgctggccggaacagcctgacgcagccgggtctcctgcaggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcac

SEQ ID NO: 191337 - DNA, 601 bp, Human
aagtgaggagtctttgtttgtaccgtggttgttgctttgaaattcaaccaaaagttcaactcaattaaacttgacccaggcaaggagcacccaccaagacctggtgtgcgtttgcccctggaagccgtctgacaggtcacaacacctcagatcctgtgacgggtacagaatgcaggctgctagagggagacgggtgctcacggttaatggggagatggagaggtacggcttgatgtccttttcgagcctttgcaggatccagcactgtccctgcgtggggatgctgaggcctggagtgcayggccctcccaagtcaggagcaggggtggccagggcgtggccttcgcacagtgggtggcagctcccgaacctgggtggacaggtgagaaggccccgccaggcaccgcggcaaagcccagccggctttcgggagaggccgctccctctggaaacgcgctctagttcctccccggttttctgtttcatagattgtgttttgtcttttacgattctggagagcagcgtgtgcccctctcggctgatttcacggcccttgaggtcatggtggagagtgttgctaagaggaggagtcgggtcgggt

SEQ ID NO: 191338 - DNA, 601 bp, Human
gtcctggtgatgctgtcacctcccattaggaaggcgtcctggtgatgatgtcacctcccatcgtgtcctggtgatgatgtcacctcccatcattaggaaggcatcctggtgatgatgtcacctcccactgtgtcctggtgatgatgtcacctgttgtgtcctggtgacgatgtcatctcctgtcgttaggaaggcgtcctggtgatgctgtcacctcccattgtgtcctggtgatgtcacctcccatcattaggagggcatcctggtgatgatgtcacctcctattgtgtcctggtgatgmtgtcacctcccgtcattaggagggcgtcctggtgatgatgtcacctcctattgtgtcctggtgatgctgtcacctcccgtcattaggaaggcgtcctggtgatgatgtcacctcccatcgtgtcctggtgatgctgtcacctcctgtcattaggagggcgtcctcgtgatgatgtcacctcccatcgtgtcctagtgatgatgtcaccacccgtcattagcgcattctggtgatgatgtcacctcccatcgtgtcctggtgatgtcacttcccatcgtgttctggtgacgatgtcatctc

SEQ ID NO: 191339 - DNA, 601 bp, Human
gtcacctcccattgtgtcctggtgatgtcacctcccatcattaggagggcatcctggtgatgatgtcacctcctattgtgtcctggtgatgctgtcacctcccgtcattaggagggcgtcctggtgatgatgtcacctcctattgtgtcctggtgatgctgtcacctcccgtcattaggaaggcgtcctggtgatgatgtcacctcccatcgtgtcctggtgatgctgtcacctcctgtcattaggagggcgtcctcgtgatgatgtcacctcccatcgtgtcctagtgatgatgtcaccrcccgtcattagcgcattctggtgatgatgtcacctcccatcgtgtcctggtgatgtcacttcccatcgtgttctggtgacgatgtcatctcctgttaaggcatcctcgtggtgatgtcgtttcaggtctttagaagggcttcctgttgcgggctggttgggtttttaatacaaggtgtctttccaacactgcttctctagctcttcgaggccagcaggtgcctaaagttcagtttgtttctgacgctgacgacccacggttgtcatcaggccttgagtctaggggctcagtcccaccagg

SEQ ID NO: 191340 - DNA, 601 bp, Human
cctggtgatgtcacctcccatcattaggagggcatcctggtgatgatgtcacctcctattgtgtcctggtgatgctgtcacctcccgtcattaggagggcgtcctggtgatgatgtcacctcctattgtgtcctggtgatgctgtcacctcccgtcattaggaaggcgtcctggtgatgatgtcacctcccatcgtgtcctggtgatgctgtcacctcctgtcattaggagggcgtcctcgtgatgatgtcacctcccatcgtgtcctagtgatgatgtcaccacccgtcattagcgcatyctggtgatgatgtcacctcccatcgtgtcctggtgatgtcacttcccatcgtgttctggtgacgatgtcatctcctgttaaggcatcctcgtggtgatgtcgtttcaggtctttagaagggcttcctgttgcgggctggttgggtttttaatacaaggtgtctttccaacactgcttctctagctcttcgaggccagcaggtgcctaaagttcagtttgtttctgacgctgacgacccacggttgtcatcaggccttgagtctaggggctcagtcccaccaggctgccctcatctcggac

SEQ ID NO: 191341 - DNA, 601 bp, Human
actctccagccagttgacaaagctcctggacacttctgagaacagcagggcggaacctggcctatgggattgctgtgggccagtcagtgaacgggccagcaccacctagagcagaaggatgtggagaccccccgtctaggaagtcagggtctgttctgtactgtcattctaatcagtagaagcacgatggcaggacagatacgtgcactgaagtgatactgctgagatttggtttcgaaattatgtgataatttaaagcagccacacgatcagtactgcgaacagcacctgttctttagaygctgcttttcatactgttgaataaaatatccaggggggtggctcgcactgtagtcccagtgctttgggaggtggacccgcaaggatctctcgagctcaggagttcaaggctgcagtgagctgtgatcgcacccctgcgcttcatcctgggccacagggtgagagcctgtctcaaaaaaaaatttttcttaataatttaaaataaaatcacaaacctttgacttattttttcttcagtatttttatttatttttttttttttgagacggaatcttgctccatcgtccaggctggagtgcag

SEQ ID NO: 191342 - DNA, 601 bp, Human
gagttcaaggctgcagtgagctgtgatcgcacccctgcgcttcatcctgggccacagggtgagagcctgtctcaaaaaaaaatttttcttaataatttaaaataaaatcacaaacctttgacttattttttcttcagtatttttatttatttttttttttttgagacggaatcttgctccatcgtccaggctggagtgcagtggtgcaatcttggctcactgcaacctccgcctcccaggttcaagcaattctcatgcctcagcctcttgagcagctggaattacaggcacgtgccaccasgcctggctaatctgtgtatttttagcagagatggggtttcatcatgttgctgaggttggtctcaagctcctgtcctcattgtcttaaactacataaagtggttaaagattagatacaaaactggtgttttaataattcagccttgcttgaagtgagctaggaatttctaagatcaatgagaaaaaaataattgttatctgaaaacagacttgcagatggtaagctggatttgaatgaagtcaaacacttttacttgaatgacactaataacatggcagccgataactgtgtatgtgtgtt

SEQ ID NO: 191343 - DNA, 601 bp, Human
tcttggctcactgcaacctccgcctcccaggttcaagcaattctcatgcctcagcctcttgagcagctggaattacaggcacgtgccaccacgcctggctaatctgtgtatttttagcagagatggggtttcatcatgttgctgaggttggtctcaagctcctgtcctcattgtcttaaactacataaagtggttaaagattagatacaaaactggtgttttaataattcagccttgcttgaagtgagctaggaatttctaagatcaatgagaaaaaaataattgttatctgaaaacagayttgcagatggtaagctggatttgaatgaagtcaaacacttttacttgaatgacactaataacatggcagccgataactgtgtatgtgtgttctgaaatgtgtataatttacgtgaacagcagcagttcagtttcgaatggcacgtcataaacaactgtttagctgtgccttccgtgaggaagatgcacgctgggctgtagttcatttgaataagtcgacttttgatgaaattttcttctgtttttaatgtgaaagtgtaatttgcaccaaaatatcaatattacttcagttaataccagc

SEQ ID NO: 191344 - DNA, 601 bp, Human
gctttttgatagttttcaaaattgatgaaacgacctacttacatcagaaaaaaggaatccctgtttgaatgtctccctccccaggctagacatagtgctggaagtctgaggaaacgggaccagccggcaggagttctgcggggccttcgtgctgcggtgaggacctgggcctgtgtggattggccacgcctctggtcccaccctcccttttctccgtaggcctccatcttggaggaacagtagagtgttttcttctggtttaatccaagagtcccccctgcttgtctgagttcatgtggcrcctgcccagttccctgcactaaatagacctgtgtccgcaatgccactccacgtgtggacccctagtgcctgcaggaccactccacctgtataaacgggtccagcgtggtctcctgcagccaccctcacacgcttgcaacagcactggtgccctgcagcccagttcccccatggcactcctgtctcacggagggtcccacacctgagcagccccaggcctcatctgtcacgggcattggttgcccgattcccccatggcatcccgtctcacagtgggtcccgtgcctgagtggccccaggc

SEQ ID NO: 191345 - DNA, 601 bp, Human
cggaaacacttttggtctcaagcatgttggatatgggatgcttaacctatctaagtttttatttctttgggataaatgtccagtggtagatacagttgctaaattggatggtgagtgtgtgtttagctttttaaagaaactgccagacctttttctggaatacctgcatcatcatttcatgttttcagcagcggtgagtgacccaggtggcgtggccagtgctgtttattgcagccattctgataggtgtgtcctgagctggttgtggctgtaacctgcatttccgtggtgaataattacscatcactcctgtgtttgttccatctgctagtccttggttggatgtgtggcttacaaatcctttcctcccagtcagcaacttgagttttcatcctctagagggtctttggcagagcaaaagttattaattttcacgagattctatttatcacttctttcttttaggaatcgtgcttttgctgtgaagttaactagtagcccagtcccagatcccagagattttcttgatgttttatcctaaaagttctatagtctttcatgcgacacctcagccccagatgctcttgagggtggttttctg

SEQ ID NO: 191346 - DNA, 601 bp, Human
cttctttcttttaggaatcgtgcttttgctgtgaagttaactagtagcccagtcccagatcccagagattttcttgatgttttatcctaaaagttctatagtctttcatgcgacacctcagccccagatgctcttgagggtggttttctggccccagccgcattgtcgccggcgccgtcctccctccatggctgcttctgccgcagcgtctcgagggcactcaggtgcacctgtgtggtctgtttctgggttttctgcccgtagatgcccttgatcaagttggatttcctgttttctgtgwgttgttatcaccagtgggtgttgaattttttaggagtttgttgattgatatgatggtgtgtgtggtttttcttcttttgcctgtcagtatgtggtggtcacattgactgatttttggacatgaaaacaaccttgcaccccagaaacaattcccgttggttgtggtatatagtaaccttgatgcgcttctgtgaagtgtctttatgttgacgttgaggggcctgtggggctgcacttgtcacgttgtgtgccgtctgcccccaggtttgctgtggctcccgtgatgaggtgggaagcgccc

SEQ ID NO: 191347 - DNA, 601 bp, Human
cgccggcgccgtcctccctccatggctgcttctgccgcagcgtctcgagggcactcaggtgcacctgtgtggtctgtttctgggttttctgcccgtagatgcccttgatcaagttggatttcctgttttctgtgagttgttatcaccagtgggtgttgaattttttaggagtttgttgattgatatgatggtgtgtgtggtttttcttcttttgcctgtcagtatgtggtggtcacattgactgatttttggacatgaaaacaaccttgcaccccagaaacaattcccgttggttgtggtrtatagtaaccttgatgcgcttctgtgaagtgtctttatgttgacgttgaggggcctgtggggctgcacttgtcacgttgtgtgccgtctgcccccaggtttgctgtggctcccgtgatgaggtgggaagcgccccaccctccagcatcactggtgagactgcggacttgccccttcctttcacatattcgggagaattctccagtgagaccgtctggtcctggagattttatttttgcaaggtttaaaatttcatattcattttccttaacagttacagggcttttcacaggacctgctg

SEQ ID NO: 191348 - DNA, 601 bp, Human
acagggcttttcacaggacctgctgcgtttgggtgagttgtggttgtgtttttgaaggaattgctccgcttaccttctctattttttttttgtttgtttttcagcctccttatttcgtactttccttctgcttgctttgggattatttcttatgacttttgttttgacagtcaagtgtggtctagagaactcgagcggagtctccggtgcttgcccggattcctgcttccgtcctcacgggaggttccctcggggtcccttccctcccgacctgacctggagtgtccatcatgctctcggrgcaggcctgggccctctccagtccctcccttgctgggggacgttttcacaggacaagactctgggttgatcttcctttttctcggggcctgaaaaacatccggcttccttctgggctccgtggttctgatgagtgatcttctgtctttgaccgtttttcctgtaggtaagctgtgttttctctttcactgccttccaggtttttctctgtctttagctgaggtttgatgacgaggtgtcctggtgtagatttggagggtttaccttgtttatgtttgactctgctttttgagttggaagg

SEQ ID NO: 191349 - DNA, 601 bp, Human
attgctccgcttaccttctctattttttttttgtttgtttttcagcctccttatttcgtactttccttctgcttgctttgggattatttcttatgacttttgttttgacagtcaagtgtggtctagagaactcgagcggagtctccggtgcttgcccggattcctgcttccgtcctcacgggaggttccctcggggtcccttccctcccgacctgacctggagtgtccatcatgctctcggagcaggcctgggccctctccagtccctcccttgctgggggacgttttcacaggacaagastctgggttgatcttcctttttctcggggcctgaaaaacatccggcttccttctgggctccgtggttctgatgagtgatcttctgtctttgaccgtttttcctgtaggtaagctgtgttttctctttcactgccttccaggtttttctctgtctttagctgaggtttgatgacgaggtgtcctggtgtagatttggagggtttaccttgtttatgtttgactctgctttttgagttggaaggtttatgtcttttgacgtctttgggacatttccagccattgcttttcagggccatctctg

SEQ ID NO: 191350 - DNA, 601 bp, Human
tgctccgcttaccttctctattttttttttgtttgtttttcagcctccttatttcgtactttccttctgcttgctttgggattatttcttatgacttttgttttgacagtcaagtgtggtctagagaactcgagcggagtctccggtgcttgcccggattcctgcttccgtcctcacgggaggttccctcggggtcccttccctcccgacctgacctggagtgtccatcatgctctcggagcaggcctgggccctctccagtccctcccttgctgggggacgttttcacaggacaagactmtgggttgatcttcctttttctcggggcctgaaaaacatccggcttccttctgggctccgtggttctgatgagtgatcttctgtctttgaccgtttttcctgtaggtaagctgtgttttctctttcactgccttccaggtttttctctgtctttagctgaggtttgatgacgaggtgtcctggtgtagatttggagggtttaccttgtttatgtttgactctgctttttgagttggaaggtttatgtcttttgacgtctttgggacatttccagccattgcttttcagggccatctctgcc

SEQ ID NO: 191351 - DNA, 601 bp, Human
agtctccggtgcttgcccggattcctgcttccgtcctcacgggaggttccctcggggtcccttccctcccgacctgacctggagtgtccatcatgctctcggagcaggcctgggccctctccagtccctcccttgctgggggacgttttcacaggacaagactctgggttgatcttcctttttctcggggcctgaaaaacatccggcttccttctgggctccgtggttctgatgagtgatcttctgtctttgaccgtttttcctgtaggtaagctgtgttttctctttcactgccttccasgtttttctctgtctttagctgaggtttgatgacgaggtgtcctggtgtagatttggagggtttaccttgtttatgtttgactctgctttttgagttggaaggtttatgtcttttgacgtctttgggacatttccagccattgcttttcagggccatctctgccatgctgggacagcagggacacggatgctgaggctttttgtatctcgtgcgtctctaagctgtgttctttttcctgttcagctcgttttctctgttgtccaggttgggtgacttctgttagattttcgggttcacagc

SEQ ID NO: 191352 - DNA, 601 bp, Human
tcggggcctgaaaaacatccggcttccttctgggctccgtggttctgatgagtgatcttctgtctttgaccgtttttcctgtaggtaagctgtgttttctctttcactgccttccaggtttttctctgtctttagctgaggtttgatgacgaggtgtcctggtgtagatttggagggtttaccttgtttatgtttgactctgctttttgagttggaaggtttatgtcttttgacgtctttgggacatttccagccattgcttttcagggccatctctgccatgctgggacagcagggacayggatgctgaggctttttgtatctcgtgcgtctctaagctgtgttctttttcctgttcagctcgttttctctgttgtccaggttgggtgacttctgttagattttcgggttcacagccttcctctgtctccttcatttgttgctagtctgtccaggacattttttggttttagtttttattttctgtttataaaatgtctgtatcttctatttctttgccaatcctttctgtgtttttcagttgtttcaagcatacttgcaattgcctcttgaagcatttttatcatggatgctataaaat

SEQ ID NO: 191353 - DNA, 601 bp, Human
ctgggctccgtggttctgatgagtgatcttctgtctttgaccgtttttcctgtaggtaagctgtgttttctctttcactgccttccaggtttttctctgtctttagctgaggtttgatgacgaggtgtcctggtgtagatttggagggtttaccttgtttatgtttgactctgctttttgagttggaaggtttatgtcttttgacgtctttgggacatttccagccattgcttttcagggccatctctgccatgctgggacagcagggacacggatgctgaggctttttgtatctcgtgcrtctctaagctgtgttctttttcctgttcagctcgttttctctgttgtccaggttgggtgacttctgttagattttcgggttcacagccttcctctgtctccttcatttgttgctagtctgtccaggacattttttggttttagtttttattttctgtttataaaatgtctgtatcttctatttctttgccaatcctttctgtgtttttcagttgtttcaagcatacttgcaattgcctcttgaagcatttttatcatggatgctataaaatcattgtgaattttagcatctctgccctct

SEQ ID NO: 191354 - DNA, 601 bp, Human
tgctgagctgtgcacctggaggccgagctagagtcctgcacttgtgtagttgtgtctggtttgggacgagcacttgtgtttttcacgcaacttcctattcaaggagacctagaacagcattaagcaatgtgtccgcagtgtgtggcatgagaacacgtggaagttgtggcttaggattcgtgcctgcgtcttcaccaggaccgatgccgcccagcccctccggctctcccggctcaccccaaggacatgggacggggtctggaggcactcatggtcatgacaaggggtgaccctggggccrgtcaacaccccctgcctgacgccgaccggcccccattgagaaacgctggagggctgtgtgttgcacgtgggccttaaacacacgcacacagagtgactggtgattctcacagcatctcgttatcacagcgcgaaacaactttaggcagcatcggtggagctggggttttctcagccgggtcctgcttggcccctgtgtcctgggccccttggcccgtgtgcttctcctcttgggtcccaggccgccccctgatagaaggttccacaacagtccggatgttagggatgggcgatctgcgca

SEQ ID NO: 191355 - DNA, 601 bp, Human
cccttccctcaggtcttcatgttcccaccagagcctatcctccctgcccgcctggcaccgctgtcctctggagagagccaccattctgtttgcatccagaaggcagcagaggttcttgaggaggaaaacagctcctgtgtatcttcaacagtagcagaaaaatgcagatagttctattcaggacagactcgtctcagtaactcaggtcatcacctttagacgccagtttatcttgtgaggatcagacccttttttgaggtgtgctgaatttctctgccatttttctgtctttttgaacatyagctgttttttgtttcacaaaaatgttttctctaaaaaaaatttttctcagccactacctgtaagcccagaccactttatttaagattccagaaggttctgtataaggaacagtcacctgcctaggaccaggggtgggaggagaggagggagggacgctgcctcttcctgcctggaagctgctgacacgtcccgtctccctcctggtttcctggtcgggcgtggaggactcggggtctgttccccacgcagtcctgtttcaggcagtggtgacaactggttcttagtcattcgatatcaa

SEQ ID NO: 191356 - DNA, 601 bp, Human
ggacccgaggcctctggaagctggaagatgtgaggaagggattctcccagtggacacctggattttggtcctgtgaggctcatgttggacttctgacctgcacagctgtgaggttgtgaatttggatcttttgagccgtggcgcctggttattacagcagcctcaggaagctcctcgtggcctggccctggcctgacagcctcgtctcacatgtgtccctcttccactccatgtgcttggggcagatgaggcagcttcaccccagataagcctgtctctcgggcccattgcctgcaccccyccgtgggcctgtgagacggactaggtacctgcccccgggtgctccctggaggctgccgtggcccctcttcatcctggggacacatggggtggggctgctgctcgttttggggcacagacgatggggagtcaagaggatctggaaccagggtcaagtgcagcccgtcagggggcctttgagtgaggggtgtcgagatctctggccatttccggcgcgtcagtgtgttaggtgggcattggctgctccagtggtagaggaagggtctccacgtcgacagaggagaggcaaagttgctgaccc

SEQ ID NO: 191357 - DNA, 601 bp, Human
atgtgtccctcttccactccatgtgcttggggcagatgaggcagcttcaccccagataagcctgtctctcgggcccattgcctgcacccccccgtgggcctgtgagacggactaggtacctgcccccgggtgctccctggaggctgccgtggcccctcttcatcctggggacacatggggtggggctgctgctcgttttggggcacagacgatggggagtcaagaggatctggaaccagggtcaagtgcagcccgtcagggggcctttgagtgaggggtgtcgagatctctggccatttcyggcgcgtcagtgtgttaggtgggcattggctgctccagtggtagaggaagggtctccacgtcgacagaggagaggcaaagttgctgacccaagagtagcacctgccgtgggggatgctgctcccacccacactgacaagggcttccccgcccctcatgtgaggagcagctttgagaactcgcgcctggtcagtgctgtgggaatgtgtgcccagttccttgagacccagtaggcatctggatttcttctcgggtttaaaccacggaggcttctacagctaggagaccactcacttgatgt

SEQ ID NO: 191358 - DNA, 601 bp, Human
tgtgagacggactaggtacctgcccccgggtgctccctggaggctgccgtggcccctcttcatcctggggacacatggggtggggctgctgctcgttttggggcacagacgatggggagtcaagaggatctggaaccagggtcaagtgcagcccgtcagggggcctttgagtgaggggtgtcgagatctctggccatttccggcgcgtcagtgtgttaggtgggcattggctgctccagtggtagaggaagggtctccacgtcgacagaggagaggcaaagttgctgacccaagagtagcrcctgccgtgggggatgctgctcccacccacactgacaagggcttccccgcccctcatgtgaggagcagctttgagaactcgcgcctggtcagtgctgtgggaatgtgtgcccagttccttgagacccagtaggcatctggatttcttctcgggtttaaaccacggaggcttctacagctaggagaccactcacttgatgtcactgctttcaaggaaaacccgtccccgtgtagcacatgcttctgacctccacgtccagaacatgcctaagcagagcgaggcatggcgtcagtaagcgtt

SEQ ID NO: 191359 - DNA, 601 bp, Human
atggggtggggctgctgctcgttttggggcacagacgatggggagtcaagaggatctggaaccagggtcaagtgcagcccgtcagggggcctttgagtgaggggtgtcgagatctctggccatttccggcgcgtcagtgtgttaggtgggcattggctgctccagtggtagaggaagggtctccacgtcgacagaggagaggcaaagttgctgacccaagagtagcacctgccgtgggggatgctgctcccacccacactgacaagggcttccccgcccctcatgtgaggagcagctttgrgaactcgcgcctggtcagtgctgtgggaatgtgtgcccagttccttgagacccagtaggcatctggatttcttctcgggtttaaaccacggaggcttctacagctaggagaccactcacttgatgtcactgctttcaaggaaaacccgtccccgtgtagcacatgcttctgacctccacgtccagaacatgcctaagcagagcgaggcatggcgtcagtaagcgttcacctgcaacggctttgaagaaacctgaaagccatgaaaattaacgttgtaattttatcttaaccatttttaaa

SEQ ID NO: 191360 - DNA, 601 bp, Human
gagttttattctgtgatccagggtcgtgcaaggaggttggtagaaacatttcatttccgtgcattgacaggataccgtagcatctgctgttatctgtatttgctctttggtagaaattccaacacttaggtatgaattcacttgtgttttttctctttacatacttttaaattttccttaagattaaaaaaaattatgttagcatgttttaagtgaagtaaatacaaacgaccctcaactttacaatagttcgcttaacaattttctaactttacaatgatgtgcaagtgacgtgtgtttsgtagaaaccacactttgaattagaagtcttggctcagaattctgtagaacagcttgttccaagtcggccttgtgctggacgactttgccagcgatggggtaatgtctgagcgtggaaggcggctgggccgggtgtgctgacacgttttcagcctgtgatgggctcatctggacgtgaccccatcctgagtcaaggagcctctgtaatgaagaaaactgtttttcagaaagcgcagtcaccttttttgtaaaaacaagcccaggaaaggtaggtgtcgttcccacatcagtgtgtttacac

SEQ ID NO: 191361 - DNA, 601 bp, Human
gacaggataccgtagcatctgctgttatctgtatttgctctttggtagaaattccaacacttaggtatgaattcacttgtgttttttctctttacatacttttaaattttccttaagattaaaaaaaattatgttagcatgttttaagtgaagtaaatacaaacgaccctcaactttacaatagttcgcttaacaattttctaactttacaatgatgtgcaagtgacgtgtgtttcgtagaaaccacactttgaattagaagtcttggctcagaattctgtagaacagcttgttccaagtyggccttgtgctggacgactttgccagcgatggggtaatgtctgagcgtggaaggcggctgggccgggtgtgctgacacgttttcagcctgtgatgggctcatctggacgtgaccccatcctgagtcaaggagcctctgtaatgaagaaaactgtttttcagaaagcgcagtcaccttttttgtaaaaacaagcccaggaaaggtaggtgtcgttcccacatcagtgtgtttacacgagtcaggcagaaagagggagaggagatcggaggagcatgatgtaggcgaggtcaggttttaatg

SEQ ID NO: 191362 - DNA, 601 bp, Human
gaaattccaacacttaggtatgaattcacttgtgttttttctctttacatacttttaaattttccttaagattaaaaaaaattatgttagcatgttttaagtgaagtaaatacaaacgaccctcaactttacaatagttcgcttaacaattttctaactttacaatgatgtgcaagtgacgtgtgtttcgtagaaaccacactttgaattagaagtcttggctcagaattctgtagaacagcttgttccaagtcggccttgtgctggacgactttgccagcgatggggtaatgtctgagcrtggaaggcggctgggccgggtgtgctgacacgttttcagcctgtgatgggctcatctggacgtgaccccatcctgagtcaaggagcctctgtaatgaagaaaactgtttttcagaaagcgcagtcaccttttttgtaaaaacaagcccaggaaaggtaggtgtcgttcccacatcagtgtgtttacacgagtcaggcagaaagagggagaggagatcggaggagcatgatgtaggcgaggtcaggttttaatgtgaatgtgtgcccacgtttctggcttggctgtgcaaaacgtacctcc

SEQ ID NO: 191363 - DNA, 601 bp, Human
tcgcttaacaattttctaactttacaatgatgtgcaagtgacgtgtgtttcgtagaaaccacactttgaattagaagtcttggctcagaattctgtagaacagcttgttccaagtcggccttgtgctggacgactttgccagcgatggggtaatgtctgagcgtggaaggcggctgggccgggtgtgctgacacgttttcagcctgtgatgggctcatctggacgtgaccccatcctgagtcaaggagcctctgtaatgaagaaaactgtttttcagaaagcgcagtcaccttttttgtamaaacaagcccaggaaaggtaggtgtcgttcccacatcagtgtgtttacacgagtcaggcagaaagagggagaggagatcggaggagcatgatgtaggcgaggtcaggttttaatgtgaatgtgtgcccacgtttctggcttggctgtgcaaaacgtacctccagatcttccagatagcagcacgggggcacgtgccgggctgccctgcctcaccagcgttggcacggacgtctgaggccctcccaggtggggcgccacactagcgagggtccctcgggtccgtgggctgccgtgctggcc

SEQ ID NO: 191364 - DNA, 601 bp, Human
tgggctgccgtgctggccggcccgcctgcccttggctgtcaagtgtaaaataacagattttaacagtgccttgtttttctctcttgacaaggtatgatgccgtgttaaaggccctaagtatttcagaatagaatttagtagaattattcccgtaggagatttgccatcgaaacagtaaattcagtgatgtaagcattctggtgaagtgtgaatattagtaaccttgtcgagtaaccagatgctcttattaaataccattccatgccagcgtccctgggaacatgttacttttagagatcaytataatgacctgatgataaagccgctgccttagctaattaaccattggttaaaatgtttctgccttttaatgattcaggccagggcacatgtgctgtgactagctggacacgtggcgatgagtttgaaattgcagagtggacggggtggatgcgtcggcctccatgtgggctcgggggctgagctgtgatttctgatcgaagcggcttcacaccgagtctctgtgactctggactcggcctcgactgctccgaaccgcgcctgtctcgggagttgtgctccgtcctctgtggccgtttct

SEQ ID NO: 191365 - DNA, 601 bp, Human
tcattataatgacctgatgataaagccgctgccttagctaattaaccattggttaaaatgtttctgccttttaatgattcaggccagggcacatgtgctgtgactagctggacacgtggcgatgagtttgaaattgcagagtggacggggtggatgcgtcggcctccatgtgggctcgggggctgagctgtgatttctgatcgaagcggcttcacaccgagtctctgtgactctggactcggcctcgactgctccgaaccgcgcctgtctcgggagttgtgctccgtcctctgtggccgtktctcgtacctgctgcgggggtggggttaggtcggcgtcggtgagtgcccctcaaggccccagccaggtgtgcacccccagatccctcctgggaaacagcctgcgctgggggactgtggtcaggccgccccgcctcacctgcctgtctcagggaccacggggctgtgccgtcgcacacagacgccctcaacgtcggagagctgtgagcggggccgtgctcttgggatgggagcccccgggagagctgcccgccaacaccactccgacgtgatccatgctggacataaagtgctcttccctc

SEQ ID NO: 191366 - DNA, 601 bp, Human
acatcttagcgagcgtccctgtggcacggccacgtctccacccccaggtggctgctctcccagattccaggatgggaaggactgggacgcctccctgaaagccctgccactcaggagtcttgctgtgaatctcattgatcttgaaaatttcaagcaaatattctgattattcaccataaaatccaacagtgcaccaggaataaagtccctgttcacataagggacagaaggaatttaaacccaatctttgcctgcgaaccgactgggtttgctctgtggatttccaagcgtcttttgcccrgggctttgttaaggattggttgagtttcaagccccagggctcaggtagaaagcagagtgctacctccagcccccaccctgctgcactcagagccctggactctgccgggagaagcctgttgcggaggaacggggcccgggaaggaggtctgtcgctgactcttggctgtttgtcaggtggacgacatccttggagaaggcagcgacgacagcgacagcgagaagaggaggcctgaggagcaggaggaggagccccagccccggaagccagggacccgcagggagcggacgctcggggcac

SEQ ID NO: 191367 - DNA, 601 bp, Human
atgtttaaggatctcacagacacatcgtcccaacaccagttccaggtaccgaaaagaacaggcgcccaggtgaggtgaggtctcctgcacaggttgggtgaggtcccccgtgcggttgatctgtccctgagtccctgaggtcccccgtgcggttgatctgtccctgagtccctgaggtcccccgtacggttgatctgtcccttagcccatggttgggtgaggtccccgtgtggttgatctgtccctgagtccccgaggtccccttgcggttgatctgtccctgagcccgtggttgggtgargtccccgtgcggttgatctgtccctgagtccctgaggtcccccgtgtggttgatctgtccctgagcctgtggttgggtgaggtcccccgtgcggttgatctctccctgagcctatccttttatgcttttggtggccggaggtgaatcatcactcacaaaggcaactttaaaatataccatagcctctttcttcagatcattcctagagttcgcggagaagtgaaaacgacattgagttaactgccaagaaacatagcacagcatggtgggagctgttatgttactggcaagaagatgagc

SEQ ID NO: 191368 - DNA, 601 bp, Human
aggtcccccgtgcggttgatctgtccctgagtccctgaggtcccccgtacggttgatctgtcccttagcccatggttgggtgaggtccccgtgtggttgatctgtccctgagtccccgaggtccccttgcggttgatctgtccctgagcccgtggttgggtgaggtccccgtgcggttgatctgtccctgagtccctgaggtcccccgtgtggttgatctgtccctgagcctgtggttgggtgaggtcccccgtgcggttgatctctccctgagcctatccttttatgcttttggtggccrgaggtgaatcatcactcacaaaggcaactttaaaatataccatagcctctttcttcagatcattcctagagttcgcggagaagtgaaaacgacattgagttaactgccaagaaacatagcacagcatggtgggagctgttatgttactggcaagaagatgagctggtcgttcccatgatctgttgacagagacaacagctgatgatggctccctaagtacttggagattttagtcctggtgcccccgtttcctgtcccatctggtgcagtgataaacaggaaaggaaaacagcaccacgt

SEQ ID NO: 191369 - DNA, 601 bp, Human
ccggaggtgaatcatcactcacaaaggcaactttaaaatataccatagcctctttcttcagatcattcctagagttcgcggagaagtgaaaacgacattgagttaactgccaagaaacatagcacagcatggtgggagctgttatgttactggcaagaagatgagctggtcgttcccatgatctgttgacagagacaacagctgatgatggctccctaagtacttggagattttagtcctggtgcccccgtttcctgtcccatctggtgcagtgataaacaggaaaggaaaacagcaccaygttttaaaggcttagtttcctgacacgagtacccagatcccaacactcagctcttctccacaggggtgtgtggtcagcctgcgtgggagacacagggcggcaggcagggtccttctgaggttcacctcctcttgtccgtttgggagggttgcgtgagctcccactcttagacaacagggaatagtgctccaccagaaacactcacacatcaaagttgtttttaatcttggataattaactaagaaagataatctttaggagagagaggagcagaaaaactattcaaagacataatgactg

SEQ ID NO: 191370 - DNA, 601 bp, Human
ttgcgtgagctcccactcttagacaacagggaatagtgctccaccagaaacactcacacatcaaagttgtttttaatcttggataattaactaagaaagataatctttaggagagagaggagcagaaaaactattcaaagacataatgactgaaaactccccaaatgtaatggaaaacattaatttatacatcccagaagcacaacaaactccaaataggatgaacacaaagatctttacctaggcacatcccagtggaagaggaaatgccgggagcagggctgggggcccagaggaagcrtgaggcgtcgtgggagagaggcctgggggcagcagaggaggcatgaggtggaggcctgggggcagcagaggaagcatgaagcatgagagagagagagagagagagagagaggcctggcaccagaggaagcgtgaggggttggtggagagaggcctgagggcagcagaggaggtgtgaggtgtccacgagagagaggcctgagggcagcagaggaggcatgaggcgtccatgggagagaggcctgagggtgggagaacccatcacaccacagccgcttctcctcagagatggcaccaccac

SEQ ID NO: 191371 - DNA, 601 bp, Human
aaacaacctttcaaaaacaaaggcagggttttcccagacaaagtgggaattcactagcagacgcaccttacaagaagttctaaaggaagctcttcaggctgaaagcaggtgacttagatgaaatctgaatccacacaaacaagcaagcacgaggaatgcagattatgtaactctgtaaggtagcgtgttgcttctcctttattctcttgatttaaaaagcagtatagttttatagtataagactctatgcctgggcatgtggtggctgtggctcacgcctgtaatcctagcactttaggaygccgaggtgggcagatgacttgaggtcaggagttcaagaccaacctggccaacatggtgaaaccctgtctctactgaaaatacaaaaattagctgggcatggtggtgcacgcctgtaatttcagctactcaggaggctgaggcacaagaatcactagaacccagaggggaggttgcagtgagccaagatcatgccactgcactcccgcctgggccacagagcaagaccctgtcacaaaacgaaataaaacaactctttgtacctaattgtattgttgggcccataccatgtggagatgta

SEQ ID NO: 191372 - DNA, 601 bp, Human
tgacttgaggtcaggagttcaagaccaacctggccaacatggtgaaaccctgtctctactgaaaatacaaaaattagctgggcatggtggtgcacgcctgtaatttcagctactcaggaggctgaggcacaagaatcactagaacccagaggggaggttgcagtgagccaagatcatgccactgcactcccgcctgggccacagagcaagaccctgtcacaaaacgaaataaaacaactctttgtacctaattgtattgttgggcccataccatgtggagatgtaacatttgccagtagcygcgccgaggaggggcctaggattaaatgacagcagatggtgactggaatttacagcaagagctgaagagacccaggagtgctgaacaagaaggttggtctcaccgtgctccgagtgtgcacctgttccctgtcctgctgtaaataattacaacgatgcattgttgggtttgtagcatgcatggatgtggtatcgtacagtgaagcaaggccgagcacggtggctcatgcttgtaatcccagcactctaggaagctgaggcgggcggattgcctgagttcaggagttcgagaacagcctgg

SEQ ID NO: 191373 - DNA, 601 bp, Human
ggtggaggttgcggtgagccgagatcgtgccactacactccaccctggacaacggagtgagactccgtctccaaaaaaaaaaaaaaaaaaacagtgaagcacaaagtgaggagtctgagtgtgcacctgctctcactcctgctgtaaataattacaacgatgcattgttgggttcatggcgtgcatggatgtggtattgtacagtgaagcacaaagtgaggaggggctgagctgtgcagcagccatgtctccgtatcgaattggaattaggccagcatgagtccaaaattgattctgatcragcgagatatacgtatgctaaacccaagagcagaagctaaggaagtaactcaaaatacatcgtgaaacagatcatacaagtgtgaaaggaggataaaccttgggccccaccatcatgaaactgaagggaaaagtcacactgggaactgctcagggccagcctgcctcccgttctatccaacctcccgcccattctatccaaagccaccctccgctcactgagacagatgcagctcagggcaaacccgccacccattctatccaaagccaccttctgctcactgagacaggtgcagatctg

SEQ ID NO: 191374 - DNA, 601 bp, Human
cattctatccaaagccaccctccgctcactgagacagatgcagctcagggcaaacccgccacccattctatccaaagccaccttctgctcactgagacaggtgcagatctgatggcctcctttggagaggctgatcagaaactcaggaggatgcagccatttgtctcttgtctacctgtgacctggaagtccctccctggttccagctgtcccacctttccagagtgaaccagtgttcatcttacatatgttctttcatgtctcatgtctccctaaaatgtgtaaaacagagccgtgcccygaccacctcaggcacatgtcaggccctcctgaggccgtgtcacaggcaggtgaccccaaccttggcaaaataaactttttaagttaagtgagacctgacacagatacttggagttcacaaaaggaaccaaaatgttacattagacagtattcacttaatgcaaaagaaaacagaaaagggaagacaggaactaaaactacatgaggcatgagaaacaaagcagagtggcggtgtgaacgtgaggggattcagagctttaactatgagtggatggacaactgggtcagaggccatcaccgt

SEQ ID NO: 191375 - DNA, 601 bp, Human
cgtccctcccgtgcgggttctgtccctgcgtccctcccgtgcgcgttctgtgcccgcgtccctcccgtgcgcgttctgtccccgcgtccctcccgtgcgcgttctgtccccgcgtccctcccgtgcgcgttctgaccctgcgtccctcccgtgcgcgttctgtccgtgcgtccctcccatgcgtgttctgactctgcggtctcttcagggtttgccactcgagggtgtcggaggtggaggttgtgttcgttctcccttcacatagcacgcggagttttggtttgtgaaagtttgctttttygtgttttcatagctacacaaactgcatctcttggaaaagtgagagcgttttgacagctgctgtcactgtgaacaggtcaggaggccctgccttgcccaccccatacttaggggcttaagaaacaaggtctcactctgttgcctgggctggagtgcagtggcacgatcatggctcactggaagcttgaactcctgggctcaagggatcgtcccgcctcaaccttccaagtaggtaggaccacaggtgcgcaccaccatgcctggctaatgtttttaaaatttttttgtagagatggggact

SEQ ID NO: 191376 - DNA, 601 bp, Human
cgtccctcccgtgcgcgttctgtccccgcgtccctcccgtgcgcgttctgtccccgcgtccctcccgtgcgcgttctgaccctgcgtccctcccgtgcgcgttctgtccgtgcgtccctcccatgcgtgttctgactctgcggtctcttcagggtttgccactcgagggtgtcggaggtggaggttgtgttcgttctcccttcacatagcacgcggagttttggtttgtgaaagtttgctttttcgtgttttcatagctacacaaactgcatctcttggaaaagtgagagcgttttgacarctgctgtcactgtgaacaggtcaggaggccctgccttgcccaccccatacttaggggcttaagaaacaaggtctcactctgttgcctgggctggagtgcagtggcacgatcatggctcactggaagcttgaactcctgggctcaagggatcgtcccgcctcaaccttccaagtaggtaggaccacaggtgcgcaccaccatgcctggctaatgtttttaaaatttttttgtagagatggggacttcctttgttgcccattgagaccagcctggcctcaaactcctggcctccagcgatcc

SEQ ID NO: 191377 - DNA, 601 bp, Human
cgtgcgcgttctgaccctgcgtccctcccgtgcgcgttctgtccgtgcgtccctcccatgcgtgttctgactctgcggtctcttcagggtttgccactcgagggtgtcggaggtggaggttgtgttcgttctcccttcacatagcacgcggagttttggtttgtgaaagtttgctttttcgtgttttcatagctacacaaactgcatctcttggaaaagtgagagcgttttgacagctgctgtcactgtgaacaggtcaggaggccctgccttgcccaccccatacttaggggcttaagaracaaggtctcactctgttgcctgggctggagtgcagtggcacgatcatggctcactggaagcttgaactcctgggctcaagggatcgtcccgcctcaaccttccaagtaggtaggaccacaggtgcgcaccaccatgcctggctaatgtttttaaaatttttttgtagagatggggacttcctttgttgcccattgagaccagcctggcctcaaactcctggcctccagcgatcctcccgcctcagcctcccaaagtgctggacctacaggtgtgaacaccgtgcccactgtgcctaccg

SEQ ID NO: 191378 - DNA, 601 bp, Human
gcatttgccgcactgacggatatctttccggtgccaaatcgtgtgcactgtgacagcccagtgtgtttggaaaactgaaatatgggggtggggtatacatatatattattctgtttgtattcttgccttattcaatgttgaatttgagataaatgttaaagctgtaaattttccccaaattctatctgttaacatttctctatggagctgtgcagctggttgtatgaacaaaatacaaatattgcatgttatgctgaggaagtgaagctagtatcagttgcggacatttactaaccatagyctgcagctgtgtctaatgttcgaggtaatttttaatgactaaagtccattcatctcgtatttttaaatcccatgctccaaacatcgtttaactaagagcaaaggttttgtgccaccttagtgaggcgctccctgtacttcatcatggagcgagaccgagggtgcggcattcgcagcaccaggagggaccgcgcagggcctggggggacccatggagggagggccgccccagcccgggctctgtgacccctcagggtggaagccgttgacctggtcccagacactcagcctcatggaagcc

SEQ ID NO: 191379 - DNA, 601 bp, Human
gagataaatgttaaagctgtaaattttccccaaattctatctgttaacatttctctatggagctgtgcagctggttgtatgaacaaaatacaaatattgcatgttatgctgaggaagtgaagctagtatcagttgcggacatttactaaccatagtctgcagctgtgtctaatgttcgaggtaatttttaatgactaaagtccattcatctcgtatttttaaatcccatgctccaaacatcgtttaactaagagcaaaggttttgtgccaccttagtgaggcgctccctgtacttcatcayggagcgagaccgagggtgcggcattcgcagcaccaggagggaccgcgcagggcctggggggacccatggagggagggccgccccagcccgggctctgtgacccctcagggtggaagccgttgacctggtcccagacactcagcctcatggaagccctgaccctgtctcccgagtcagctacgtttttccaaagtgcgtggaggacgtttctcagcattcttaccagcatcgtggggtccaggcccctgctgtgagatggggatggtggcgcctgcccgcaggtttcttgtgaaaatctaa

SEQ ID NO: 191380 - DNA, 601 bp, Human
ttaaagctgtaaattttccccaaattctatctgttaacatttctctatggagctgtgcagctggttgtatgaacaaaatacaaatattgcatgttatgctgaggaagtgaagctagtatcagttgcggacatttactaaccatagtctgcagctgtgtctaatgttcgaggtaatttttaatgactaaagtccattcatctcgtatttttaaatcccatgctccaaacatcgtttaactaagagcaaaggttttgtgccaccttagtgaggcgctccctgtacttcatcatggagcgagaycgagggtgcggcattcgcagcaccaggagggaccgcgcagggcctggggggacccatggagggagggccgccccagcccgggctctgtgacccctcagggtggaagccgttgacctggtcccagacactcagcctcatggaagccctgaccctgtctcccgagtcagctacgtttttccaaagtgcgtggaggacgtttctcagcattcttaccagcatcgtggggtccaggcccctgctgtgagatggggatggtggcgcctgcccgcaggtttcttgtgaaaatctaaggaagaagca

SEQ ID NO: 191381 - DNA, 601 bp, Human
tttgtgccaccttagtgaggcgctccctgtacttcatcatggagcgagaccgagggtgcggcattcgcagcaccaggagggaccgcgcagggcctggggggacccatggagggagggccgccccagcccgggctctgtgacccctcagggtggaagccgttgacctggtcccagacactcagcctcatggaagccctgaccctgtctcccgagtcagctacgtttttccaaagtgcgtggaggacgtttctcagcattcttaccagcatcgtggggtccaggcccctgctgtgagatgggratggtggcgcctgcccgcaggtttcttgtgaaaatctaaggaagaagcacttagcacagccccagaccacagcgtccccagctgtggatccacaagaaactgttcccagcgaatgccatgagcgcctgcggccgcctcatctcacacaacagcgacagagtcatgatcagaggcctttagagtcatcattatcatgtctgtgtgtgagccgtgactgcctgggagccgtgtctgcctgggagccgtgactgcacatgagccgtgtctgtgtgtgagccgttctgtgtgtttgccgtgtct

SEQ ID NO: 191382 - DNA, 601 bp, Human
tgtgccaccttagtgaggcgctccctgtacttcatcatggagcgagaccgagggtgcggcattcgcagcaccaggagggaccgcgcagggcctggggggacccatggagggagggccgccccagcccgggctctgtgacccctcagggtggaagccgttgacctggtcccagacactcagcctcatggaagccctgaccctgtctcccgagtcagctacgtttttccaaagtgcgtggaggacgtttctcagcattcttaccagcatcgtggggtccaggcccctgctgtgagatggggayggtggcgcctgcccgcaggtttcttgtgaaaatctaaggaagaagcacttagcacagccccagaccacagcgtccccagctgtggatccacaagaaactgttcccagcgaatgccatgagcgcctgcggccgcctcatctcacacaacagcgacagagtcatgatcagaggcctttagagtcatcattatcatgtctgtgtgtgagccgtgactgcctgggagccgtgtctgcctgggagccgtgactgcacatgagccgtgtctgtgtgtgagccgttctgtgtgtttgccgtgtctgt

SEQ ID NO: 191383 - DNA, 601 bp, Human
gcgcctgcccgcaggtttcttgtgaaaatctaaggaagaagcacttagcacagccccagaccacagcgtccccagctgtggatccacaagaaactgttcccagcgaatgccatgagcgcctgcggccgcctcatctcacacaacagcgacagagtcatgatcagaggcctttagagtcatcattatcatgtctgtgtgtgagccgtgactgcctgggagccgtgtctgcctgggagccgtgactgcacatgagccgtgtctgtgtgtgagccgttctgtgtgtttgccgtgtctgtgtgtkagccgtgtctgtgtgtgagccgtgttggtgcatgtgcacagggctctccagcgggagctgaggtggtcccttccgtgggctcggttcaggtcctgtggcaccctgccaagttatgctggcgtttctgaaggtgtgtcctgctgtcaacagcactctgggtgtttttgtcggccttgtgaggggaacatatttctaaacctcaaacagagagtcacagctggcatttcccattctttgccatcctcttgctgccattagaactctgccacggatggcttcctcgcttgattttagaaagaa

SEQ ID NO: 191384 - DNA, 601 bp, Human
cgcctgcccgcaggtttcttgtgaaaatctaaggaagaagcacttagcacagccccagaccacagcgtccccagctgtggatccacaagaaactgttcccagcgaatgccatgagcgcctgcggccgcctcatctcacacaacagcgacagagtcatgatcagaggcctttagagtcatcattatcatgtctgtgtgtgagccgtgactgcctgggagccgtgtctgcctgggagccgtgactgcacatgagccgtgtctgtgtgtgagccgttctgtgtgtttgccgtgtctgtgtgtgwgccgtgtctgtgtgtgagccgtgttggtgcatgtgcacagggctctccagcgggagctgaggtggtcccttccgtgggctcggttcaggtcctgtggcaccctgccaagttatgctggcgtttctgaaggtgtgtcctgctgtcaacagcactctgggtgtttttgtcggccttgtgaggggaacatatttctaaacctcaaacagagagtcacagctggcatttcccattctttgccatcctcttgctgccattagaactctgccacggatggcttcctcgcttgattttagaaagaaa

SEQ ID NO: 191385 - DNA, 601 bp, Human
gcactctgggtgtttttgtcggccttgtgaggggaacatatttctaaacctcaaacagagagtcacagctggcatttcccattctttgccatcctcttgctgccattagaactctgccacggatggcttcctcgcttgattttagaaagaaaagaattgttggaactggttcttgcacctctcgccctccccctcctctccctgcttgccccagggtcccgcctggctctcgtctgccccgtcttcactttcggtcggggcccctgcccctgcccctgctctgctcagtgcccctgatacrtccaacccagcgtcgctgtgagggagtcaaccacacctgccagcacccccgagtctggccccactaggaggggccagggctcccttgagcaaggcatcagcacacaggcagggagccgggcaccagactgtgagggtcgcgccacgcactcccgaggccccgtgcacacgagatccaggcccgccccctcctggacttggtgaccgtcccgagctcgacctgagagggcacttcggctctcctgttcacagtcatgactgccccctccccgaggtcagcgccatgcactgctctgggggc

SEQ ID NO: 191386 - DNA, 601 bp, Human
caaggcatcagcacacaggcagggagccgggcaccagactgtgagggtcgcgccacgcactcccgaggccccgtgcacacgagatccaggcccgccccctcctggacttggtgaccgtcccgagctcgacctgagagggcacttcggctctcctgttcacagtcatgactgccccctccccgaggtcagcgccatgcactgctctgggggcctgaaacgccgcctctgttcgcaagggtctcctgtcccgtccacctgccagtgggttgagctcttccaggggttcgggacacccctcackgcagcaccttcacgtttacgagaactgtctctgtcttgttttgtttcaagttctcaaaacggagtgaggtggaggaagcctaatgggaggatgggagccgggttttcccggaacagccgtcagcgtgtatgcggaggaagagagatgactgatgaatttgttaattgccaaaagcttgttgctgtagcaaccggaggccagactcgtggccctgacagcgtcgttagtgtcagcagagactggaaataaaggaaactcgtgtatgatacgcctggcgtcctcaaagcaaacagcaggcgg

SEQ ID NO: 191387 - DNA, 601 bp, Human
cccgccccctcctggacttggtgaccgtcccgagctcgacctgagagggcacttcggctctcctgttcacagtcatgactgccccctccccgaggtcagcgccatgcactgctctgggggcctgaaacgccgcctctgttcgcaagggtctcctgtcccgtccacctgccagtgggttgagctcttccaggggttcgggacacccctcacggcagcaccttcacgtttacgagaactgtctctgtcttgttttgtttcaagttctcaaaacggagtgaggtggaggaagcctaatgggagratgggagccgggttttcccggaacagccgtcagcgtgtatgcggaggaagagagatgactgatgaatttgttaattgccaaaagcttgttgctgtagcaaccggaggccagactcgtggccctgacagcgtcgttagtgtcagcagagactggaaataaaggaaactcgtgtatgatacgcctggcgtcctcaaagcaaacagcaggcggtgcccagcccaacacaggcacgggcacaagatctgcagatgaggcatggaggggaagcgggcggtgcccagcccaacacaggcacgggca

SEQ ID NO: 191388 - DNA, 601 bp, Human
ctcacggcagcaccttcacgtttacgagaactgtctctgtcttgttttgtttcaagttctcaaaacggagtgaggtggaggaagcctaatgggaggatgggagccgggttttcccggaacagccgtcagcgtgtatgcggaggaagagagatgactgatgaatttgttaattgccaaaagcttgttgctgtagcaaccggaggccagactcgtggccctgacagcgtcgttagtgtcagcagagactggaaataaaggaaactcgtgtatgatacgcctggcgtcctcaaagcaaacagcrggcggtgcccagcccaacacaggcacgggcacaagatctgcagatgaggcatggaggggaagcgggcggtgcccagcccaacacaggcacgggcacaagatctgcagacgaggtgtgcagaggggaagcaggtgcacagaaaaggtgcgcggagattttttttttttaagacagggtcttgctctgtcgcccaggctggagtgcagtgttgcggtcatggcccaggctcactgcagcctccatttcctgggctcagaggatcctttttcctcagcctcccaaatagctgggactccaggc

SEQ ID NO: 191389 - DNA, 601 bp, Human
gaaaccaggtgcacctgcagcggctcctaaggaaaacctagtggcactggctggttatgcagaggctcgtaaggaaagcctagtggcaccggctggttatgcagaggctcctaaggaaagcctagtggcaccggctggttatgcagaggctcctaaggaaagcctagtggcaccggctggttatgcagaggctcctaaggaaagcctagtggcacccgctggttatgcagaggctcgtaaggaaagcctagtggcaccggctggttatgcagaggctcgtaaggaaagcctagtggcaccsgctggttatgcagaggctcctaaggaaagcctagtggcaccggctggttatgcagaggctcctaaggaaagcctagtggcaccggctggttatgcagaggctcctaaggaaagcctagtggcaccggctggttatgcagaggctcgtaaggaaagcctagtggtactggctggttatgcagaggctcgtaaggaaagcctagtggcaccggctggttatgcagagggctggtgttctctttgtttattaagagtcattttagcagtggcctgaggaaatgagaatttccagaccgtggcc

SEQ ID NO: 191390 - DNA, 601 bp, Human
tagtggcaccggctggttatgcagaggctcctaaggaaagcctagtggcacccgctggttatgcagaggctcgtaaggaaagcctagtggcaccggctggttatgcagaggctcgtaaggaaagcctagtggcacccgctggttatgcagaggctcctaaggaaagcctagtggcaccggctggttatgcagaggctcctaaggaaagcctagtggcaccggctggttatgcagaggctcctaaggaaagcctagtggcaccggctggttatgcagaggctcgtaaggaaagcctagtggyactggctggttatgcagaggctcgtaaggaaagcctagtggcaccggctggttatgcagagggctggtgttctctttgtttattaagagtcattttagcagtggcctgaggaaatgagaatttccagaccgtggcccacttgatgagctgggaggtgcttgttcacataacactaatagttactctgacagatgatcttaacttccctgtcctgttttcctgttctgatgtcttctggcatcacaggtgttcatgagcggccggaacgtgcatttgcagcaggtgaacacctgctttgtc

SEQ ID NO: 191391 - DNA, 601 bp, Human
tggcaccggctggttatgcagaggctcctaaggaaagcctagtggcacccgctggttatgcagaggctcgtaaggaaagcctagtggcaccggctggttatgcagaggctcgtaaggaaagcctagtggcacccgctggttatgcagaggctcctaaggaaagcctagtggcaccggctggttatgcagaggctcctaaggaaagcctagtggcaccggctggttatgcagaggctcctaaggaaagcctagtggcaccggctggttatgcagaggctcgtaaggaaagcctagtggtacyggctggttatgcagaggctcgtaaggaaagcctagtggcaccggctggttatgcagagggctggtgttctctttgtttattaagagtcattttagcagtggcctgaggaaatgagaatttccagaccgtggcccacttgatgagctgggaggtgcttgttcacataacactaatagttactctgacagatgatcttaacttccctgtcctgttttcctgttctgatgtcttctggcatcacaggtgttcatgagcggccggaacgtgcatttgcagcaggtgaacacctgctttgtcagt

SEQ ID NO: 191392 - DNA, 601 bp, Human
ggggcgcagacgctgacccttcccggggctcctcccctcccttcaccccatcctctggccttagctggcctgaaattaaggccacggtaataggggtagcaggaggcggcggactgacctaaagcagctggttctttgtgcgcatagaccgtaagggggaatgatctggacttggtcagctgcctcggggcctaggcagggatctgctcatccagatgttcagttgcgttgcccttctttcccttcaatattattaacttaatagtccacttgaagcttgccggcttttttccgggcgacktggtgtaaacaaccacaacctcgttggtgctgcaacgagctggtggagcccagaaacctttcacatgccagtgtgtcatcctcgtagtaacgtacataacatctccccctaattccacatgcgtgtcatttgtgcatttcttccttgcgattttccctggttcttgttctttgccaagaggattaattatgtagaacatcttggactcaggatatttattagtcgtctcatcagctgatgtgctgagaaaccttcataagccctcaaattgatcacatgtagtaaattgttactataatc

SEQ ID NO: 191393 - DNA, 601 bp, Human
ggggtagcaggaggcggcggactgacctaaagcagctggttctttgtgcgcatagaccgtaagggggaatgatctggacttggtcagctgcctcggggcctaggcagggatctgctcatccagatgttcagttgcgttgcccttctttcccttcaatattattaacttaatagtccacttgaagcttgccggcttttttccgggcgacgtggtgtaaacaaccacaacctcgttggtgctgcaacgagctggtggagcccagaaacctttcacatgccagtgtgtcatcctcgtagtaacstacataacatctccccctaattccacatgcgtgtcatttgtgcatttcttccttgcgattttccctggttcttgttctttgccaagaggattaattatgtagaacatcttggactcaggatatttattagtcgtctcatcagctgatgtgctgagaaaccttcataagccctcaaattgatcacatgtagtaaattgttactataatcataaattgttacattcatcattgcctttctgttccttactatttcattgcttagaatgattttttctttcttccattttatcccttcttttt

SEQ ID NO: 191394 - DNA, 601 bp, Human
taacgtacataacatctccccctaattccacatgcgtgtcatttgtgcatttcttccttgcgattttccctggttcttgttctttgccaagaggattaattatgtagaacatcttggactcaggatatttattagtcgtctcatcagctgatgtgctgagaaaccttcataagccctcaaattgatcacatgtagtaaattgttactataatcataaattgttacattcatcattgcctttctgttccttactatttcattgcttagaatgattttttctttcttccattttatcccttctttttttttttaagtttatcgatttattggcgtacaatacagatgttttgagctatgcaagttaaaattcttctgtaaactttttaagtgctgtgaaaaagacacacatgatcagtaaatttggaattttggaatttggcagaaataaagtagttccgaacagggtgcagaagggaattagaaagaggcagatttcgagttcagacagataagactaggtcttaagatcagtagaagtttctaattatactgttcttaatctttcaagagttagtgttattcctctgacgtgggtatacag

SEQ ID NO: 191395 - DNA, 601 bp, Human
gtcttcctggcaagcaataaaaccttgacatatcatgggcttatgtgcttaatttcaggacagggaagaaaagagaaaatttgggactatatagccagactatacaggtctaatttctgactctgaatattctgaagagaaagaactcaggaagccagtcctaaatcagaaaactacccctcaaaggcttaatggagggttttgcagtttagcaaacccattgctaaggaaagaatacaatagaagggagttggagctattacagaagggcactgctgttgtctagatactcttgtatagygttatttgtgtagcacatattgttactaatgattaaggtcccctccagctttcagatcttattgttaaactactatttgcatttttcacaaatattttatactgcttgaaccaagcctttttcttttttgctcagttcatggttgacagatcaactaagctaatttttattggatgtagtaatttttaaaagttcctctgtatcacaaattctgtaagattggtgcctgtgacatacttactcttgatttttttctcaaaaaggttaaatattggctaaaataacttagaaatgtcaaac

SEQ ID NO: 191396 - DNA, 601 bp, Human
tagtgcctttacaaaggacagggtgcagttttagaagagtttggtgaacttgaaattaattgttagaatgagatttttaaattttgtgcatacatatcaggttccctattgcgtaatatgtaatcagcttctcaattttttatgtaccctaatatttaatcaggttttacatgtgatgcctctatcagcagtcagtagattagtatatttatgtctgtattcaggaatggtataactgagtgttagtatgagtatatttgtatcatgcctaaatttgatatggtcattctctacaattacyttccttccacatttcctttctgttgataaagttggaaatctgacatctttacctagccattttatttatcctttatcattgagttctatgtgttctacatttgaaatgtttcagatatctaaatttctttcccatttatagtccagtatcacactacaatttacttgaatattacagtagtcttccatccatttccctgccttatgcatttttttccagttcatcctacacacagccaccaaaatcatgtctaaatcatttttctagttatgtcctattaagaaactactagtggtcttt

SEQ ID NO: 191397 - DNA, 601 bp, Human
actttccttccacatttcctttctgttgataaagttggaaatctgacatctttacctagccattttatttatcctttatcattgagttctatgtgttctacatttgaaatgtttcagatatctaaatttctttcccatttatagtccagtatcacactacaatttacttgaatattacagtagtcttccatccatttccctgccttatgcatttttttccagttcatcctacacacagccaccaaaatcatgtctaaatcatttttctagttatgtcctattaagaaactactagtggtcyttctgctgcttacagggtaaagtagaaatttccttgcctaccttgatgactattctgcttttacacacttaatctcccagtacttcctagcttgtctctactagagccaaattttgtgtcattctcagccacaatatttatggcttttcagtcagtttacccaaaacttgttcatctttcaaactttatcttcctcttccagtgttcccatccacattgataatctcactcctaatttgggtgctttcactttgttgccaaggctggagtgcagtggcatgatcttggttcactgcagcc

SEQ ID NO: 191398 - DNA, 601 bp, Human
agccaaattttgtgtcattctcagccacaatatttatggcttttcagtcagtttacccaaaacttgttcatctttcaaactttatcttcctcttccagtgttcccatccacattgataatctcactcctaatttgggtgctttcactttgttgccaaggctggagtgcagtggcatgatcttggttcactgcagcctcaacctaccagggctcaggtggtcttcctacctcagcctcctgagtagctggaactacacatgtgtagcacctttttctatcttttttttttttttttttttakgtagagaaggagtttcaccatgttgcccaggctggtctcaagcctggtttcctgggctcaagcagtctgcctgcctcagccacccaaagtactgggattacaggcatgagccacccaacccatcctactctgtgtatttcaaaaatattttttctgcccctctttttgggaaataataattactgcttctaacagttatgtaacagagtgtacatatcatgccttacaaatctttgctgttaactgtagcatccaaagatgatagggtgagtactctgtaagtctggaagaacaggtcac

SEQ ID NO: 191399 - DNA, 601 bp, Human
ttagccaggtgtggtggcgggcacctatagtcccagctactcgggaggctgaggcaggagaatggcgtgaacccgggaggcggagcttgcagtgagccgaggttgcgccactgcactccagcctgggcgacagagtgagacattgttgagacaaggatgagctaacactcatgcagttgatatttgcttgtcttttgtagcaacttgtctagttagaattagctccagcaagcatatatccagggcaacttgaatctgctcgtggggaaaaaataaaaaggtgaatagaattagctccacrgtacaaacttccaggctgggcacagtggttcacgcctgtaatcctgacactttgggagaccaaggcagggagatcacatgaggccaggagttcaagaccagcctggccaacatagcgaaaccccatctctactaaaaatacaaaaattagccaggcgtggtggcatgcacctgtagtcccagcaacttgggtgactgagacatgaaaatagcttcagcccgggaggtggaggttgcagtgagccgagatcgcaccactgcactccaacctgggtgacagagcaagactctgtcttaaaaa

SEQ ID NO: 191400 - DNA, 601 bp, Human
ggcgacagagtgagacattgttgagacaaggatgagctaacactcatgcagttgatatttgcttgtcttttgtagcaacttgtctagttagaattagctccagcaagcatatatccagggcaacttgaatctgctcgtggggaaaaaataaaaaggtgaatagaattagctccacggtacaaacttccaggctgggcacagtggttcacgcctgtaatcctgacactttgggagaccaaggcagggagatcacatgaggccaggagttcaagaccagcctggccaacatagcgaaaccccrtctctactaaaaatacaaaaattagccaggcgtggtggcatgcacctgtagtcccagcaacttgggtgactgagacatgaaaatagcttcagcccgggaggtggaggttgcagtgagccgagatcgcaccactgcactccaacctgggtgacagagcaagactctgtcttaaaaacaaaccaaaaagtacaaacttccttacctgccacaaaactgatgtattttttacatgttgtgtaaaaattaagagatgctacaaatgcagaaactggggcacagagaacttaagtactttatcta

SEQ ID NO: 191401 - DNA, 601 bp, Human
ctttattaagaatcattttttccactaaagtaaatttaagaaaatgggaactgttgcaaatgatttagaagaaaatccaaattactaataatgttgcttcgtagatagccagccacattaccatttgagaatatatacttcaagtatctgtatgtgtacacatgtactcttaatatatggacatgtatattaactgcattataaaatgctgctttttcaattaacatatgaggaacaggatgtatttttattttcatttggagtggaaataaatgttcctgaaagaaaatctggaaatcayataagtgcacaaagaaaattagaatatattttcattatagattttttttgtaagacattctggagtaaaaaatgtaagactacacttcatattcaaatatgccactactattcttaaatcccactttgtactcataagtagttaatcattaaggtctcatttcagattcttgtttgtttatatatgtatatgtattcatagcagatatgatggtagcattttgaggggcagtttgaacatttgcacaattatatgcacaatcatatttacataatttaaaaatagctcttccaaataagt

SEQ ID NO: 191402 - DNA, 601 bp, Human
actgcattataaaatgctgctttttcaattaacatatgaggaacaggatgtatttttattttcatttggagtggaaataaatgttcctgaaagaaaatctggaaatcatataagtgcacaaagaaaattagaatatattttcattatagattttttttgtaagacattctggagtaaaaaatgtaagactacacttcatattcaaatatgccactactattcttaaatcccactttgtactcataagtagttaatcattaaggtctcatttcagattcttgtttgtttatatatgtatatrtattcatagcagatatgatggtagcattttgaggggcagtttgaacatttgcacaattatatgcacaatcatatttacataatttaaaaatagctcttccaaataagtagtatgggccaaatgaggaaacctagaaattagctttgtggaagtgctcataggctggacctaattggggagcagatggaagcccagccaggcaggtaaaacatagaaacataggtgcttcaggggactgaacacagtgacaaaaagaagtggttatctgggcaggaagaaagcatctagttaacaagtgct

SEQ ID NO: 191403 - DNA, 601 bp, Human
taatcattaaggtctcatttcagattcttgtttgtttatatatgtatatgtattcatagcagatatgatggtagcattttgaggggcagtttgaacatttgcacaattatatgcacaatcatatttacataatttaaaaatagctcttccaaataagtagtatgggccaaatgaggaaacctagaaattagctttgtggaagtgctcataggctggacctaattggggagcagatggaagcccagccaggcaggtaaaacatagaaacataggtgcttcaggggactgaacacagtgacawaaagaagtggttatctgggcaggaagaaagcatctagttaacaagtgctgtgatgtgctggagcaggcaccagtgaggtgtaagtagaaaggtagctagatagtcaccattagcaggcaccagtggtggtagtgagacgtagcttctagattgtattgtggcaattagacattatcaaagcaggaatggagaaaccaatcagaaattctgaaactagaacatgagatttgaaaaagtgacttttagatgacaaaaataagggcaacccaatttcttgagtaggattgtaaggttaaagag

SEQ ID NO: 191404 - DNA, 601 bp, Human
aacatttcttaaactgtttattttctcctttctttattacgtcagctcttgcatttgagacttaacataaagtgaagctgagtcttgattatatgaacccagaaagagtctttatatggataatctcaaacctataatctcttttatacttaaggtacatcattaaaagtgaaaattatattgaatatcactgagttttgacaacttttatataattgactgtaaagtgttttgatttagtggtagagttgactactttttcacgggcatactagttgtaatttctcttgtgttgctaatytatgccttcctttgcttattttattcaggtcttgatatttttgcttttcagtctctatctatatggggagtgtaatgccatacctgtttttcccaaaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaa

SEQ ID NO: 191405 - DNA, 601 bp, Human
cataaagtgaagctgagtcttgattatatgaacccagaaagagtctttatatggataatctcaaacctataatctcttttatacttaaggtacatcattaaaagtgaaaattatattgaatatcactgagttttgacaacttttatataattgactgtaaagtgttttgatttagtggtagagttgactactttttcacgggcatactagttgtaatttctcttgtgttgctaatttatgccttcctttgcttattttattcaggtcttgatatttttgcttttcagtctctatctatatkgggagtgtaatgccatacctgtttttcccaaaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggtgagttaatctaaaattaagtaaaaatttaaaaatcattatgtgcacatgaacactactgg

SEQ ID NO: 191406 - DNA, 601 bp, Human
tgagtcttgattatatgaacccagaaagagtctttatatggataatctcaaacctataatctcttttatacttaaggtacatcattaaaagtgaaaattatattgaatatcactgagttttgacaacttttatataattgactgtaaagtgttttgatttagtggtagagttgactactttttcacgggcatactagttgtaatttctcttgtgttgctaatttatgccttcctttgcttattttattcaggtcttgatatttttgcttttcagtctctatctatatggggagtgtaatgmcatacctgtttttcccaaaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggtgagttaatctaaaattaagtaaaaatttaaaaatcattatgtgcacatgaacactactggcctatgagcacat

SEQ ID NO: 191407 - DNA, 601 bp, Human
ccccaagacagagtcttgctctgtcgcccatgctggagtgcagtggtgtgatctcagctaactgcaacctctgcctcctgggttcaagcaattctcctgcctcagcctcccgagtagctgggattacaagcgtccaccaccacacctggctaatttttgtatttttagtagaggcagggtttcaccatgttggccaggcttgtcttgaactcctgacctcaagtgatctgcccgccttggcctccaaagtgctgggattataggcgtgagccaccaagcccagtcaaacaaatttttaagwgtatgtaagaacatacaaatttacttaagtgctttatagaatttatagttatcctataatcattttctagcgccagaagaaccactactactgaaggaaagatctttggaatttatttaccttagaaattacttctcgtatgttaagaggttgatgactgctttaagggacctaaaatatagaattaagcattactttctaatgtgacattagaacttttaagcaccgaggtttcttgattcttctaggtgtatgtatggatctatgacccagttcactttaaaacatttgtcatgggat

SEQ ID NO: 191408 - DNA, 601 bp, Human
ttgtcattttaaaaatactttaaataaagtcagaagataaataatacactaaggaaaatatttgaaacatattaaagatcttttaagagattaacaaactgatagaaaaatggtcaaggtagttaacagataaagaaatacaatgaccaatcatcatgagtgatacttaatcacactcatatacaaattaaagctgtagtgattaagagtcttgcaaaccttaacattaaaggtcttagaaaaaaatcagctctctctaacagttgataggtatgtctattgttttaatttttgtaaaggrcagtttgtcagtatctttgaaattttatgtgtctgcagtgacccagcaattctaggctgttcccatacagttgcacaaagtgtgtgcattgacacattatctgtttttttccaaatcccttagactatacttgagtataatctagcaaatatctttcaaattcaaaatgcttataccatttgatctaataaattccactttaaggaatttaccctatgccataatcacagttgcacaaacgtacatgtgcaaggatattatacctagaatagataaaaaaagaaaagaaagttacagacg

SEQ ID NO: 191409 - DNA, 601 bp, Human
aattccaaatatactttcaaataattagatatttcttttatattattctttgaagtctttatatatattatgtatatcgcatataatatatatcatgtatattatatatgaatatatatgatatatagatatatgatatatcataatattatatatcatatatatcatataatatatatcatatgatatgtcatatatattatatgatatctcatatttatatgaaatatatttttatatatattcattttttggagacagggtcttgctctgttgcccagggtaaagtaccatggcagartcatagctcactgtaccctcaaactcctgggctcaagcagccctcccaccttagcctcctgaatagctgggactataggagcatgttgccatgcctagctaatttttttttttaaagtcagggtcttgaaatattatgtattggtcacaattatatctggtgtttctttgaatatgcattattaataatgccatttaaaataaaacctttggcagttttctaaaatctgtcgcttttagcataggaatgttattatagtacatgtcacagcttccccataattcttcccttttcactctc

SEQ ID NO: 191410 - DNA, 601 bp, Human
agggacagagagagagacagaaagccaccttacatgaagcgggagtgggtggagccccacccctggaacttcctcttttggggttcttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtgagttgcctcatggctacccagmcggggcccagcccctgccgctaacccagccctcatcttcccctgtggcccacccccgtatccgcatctcctctccccaggtcctcggcagcctgatcttctgcttcggcatctggatcctcatcgacaagaccagcttcgtgtcctttgtgggtgaggggggctggggcaggtgggagggcctcccccaacccaagcaacttcctggggtctcccttgtctcagggagacctacggtgccctactctgcaggcaggctacaggctcccatccactgctcaccggaggcttcttggagcct

SEQ ID NO: 191411 - DNA, 601 bp, Human
cagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtgagttgcctcatggctacccagacggggcccagcccctgccgctaacccagccctcatcttcccctgtggcccacccccgtatccgcatctcctctccccaggtcctcggcagcctgatcttctgcttcggcatctggatcctcatygacaagaccagcttcgtgtcctttgtgggtgaggggggctggggcaggtgggagggcctcccccaacccaagcaacttcctggggtctcccttgtctcagggagacctacggtgccctactctgcaggcaggctacaggctcccatccactgctcaccggaggcttcttggagcctgagtcttcttccggcaaatggggttgtgcatacaaacaacaatgatcatgagagccatttctcaagcacttcctatctgtcgggacttgtgactggtcagatgcccccacaaaccttcccctcg

SEQ ID NO: 191412 - DNA, 601 bp, Human
gccaacatggtgaaaccctgtctctactcaaaaatacaaaacgttagccaggcatggtggcacatgcctgtagtcgcagctactagggaggctgaggcaggagaatcacttgaacctgggaggcagaggttgcagtgagccgagatcacatcactgcactccagcctgggggacagagcgaggctccaactcaaaaaaaaaccctaagaaatagatatcatctcctatgcctcagggaggtttaaggagccaagccaatgtcacagaacaagtgatagggctgaaactactggggacgagsaggagctgaaggaggaaggagagggtaagaggaagagagacagagatccagggacgggaaacaggcccagaaagaagagaaagtttcagaaggaaacagggactcagggtggggcagggacagagtcccagagagaggggcaccaagatactgctccccacttgggtggctgcctaggtgggaaatggggctgcctggagctgtgccacacagctcatcatcactcccctcacctctcccaggcttggccttcgtgcctctgcagatctggtccaaagtcctggccatctcaggaatctt

SEQ ID NO: 191413 - DNA, 601 bp, Human
gtcacctctcccacgggacctggggctttcgtccacagcttcctgtccccatctgtcggcctaccaccacccacaagattatttttcacccaaacctcaaataaatcccctgcgtttttggtaaaatagctttatcctctgtcagaacacaaacaaacaaactttgagaggggaggaaggaaaccgtctagctcagggctcacttaggagagggatgagattagaaagttcaacacactgcttgtgcagcggagataaagtcaagaccctagcacccacttataaatatctcgttatattaaaaaaaaaaaaaatgtccagggcccacctggctctgctcctgcacagaaagggttcatcttcactttgtgatctcacaggtcatggagtgagggtggtagagaggggcagaaatttcagggggaggggtggctgggaaaaagtaaaggggacaagccaatgtgtaactagcgctctccaagacatgcagaggagtgggggtggcctgtcaggggctgaaaagaaaagccagtgctgtacctggggggttgtctcactcctgtccccacaatccctgatactccggagtgatctgtccttt

SEQ ID NO: 191414 - DNA, 601 bp, Human
ggtggctcacgactgtaatcccagcactttgggaggctgaggcgggtggattgcctgagctcaggagttcgagaccagcctcggcaacgtgatgaaaaccatctctactaaaatacaaaaacaaaattagccaggcatggtggtgggcacctgtagtcccagctacttgggagactgaggcaggagaattgcttgaacccaggaggcagaggttgcagtgagccgagatcacaccactgccctccagcctgggcgacagagcaagactccatctccaaaaaaataaaaataaaataaaagsctgggtacagtggctcacgcctgtaatcccagcactttgggagcccgaggcgggcagatcacgaggtcaggagtttgagaccaccctggccaatgtggtgaaaccccgtctctactaaaaatacaaaaattagctgggcatggtggcgcgcgcctgtagtcccagctactcaggaggctgaggcagaattccttgaacccgggaggtagaagttgcagtaagccgagatcgtgccactgtactccagccagggtgacagagcaagactctgtccccaaaaaataaataaataataaagta

SEQ ID NO: 191415 - DNA, 601 bp, Human
tttttttttgagatggagtcttgctctgtcccccaggctggagtgcaggggtgctatctcggctcactgcaagctctgcctcctgggttcacgccattctcttgcctcagcctccccagcagctgggactacaggcgcctgccacctcacgcggctaatttttttttttgtatttttagtagagacggtgtttcaccgtgtcagccaggatggtctcgatctcctgacctcgtgatctgcccgcctcggcctcccaaagtgctaggattacagatgtgagccaccgcgcccagcctattgytttttttttctaagtcggagtcttgctctgtcgcccaggctggagtgcagtggcgcaatcttggctcactgcaacctccatctccagggttcaagcgaatcttctgcctcagccttccgagtacctgggattacagatgcgcataccatgcctggctagtttttgtgtttttagtagagatgggttttcaccatgttggccaggctggtcttgaactcctgacctcaagtgatccacccaccttggcctcccaaagtgctgggattataggcgtgagccaccgcgctcagcctattcact

SEQ ID NO: 191416 - DNA, 601 bp, Human
tacagatgtgagccaccgcgcccagcctattgttttttttttctaagtcggagtcttgctctgtcgcccaggctggagtgcagtggcgcaatcttggctcactgcaacctccatctccagggttcaagcgaatcttctgcctcagccttccgagtacctgggattacagatgcgcataccatgcctggctagtttttgtgtttttagtagagatgggttttcaccatgttggccaggctggtcttgaactcctgacctcaagtgatccacccaccttggcctcccaaagtgctgggattayaggcgtgagccaccgcgctcagcctattcactcatttaatttgtgacagtctgatgaggtaggtacaatgattatcctagttttacagatgagcaaactgaggcacagagaggccaagcagcccatccaaggtcacacagccagtggcagccaggcctctctttccttccttaccccagcccttctccttggtcacccagcctcctctttctccccagactcctcaaccctgccacccccatggagtccccggcccctggaggccacagccccgacagccccgcagccccctctgctcct

SEQ ID NO: 191417 - DNA, 601 bp, Human
taatttgtgacagtctgatgaggtaggtacaatgattatcctagttttacagatgagcaaactgaggcacagagaggccaagcagcccatccaaggtcacacagccagtggcagccaggcctctctttccttccttaccccagcccttctccttggtcacccagcctcctctttctccccagactcctcaaccctgccacccccatggagtccccggcccctggaggccacagccccgacagccccgcagccccctctgctcctcctactgctgctgcccgtgggcctcctgctgctggcygctgcctggtgcctgcactggcagaggacgcggcggaggacaccccgccctggggagcaggtgagcaggctgggaagagggggtgagggggccgagagggtggcccacttgtggctgacactttggggcccacaggtgccccccgtccccagtccccaggacctgctgcttgtggagcactgacctggccaaggcctcatcctggtgagtccttcctgggctatggggcctggactttgtgtctgcaggttgggagggtcactaggaggccatggaagggtggtgagcagtggaggggca

SEQ ID NO: 191418 - DNA, 601 bp, Human
tgcaggcaggtaggcaggtgggccaggagggaagaaggaggggaggccccagcgggtcccctaacatttcaaatctaacattttgtagtaattgctcgcacatatagtgccttggtaatgcaggcctcatgtggggctggcttgcttgctttatttttttttgagatggactctcactctgtcacccaggctggagtgcagtggcgggatcttggctcactgcaacctccacctcccaggttcaagcaattctcctgcctcagcctcccaagtagctgggattacaggcgcccgccaccaygcctggctaattttttgtatttttagtagagatggggtttcgccatgttggccaggctggtctcaaactcctgatctcagctgatccgcccgcctcagcctcccaaagtgctgggatgacaggtgtgagccactgttcctggcccatgctgggctttccacaaatgaactcacttccttgagaagttcgtgccattatgatcccaaggcatagagaggtaaataatttgccaaaagtcacacagctcaagggtgacaaccaagatttgacttcaggttgtcttttttttttttttgagat

SEQ ID NO: 191419 - DNA, 601 bp, Human
gtctcaaaaaaaaaaaaaaagaaaagaaaaaagaactccattcctttttatgactgaataatattcctttgcacaaatagaccctgttttattttgccattcatcagctgatggacatgtgggttgtttctatcttttggctgttgtgaatagtgctgccgtgaacactcgtgtccatgttttgtgtggacctctgggggggtcctgaattgtcccgggtggtgtttactcacctccctcccccatgtgagaaggggtggtagctggctcctctctgtggagaactgtcaacatgggaagmctcggtatattcttgttgaatgagctcagcactttagagtatcacttagcaaaccacagacattgagtcccgaggtgaacaagagagaacaggccgtgcccttcatgggactcatgtccactggagcagagaatattgatccatccatctccctcgggaatgtgagatcacacagggagatcgggctcccagggaggcctttcatctgtctgaatgtctagaggtcctagaactagcctggcagggctgttggacagaaagggcctcccctagggggcagcacttgatctaattcagtga

SEQ ID NO: 191420 - DNA, 601 bp, Human
aaaaatacaaaaattagccaggcatggtggtgcatgcctatagtcccagctactagggaggatggcttgaacctgggaggcagaggttgcagtgagccaatatcgtgccactgcactccagcttgggtgacagagtgactccatctcaaaaacaaacaaaaagtgccaagtatggccgggcatgatgggtcacgcctgtaatcctagcactttgagaggtggagtcaggaggattgcttgaatcaggagttcaagaccagcctgagtcacatagtgtgatcctgtctctaaaaaaaaaatmaaaaaattagccggcagtggtggtccatgcctgagtcccagctacttgggagaactgcttgaaccaaggaggttcaggatgtggtgagatgtgactgcaccatgcactccagcctgggtgacagagtgagacgctctctcaaaaaataaaaataaaaacatttttttttttttttggagacggagtctcgctctgtcgcccaggctggagtgcagtggcgcaatctcggctcactgcaagctctgcctcccgggttcacgccattctcctgcctcagcctcccgagtagctgggactaca

SEQ ID NO: 191421 - DNA, 601 bp, Human
ccaggttcaagcaattctcctgcctcagcctcctgagaagctgggattacagtcatctgccaccatgcccagctaatttttgtatttttagtagagacagggtttcaccatgttggccaggctggtctcgaactcctgacctccagtgatccgcccgcctcggcctcccaaagtgctgggattataggcaggagccactgcgcccggccccagccagggctctttttttgcaggatcatatggaataaactgagaacatgtgggtgctgtgtaaaccataaacatgaagtaattgtgatcmttagcccttgtggttagatcttagtacaattatgtgcttaatcaggcctcagtgacttttgtttaactaggatgcatcctcagagcagctccagttcattgagcatttaccacattcagccatcttcctagggaggtgccaatttgggatatcctttccatgtgccccttcattcccccaacccctgctccctactcccacccacccctttgacaaagaaggaaaccagggctcagaggggtcaggccacatgtgcagcaagctggctagtaactgagtctttgttctttcccttcatgt

SEQ ID NO: 191422 - DNA, 601 bp, Human
tatgttacggtcttctggacctttggctacatacccataaacttcaaccacatgtgggttttcttggtactaaagaattgattaggctaggtgtggtggctcatgcctgtaatctcagcactttgggaggccaaggtgggtggatcacctgaagtcagagtcaagaccagcctgaccaacatggtgaaaccctgtctctactaaaaatacaaaaattagccgggcatggtggtgcatgcctgtaattccagctactcaagagcctaaggcaggagaattgcttgaacctgggaggtggagkttgcaatgagccgagattgtgccactgccctccagcctgggtgacatctcggaaaaaaaaaaaaagaattgggagtgggtagcaattgctttgccaccttaaaaaaaagttagactgggtgcaatggctcacacttgtaatcccaatactttgggaggctgagatgggaagattgcttgagcctaagagcttgaggccagcctgggtaacatagtgacacctcctttctacaaaaaattttaaaaattagctggacatggtggtgcacatttgtggtcccagctactcaagaggctgagg

SEQ ID NO: 191423 - DNA, 601 bp, Human
ggacacgatcccttccaaggcgacatgtgttacaatgcaggtagcatgtgacagaggaggctcctgaccttggtaggaaaacggggcatgtggtggcatttgttgctagaggcttccagagaagcggatacctgagctaagcctagtaggatggccaggaggctcctgggcggacactggggacagcatgtccaggcccagaatgtggcacacacagtaacttccttccctccatcctttctgctttcctactcttcttcatttttttttttttttgagacagtttcactctgtcgctcaggctggagtgcagtggtgtgatcttcgctcactgcaacctctgcctcctgggttcaagtgatcctcctgcctcaacctcccaagtagctgggattacagatgtgtgccaccacacccaactgatttttgtatttttagtagaaatgggatttcaccatgttgaccaggctggtcccgaactcctgacctcaggtgatccacccccctgcctcggcctcccaaagtgctgggattacaggcgggagcctgtagactttattttttaggcatgttgtgactgtgcccggcctcgcctttcctc

SEQ ID NO: 191424 - DNA, 601 bp, Human
gtggcacacacagtaacttccttccctccatcctttctgctttcctactcttcttcatttttttttttttttgagacagtttcactctgtcgctcaggctggagtgcagtggtgtgatcttcgctcactgcaacctctgcctcctgggttcaagtgatcctcctgcctcaacctcccaagtagctgggattacagatgtgtgccaccacacccaactgatttttgtatttttagtagaaatgggatttcaccatgttgaccaggctggtcccgaactcctgacctcaggtgatccaccccsctgcctcggcctcccaaagtgctgggattacaggcgggagcctgtagactttattttttaggcatgttgtgactgtgcccggcctcgcctttcctcttcttgtgtctcccgcaggcctcctgcaggccaaaccctgtgctgggcagcactggggtgaggctagcctcgccctggcggggacgcttcttagtctagtgaaagaggcagagaggacccctggtgtccccagatggcatgggccgtgctcgtccactcagccctcagcagatacttgctgagttctgtgatgagggccattgt

SEQ ID NO: 191425 - DNA, 601 bp, Human
tgagccactgcaccctgcctgtttactatttttattaagagctttattgagttttggccaggcgcagtggctcacacctgtaatcccagcactttgggaggctgaggtgggcgatcacttgagatcaggagttcgaaacgagcctgactaacatggtgaaaccctgtctatactaaaaatacaaaatggctgggcgcggtggttcatgcctataatcccagcactttgggaggccgaggcgggtggatcacctgaagtcaggagttcaagaccagcctgaccaacatggtgaaaccctgtmtctactaaaaatacaaaaaattagctgggcgtggtggtgggtgcttgtaatcccagctacttgggaggctaaggcaggagaatcgcttgaatctgggaggcagaagttgcagtaagccgagatcacaccattgcactccagcctgggcaacaagagcgaaactccatctcaaaaataaataaataataaaaacacaaaacaattagctgggtatggtggcacacatctgtaatcccagctacttgggaggctgaggcaggagaactacttgaacccgggagatggaggttggagtgagct

SEQ ID NO: 191426 - DNA, 601 bp, Human
gcactggggcaacatcagggccctctctgagccccatccctggcttgtccccactctcagggctccaaggtgggcaaactgaccctcaagaccacagagatggagaccatctacgacctgggcaccaagatgattgagtccctgaccaaggacaaggtccaggccgggtgagcagtcaggggccatgccaggcagccagggggatgggcgagcttgggcccattcctttccttaccctaccccccatccccctgtagggacgtgatcaccatcgacaaggcgacgggcaagatctccaagytgggccgctccttcacacgcgcccgcgactacgacgctatgggctcccaggtgcggccgggactcccgggatcccctcgcccccagcactggggtgttttcatctcctccatcacccccttgacccatggggtctggatcttcctgttaccctgactgtttgtcctggtactcctgggtcttccctgtaaccctaggacagcagggcccctcagcctggcactatagcttcgcatggccacatgtggcctgtggcttctgaggtcctccgggagcccccgtgaccctcagcgctctggaa

SEQ ID NO: 191427 - DNA, 601 bp, Human
aactgaccctcaagaccacagagatggagaccatctacgacctgggcaccaagatgattgagtccctgaccaaggacaaggtccaggccgggtgagcagtcaggggccatgccaggcagccagggggatgggcgagcttgggcccattcctttccttaccctaccccccatccccctgtagggacgtgatcaccatcgacaaggcgacgggcaagatctccaagctgggccgctccttcacacgcgcccgcgactacgacgctatgggctcccaggtgcggccgggactcccgggatcccstcgcccccagcactggggtgttttcatctcctccatcacccccttgacccatggggtctggatcttcctgttaccctgactgtttgtcctggtactcctgggtcttccctgtaaccctaggacagcagggcccctcagcctggcactatagcttcgcatggccacatgtggcctgtggcttctgaggtcctccgggagcccccgtgaccctcagcgctctggaatgtccctagtcctgactacctcctgggcctggggtttccagatgaccccatttagcctcccagctccatttcctgg

SEQ ID NO: 191428 - DNA, 601 bp, Human
ctgtctccgccgttcttcccccacccccgccccatagaccaagttcgtgcagtgcccagatggggagctccagaaacgcaaggaggtggtgcacaccgtgtccctgcacgagatcgacgtcatcaactctcgcacccagggcttcctggcgctcttctcaggtgaggcccctcctgccctgccctgccctgccctgccccaggcctagcagcctccctcgggctccctctgttcctgagctccgagtgtggcccacctgctccacgctgtttcctgtaactccggcccgtggctgcctctsttctccacctgcaagtccgctccgtccccacccctgctggtgctgtgatgggtgtggccctgccctctcccctcctgtgttctctgcctctgttcctcctctttggggatgtttcaggctcctcatccctccttgctttgctccccttcctccatccctggcatcatccttctctgtcttagccacactctggccctggaacccgcctcctctctggcttccctgatgcaacctgtgcctcccataggtgacacaggggagatcaagtcagaagtccgtgagcagatcaatgccaaggtg

SEQ ID NO: 191429 - DNA, 601 bp, Human
gccgttcttcccccacccccgccccatagaccaagttcgtgcagtgcccagatggggagctccagaaacgcaaggaggtggtgcacaccgtgtccctgcacgagatcgacgtcatcaactctcgcacccagggcttcctggcgctcttctcaggtgaggcccctcctgccctgccctgccctgccctgccccaggcctagcagcctccctcgggctccctctgttcctgagctccgagtgtggcccacctgctccacgctgtttcctgtaactccggcccgtggctgcctctgttctccamctgcaagtccgctccgtccccacccctgctggtgctgtgatgggtgtggccctgccctctcccctcctgtgttctctgcctctgttcctcctctttggggatgtttcaggctcctcatccctccttgctttgctccccttcctccatccctggcatcatccttctctgtcttagccacactctggccctggaacccgcctcctctctggcttccctgatgcaacctgtgcctcccataggtgacacaggggagatcaagtcagaagtccgtgagcagatcaatgccaaggtggctgagtg

SEQ ID NO: 191430 - DNA, 601 bp, Human
ccccacccccgccccatagaccaagttcgtgcagtgcccagatggggagctccagaaacgcaaggaggtggtgcacaccgtgtccctgcacgagatcgacgtcatcaactctcgcacccagggcttcctggcgctcttctcaggtgaggcccctcctgccctgccctgccctgccctgccccaggcctagcagcctccctcgggctccctctgttcctgagctccgagtgtggcccacctgctccacgctgtttcctgtaactccggcccgtggctgcctctgttctccacctgcaagtcygctccgtccccacccctgctggtgctgtgatgggtgtggccctgccctctcccctcctgtgttctctgcctctgttcctcctctttggggatgtttcaggctcctcatccctccttgctttgctccccttcctccatccctggcatcatccttctctgtcttagccacactctggccctggaacccgcctcctctctggcttccctgatgcaacctgtgcctcccataggtgacacaggggagatcaagtcagaagtccgtgagcagatcaatgccaaggtggctgagtggcgcgaggag

SEQ ID NO: 191431 - DNA, 601 bp, Human
aaccgggccctggagagtgacatggcgcctgtcctgatcatggccaccaaccgtggcatcacgcggtgagccggctacaggggcctctggggaaaacaggatgctctgggcagtgggtgtggtcagagggtcaatgggagcctgtgttgacaccgggtcagggagggacgcgtgactgcagtgtgcgctctttgcttacaaaaggcgggtgggaggcagctctgcttcccgaggaagcccagagactgtgttcttgctgcctttctgtcttgctgctcctttagcccccaaggctgcagtyttcaaactgcgtgccgaggcaccccagggtgctgcaggaaactcacaggagtgctgtgggatgttttctagtcttgagggaagcacagtgacatctgttagacataacataaactacgattgttcagtcacttcgacccagcaactccattaacagaactcttagcgttgtgtttggcctaaggatgccagggacagattcccatgacacagagggtaccgtgctctgctgaagcctgggaacctcatctcccaggtgttgccagcaccctgtgcacggggaactcttaatgttgtgttt

SEQ ID NO: 191432 - DNA, 601 bp, Human
ggagagtgacatggcgcctgtcctgatcatggccaccaaccgtggcatcacgcggtgagccggctacaggggcctctggggaaaacaggatgctctgggcagtgggtgtggtcagagggtcaatgggagcctgtgttgacaccgggtcagggagggacgcgtgactgcagtgtgcgctctttgcttacaaaaggcgggtgggaggcagctctgcttcccgaggaagcccagagactgtgttcttgctgcctttctgtcttgctgctcctttagcccccaaggctgcagtcttcaaactgcrtgccgaggcaccccagggtgctgcaggaaactcacaggagtgctgtgggatgttttctagtcttgagggaagcacagtgacatctgttagacataacataaactacgattgttcagtcacttcgacccagcaactccattaacagaactcttagcgttgtgtttggcctaaggatgccagggacagattcccatgacacagagggtaccgtgctctgctgaagcctgggaacctcatctcccaggtgttgccagcaccctgtgcacggggaactcttaatgttgtgtttggcctgaggat

SEQ ID NO: 191433 - DNA, 601 bp, Human
gggtcagggagggacgcgtgactgcagtgtgcgctctttgcttacaaaaggcgggtgggaggcagctctgcttcccgaggaagcccagagactgtgttcttgctgcctttctgtcttgctgctcctttagcccccaaggctgcagtcttcaaactgcgtgccgaggcaccccagggtgctgcaggaaactcacaggagtgctgtgggatgttttctagtcttgagggaagcacagtgacatctgttagacataacataaactacgattgttcagtcacttcgacccagcaactccattaayagaactcttagcgttgtgtttggcctaaggatgccagggacagattcccatgacacagagggtaccgtgctctgctgaagcctgggaacctcatctcccaggtgttgccagcaccctgtgcacggggaactcttaatgttgtgtttggcctgaggatgccggggacagattcctgtgcgctgccctgggaacctcgtctcccaggtgttgccagcaccctgtgtagctgggattacgggcacctgccaccatgcccgctggctgtcttctccacctcgccacattttggcccgcaggaag

SEQ ID NO: 191434 - DNA, 601 bp, Human
gcactgcttgggctcagtgctgtacctggtggcaaagaaggctgggtactgtcagctccagccctgcagccttgggcccagctgaaactgggcggttgggatgggcatcacaaaagggaagaagcgggcaccctacagaggatgctgggccgctgggcctggctctgtgtttggctcttttaactccttggatccgcagaagaagctcagaaggtagatatcacctcagccccattttatagggcaggacagtgaggcccagtgacttgcccaggtcacaagtctagaaggtagcagggcygtaatttggtctctggatggctggacactggaagagacccccagggctgatggtgttttcacagaaactgcaggtcagggcctggggactgcccaggggcacctcctgtgggaggcagcagctacgggcagccctgattgttcgtagactctgtatctgagaatctcgcttgctaagatttatttgtaatccccaaataaatatctgccctgctttcggcaacaaattcaagtcacctgacacccactttcccagctgagtgtgaacgaggcaacactgcctgctcccttagcgctcatg

SEQ ID NO: 191435 - DNA, 601 bp, Human
tgcccaggtcacaagtctagaaggtagcagggccgtaatttggtctctggatggctggacactggaagagacccccagggctgatggtgttttcacagaaactgcaggtcagggcctggggactgcccaggggcacctcctgtgggaggcagcagctacgggcagccctgattgttcgtagactctgtatctgagaatctcgcttgctaagatttatttgtaatccccaaataaatatctgccctgctttcggcaacaaattcaagtcacctgacacccactttcccagctgagtgtgaaygaggcaacactgcctgctcccttagcgctcatgctgtaaataagtgtccttgttgtattctatttagtgctacgtttgtcacttttgttctttgagacagggtcttgctctgtcgcccaggctggagtgcagaggcacgatcatggcacactgcagcctcagtgcccaccacacacacacacacacacacacacacacacacacacacaccacccctgggactcaatcagtcctctggcctcagcctcctcatcagctgggaccacgggcatgcaccactatgcctagctaatttctgtt

SEQ ID NO: 191436 - DNA, 601 bp, Human
ggatggctggacactggaagagacccccagggctgatggtgttttcacagaaactgcaggtcagggcctggggactgcccaggggcacctcctgtgggaggcagcagctacgggcagccctgattgttcgtagactctgtatctgagaatctcgcttgctaagatttatttgtaatccccaaataaatatctgccctgctttcggcaacaaattcaagtcacctgacacccactttcccagctgagtgtgaacgaggcaacactgcctgctcccttagcgctcatgctgtaaataagtgtycttgttgtattctatttagtgctacgtttgtcacttttgttctttgagacagggtcttgctctgtcgcccaggctggagtgcagaggcacgatcatggcacactgcagcctcagtgcccaccacacacacacacacacacacacacacacacacacacacaccacccctgggactcaatcagtcctctggcctcagcctcctcatcagctgggaccacgggcatgcaccactatgcctagctaatttctgtttttgttttgagacggagtctagctctgtcaccaggctggagtgcagtg

SEQ ID NO: 191437 - DNA, 601 bp, Human
tgattgttcgtagactctgtatctgagaatctcgcttgctaagatttatttgtaatccccaaataaatatctgccctgctttcggcaacaaattcaagtcacctgacacccactttcccagctgagtgtgaacgaggcaacactgcctgctcccttagcgctcatgctgtaaataagtgtccttgttgtattctatttagtgctacgtttgtcacttttgttctttgagacagggtcttgctctgtcgcccaggctggagtgcagaggcacgatcatggcacactgcagcctcagtgccccccacacacacacacacacacacacacacacacacacacacaccacccctgggactcaatcagtcctctggcctcagcctcctcatcagctgggaccacgggcatgcaccactatgcctagctaatttctgtttttgttttgagacggagtctagctctgtcaccaggctggagtgcagtggcacgatctcggctcactgcaacctctgccttctgggttcaagcagttttcctgcctcagcctcctgagtagctgggattatgggcacccgccaccatgcccagctaattttggtatttt

SEQ ID NO: 191438 - DNA, 601 bp, Human
attgttcgtagactctgtatctgagaatctcgcttgctaagatttatttgtaatccccaaataaatatctgccctgctttcggcaacaaattcaagtcacctgacacccactttcccagctgagtgtgaacgaggcaacactgcctgctcccttagcgctcatgctgtaaataagtgtccttgttgtattctatttagtgctacgtttgtcacttttgttctttgagacagggtcttgctctgtcgcccaggctggagtgcagaggcacgatcatggcacactgcagcctcagtgcccacaacacacacacacacacacacacacacacacacacacacaccacccctgggactcaatcagtcctctggcctcagcctcctcatcagctgggaccacgggcatgcaccactatgcctagctaatttctgtttttgttttgagacggagtctagctctgtcaccaggctggagtgcagtggcacgatctcggctcactgcaacctctgccttctgggttcaagcagttttcctgcctcagcctcctgagtagctgggattatgggcacccgccaccatgcccagctaattttggtattttta

SEQ ID NO: 191439 - DNA, 601 bp, Human
tgtaatcccagcactttgggaggccgaggtgggtggatcacgaggtcaagagaatgagaccgtcccggccaacatggtgaaaccctgtctgtattaaaaatagaaaaaactagctgggcgtgatggcgtgcgcctgtagacccagctacttgggaggctgaggcaggaggatcggttgaacccgggaggcggaggttgcagtgagccgagatcgcgccactgcactccagcctcgcaacagagcgagactccgtctcaaaaaacaaaccaaaaagaccagaaacacacaaatgaaaatacrcatagacccagattatatatatatggattgatgaaaatactgtaagccgaggctcgagagagcctaaccctgtattccagtaggagcagtggctcaggatcagctaattggagtgttcacgatgactttctagaacctcactactgtgaataaggggaactgactgtatcccctggcaccagccctgggctggccccgctgcagcagggaacaagacaggtgcagtcccctcctttgtgaagctttgtgtcgagcacgggagtgggaccttgatccagtaatcctggaggcagagatcta

SEQ ID NO: 191440 - DNA, 601 bp, Human
aaccctgtctgtattaaaaatagaaaaaactagctgggcgtgatggcgtgcgcctgtagacccagctacttgggaggctgaggcaggaggatcggttgaacccgggaggcggaggttgcagtgagccgagatcgcgccactgcactccagcctcgcaacagagcgagactccgtctcaaaaaacaaaccaaaaagaccagaaacacacaaatgaaaatacgcatagacccagattatatatatatggattgatgaaaatactgtaagccgaggctcgagagagcctaaccctgtattccastaggagcagtggctcaggatcagctaattggagtgttcacgatgactttctagaacctcactactgtgaataaggggaactgactgtatcccctggcaccagccctgggctggccccgctgcagcagggaacaagacaggtgcagtcccctcctttgtgaagctttgtgtcgagcacgggagtgggaccttgatccagtaatcctggaggcagagatctagcttaaagcagcccagctccgcggaaaggtgcccttgggggactgacgcagctgtggaaggctgcgtcatcaggggtgat

SEQ ID NO: 191441 - DNA, 601 bp, Human
cagtggggaagggccagagggttgctgtggccacttctgctgcagtcagaggctgggccccggctgagccacccctgtcccccactgcttgcaggtgcgaggaagaagatgtggagatgagtgaggacgcctacacggtgctgacccgcatcgggctggagacgtcactgcgctacgccatccagctcatcacagctgccagcttggtgtgccggaaacgcaaggtcagccggccgaattagccagcagggccagatggcggcagtgagtgacacagtacttcaggggcttccagggttcygatttcatcctagaatgtacgttttcagacgcagggaattttcatccctcaggttggcttctgtatcatccagcctggcctatagtaggtgtcagtaaatctctcttgacttaagtagatgctgttaggtccaccttacagataaagaaactgaggaatgaagaggctgggcccacaacaaggagatggccaggcaggatttgaacccaggcaatctggcccagaatgccctcccctcacatgccacactctgctgcctagagcatggaggtggcatacgctggggtctgtgccttgagc

SEQ ID NO: 191442 - DNA, 601 bp, Human
caggtgcgaggaagaagatgtggagatgagtgaggacgcctacacggtgctgacccgcatcgggctggagacgtcactgcgctacgccatccagctcatcacagctgccagcttggtgtgccggaaacgcaaggtcagccggccgaattagccagcagggccagatggcggcagtgagtgacacagtacttcaggggcttccagggttctgatttcatcctagaatgtacgttttcagacgcagggaattttcatccctcaggttggcttctgtatcatccagcctggcctatagtaggtrtcagtaaatctctcttgacttaagtagatgctgttaggtccaccttacagataaagaaactgaggaatgaagaggctgggcccacaacaaggagatggccaggcaggatttgaacccaggcaatctggcccagaatgccctcccctcacatgccacactctgctgcctagagcatggaggtggcatacgctggggtctgtgccttgagcctcacggagaggggcccaactgaggactcgccctccccctccagggtacagaagtgcaggtggatgacatcaagcgggtctactcactctt

SEQ ID NO: 191443 - DNA, 601 bp, Human
gcatacgctggggtctgtgccttgagcctcacggagaggggcccaactgaggactcgccctccccctccagggtacagaagtgcaggtggatgacatcaagcgggtctactcactcttcctggacgagtcccgctccacgcagtacatgaaggagtaccaggacgccttcctcttcaacgaactcagtaagaatccccaccccgcacctgcactgccagagccaacctcagagggaggaagagggagctcggcgtagaaggctcaggccctgccacctgggcgacactgaccatgtggccytccttctccccacagaaggcgagaccatggacacctcctgagttggatgtcatcccccgaccccaccctgttttccaccagagttctgacactgtgactctgtataaaatggttgggaagctgcacccaccctgtgtatgtgtggttgccctgagcccacagaaagacaccgccagagtgcggattgagaagcctttattgtgggaggatcggggtgtcagggctccaggagtcgggatggacttggaaggctgcggggagggtctttagaggaagaggaggcctgagagttgggggtgg

SEQ ID NO: 191444 - DNA, 601 bp, Human
gtggggaggcgttggggcgtgaggttgagagagacagagtggcctggcctggcctgccctgtgagctgggtgagttggcactgattctggaagatggacgtgaatgggcgtggtcacttgtcgctaggtgagttgctgggagatgggcctgcagcgtggtcttgctggtgtgaggctccagggattccggggtgatcagagcgtgggtccccagattgcctttgggtggcgacatctagactgctcagccttgcagccatgcttctgcccagagggataggacacccacagtatgagagasacaaacacagtgcgacagccagcctgtgggcaggagagctgccctcagagccaagatgaaaaaaagagagtaagagatggaagaggaaggatgagaaaaagaaacacagaaaggggcgcacaaacagaaaaaaaaaaaaacaaaaacagaaattgacgccaagaaacaagagatgccaaaatagatctaatcatagaaagaggccacacgcagtggctcgcgcctgtaatcccagcactgtgggaggccgaggcaggaggatagcttgaggccaggtgttcaagaccagcctgggcaaca

SEQ ID NO: 191445 - DNA, 601 bp, Human
ctttcgtgcccagatctgggtggagaaagaagtgagagagggggtgagtggggcacagcaggggccctggcagctcgctcgccacctcctgcacttggaggtcccactggcctgcctgttctgtcccagtttcagtccattctagacggggcaggtggtcctgaaggaggccaagtcccctccctgccctgacgagggctcgctggaaagagctgagtcagctcccgccccctcctccatgctgcggcaaagtcaaacgcaagcgcctcccaccccagagacctttggtcgcagcctggaratcagctcagacaagaaaacaaccagggaaggcacacaggtaagtgaaggcctccgggtacccaagtgctgacaggccttagaagaccaaggaccgacaggtcctgctcccccagagctcaggggtgcagaccccaggcccgcctccctcagacctaagtaagagtccagactctagctgcctcctccctcagacccgaagtctgggcccccagcccctcctccctcagaccctggagtccaggcctcagaccctcctcccttacatccaggagtacaggccccacccctcctccctcag

SEQ ID NO: 191446 - DNA, 601 bp, Human
gctgaggcaggagaatcacttgaacccgggaggcggaggttgcagtgagcgagattgtatcattgcactccaacctgggggacagagtgagactctgtctctaaataaataaataagaaaaaataaaataaaaaataatacacgtggtcggcctgcaatccacacatgccctggagtgtgggtgacatagggacagcattgtcctactccctcatcctcccccttccgccccctggacccgcgggatcacagcagtgcgttctgtctgccagggccacaggcttcctctgctctcactcarctgaagaaaaagtactgggtccccagccagaggacaactgctgtgctgggctgaagggagaagtgtgtggtggtctccaagtaaccagcttcctgggggctcagcaggcggaatcctgcccatcacgcttatgtactggcaggagtgtctggctgtgattggaggtgtgtgtgctctgtacagaatcgactggtgttgcttagatgtccagagtgggaggggagaggggaaaaaacaaaaccttaaaattctggaaaggaaggaagaaaggaaaaaacagagggagggagggaaaggaaa

SEQ ID NO: 191447 - DNA, 601 bp, Human
aaaaatacaaaaattagccgggtgtggtggcgggcgcctgtaatcccagctactggggaggctgaggcaggagaatcacttgaacccgggaggcggaggttgcagtgagcgagattgtatcattgcactccaacctgggggacagagtgagactctgtctctaaataaataaataagaaaaaataaaataaaaaataatacacgtggtcggcctgcaatccacacatgccctggagtgtgggtgacatagggacagcattgtcctactccctcatcctcccccttccgccccctggacccrcgggatcacagcagtgcgttctgtctgccagggccacaggcttcctctgctctcactcaactgaagaaaaagtactgggtccccagccagaggacaactgctgtgctgggctgaagggagaagtgtgtggtggtctccaagtaaccagcttcctgggggctcagcaggcggaatcctgcccatcacgcttatgtactggcaggagtgtctggctgtgattggaggtgtgtgtgctctgtacagaatcgactggtgttgcttagatgtccagagtgggaggggagaggggaaaaaacaaaa

SEQ ID NO: 191448 - DNA, 601 bp, Human
atcacttgaacctgggaggcagaggttgcagtgagccaagattgtgccactgcactccagcctgggcaacaagagtgaaactctatctcataaataaataaataaataaacaaacaaacaaacaaataaaatggttggaatcccacatttgatgctgtgtgttattatgtatgcgtattagtaccacaataataaaaaataaggccaggcatggtggctcacgcctgcaatcccagcactttgggaggctgaggtgggcagatcacttgaggccaggagttcgaaaacagcctggccaacrtggtgaaaccctggctttactaaaaatacaaaaattagccgggtgtggtggcgggcgcctgtaatcccagctactggggaggctgaggcaggagaatcacttgaacccgggaggcggaggttgcagtgagcgagattgtatcattgcactccaacctgggggacagagtgagactctgtctctaaataaataaataagaaaaaataaaataaaaaataatacacgtggtcggcctgcaatccacacatgccctggagtgtgggtgacatagggacagcattgtcctactccctcatcctc

SEQ ID NO: 191449 - DNA, 601 bp, Human
actaaatatacaaaaattagccaatagtggtgcatgtctataatcccagctactcaggaggctgaggcaggagaatcacttgaacctgggaggcagaggttgcagtgagccaagattgtgccactgcactccagcctgggcaacaagagtgaaactctatctcataaataaataaataaataaacaaacaaacaaacaaataaaatggttggaatcccacatttgatgctgtgtgttattatgtatgcgtattagtaccacaataataaaaaataaggccaggcatggtggctcacgcctrcaatcccagcactttgggaggctgaggtgggcagatcacttgaggccaggagttcgaaaacagcctggccaacatggtgaaaccctggctttactaaaaatacaaaaattagccgggtgtggtggcgggcgcctgtaatcccagctactggggaggctgaggcaggagaatcacttgaacccgggaggcggaggttgcagtgagcgagattgtatcattgcactccaacctgggggacagagtgagactctgtctctaaataaataaataagaaaaaataaaataaaaaataatacacgt

SEQ ID NO: 191450 - DNA, 601 bp, Human
tgacccacctgcctcagcctcccaaagtgctgggattgcaggtgagccatcacagccggccctgtactagattctttattgcaaaattgtttataatagactggaaacaacctaagtgtccaacagtaggggattgcctaaggaggtgcattgttaggatgatacagcatgaggctgcaagaaagatggaaaaagctctttaagctttaaggtatagagaagaatttccaggcccagtatgatggctcatacctgtaaccccagaactgggaggctaaggtgggagaattgcttgaagccwggagttcgagaccagcctgggcaacaaagtgagatcctgtctttgcacaagatttaaaaattaactgggcaaggtggtgtgtgcctgtagtcctagccactcgggaggcagaggcaggaggatcacttgagcctaggaggcggaggttgcagtgagctgagaccatgccactgcactccagcctgggaaacagagcaagacaccgtctcaaaaacaaaacaaaacaaaacccaggtaaaagagcccggatacaccggatatagtggctcatgcctgcaatcccaggactttgggaggctg

SEQ ID NO: 191451 - DNA, 601 bp, Human
aactacgttgaatctctatttcacacctcacaccagaaaaaattccaggtgcattaaaagtctaaacaaaatatatatatatatattacaccataaaagctatagaaggaaacaaaaataactgttttatatcttggattgggaattttattttttattttatttgagatggagtctcactctgttgcccaggctgaagtgctctatcttggctcactgcaacctctacctcccaggttcaagcaattcttttgcctcaacctcccaagtagctgggattacaggtgcctacaaccacgcycggctaatttttgtgtttttggtagagacggggtttcaccacgttggccaggctggtcttgaactcctgacctcaggtgatgcgcccacctcggcctcccaaagtgctgggattacaggcgtgagccaccacgactggactttttttttttttccaatttcttgtacagatagggtcttactatgttgcccaggctggtcttgaactcctgagctcaagcaatccccctgcctcttcttcccagccccagatgaattttttaaaacctaacctgatagaaaaatcagcctagcaaatgga

SEQ ID NO: 191452 - DNA, 601 bp, Human
gaaaattagccagacgtggtagcacgtgactggagtcccaggtatttggaaggtggtgggaggatcacttgagcctgggagtttgagactgcagtgagccacgatcatgccactgcactccagcctgggacctagttttttttttctggagactctgtccctgatcactgccccatggttccaagtttgcttgttcagcatctgctccactgcagagtggaagagcctggaaggcagggattacccttgacacgtttaccagacagcctctcctgcagtcccatgcaccagggtaggcagygcttggcacagagtgtttttttgttttgttttgttttgttttgagacagggtctcactctgtcacccaggctggagtgcagtggcgtgatctctgctgattgcaacctccgcctcccaggtccaagtgattcttgtgcctcggcctcctgggtagctgggattacaggcgcccaccaccacgcccagctaatttttgtatttttagttgatccacccgcctcagcctcccaaagtgctaggattacaggggtgagccactgcacccagccagactttttttttttttcccatagtgggtt

SEQ ID NO: 191453 - DNA, 601 bp, Human
ctctctcccagagatagcctctcccctcagctgctaacaagcctcccatggctccccagtgccccaggacaagaccctagcctccttccggcattccaggcctgcctgggtctaatgaatacttgctaagcatttttcaaaacccaaacttatttttgtaacctgaacatcttctgtgatcctattccttctgtccctgtacacatggttcccaggactggaaacagtttgctgacttttgtacccaggaaaccccctcctccctcctcgtcagacctagttgaagggtcgcctcctctgygaaacctttcttttttttttttgagatggagtttcgctctgtcgcccaggctggagtgcagtggcgcgatctcggctcactgcaagctctgtctcctgggttctcgccattgtcctgcctcagcctcctgagtagctgcgactacaggcgcccgccaccaagcccggctaattttttttttttttttttgtatttttagtagagatggggtttcactgtgttaatcaggatggtctcgatctcctgacctcgtgatctgcccgcctcagcctcccaaagtgctgggattacaggcgtgag

SEQ ID NO: 191454 - DNA, 601 bp, Human
tcaaactcctgacctcaagtgatccgcctacctcggcctcccaaagtgctgggattacaagcgtgagctaccgcgcctggctccaaaaccgtttctgttgtcacctcctcgagaggtgtttccagacctccaggctgggtgctggaccttccctggactcccccagtgaactgggctacctggatgactttctgagtctctctcccagagatagcctctcccctcagctgctaacaagcctcccatggctccccagtgccccaggacaagaccctagcctccttccggcattccaggcctscctgggtctaatgaatacttgctaagcatttttcaaaacccaaacttatttttgtaacctgaacatcttctgtgatcctattccttctgtccctgtacacatggttcccaggactggaaacagtttgctgacttttgtacccaggaaaccccctcctccctcctcgtcagacctagttgaagggtcgcctcctctgtgaaacctttcttttttttttttgagatggagtttcgctctgtcgcccaggctggagtgcagtggcgcgatctcggctcactgcaagctctgtctcctgggttc

SEQ ID NO: 191455 - DNA, 601 bp, Human
ccaggctggtctcaaactcctgacctcaagtgatccgcctacctcggcctcccaaagtgctgggattacaagcgtgagctaccgcgcctggctccaaaaccgtttctgttgtcacctcctcgagaggtgtttccagacctccaggctgggtgctggaccttccctggactcccccagtgaactgggctacctggatgactttctgagtctctctcccagagatagcctctcccctcagctgctaacaagcctcccatggctccccagtgccccaggacaagaccctagcctccttccggcrttccaggcctgcctgggtctaatgaatacttgctaagcatttttcaaaacccaaacttatttttgtaacctgaacatcttctgtgatcctattccttctgtccctgtacacatggttcccaggactggaaacagtttgctgacttttgtacccaggaaaccccctcctccctcctcgtcagacctagttgaagggtcgcctcctctgtgaaacctttcttttttttttttgagatggagtttcgctctgtcgcccaggctggagtgcagtggcgcgatctcggctcactgcaagctctgt

SEQ ID NO: 191456 - DNA, 601 bp, Human
cttactttttatatttttagtagagacggggtttcaccatgttggccaggctggtctcaaactcctgacctcaagtgatccgcctacctcggcctcccaaagtgctgggattacaagcgtgagctaccgcgcctggctccaaaaccgtttctgttgtcacctcctcgagaggtgtttccagacctccaggctgggtgctggaccttccctggactcccccagtgaactgggctacctggatgactttctgagtctctctcccagagatagcctctcccctcagctgctaacaagcctcccrtggctccccagtgccccaggacaagaccctagcctccttccggcattccaggcctgcctgggtctaatgaatacttgctaagcatttttcaaaacccaaacttatttttgtaacctgaacatcttctgtgatcctattccttctgtccctgtacacatggttcccaggactggaaacagtttgctgacttttgtacccaggaaaccccctcctccctcctcgtcagacctagttgaagggtcgcctcctctgtgaaacctttcttttttttttttgagatggagtttcgctctgtcgccc

SEQ ID NO: 191457 - DNA, 601 bp, Human
cgcctcagcctcccaaagtgctgggattacaggcgtgagccaccgcgcccagccctcacccatttcatactgaccaaatcctcagctgtcattcaaaaccatttctttttttctttttttcttttttttttttttgagacagagtcttgctctgtcgcccaggctgaggctagagtgcagtggtgcgatctcagctcactgcaacctccgcctctcgggtccaagcgattctcgtgcctcagcctcctgagtaactggagtaactggggcatgcagcaccatgtccggctaatttatattyacatttatatttatatgcccgcctcagccccccaaagtgctgggattacaagagtgagccacagcgcccggccttactttttatatttttagtagagacggggtttcaccatgttggccaggctggtctcaaactcctgacctcaagtgatccgcctacctcggcctcccaaagtgctgggattacaagcgtgagctaccgcgcctggctccaaaaccgtttctgttgtcacctcctcgagaggtgtttccagacctccaggctgggtgctggaccttccctggactcccccagtgaact

SEQ ID NO: 191458 - DNA, 601 bp, Human
ggtggggcaagggagccccatccttccccagcccagccccagaggaggctcatcctactctctcccgtctccctgctcacagctctcacagggctccccagttcccctgagatggaatccttgacttttcatttggcatcaggaccctaaatggttatgtcccctctctcctgtctcttcccacttttctttcttttcttttcttttttttttaagacggagtctcgctctgtcacccaggctggagtgcagtggtgcgatcttggctcactgcaacctccgcctcccaggttcaagagaytctcctgcctcagcctctcttgacctggtgatctgcccgcctcagcctcccaaagtgctgggattacaggcgtgagccaccgcgcccagccctcacccatttcatactgaccaaatcctcagctgtcattcaaaaccatttctttttttctttttttcttttttttttttttgagacagagtcttgctctgtcgcccaggctgaggctagagtgcagtggtgcgatctcagctcactgcaacctccgcctctcgggtccaagcgattctcgtgcctcagcctcctgagtaactggagtaa

SEQ ID NO: 191459 - DNA, 601 bp, Human
agccctctgatgccctggcccctggcacatggcgcccatcaccagaagatgccatgtcctcacccaggtctgagccatgtccagtagactctgtctgaccactccaggcaggataacaccattcagcgggggcgtcaccagctccagcactagggcaggtgtaaggggtggaagatgttacctctcaccccctagcaccgccgtcttaagagccacccccttcccccatcccagaatccctggggcctgtaacctgccaggaatgatggtgccacccacttccaccagggttcgggctggrtcatgggtgggcttacccccatcttcgtgggtccagtagacaaagatgttcatggttcccacctcggtgagctggtggtcgggcccatacagccagaggacctgttcacagccccgcttgagtgcctcctgttgcactaacacggtgggcccataattcctggtggagggcagcctggttgggtggggcaagggagccccatccttccccagcccagccccagaggaggctcatcctactctctcccgtctccctgctcacagctctcacagggctccccagttcccctgagatggaatc

SEQ ID NO: 191460 - DNA, 601 bp, Human
cagcacggaaagcccactctccagggcctcaataagaaaggccattatctgttcctggtactactgaaggaggctggctgttagtccaggggctcatgggacaccaacttctccagggaacaagctcccagcccattccccagctccctgcagctcacctggatctccttcagctccttctggaagcggaggatcagctcaggcccattttccatggtgggaatgtggaggttctgggacagaaggtgcggtgaggaccaagcccctcccctccttccctcccacccacaatggcagcccygcctcaccctgtctttgtacaggattcggtgcactgggcagacctggcaagcggtgcccgagccaaagacttcccgcacgcggccctcctccagggcccgcagcaactgcttcatggtgatcgtgcgctccaccacccggaactcaccctgcagggcagttggcagagacacgtgtccccagagggttgccctgctgcagacctccacctctccctccctgaggatagtgagaaagacagaggcccaacgggagagacagacccaggagaaggggcagagacatgccagtgtgccccagt

SEQ ID NO: 191461 - DNA, 601 bp, Human
agaggaagttaaaggtttagactcctggggctgaggtagggagagcctgagtcctaggtttcagggatgagagccttggaatttcggggcatggggactggaagacaagtggttttcaagatagccatggtttggctgggcactgtggctcacacctgtaatcccagcatattgggaggctgagatgggaggatcccttgagcccaggagttcaagatcagcctgggcaacagagcactcttacaaaaaaattttaaaattagcttggcatgggccaggcgcggtggctcacacctgtaaycccagcactttgggaggccaaggtgggtggatcacctgaggttgggagttcgagaccagcctgaccaacgtggagaaaccctgtctctacttaaaatacaaaattagccgggcatggtggcgcatgcctgtaatcccagccactcgggaggctgaggcaggagaatcgcctgaacccggggggcgggagttgcggtgagctgagatcatgccattacactccagcctgggcaacaagagtgaaactccgtctccaaaaaaaaataaataaaattagcttggcatggtggcacatgtctgt

SEQ ID NO: 191462 - DNA, 601 bp, Human
aaccggccattggggtagacagtccaggtgccggagagggaagcagggtgctggggacaggaagaggaggcgttggggcccatcgcagtacccggcaggcagaagatggccactgggggtgtcaccaggcggcggtctggacacaggatcgacaggcctaggccatgtggaaagctgtcttgatggatatggaggaagaagattacagagaggacacagactagcaggaaggccaggcagagctgacgatggctccggagccacatggctgcaggggaggaaaggcgaattagcaaatgcwctgaggctgaggaggggaggctgaggagggatgtggggtaagggaggcgcctggggtgcagcactccttagtcccagggaaagaggaagttaaaggtttagactcctggggctgaggtagggagagcctgagtcctaggtttcagggatgagagccttggaatttcggggcatggggactggaagacaagtggttttcaagatagccatggtttggctgggcactgtggctcacacctgtaatcccagcatattgggaggctgagatgggaggatcccttgagcccaggagttcaagatc

SEQ ID NO: 191463 - DNA, 601 bp, Human
ggggtgagagcctgtggggaggtgtccagattatcctgagggacactcggttcactggggtcatcaacctggttgggagggagtccctgtcagccccagcctgtatcctttgggaaggctgtcctaccccaggagccgaaatttttggcctctaactcctttctctcccagggacccagggtgctgtgacttcttccacccagcctcaccccctcaaggacaacgggctatgagccccaatccgctttagctgcagattaaactccatgccagacagaaacggaaaaagacacagagagasggagagacccatggtgggagaattaaaacacagagacggggacagggacccagagaagtggggaccagagatccagggaagaggagagacccagaaagagggggacagagactctgagtcaggagttgatagagatccagtgagagcaatggccagagaaccagagagaggggcacagagacgcaaagaagcggaggcagagatctagggagaaggaggggcccagagagaagggagccgagatctggaaaaagagggagacggagacccagagagaaaaggggcagagacatccagaaa

SEQ ID NO: 191464 - DNA, 601 bp, Human
atctgacttagagccaaagctggggttgggggtgagagcctgtggggaggtgtccagattatcctgagggacactcggttcactggggtcatcaacctggttgggagggagtccctgtcagccccagcctgtatcctttgggaaggctgtcctaccccaggagccgaaatttttggcctctaactcctttctctcccagggacccagggtgctgtgacttcttccacccagcctcaccccctcaaggacaacgggctatgagccccaatccgctttagctgcagattaaactccatgccasacagaaacggaaaaagacacagagagagggagagacccatggtgggagaattaaaacacagagacggggacagggacccagagaagtggggaccagagatccagggaagaggagagacccagaaagagggggacagagactctgagtcaggagttgatagagatccagtgagagcaatggccagagaaccagagagaggggcacagagacgcaaagaagcggaggcagagatctagggagaaggaggggcccagagagaagggagccgagatctggaaaaagagggagacggagacccag

SEQ ID NO: 191465 - DNA, 601 bp, Human
ccatctttgtctagaggattaaatgagatcaacctgttgtctctaatatggggtattcccctctccctccaaccatcagagcaaaccccaggcattggaagcaaatgcttttctctgcacaaactccctgctgatggtcctggccagagcccgggggtctctggggacccaagaggtaactcagagagtgagagccagagagattgactgtgagaaaccctagcacagatgagaaacagaggcagagactgagggaggggcctgaggaatacatccctcccgctgccaccccccagccccctccaccagcacgtctctttctctctctctcattctcctgacttcacactgatgtattttgagaaactcgtgaaaggaggcgagaaaaagggtggggaggggctggaaaattggaaaaagaaggggtgaggttatctcagcttcccctccaccaccaacctccgtcactgcaccatcctcctgcccacctccccccacttctgtccagccttattcttgtctctcatgttactagagggtggggtaactttggagctaagaggtgatctgcagcaagcaagactgatgttagacttagcaa

SEQ ID NO: 191466 - DNA, 601 bp, Human
gacccaaaaagagggtgacagagatggggggagttgtacagaggcccagagagagggggtcacagacagaagaagggagagagatccagtgaaagggggacagagatctagagaggaagagacagagacccagagagagggagagagaataacaagggagcagagacccagagagagaaggggacagagacccagagatacagggggacagagacccagagacatagtgggacagagacccagaaagagggggacagagacccagagagaaagggagacagagacccagagagagaggaacagagacccagatagagagggggacagagacccagagagagggagagagaataacaggggagcagagacccagagagagagggggacagagacccagagatacagcgggacagagacccagagacatagcgggccagagacccagaaagagggggacagagacccagagagaaagggagacagagacccagagagagaggaacagagacccagatagagagggggacagagacccagagatggaggggtcagagacacagaggatgacagagacccagagagagggagacagagacccaga

SEQ ID NO: 191467 - DNA, 601 bp, Human
aagacccaaaaagagggtgacagagatggggggagttgtacagaggcccagagagagggggtcacagacagaagaagggagagagatccagtgaaagggggacagagatctagagaggaagagacagagacccagagagagggagagagaataacaagggagcagagacccagagagagaaggggacagagacccagagatacagggggacagagacccagagacatagtgggacagagacccagaaagagggggacagagacccagagagaaagggagacagagacccagagagagagggacagagacccagatagagagggggacagagacccagagagagggagagagaataacaggggagcagagacccagagagagagggggacagagacccagagatacagcgggacagagacccagagacatagcgggccagagacccagaaagagggggacagagacccagagagaaagggagacagagacccagagagagaggaacagagacccagatagagagggggacagagacccagagatggaggggtcagagacacagaggatgacagagacccagagagagggagacagagaccca

SEQ ID NO: 191468 - DNA, 601 bp, Human
gaaagacccaaaaagagggtgacagagatggggggagttgtacagaggcccagagagagggggtcacagacagaagaagggagagagatccagtgaaagggggacagagatctagagaggaagagacagagacccagagagagggagagagaataacaagggagcagagacccagagagagaaggggacagagacccagagatacagggggacagagacccagagacatagtgggacagagacccagaaagagggggacagagacccagagagaaagggagacagagacccagagagagaagaacagagacccagatagagagggggacagagacccagagagagggagagagaataacaggggagcagagacccagagagagagggggacagagacccagagatacagcgggacagagacccagagacatagcgggccagagacccagaaagagggggacagagacccagagagaaagggagacagagacccagagagagaggaacagagacccagatagagagggggacagagacccagagatggaggggtcagagacacagaggatgacagagacccagagagagggagacagagacc

SEQ ID NO: 191469 - DNA, 601 bp, Human
ggagaaagacccaaaaagagggtgacagagatggggggagttgtacagaggcccagagagagggggtcacagacagaagaagggagagagatccagtgaaagggggacagagatctagagaggaagagacagagacccagagagagggagagagaataacaagggagcagagacccagagagagaaggggacagagacccagagatacagggggacagagacccagagacatagtgggacagagacccagaaagagggggacagagacccagagagaaagggagacagagacccagagagagaggaacagagacccagatagagagggggacagagacccagagagagggagagagaataacaggggagcagagacccagagagagagggggacagagacccagagatacagcgggacagagacccagagacatagcgggccagagacccagaaagagggggacagagacccagagagaaagggagacagagacccagagagagaggaacagagacccagatagagagggggacagagacccagagatggaggggtcagagacacagaggatgacagagacccagagagagggagacagag

SEQ ID NO: 191470 - DNA, 601 bp, Human
cagagagaggctgcagagagagagaggtgccttcagacaggtggagaaagacccaaaaagagggtgacagagatggggggagttgtacagaggcccagagagagggggtcacagacagaagaagggagagagatccagtgaaagggggacagagatctagagaggaagagacagagacccagagagagggagagagaataacaagggagcagagacccagagagagaaggggacagagacccagagatacagggggacagagacccagagacatagtgggacagagacccagaaagagggrgacagagacccagagagaaagggagacagagacccagagagagaggaacagagacccagatagagagggggacagagacccagagagagggagagagaataacaggggagcagagacccagagagagagggggacagagacccagagatacagcgggacagagacccagagacatagcgggccagagacccagaaagagggggacagagacccagagagaaagggagacagagacccagagagagaggaacagagacccagatagagagggggacagagacccagagatggaggggtcag

SEQ ID NO: 191471 - DNA, 601 bp, Human
aacccagagagaggctgcagagagagagaggtgccttcagacaggtggagaaagacccaaaaagagggtgacagagatggggggagttgtacagaggcccagagagagggggtcacagacagaagaagggagagagatccagtgaaagggggacagagatctagagaggaagagacagagacccagagagagggagagagaataacaagggagcagagacccagagagagaaggggacagagacccagagatacagggggacagagacccagagacatagtgggacagagacccagaaagagggggacagagacccagagagaaagggagacagagacccagagagagaggaacagagacccagatagagagggggacagagacccagagagagggagagagaataacaggggagcagagacccagagagagagggggacagagacccagagatacagcgggacagagacccagagacatagcgggccagagacccagaaagagggggacagagacccagagagaaagggagacagagacccagagagagaggaacagagacccagatagagagggggacagagacccagagatggagggg

SEQ ID NO: 191472 - DNA, 601 bp, Human
tcaaacccagagagaggctgcagagagagagaggtgccttcagacaggtggagaaagacccaaaaagagggtgacagagatggggggagttgtacagaggcccagagagagggggtcacagacagaagaagggagagagatccagtgaaagggggacagagatctagagaggaagagacagagacccagagagagggagagagaataacaagggagcagagacccagagagagaaggggacagagacccagagatacagggggacagagacccagagacatagtgggacagagacccagaragagggggacagagacccagagagaaagggagacagagacccagagagagaggaacagagacccagatagagagggggacagagacccagagagagggagagagaataacaggggagcagagacccagagagagagggggacagagacccagagatacagcgggacagagacccagagacatagcgggccagagacccagaaagagggggacagagacccagagagaaagggagacagagacccagagagagaggaacagagacccagatagagagggggacagagacccagagatggag

SEQ ID NO: 191473 - DNA, 601 bp, Human
gtatttggagggctgcctcaaacccagagagaggctgcagagagagagaggtgccttcagacaggtggagaaagacccaaaaagagggtgacagagatggggggagttgtacagaggcccagagagagggggtcacagacagaagaagggagagagatccagtgaaagggggacagagatctagagaggaagagacagagacccagagagagggagagagaataacaagggagcagagacccagagagagaaggggacagagacccagagatacagggggacagagacccagagacatagkgggacagagacccagaaagagggggacagagacccagagagaaagggagacagagacccagagagagaggaacagagacccagatagagagggggacagagacccagagagagggagagagaataacaggggagcagagacccagagagagagggggacagagacccagagatacagcgggacagagacccagagacatagcgggccagagacccagaaagagggggacagagacccagagagaaagggagacagagacccagagagagaggaacagagacccagatagagagggggaca

SEQ ID NO: 191474 - DNA, 601 bp, Human
agggtatttggagggctgcctcaaacccagagagaggctgcagagagagagaggtgccttcagacaggtggagaaagacccaaaaagagggtgacagagatggggggagttgtacagaggcccagagagagggggtcacagacagaagaagggagagagatccagtgaaagggggacagagatctagagaggaagagacagagacccagagagagggagagagaataacaagggagcagagacccagagagagaaggggacagagacccagagatacagggggacagagacccagagacakagtgggacagagacccagaaagagggggacagagacccagagagaaagggagacagagacccagagagagaggaacagagacccagatagagagggggacagagacccagagagagggagagagaataacaggggagcagagacccagagagagagggggacagagacccagagatacagcgggacagagacccagagacatagcgggccagagacccagaaagagggggacagagacccagagagaaagggagacagagacccagagagagaggaacagagacccagatagagaggggg

SEQ ID NO: 191475 - DNA, 601 bp, Human
ggaacctgagatgggactgagattaaatagatgtgacccggggacatgagcttggggtacaggcgtgagcaaaattgctagtaggtccaaaatggggcaggggcaacccctagggaacctgatgttggggcggactctacatttttcaatcaagcccctggaaataagggcgggacttcatttagatcaggacggggcttaggaaacggaggcggcccctaaggcgaggtcagaactaaggggcgcacggattgggcggagctattccgacagcgtttcggaaggggcgtggcctggacgyctggtgggtgagtgtgacgtcatgggggcgtaggcggagctcggtgagcggggcggggctctgcaagggctcaggccttgagctacctgcaccaccacgtggcccccgcggtgggtcgtgctgttattgaccatggagacgatggccacgcccaggttgcagcggatgccaaagctgatgcagaagcccagaccactcatgatggcgataatgtagcggcgagggaggccgaagcaggtgcagtccaccaccggcgggtcccgggtctgcgtggtcaccgggcgcccatccgcactcagc

SEQ ID NO: 191476 - DNA, 601 bp, Human
agggtccaggcggggacacgaagcagccaagggggcggaccagattggaagggagcaaggggaggaacttcaggtaggacaaaggcacaaatcaggactcttttctgatgcaggggcaaggcctatgctgaaattaaaataggagaaaggacagggcacggtggctcacgcctgtactcccaggactgggaggccaaggcaggaggatcgcttgagcccaggagtccgagaccagcctgggcaacatagtgagaccttgtctctacaaagataaaaataaaaatgttagctgggtatgccrgcgcacgcctgtagtcccagctgctcagaaggctgaggcaggagagtcacttgagcccaggagttcgaggctgcagtgatggtgccactgcactccagcttgggcgacagagcaatggccccactgcaccgtagcctgggagaccctgtgggtctttagataagggacacaacacatgcagtgggacgtaggcagtggcagggtttcaaaaaaggatcacattcagggaggaacctgagatgggactgagattaaatagatgtgacccggggacatgagcttggggtacaggcgtgagca

SEQ ID NO: 191477 - DNA, 601 bp, Human
acaaagtctcgctctgtcgcccaggctggagtgctgcggcgcgatcatagctcactgcggcctcgcagttctgggctccagcgatcctcccttctcagcctcccaagtagatgggaccacaggcgcgcgccaccacgcctagcaaatctcacttgttagacagcaggccccctaggaccctgtctctccaggtgccttgctcttagcgcctcttcatcacctagttcatgtcctaccacacccaactttgtgcaggtcttgtccctccaggcccaactcggtcttctctctgctccacccrggaagtctcgcccaccctgcccttccgcgcggtggccccttggacggccgcgtgacagtccctttcatccaggcctgccctgccccggctccaccctgttggccacggccctttgcatagaaagggactcctggggcaggctggatggtttccgcctgtaaccactccccatcacctctcaatccggctctgctccacccaggctgtcctagagccggcccaggccccgccccactcacctccgcagttcatcaacttgcgcacgttggtggtggacatgatgcggcggctccgcaggaa

SEQ ID NO: 191478 - DNA, 601 bp, Human
caaggcgcaggctgccccacaccgcccttccagacctgctccagccccaaaccgcgtctatccaccccagtctggccacctccacgcccaggcctcttcgcgccctccacgccacccgcacccaccctaaccaggcccctacttctccaagacccagccctgaccacgcccaccagctccatcgcccctcccgtagctccaccccttgactaggccactccccgaacacgcaggatccctgctgtgcacgttcacaccttcccctcaatccccactcatgagtttttggggttttttttttaatttttgattttttattttttttaagagacaaagtctcacgacgttgcccaggctggtctcaaactcctgagctcaagtgatccaccggccttcgcctccgaaagtgctgggataacaggggttagccaccatgccctgcctgttttttaatttttaattgtaattttaatttttctagaaacaaagtctcgctctgtcgcccaggctggagtgctgcggcgcgatcatagctcactgcggcctcgcagttctgggctccagcgatcctcccttctcagcctcccaagtagatgggacc

SEQ ID NO: 191479 - DNA, 601 bp, Human
tcggccggagcaaggcgcaggctgccccacaccgcccttccagacctgctccagccccaaaccgcgtctatccaccccagtctggccacctccacgcccaggcctcttcgcgccctccacgccacccgcacccaccctaaccaggcccctacttctccaagacccagccctgaccacgcccaccagctccatcgcccctcccgtagctccaccccttgactaggccactccccgaacacgcaggatccctgctgtgcacgttcacaccttcccctcaatccccactcatgagtttttgggkttttttttttaatttttgattttttattttttttaagagacaaagtctcacgacgttgcccaggctggtctcaaactcctgagctcaagtgatccaccggccttcgcctccgaaagtgctgggataacaggggttagccaccatgccctgcctgttttttaatttttaattgtaattttaatttttctagaaacaaagtctcgctctgtcgcccaggctggagtgctgcggcgcgatcatagctcactgcggcctcgcagttctgggctccagcgatcctcccttctcagcctcccaagt

SEQ ID NO: 191480 - DNA, 601 bp, Human
gtcggccggagcaaggcgcaggctgccccacaccgcccttccagacctgctccagccccaaaccgcgtctatccaccccagtctggccacctccacgcccaggcctcttcgcgccctccacgccacccgcacccaccctaaccaggcccctacttctccaagacccagccctgaccacgcccaccagctccatcgcccctcccgtagctccaccccttgactaggccactccccgaacacgcaggatccctgctgtgcacgttcacaccttcccctcaatccccactcatgagtttttggkgttttttttttaatttttgattttttattttttttaagagacaaagtctcacgacgttgcccaggctggtctcaaactcctgagctcaagtgatccaccggccttcgcctccgaaagtgctgggataacaggggttagccaccatgccctgcctgttttttaatttttaattgtaattttaatttttctagaaacaaagtctcgctctgtcgcccaggctggagtgctgcggcgcgatcatagctcactgcggcctcgcagttctgggctccagcgatcctcccttctcagcctcccaag

SEQ ID NO: 191481 - DNA, 601 bp, Human
gaagcctacgggggcggggggggcccgcgtctcctgagtgtcggccggagcaaggcgcaggctgccccacaccgcccttccagacctgctccagccccaaaccgcgtctatccaccccagtctggccacctccacgcccaggcctcttcgcgccctccacgccacccgcacccaccctaaccaggcccctacttctccaagacccagccctgaccacgcccaccagctccatcgcccctcccgtagctccaccccttgactaggccactccccgaacacgcaggatccctgctgtgcacgytcacaccttcccctcaatccccactcatgagtttttggggttttttttttaatttttgattttttattttttttaagagacaaagtctcacgacgttgcccaggctggtctcaaactcctgagctcaagtgatccaccggccttcgcctccgaaagtgctgggataacaggggttagccaccatgccctgcctgttttttaatttttaattgtaattttaatttttctagaaacaaagtctcgctctgtcgcccaggctggagtgctgcggcgcgatcatagctcactgcggcctcgcag

SEQ ID NO: 191482 - DNA, 601 bp, Human; identical to SEQ ID NO: 95189

SEQ ID NO: 191483 - DNA, 601 bp, Human; identical to SEQ ID NO: 95190

SEQ ID NO: 191484 - DNA, 601 bp, Human; identical to SEQ ID NO: 95191

SEQ ID NO: 191485 - DNA, 601 bp, Human; identical to SEQ ID NO: 95192

SEQ ID NO: 191486 - DNA, 601 bp, Human; identical to SEQ ID NO: 95193

SEQ ID NO: 191487 - DNA, 601 bp, Human; identical to SEQ ID NO: 95194

SEQ ID NO: 191488 - DNA, 601 bp, Human; identical to SEQ ID NO: 95195

SEQ ID NO: 191489 - DNA, 601 bp, Human; identical to SEQ ID NO: 95196

SEQ ID NO: 191490 - DNA, 601 bp, Human; identical to SEQ ID NO: 95197

SEQ ID NO: 191491 - DNA, 601 bp, Human; identical to SEQ ID NO: 95198

SEQ ID NO: 191492 - DNA, 601 bp, Human; identical to SEQ ID NO: 95199

SEQ ID NO: 191493 - DNA, 601 bp, Human; identical to SEQ ID NO: 95200

SEQ ID NO: 191494 - DNA, 601 bp, Human; identical to SEQ ID NO: 95201

SEQ ID NO: 191495 - DNA, 601 bp, Human; identical to SEQ ID NO: 95202

SEQ ID NO: 191496 - DNA, 601 bp, Human; identical to SEQ ID NO: 95203

SEQ ID NO: 191497 - DNA, 601 bp, Human; identical to SEQ ID NO: 95204

SEQ ID NO: 191498 - DNA, 601 bp, Human; identical to SEQ ID NO: 95205

SEQ ID NO: 191499 - DNA, 601 bp, Human; identical to SEQ ID NO: 95206

SEQ ID NO: 191500 - DNA, 601 bp, Human; identical to SEQ ID NO: 95207

SEQ ID NO: 191501 - DNA, 601 bp, Human; identical to SEQ ID NO: 95208

SEQ ID NO: 191502 - DNA, 601 bp, Human; identical to SEQ ID NO: 95209

SEQ ID NO: 191503 - DNA, 601 bp, Human; identical to SEQ ID NO: 95210

SEQ ID NO: 191504 - DNA, 601 bp, Human; identical to SEQ ID NO: 95211

SEQ ID NO: 191505 - DNA, 601 bp, Human; identical to SEQ ID NO: 95212

SEQ ID NO: 191506 - DNA, 601 bp, Human; identical to SEQ ID NO: 95213

SEQ ID NO: 191507 - DNA, 601 bp, Human; identical to SEQ ID NO: 95214

SEQ ID NO: 191508 - DNA, 601 bp, Human; identical to SEQ ID NO: 95215

SEQ ID NO: 191509 - DNA, 601 bp, Human; identical to SEQ ID NO: 95216

SEQ ID NO: 191510 - DNA, 601 bp, Human; identical to SEQ ID NO: 95217

SEQ ID NO: 191511 - DNA, 601 bp, Human; identical to SEQ ID NO: 95218

SEQ ID NO: 191512 - DNA, 601 bp, Human; identical to SEQ ID NO: 95219

SEQ ID NO: 191513 - DNA, 601 bp, Human; identical to SEQ ID NO: 95220

SEQ ID NO: 191514 - DNA, 601 bp, Human; identical to SEQ ID NO: 95221

SEQ ID NO: 191515 - DNA, 601 bp, Human; identical to SEQ ID NO: 95222

SEQ ID NO: 191516 - DNA, 601 bp, Human; identical to SEQ ID NO: 95223

SEQ ID NO: 191517 - DNA, 601 bp, Human; identical to SEQ ID NO: 95224

SEQ ID NO: 191518 - DNA, 601 bp, Human; identical to SEQ ID NO: 95225

SEQ ID NO: 191519 - DNA, 601 bp, Human; identical to SEQ ID NO: 95226

SEQ ID NO: 191520 - DNA, 601 bp, Human; identical to SEQ ID NO: 95227

SEQ ID NO: 191521 - DNA, 601 bp, Human; identical to SEQ ID NO: 95228

SEQ ID NO: 191522 - DNA, 601 bp, Human; identical to SEQ ID NO: 95229

SEQ ID NO: 191523 - DNA, 601 bp, Human; identical to SEQ ID NO: 95230

SEQ ID NO: 191524 - DNA, 601 bp, Human; identical to SEQ ID NO: 95231

SEQ ID NO: 191525 - DNA, 601 bp, Human; identical to SEQ ID NO: 95232

SEQ ID NO: 191526 - DNA, 601 bp, Human; identical to SEQ ID NO: 95233

SEQ ID NO: 191527 - DNA, 601 bp, Human; identical to SEQ ID NO: 95234

SEQ ID NO: 191528 - DNA, 601 bp, Human; identical to SEQ ID NO: 95235

SEQ ID NO: 191529 - DNA, 601 bp, Human; identical to SEQ ID NO: 95236

SEQ ID NO: 191530 - DNA, 601 bp, Human; identical to SEQ ID NO: 95237

SEQ ID NO: 191531 - DNA, 601 bp, Human; identical to SEQ ID NO: 95238

SEQ ID NO: 191532 - DNA, 601 bp, Human; identical to SEQ ID NO: 95239

SEQ ID NO: 191533 - DNA, 601 bp, Human; identical to SEQ ID NO: 95240

SEQ ID NO: 191534 - DNA, 601 bp, Human; identical to SEQ ID NO: 95241

SEQ ID NO: 191535 - DNA, 601 bp, Human; identical to SEQ ID NO: 95242

SEQ ID NO: 191536 - DNA, 601 bp, Human; identical to SEQ ID NO: 95243

SEQ ID NO: 191537 - DNA, 601 bp, Human; identical to SEQ ID NO: 95244

SEQ ID NO: 191538 - DNA, 601 bp, Human; identical to SEQ ID NO: 95245

SEQ ID NO: 191539 - DNA, 601 bp, Human; identical to SEQ ID NO: 95246

SEQ ID NO: 191540 - DNA, 601 bp, Human; identical to SEQ ID NO: 95247

SEQ ID NO: 191541 - DNA, 601 bp, Human; identical to SEQ ID NO: 95248

SEQ ID NO: 191542 - DNA, 601 bp, Human; identical to SEQ ID NO: 95249

SEQ ID NO: 191543 - DNA, 601 bp, Human; identical to SEQ ID NO: 95250

SEQ ID NO: 191544 - DNA, 601 bp, Human; identical to SEQ ID NO: 95251

SEQ ID NO: 191545 - DNA, 601 bp, Human; identical to SEQ ID NO: 95252

SEQ ID NO: 191546 - DNA, 601 bp, Human; identical to SEQ ID NO: 95253

SEQ ID NO: 191547 - DNA, 601 bp, Human; identical to SEQ ID NO: 95254

SEQ ID NO: 191548 - DNA, 601 bp, Human; identical to SEQ ID NO: 95255

SEQ ID NO: 191549 - DNA, 601 bp, Human; identical to SEQ ID NO: 95256

SEQ ID NO: 191550 - DNA, 601 bp, Human; identical to SEQ ID NO: 95257

SEQ ID NO: 191551 - DNA, 601 bp, Human; identical to SEQ ID NO: 95258

SEQ ID NO: 191552 - DNA, 601 bp, Human; identical to SEQ ID NO: 95259

SEQ ID NO: 191553 - DNA, 601 bp, Human; identical to SEQ ID NO: 95260

SEQ ID NO: 191554 - DNA, 601 bp, Human; identical to SEQ ID NO: 95261

SEQ ID NO: 191555 - DNA, 601 bp, Human; identical to SEQ ID NO: 95262

SEQ ID NO: 191556 - DNA, 601 bp, Human; identical to SEQ ID NO: 95263

SEQ ID NO: 191557 - DNA, 601 bp, Human; identical to SEQ ID NO: 95264

SEQ ID NO: 191558 - DNA, 601 bp, Human; identical to SEQ ID NO: 95265

SEQ ID NO: 191559 - DNA, 601 bp, Human; identical to SEQ ID NO: 95266

SEQ ID NO: 191560 - DNA, 601 bp, Human; identical to SEQ ID NO: 95267

SEQ ID NO: 191561 - DNA, 601 bp, Human; identical to SEQ ID NO: 95268

SEQ ID NO: 191562 - DNA, 601 bp, Human; identical to SEQ ID NO: 95269

SEQ ID NO: 191563 - DNA, 601 bp, Human; identical to SEQ ID NO: 95270

SEQ ID NO: 191564 - DNA, 601 bp, Human; identical to SEQ ID NO: 95271

SEQ ID NO: 191565 - DNA, 601 bp, Human; identical to SEQ ID NO: 95272

SEQ ID NO: 191566 - DNA, 601 bp, Human; identical to SEQ ID NO: 95273

SEQ ID NO: 191567 - DNA, 601 bp, Human; identical to SEQ ID NO: 95274

SEQ ID NO: 191568 - DNA, 601 bp, Human; identical to SEQ ID NO: 95275

SEQ ID NO: 191569 - DNA, 601 bp, Human; identical to SEQ ID NO: 95276

SEQ ID NO: 191570 - DNA, 601 bp, Human; identical to SEQ ID NO: 95277

SEQ ID NO: 191571 - DNA, 601 bp, Human; identical to SEQ ID NO: 95278

SEQ ID NO: 191572 - DNA, 601 bp, Human; identical to SEQ ID NO: 95279

SEQ ID NO: 191573 - DNA, 601 bp, Human; identical to SEQ ID NO: 95280

SEQ ID NO: 191574 - DNA, 601 bp, Human; identical to SEQ ID NO: 95281

SEQ ID NO: 191575 - DNA, 601 bp, Human; identical to SEQ ID NO: 95282

SEQ ID NO: 191576 - DNA, 601 bp, Human; identical to SEQ ID NO: 95283

SEQ ID NO: 191577 - DNA, 601 bp, Human; identical to SEQ ID NO: 95284

SEQ ID NO: 191578 - DNA, 601 bp, Human; identical to SEQ ID NO: 95285

SEQ ID NO: 191579 - DNA, 601 bp, Human; identical to SEQ ID NO: 95286

SEQ ID NO: 191580 - DNA, 601 bp, Human; identical to SEQ ID NO: 95287

SEQ ID NO: 191581 - DNA, 601 bp, Human; identical to SEQ ID NO: 95288

SEQ ID NO: 191582 - DNA, 601 bp, Human; identical to SEQ ID NO: 95289

SEQ ID NO: 191583 - DNA, 601 bp, Human; identical to SEQ ID NO: 95290

SEQ ID NO: 191584 - DNA, 601 bp, Human; identical to SEQ ID NO: 95291

SEQ ID NO: 191585 - DNA, 601 bp, Human; identical to SEQ ID NO: 95292

SEQ ID NO: 191586 - DNA, 601 bp, Human; identical to SEQ ID NO: 95293

SEQ ID NO: 191587 - DNA, 601 bp, Human; identical to SEQ ID NO: 95294

SEQ ID NO: 191588 - DNA, 601 bp, Human; identical to SEQ ID NO: 95295

SEQ ID NO: 191589 - DNA, 601 bp, Human; identical to SEQ ID NO: 95296

SEQ ID NO: 191590 - DNA, 601 bp, Human; identical to SEQ ID NO: 95297

SEQ ID NO: 191591 - DNA, 601 bp, Human; identical to SEQ ID NO: 95298

SEQ ID NO: 191592 - DNA, 601 bp, Human; identical to SEQ ID NO: 95299

SEQ ID NO: 191593 - DNA, 601 bp, Human; identical to SEQ ID NO: 95300

SEQ ID NO: 191594 - DNA, 601 bp, Human; identical to SEQ ID NO: 95301

SEQ ID NO: 191595 - DNA, 601 bp, Human; identical to SEQ ID NO: 95302

SEQ ID NO: 191596 - DNA, 601 bp, Human; identical to SEQ ID NO: 95303

SEQ ID NO: 191597 - DNA, 601 bp, Human; identical to SEQ ID NO: 95304

SEQ ID NO: 191598 - DNA, 601 bp, Human; identical to SEQ ID NO: 95305

SEQ ID NO: 191599 - DNA, 601 bp, Human; identical to SEQ ID NO: 95306

SEQ ID NO: 191600 - DNA, 601 bp, Human; identical to SEQ ID NO: 95307

SEQ ID NO: 191601 - DNA, 601 bp, Human; identical to SEQ ID NO: 95308

SEQ ID NO: 191602 - DNA, 601 bp, Human; identical to SEQ ID NO: 95309

SEQ ID NO: 191603 - DNA, 601 bp, Human; identical to SEQ ID NO: 95310

SEQ ID NO: 191604 - DNA, 601 bp, Human; identical to SEQ ID NO: 95311

SEQ ID NO: 191605 - DNA, 601 bp, Human; identical to SEQ ID NO: 95312

SEQ ID NO: 191606 - DNA, 601 bp, Human; identical to SEQ ID NO: 95313

SEQ ID NO: 191607 - DNA, 601 bp, Human; identical to SEQ ID NO: 95314

SEQ ID NO: 191608 - DNA, 601 bp, Human; identical to SEQ ID NO: 95315

SEQ ID NO: 191609 - DNA, 601 bp, Human; identical to SEQ ID NO: 95316

SEQ ID NO: 191610 - DNA, 601 bp, Human; identical to SEQ ID NO: 95317

SEQ ID NO: 191611 - DNA, 601 bp, Human; identical to SEQ ID NO: 95318

SEQ ID NO: 191612 - DNA, 601 bp, Human; identical to SEQ ID NO: 95319

SEQ ID NO: 191613 - DNA, 601 bp, Human; identical to SEQ ID NO: 95320

SEQ ID NO: 191614 - DNA, 601 bp, Human; identical to SEQ ID NO: 95321

SEQ ID NO: 191615 - DNA, 601 bp, Human; identical to SEQ ID NO: 95322

SEQ ID NO: 191616 - DNA, 601 bp, Human; identical to SEQ ID NO: 95323

SEQ ID NO: 191617 - DNA, 601 bp, Human; identical to SEQ ID NO: 95324

SEQ ID NO: 191618 - DNA, 601 bp, Human; identical to SEQ ID NO: 95325

SEQ ID NO: 191619 - DNA, 601 bp, Human; identical to SEQ ID NO: 95326

SEQ ID NO: 191620 - DNA, 601 bp, Human; identical to SEQ ID NO: 95327

SEQ ID NO: 191621 - DNA, 601 bp, Human; identical to SEQ ID NO: 95328

SEQ ID NO: 191622 - DNA, 601 bp, Human; identical to SEQ ID NO: 95329

SEQ ID NO: 191623 - DNA, 601 bp, Human; identical to SEQ ID NO: 95330

SEQ ID NO: 191624 - DNA, 601 bp, Human; identical to SEQ ID NO: 95331

SEQ ID NO: 191625 - DNA, 601 bp, Human; identical to SEQ ID NO: 95332

SEQ ID NO: 191626 - DNA, 601 bp, Human; identical to SEQ ID NO: 95333

SEQ ID NO: 191627 - DNA, 601 bp, Human; identical to SEQ ID NO: 95334

SEQ ID NO: 191628 - DNA, 601 bp, Human; identical to SEQ ID NO: 95335

SEQ ID NO: 191629 - DNA, 601 bp, Human; identical to SEQ ID NO: 95336

SEQ ID NO: 191630 - DNA, 601 bp, Human; identical to SEQ ID NO: 95337

SEQ ID NO: 191631 - DNA, 601 bp, Human; identical to SEQ ID NO: 95338

SEQ ID NO: 191632 - DNA, 601 bp, Human; identical to SEQ ID NO: 95339

SEQ ID NO: 191633 - DNA, 601 bp, Human; identical to SEQ ID NO: 95340

SEQ ID NO: 191634 - DNA, 601 bp, Human; identical to SEQ ID NO: 95341

SEQ ID NO: 191635 - DNA, 601 bp, Human; identical to SEQ ID NO: 95342

SEQ ID NO: 191636 - DNA, 601 bp, Human; identical to SEQ ID NO: 95343

SEQ ID NO: 191637 - DNA, 601 bp, Human; identical to SEQ ID NO: 95344

SEQ ID NO: 191638 - DNA, 601 bp, Human; identical to SEQ ID NO: 95345

SEQ ID NO: 191639 - DNA, 601 bp, Human; identical to SEQ ID NO: 95346

SEQ ID NO: 191640 - DNA, 601 bp, Human; identical to SEQ ID NO: 95347

SEQ ID NO: 191641 - DNA, 601 bp, Human; identical to SEQ ID NO: 95348

SEQ ID NO: 191642 - DNA, 601 bp, Human; identical to SEQ ID NO: 95349

SEQ ID NO: 191643 - DNA, 601 bp, Human; identical to SEQ ID NO: 95350

SEQ ID NO: 191644 - DNA, 601 bp, Human; identical to SEQ ID NO: 95351

SEQ ID NO: 191645 - DNA, 601 bp, Human; identical to SEQ ID NO: 95352

SEQ ID NO: 191646 - DNA, 601 bp, Human; identical to SEQ ID NO: 95353

SEQ ID NO: 191647 - DNA, 601 bp, Human; identical to SEQ ID NO: 95354

SEQ ID NO: 191648 - DNA, 601 bp, Human; identical to SEQ ID NO: 95355

SEQ ID NO: 191649 - DNA, 601 bp, Human; identical to SEQ ID NO: 95356

SEQ ID NO: 191650 - DNA, 601 bp, Human; identical to SEQ ID NO: 95357

SEQ ID NO: 191651 - DNA, 601 bp, Human; identical to SEQ ID NO: 95358

SEQ ID NO: 191652 - DNA, 601 bp, Human; identical to SEQ ID NO: 95359

SEQ ID NO: 191653 - DNA, 601 bp, Human; identical to SEQ ID NO: 95360

SEQ ID NO: 191654 - DNA, 601 bp, Human; identical to SEQ ID NO: 95361

SEQ ID NO: 191655 - DNA, 601 bp, Human; identical to SEQ ID NO: 95362

SEQ ID NO: 191656 - DNA, 601 bp, Human; identical to SEQ ID NO: 95363

SEQ ID NO: 191657 - DNA, 601 bp, Human; identical to SEQ ID NO: 95364

SEQ ID NO: 191658 - DNA, 601 bp, Human; identical to SEQ ID NO: 95365

SEQ ID NO: 191659 - DNA, 601 bp, Human; identical to SEQ ID NO: 95366

SEQ ID NO: 191660 - DNA, 601 bp, Human; identical to SEQ ID NO: 95189

SEQ ID NO: 191661 - DNA, 601 bp, Human; identical to SEQ ID NO: 95190

SEQ ID NO: 191662 - DNA, 601 bp, Human; identical to SEQ ID NO: 95191

SEQ ID NO: 191663 - DNA, 601 bp, Human; identical to SEQ ID NO: 95192

SEQ ID NO: 191664 - DNA, 601 bp, Human; identical to SEQ ID NO: 95193

SEQ ID NO: 191665 - DNA, 601 bp, Human; identical to SEQ ID NO: 95194

SEQ ID NO: 191666 - DNA, 601 bp, Human; identical to SEQ ID NO: 95195

SEQ ID NO: 191667 - DNA, 601 bp, Human; identical to SEQ ID NO: 95196

SEQ ID NO: 191668 - DNA, 601 bp, Human; identical to SEQ ID NO: 95197

SEQ ID NO: 191669 - DNA, 601 bp, Human; identical to SEQ ID NO: 95198

SEQ ID NO: 191670 - DNA, 601 bp, Human; identical to SEQ ID NO: 95199

SEQ ID NO: 191671 - DNA, 601 bp, Human; identical to SEQ ID NO: 95200

SEQ ID NO: 191672 - DNA, 601 bp, Human; identical to SEQ ID NO: 95201

SEQ ID NO: 191673 - DNA, 601 bp, Human; identical to SEQ ID NO: 95202

SEQ ID NO: 191674 - DNA, 601 bp, Human; identical to SEQ ID NO: 95203

SEQ ID NO: 191675 - DNA, 601 bp, Human; identical to SEQ ID NO: 95204

SEQ ID NO: 191676 - DNA, 601 bp, Human; identical to SEQ ID NO: 95205

SEQ ID NO: 191677 - DNA, 601 bp, Human; identical to SEQ ID NO: 95206

SEQ ID NO: 191678 - DNA, 601 bp, Human; identical to SEQ ID NO: 95207

SEQ ID NO: 191679 - DNA, 601 bp, Human; identical to SEQ ID NO: 95208

SEQ ID NO: 191680 - DNA, 601 bp, Human; identical to SEQ ID NO: 95209

SEQ ID NO: 191681 - DNA, 601 bp, Human; identical to SEQ ID NO: 95210

SEQ ID NO: 191682 - DNA, 601 bp, Human; identical to SEQ ID NO: 95211

SEQ ID NO: 191683 - DNA, 601 bp, Human; identical to SEQ ID NO: 95212

SEQ ID NO: 191684 - DNA, 601 bp, Human; identical to SEQ ID NO: 95213

SEQ ID NO: 191685 - DNA, 601 bp, Human; identical to SEQ ID NO: 95214

SEQ ID NO: 191686 - DNA, 601 bp, Human; identical to SEQ ID NO: 95215

SEQ ID NO: 191687 - DNA, 601 bp, Human; identical to SEQ ID NO: 95216

SEQ ID NO: 191688 - DNA, 601 bp, Human; identical to SEQ ID NO: 95217

SEQ ID NO: 191689 - DNA, 601 bp, Human; identical to SEQ ID NO: 95218

SEQ ID NO: 191690 - DNA, 601 bp, Human; identical to SEQ ID NO: 95219

SEQ ID NO: 191691 - DNA, 601 bp, Human; identical to SEQ ID NO: 95220

SEQ ID NO: 191692 - DNA, 601 bp, Human; identical to SEQ ID NO: 95221

SEQ ID NO: 191693 - DNA, 601 bp, Human; identical to SEQ ID NO: 95222

SEQ ID NO: 191694 - DNA, 601 bp, Human; identical to SEQ ID NO: 95223

SEQ ID NO: 191695 - DNA, 601 bp, Human; identical to SEQ ID NO: 95224

SEQ ID NO: 191696 - DNA, 601 bp, Human; identical to SEQ ID NO: 95225

SEQ ID NO: 191697 - DNA, 601 bp, Human; identical to SEQ ID NO: 95226

SEQ ID NO: 191698 - DNA, 601 bp, Human; identical to SEQ ID NO: 95227

SEQ ID NO: 191699 - DNA, 601 bp, Human; identical to SEQ ID NO: 95228

SEQ ID NO: 191700 - DNA, 601 bp, Human; identical to SEQ ID NO: 95229

SEQ ID NO: 191701 - DNA, 601 bp, Human; identical to SEQ ID NO: 95230

SEQ ID NO: 191702 - DNA, 601 bp, Human; identical to SEQ ID NO: 95231

SEQ ID NO: 191703 - DNA, 601 bp, Human; identical to SEQ ID NO: 95232

SEQ ID NO: 191704 - DNA, 601 bp, Human; identical to SEQ ID NO: 95233

SEQ ID NO: 191705 - DNA, 601 bp, Human; identical to SEQ ID NO: 95234

SEQ ID NO: 191706 - DNA, 601 bp, Human; identical to SEQ ID NO: 95235

SEQ ID NO: 191707 - DNA, 601 bp, Human; identical to SEQ ID NO: 95236

SEQ ID NO: 191708 - DNA, 601 bp, Human; identical to SEQ ID NO: 95237

SEQ ID NO: 191709 - DNA, 601 bp, Human; identical to SEQ ID NO: 95238

SEQ ID NO: 191710 - DNA, 601 bp, Human; identical to SEQ ID NO: 95239

SEQ ID NO: 191711 - DNA, 601 bp, Human; identical to SEQ ID NO: 95240

SEQ ID NO: 191712 - DNA, 601 bp, Human; identical to SEQ ID NO: 95241

SEQ ID NO: 191713 - DNA, 601 bp, Human; identical to SEQ ID NO: 95242

SEQ ID NO: 191714 - DNA, 601 bp, Human; identical to SEQ ID NO: 95243

SEQ ID NO: 191715 - DNA, 601 bp, Human; identical to SEQ ID NO: 95244

SEQ ID NO: 191716 - DNA, 601 bp, Human; identical to SEQ ID NO: 95245

SEQ ID NO: 191717 - DNA, 601 bp, Human; identical to SEQ ID NO: 95246

SEQ ID NO: 191718 - DNA, 601 bp, Human; identical to SEQ ID NO: 95247

SEQ ID NO: 191719 - DNA, 601 bp, Human; identical to SEQ ID NO: 95248

SEQ ID NO: 191720 - DNA, 601 bp, Human; identical to SEQ ID NO: 95249

SEQ ID NO: 191721 - DNA, 601 bp, Human; identical to SEQ ID NO: 95250

SEQ ID NO: 191722 - DNA, 601 bp, Human; identical to SEQ ID NO: 95251

SEQ ID NO: 191723 - DNA, 601 bp, Human; identical to SEQ ID NO: 95252

SEQ ID NO: 191724 - DNA, 601 bp, Human; identical to SEQ ID NO: 95253

SEQ ID NO: 191725 - DNA, 601 bp, Human; identical to SEQ ID NO: 95254

SEQ ID NO: 191726 - DNA, 601 bp, Human; identical to SEQ ID NO: 95255

SEQ ID NO: 191727 - DNA, 601 bp, Human; identical to SEQ ID NO: 95256

SEQ ID NO: 191728 - DNA, 601 bp, Human; identical to SEQ ID NO: 95257

SEQ ID NO: 191729 - DNA, 601 bp, Human; identical to SEQ ID NO: 95258

SEQ ID NO: 191730 - DNA, 601 bp, Human; identical to SEQ ID NO: 95259

SEQ ID NO: 191731 - DNA, 601 bp, Human; identical to SEQ ID NO: 95260

SEQ ID NO: 191732 - DNA, 601 bp, Human; identical to SEQ ID NO: 95261

SEQ ID NO: 191733 - DNA, 601 bp, Human; identical to SEQ ID NO: 95262

SEQ ID NO: 191734 - DNA, 601 bp, Human; identical to SEQ ID NO: 95263

SEQ ID NO: 191735 - DNA, 601 bp, Human; identical to SEQ ID NO: 95264

SEQ ID NO: 191736 - DNA, 601 bp, Human; identical to SEQ ID NO: 95265

SEQ ID NO: 191737 - DNA, 601 bp, Human; identical to SEQ ID NO: 95266

SEQ ID NO: 191738 - DNA, 601 bp, Human; identical to SEQ ID NO: 95267

SEQ ID NO: 191739 - DNA, 601 bp, Human; identical to SEQ ID NO: 95268

SEQ ID NO: 191740 - DNA, 601 bp, Human; identical to SEQ ID NO: 95269

SEQ ID NO: 191741 - DNA, 601 bp, Human; identical to SEQ ID NO: 95270

SEQ ID NO: 191742 - DNA, 601 bp, Human; identical to SEQ ID NO: 95271

SEQ ID NO: 191743 - DNA, 601 bp, Human; identical to SEQ ID NO: 95272

SEQ ID NO: 191744 - DNA, 601 bp, Human; identical to SEQ ID NO: 95273

SEQ ID NO: 191745 - DNA, 601 bp, Human; identical to SEQ ID NO: 95274

SEQ ID NO: 191746 - DNA, 601 bp, Human; identical to SEQ ID NO: 95275

SEQ ID NO: 191747 - DNA, 601 bp, Human; identical to SEQ ID NO: 95276

SEQ ID NO: 191748 - DNA, 601 bp, Human; identical to SEQ ID NO: 95277

SEQ ID NO: 191749 - DNA, 601 bp, Human; identical to SEQ ID NO: 95278

SEQ ID NO: 191750 - DNA, 601 bp, Human; identical to SEQ ID NO: 95279

SEQ ID NO: 191751 - DNA, 601 bp, Human; identical to SEQ ID NO: 95280

SEQ ID NO: 191752 - DNA, 601 bp, Human; identical to SEQ ID NO: 95281

SEQ ID NO: 191753 - DNA, 601 bp, Human; identical to SEQ ID NO: 95282

SEQ ID NO: 191754 - DNA, 601 bp, Human; identical to SEQ ID NO: 95283

SEQ ID NO: 191755 - DNA, 601 bp, Human; identical to SEQ ID NO: 95284

SEQ ID NO: 191756 - DNA, 601 bp, Human; identical to SEQ ID NO: 95285

SEQ ID NO: 191757 - DNA, 601 bp, Human; identical to SEQ ID NO: 95286

SEQ ID NO: 191758 - DNA, 601 bp, Human; identical to SEQ ID NO: 95287

SEQ ID NO: 191759 - DNA, 601 bp, Human; identical to SEQ ID NO: 95288

SEQ ID NO: 191760 - DNA, 601 bp, Human; identical to SEQ ID NO: 95289

SEQ ID NO: 191761 - DNA, 601 bp, Human; identical to SEQ ID NO: 95290

SEQ ID NO: 191762 - DNA, 601 bp, Human; identical to SEQ ID NO: 95291

SEQ ID NO: 191763 - DNA, 601 bp, Human; identical to SEQ ID NO: 95292

SEQ ID NO: 191764 - DNA, 601 bp, Human; identical to SEQ ID NO: 95293

SEQ ID NO: 191765 - DNA, 601 bp, Human; identical to SEQ ID NO: 95294

SEQ ID NO: 191766 - DNA, 601 bp, Human; identical to SEQ ID NO: 95295

SEQ ID NO: 191767 - DNA, 601 bp, Human; identical to SEQ ID NO: 95296

SEQ ID NO: 191768 - DNA, 601 bp, Human; identical to SEQ ID NO: 95297

SEQ ID NO: 191769 - DNA, 601 bp, Human; identical to SEQ ID NO: 95298

SEQ ID NO: 191770 - DNA, 601 bp, Human; identical to SEQ ID NO: 95299

SEQ ID NO: 191771 - DNA, 601 bp, Human; identical to SEQ ID NO: 95300

SEQ ID NO: 191772 - DNA, 601 bp, Human; identical to SEQ ID NO: 95301

SEQ ID NO: 191773 - DNA, 601 bp, Human; identical to SEQ ID NO: 95302

SEQ ID NO: 191774 - DNA, 601 bp, Human; identical to SEQ ID NO: 95303

SEQ ID NO: 191775 - DNA, 601 bp, Human; identical to SEQ ID NO: 95304

SEQ ID NO: 191776 - DNA, 601 bp, Human; identical to SEQ ID NO: 95305

SEQ ID NO: 191777 - DNA, 601 bp, Human; identical to SEQ ID NO: 95306

SEQ ID NO: 191778 - DNA, 601 bp, Human; identical to SEQ ID NO: 95307

SEQ ID NO: 191779 - DNA, 601 bp, Human; identical to SEQ ID NO: 95308

SEQ ID NO: 191780 - DNA, 601 bp, Human; identical to SEQ ID NO: 95309

SEQ ID NO: 191781 - DNA, 601 bp, Human; identical to SEQ ID NO: 95310

SEQ ID NO: 191782 - DNA, 601 bp, Human; identical to SEQ ID NO: 95311

SEQ ID NO: 191783 - DNA, 601 bp, Human; identical to SEQ ID NO: 95312

SEQ ID NO: 191784 - DNA, 601 bp, Human; identical to SEQ ID NO: 95313

SEQ ID NO: 191785 - DNA, 601 bp, Human; identical to SEQ ID NO: 95314

SEQ ID NO: 191786 - DNA, 601 bp, Human; identical to SEQ ID NO: 95315

SEQ ID NO: 191787 - DNA, 601 bp, Human; identical to SEQ ID NO: 95316

SEQ ID NO: 191788 - DNA, 601 bp, Human; identical to SEQ ID NO: 95317

SEQ ID NO: 191789 - DNA, 601 bp, Human; identical to SEQ ID NO: 95318

SEQ ID NO: 191790 - DNA, 601 bp, Human; identical to SEQ ID NO: 95319

SEQ ID NO: 191791 - DNA, 601 bp, Human; identical to SEQ ID NO: 95320

SEQ ID NO: 191792 - DNA, 601 bp, Human; identical to SEQ ID NO: 95321

SEQ ID NO: 191793 - DNA, 601 bp, Human; identical to SEQ ID NO: 95322

SEQ ID NO: 191794 - DNA, 601 bp, Human; identical to SEQ ID NO: 95323

SEQ ID NO: 191795 - DNA, 601 bp, Human; identical to SEQ ID NO: 95324

SEQ ID NO: 191796 - DNA, 601 bp, Human; identical to SEQ ID NO: 95325

SEQ ID NO: 191797 - DNA, 601 bp, Human; identical to SEQ ID NO: 95326

SEQ ID NO: 191798 - DNA, 601 bp, Human; identical to SEQ ID NO: 95327

SEQ ID NO: 191799 - DNA, 601 bp, Human; identical to SEQ ID NO: 95328

SEQ ID NO: 191800 - DNA, 601 bp, Human; identical to SEQ ID NO: 95329

SEQ ID NO: 191801 - DNA, 601 bp, Human; identical to SEQ ID NO: 95330

SEQ ID NO: 191802 - DNA, 601 bp, Human; identical to SEQ ID NO: 95331

SEQ ID NO: 191803 - DNA, 601 bp, Human; identical to SEQ ID NO: 95332

SEQ ID NO: 191804 - DNA, 601 bp, Human; identical to SEQ ID NO: 95333

SEQ ID NO: 191805 - DNA, 601 bp, Human; identical to SEQ ID NO: 95334

SEQ ID NO: 191806 - DNA, 601 bp, Human; identical to SEQ ID NO: 95335

SEQ ID NO: 191807 - DNA, 601 bp, Human; identical to SEQ ID NO: 95336

SEQ ID NO: 191808 - DNA, 601 bp, Human; identical to SEQ ID NO: 95337

SEQ ID NO: 191809 - DNA, 601 bp, Human; identical to SEQ ID NO: 95338

SEQ ID NO: 191810 - DNA, 601 bp, Human; identical to SEQ ID NO: 95339

SEQ ID NO: 191811 - DNA, 601 bp, Human; identical to SEQ ID NO: 95340

SEQ ID NO: 191812 - DNA, 601 bp, Human; identical to SEQ ID NO: 95341

SEQ ID NO: 191813 - DNA, 601 bp, Human; identical to SEQ ID NO: 95342

SEQ ID NO: 191814 - DNA, 601 bp, Human; identical to SEQ ID NO: 95343

SEQ ID NO: 191815 - DNA, 601 bp, Human; identical to SEQ ID NO: 95344

SEQ ID NO: 191816 - DNA, 601 bp, Human; identical to SEQ ID NO: 95345

SEQ ID NO: 191817 - DNA, 601 bp, Human; identical to SEQ ID NO: 95346

SEQ ID NO: 191818 - DNA, 601 bp, Human; identical to SEQ ID NO: 95347

SEQ ID NO: 191819 - DNA, 601 bp, Human; identical to SEQ ID NO: 95348

SEQ ID NO: 191820 - DNA, 601 bp, Human; identical to SEQ ID NO: 95349

SEQ ID NO: 191821 - DNA, 601 bp, Human; identical to SEQ ID NO: 95350

SEQ ID NO: 191822 - DNA, 601 bp, Human; identical to SEQ ID NO: 95351

SEQ ID NO: 191823 - DNA, 601 bp, Human; identical to SEQ ID NO: 95352

SEQ ID NO: 191824 - DNA, 601 bp, Human; identical to SEQ ID NO: 95353

SEQ ID NO: 191825 - DNA, 601 bp, Human; identical to SEQ ID NO: 95354

SEQ ID NO: 191826 - DNA, 601 bp, Human; identical to SEQ ID NO: 95355

SEQ ID NO: 191827 - DNA, 601 bp, Human; identical to SEQ ID NO: 95356

SEQ ID NO: 191828 - DNA, 601 bp, Human; identical to SEQ ID NO: 95357

SEQ ID NO: 191829 - DNA, 601 bp, Human; identical to SEQ ID NO: 95358

SEQ ID NO: 191830 - DNA, 601 bp, Human; identical to SEQ ID NO: 95359

SEQ ID NO: 191831 - DNA, 601 bp, Human; identical to SEQ ID NO: 95360

SEQ ID NO: 191832 - DNA, 601 bp, Human; identical to SEQ ID NO: 95361

SEQ ID NO: 191833 - DNA, 601 bp, Human; identical to SEQ ID NO: 95362

SEQ ID NO: 191834 - DNA, 601 bp, Human; identical to SEQ ID NO: 95363

SEQ ID NO: 191835 - DNA, 601 bp, Human; identical to SEQ ID NO: 95364

SEQ ID NO: 191836 - DNA, 601 bp, Human; identical to SEQ ID NO: 95365

SEQ ID NO: 191837 - DNA, 601 bp, Human; identical to SEQ ID NO: 95366

SEQ ID NO: 191838 - DNA, 601 bp, Human; identical to SEQ ID NO: 95189

SEQ ID NO: 191839 - DNA, 601 bp, Human; identical to SEQ ID NO: 95190

SEQ ID NO: 191840 - DNA, 601 bp, Human; identical to SEQ ID NO: 95191

SEQ ID NO: 191841 - DNA, 601 bp, Human; identical to SEQ ID NO: 95192

SEQ ID NO: 191842 - DNA, 601 bp, Human; identical to SEQ ID NO: 95193

SEQ ID NO: 191843 - DNA, 601 bp, Human; identical to SEQ ID NO: 95194

SEQ ID NO: 191844 - DNA, 601 bp, Human; identical to SEQ ID NO: 95195

SEQ ID NO: 191845 - DNA, 601 bp, Human; identical to SEQ ID NO: 95196

SEQ ID NO: 191846 - DNA, 601 bp, Human; identical to SEQ ID NO: 95197

SEQ ID NO: 191847 - DNA, 601 bp, Human; identical to SEQ ID NO: 95198

SEQ ID NO: 191848 - DNA, 601 bp, Human; identical to SEQ ID NO: 95199

SEQ ID NO: 191849 - DNA, 601 bp, Human; identical to SEQ ID NO: 95200

SEQ ID NO: 191850 - DNA, 601 bp, Human; identical to SEQ ID NO: 95201

SEQ ID NO: 191851 - DNA, 601 bp, Human; identical to SEQ ID NO: 95202

SEQ ID NO: 191852 - DNA, 601 bp, Human; identical to SEQ ID NO: 95203

SEQ ID NO: 191853 - DNA, 601 bp, Human; identical to SEQ ID NO: 95204

SEQ ID NO: 191854 - DNA, 601 bp, Human; identical to SEQ ID NO: 95205

SEQ ID NO: 191855 - DNA, 601 bp, Human; identical to SEQ ID NO: 95206

SEQ ID NO: 191856 - DNA, 601 bp, Human; identical to SEQ ID NO: 95207

SEQ ID NO: 191857 - DNA, 601 bp, Human; identical to SEQ ID NO: 95208

SEQ ID NO: 191858 - DNA, 601 bp, Human; identical to SEQ ID NO: 95209

SEQ ID NO: 191859 - DNA, 601 bp, Human; identical to SEQ ID NO: 95210

SEQ ID NO: 191860 - DNA, 601 bp, Human; identical to SEQ ID NO: 95211

SEQ ID NO: 191861 - DNA, 601 bp, Human; identical to SEQ ID NO: 95212

SEQ ID NO: 191862 - DNA, 601 bp, Human; identical to SEQ ID NO: 95213

SEQ ID NO: 191863 - DNA, 601 bp, Human; identical to SEQ ID NO: 95214

SEQ ID NO: 191864 - DNA, 601 bp, Human; identical to SEQ ID NO: 95215

SEQ ID NO: 191865 - DNA, 601 bp, Human; identical to SEQ ID NO: 95216

SEQ ID NO: 191866 - DNA, 601 bp, Human; identical to SEQ ID NO: 95217

SEQ ID NO: 191867 - DNA, 601 bp, Human; identical to SEQ ID NO: 95218

SEQ ID NO: 191868 - DNA, 601 bp, Human; identical to SEQ ID NO: 95219

SEQ ID NO: 191869 - DNA, 601 bp, Human; identical to SEQ ID NO: 95220

SEQ ID NO: 191870 - DNA, 601 bp, Human; identical to SEQ ID NO: 95221

SEQ ID NO: 191871 - DNA, 601 bp, Human; identical to SEQ ID NO: 95222

SEQ ID NO: 191872 - DNA, 601 bp, Human; identical to SEQ ID NO: 95223

SEQ ID NO: 191873 - DNA, 601 bp, Human; identical to SEQ ID NO: 95224

SEQ ID NO: 191874 - DNA, 601 bp, Human; identical to SEQ ID NO: 95225

SEQ ID NO: 191875 - DNA, 601 bp, Human; identical to SEQ ID NO: 95226

SEQ ID NO: 191876 - DNA, 601 bp, Human; identical to SEQ ID NO: 95227

SEQ ID NO: 191877 - DNA, 601 bp, Human; identical to SEQ ID NO: 95228

SEQ ID NO: 191878 - DNA, 601 bp, Human; identical to SEQ ID NO: 95229

SEQ ID NO: 191879 - DNA, 601 bp, Human; identical to SEQ ID NO: 95230

SEQ ID NO: 191880 - DNA, 601 bp, Human; identical to SEQ ID NO: 95231

SEQ ID NO: 191881 - DNA, 601 bp, Human; identical to SEQ ID NO: 95232

SEQ ID NO: 191882 - DNA, 601 bp, Human; identical to SEQ ID NO: 95233

SEQ ID NO: 191883 - DNA, 601 bp, Human; identical to SEQ ID NO: 95234

SEQ ID NO: 191884 - DNA, 601 bp, Human; identical to SEQ ID NO: 95235

SEQ ID NO: 191885 - DNA, 601 bp, Human; identical to SEQ ID NO: 95236

SEQ ID NO: 191886 - DNA, 601 bp, Human; identical to SEQ ID NO: 95237

SEQ ID NO: 191887 - DNA, 601 bp, Human; identical to SEQ ID NO: 95238

SEQ ID NO: 191888 - DNA, 601 bp, Human; identical to SEQ ID NO: 95239

SEQ ID NO: 191889 - DNA, 601 bp, Human; identical to SEQ ID NO: 95240

SEQ ID NO: 191890 - DNA, 601 bp, Human; identical to SEQ ID NO: 95241

SEQ ID NO: 191891 - DNA, 601 bp, Human; identical to SEQ ID NO: 95242

SEQ ID NO: 191892 - DNA, 601 bp, Human; identical to SEQ ID NO: 95243

SEQ ID NO: 191893 - DNA, 601 bp, Human; identical to SEQ ID NO: 95244

SEQ ID NO: 191894 - DNA, 601 bp, Human; identical to SEQ ID NO: 95245

SEQ ID NO: 191895 - DNA, 601 bp, Human; identical to SEQ ID NO: 95246

SEQ ID NO: 191896 - DNA, 601 bp, Human; identical to SEQ ID NO: 95247

SEQ ID NO: 191897 - DNA, 601 bp, Human; identical to SEQ ID NO: 95248

SEQ ID NO: 191898 - DNA, 601 bp, Human; identical to SEQ ID NO: 95249

SEQ ID NO: 191899 - DNA, 601 bp, Human; identical to SEQ ID NO: 95250

SEQ ID NO: 191900 - DNA, 601 bp, Human; identical to SEQ ID NO: 95251

SEQ ID NO: 191901 - DNA, 601 bp, Human; identical to SEQ ID NO: 95252

SEQ ID NO: 191902 - DNA, 601 bp, Human; identical to SEQ ID NO: 95253

SEQ ID NO: 191903 - DNA, 601 bp, Human; identical to SEQ ID NO: 95254

SEQ ID NO: 191904 - DNA, 601 bp, Human; identical to SEQ ID NO: 95255

SEQ ID NO: 191905 - DNA, 601 bp, Human; identical to SEQ ID NO: 95256

SEQ ID NO: 191906 - DNA, 601 bp, Human; identical to SEQ ID NO: 95257

SEQ ID NO: 191907 - DNA, 601 bp, Human; identical to SEQ ID NO: 95258

SEQ ID NO: 191908 - DNA, 601 bp, Human; identical to SEQ ID NO: 95259

SEQ ID NO: 191909 - DNA, 601 bp, Human; identical to SEQ ID NO: 95260

SEQ ID NO: 191910 - DNA, 601 bp, Human; identical to SEQ ID NO: 95261

SEQ ID NO: 191911 - DNA, 601 bp, Human; identical to SEQ ID NO: 95262

SEQ ID NO: 191912 - DNA, 601 bp, Human; identical to SEQ ID NO: 95263

SEQ ID NO: 191913 - DNA, 601 bp, Human; identical to SEQ ID NO: 95264

SEQ ID NO: 191914 - DNA, 601 bp, Human; identical to SEQ ID NO: 95265

SEQ ID NO: 191915 - DNA, 601 bp, Human; identical to SEQ ID NO: 95266

SEQ ID NO: 191916 - DNA, 601 bp, Human; identical to SEQ ID NO: 95267

SEQ ID NO: 191917 - DNA, 601 bp, Human; identical to SEQ ID NO: 95268

SEQ ID NO: 191918 - DNA, 601 bp, Human; identical to SEQ ID NO: 95269

SEQ ID NO: 191919 - DNA, 601 bp, Human; identical to SEQ ID NO: 95270

SEQ ID NO: 191920 - DNA, 601 bp, Human; identical to SEQ ID NO: 95271

SEQ ID NO: 191921 - DNA, 601 bp, Human; identical to SEQ ID NO: 95272

SEQ ID NO: 191922 - DNA, 601 bp, Human; identical to SEQ ID NO: 95273

SEQ ID NO: 191923 - DNA, 601 bp, Human; identical to SEQ ID NO: 95274

SEQ ID NO: 191924 - DNA, 601 bp, Human; identical to SEQ ID NO: 95275

SEQ ID NO: 191925 - DNA, 601 bp, Human; identical to SEQ ID NO: 95276

SEQ ID NO: 191926 - DNA, 601 bp, Human; identical to SEQ ID NO: 95277

SEQ ID NO: 191927 - DNA, 601 bp, Human; identical to SEQ ID NO: 95278

SEQ ID NO: 191928 - DNA, 601 bp, Human; identical to SEQ ID NO: 95279

SEQ ID NO: 191929 - DNA, 601 bp, Human; identical to SEQ ID NO: 95280

SEQ ID NO: 191930 - DNA, 601 bp, Human; identical to SEQ ID NO: 95281

SEQ ID NO: 191931 - DNA, 601 bp, Human; identical to SEQ ID NO: 95282

SEQ ID NO: 191932 - DNA, 601 bp, Human; identical to SEQ ID NO: 95283

SEQ ID NO: 191933 - DNA, 601 bp, Human; identical to SEQ ID NO: 95284

SEQ ID NO: 191934 - DNA, 601 bp, Human; identical to SEQ ID NO: 95285

SEQ ID NO: 191935 - DNA, 601 bp, Human; identical to SEQ ID NO: 95286

SEQ ID NO: 191936 - DNA, 601 bp, Human; identical to SEQ ID NO: 95287

SEQ ID NO: 191937 - DNA, 601 bp, Human; identical to SEQ ID NO: 95288

SEQ ID NO: 191938 - DNA, 601 bp, Human; identical to SEQ ID NO: 95289

SEQ ID NO: 191939 - DNA, 601 bp, Human; identical to SEQ ID NO: 95290

SEQ ID NO: 191940 - DNA, 601 bp, Human; identical to SEQ ID NO: 95291

SEQ ID NO: 191941 - DNA, 601 bp, Human; identical to SEQ ID NO: 95292

SEQ ID NO: 191942 - DNA, 601 bp, Human; identical to SEQ ID NO: 95293

SEQ ID NO: 191943 - DNA, 601 bp, Human; identical to SEQ ID NO: 95294

SEQ ID NO: 191944 - DNA, 601 bp, Human; identical to SEQ ID NO: 95295

SEQ ID NO: 191945 - DNA, 601 bp, Human; identical to SEQ ID NO: 95296

SEQ ID NO: 191946 - DNA, 601 bp, Human; identical to SEQ ID NO: 95297

SEQ ID NO: 191947 - DNA, 601 bp, Human; identical to SEQ ID NO: 95298

SEQ ID NO: 191948 - DNA, 601 bp, Human; identical to SEQ ID NO: 95299

SEQ ID NO: 191949 - DNA, 601 bp, Human; identical to SEQ ID NO: 95300

SEQ ID NO: 191950 - DNA, 601 bp, Human; identical to SEQ ID NO: 95301

SEQ ID NO: 191951 - DNA, 601 bp, Human; identical to SEQ ID NO: 95302

SEQ ID NO: 191952 - DNA, 601 bp, Human; identical to SEQ ID NO: 95303

SEQ ID NO: 191953 - DNA, 601 bp, Human; identical to SEQ ID NO: 95304

SEQ ID NO: 191954 - DNA, 601 bp, Human; identical to SEQ ID NO: 95305

SEQ ID NO: 191955 - DNA, 601 bp, Human; identical to SEQ ID NO: 95306

SEQ ID NO: 191956 - DNA, 601 bp, Human; identical to SEQ ID NO: 95307

SEQ ID NO: 191957 - DNA, 601 bp, Human; identical to SEQ ID NO: 95308

SEQ ID NO: 191958 - DNA, 601 bp, Human; identical to SEQ ID NO: 95309

SEQ ID NO: 191959 - DNA, 601 bp, Human; identical to SEQ ID NO: 95310

SEQ ID NO: 191960 - DNA, 601 bp, Human; identical to SEQ ID NO: 95311

SEQ ID NO: 191961 - DNA, 601 bp, Human; identical to SEQ ID NO: 95312

SEQ ID NO: 191962 - DNA, 601 bp, Human; identical to SEQ ID NO: 95313

SEQ ID NO: 191963 - DNA, 601 bp, Human; identical to SEQ ID NO: 95314

SEQ ID NO: 191964 - DNA, 601 bp, Human; identical to SEQ ID NO: 95315

SEQ ID NO: 191965 - DNA, 601 bp, Human; identical to SEQ ID NO: 95316

SEQ ID NO: 191966 - DNA, 601 bp, Human; identical to SEQ ID NO: 95317

SEQ ID NO: 191967 - DNA, 601 bp, Human; identical to SEQ ID NO: 95318

SEQ ID NO: 191968 - DNA, 601 bp, Human; identical to SEQ ID NO: 95319

SEQ ID NO: 191969 - DNA, 601 bp, Human; identical to SEQ ID NO: 95320

SEQ ID NO: 191970 - DNA, 601 bp, Human; identical to SEQ ID NO: 95321

SEQ ID NO: 191971 - DNA, 601 bp, Human; identical to SEQ ID NO: 95322

SEQ ID NO: 191972 - DNA, 601 bp, Human; identical to SEQ ID NO: 95323

SEQ ID NO: 191973 - DNA, 601 bp, Human; identical to SEQ ID NO: 95324

SEQ ID NO: 191974 - DNA, 601 bp, Human; identical to SEQ ID NO: 95325

SEQ ID NO: 191975 - DNA, 601 bp, Human; identical to SEQ ID NO: 95326

SEQ ID NO: 191976 - DNA, 601 bp, Human; identical to SEQ ID NO: 95327

SEQ ID NO: 191977 - DNA, 601 bp, Human; identical to SEQ ID NO: 95328

SEQ ID NO: 191978 - DNA, 601 bp, Human; identical to SEQ ID NO: 95329

SEQ ID NO: 191979 - DNA, 601 bp, Human; identical to SEQ ID NO: 95330

SEQ ID NO: 191980 - DNA, 601 bp, Human; identical to SEQ ID NO: 95331

SEQ ID NO: 191981 - DNA, 601 bp, Human; identical to SEQ ID NO: 95332

SEQ ID NO: 191982 - DNA, 601 bp, Human; identical to SEQ ID NO: 95333

SEQ ID NO: 191983 - DNA, 601 bp, Human; identical to SEQ ID NO: 95334

SEQ ID NO: 191984 - DNA, 601 bp, Human; identical to SEQ ID NO: 95335

SEQ ID NO: 191985 - DNA, 601 bp, Human; identical to SEQ ID NO: 95336

SEQ ID NO: 191986 - DNA, 601 bp, Human; identical to SEQ ID NO: 95337

SEQ ID NO: 191987 - DNA, 601 bp, Human; identical to SEQ ID NO: 95338

SEQ ID NO: 191988 - DNA, 601 bp, Human; identical to SEQ ID NO: 95339

SEQ ID NO: 191989 - DNA, 601 bp, Human; identical to SEQ ID NO: 95340

SEQ ID NO: 191990 - DNA, 601 bp, Human; identical to SEQ ID NO: 95341

SEQ ID NO: 191991 - DNA, 601 bp, Human; identical to SEQ ID NO: 95342

SEQ ID NO: 191992 - DNA, 601 bp, Human; identical to SEQ ID NO: 95343

SEQ ID NO: 191993 - DNA, 601 bp, Human; identical to SEQ ID NO: 95344

SEQ ID NO: 191994 - DNA, 601 bp, Human; identical to SEQ ID NO: 95345

SEQ ID NO: 191995 - DNA, 601 bp, Human; identical to SEQ ID NO: 95346

SEQ ID NO: 191996 - DNA, 601 bp, Human; identical to SEQ ID NO: 95347

SEQ ID NO: 191997 - DNA, 601 bp, Human; identical to SEQ ID NO: 95348

SEQ ID NO: 191998 - DNA, 601 bp, Human; identical to SEQ ID NO: 95349

SEQ ID NO: 191999 - DNA, 601 bp, Human; identical to SEQ ID NO: 95350

SEQ ID NO: 192000 - DNA, 601 bp, Human; identical to SEQ ID NO: 95351

SEQ ID NO: 192001 - DNA, 601 bp, Human; identical to SEQ ID NO: 95352

SEQ ID NO: 192002 - DNA, 601 bp, Human; identical to SEQ ID NO: 95353

SEQ ID NO: 192003 - DNA, 601 bp, Human; identical to SEQ ID NO: 95354

SEQ ID NO: 192004 - DNA, 601 bp, Human; identical to SEQ ID NO: 95355

SEQ ID NO: 192005 - DNA, 601 bp, Human; identical to SEQ ID NO: 95356

SEQ ID NO: 192006 - DNA, 601 bp, Human; identical to SEQ ID NO: 95357

SEQ ID NO: 192007 - DNA, 601 bp, Human; identical to SEQ ID NO: 95358

SEQ ID NO: 192008 - DNA, 601 bp, Human; identical to SEQ ID NO: 95359

SEQ ID NO: 192009 - DNA, 601 bp, Human; identical to SEQ ID NO: 95360

SEQ ID NO: 192010 - DNA, 601 bp, Human; identical to SEQ ID NO: 95361

SEQ ID NO: 192011 - DNA, 601 bp, Human; identical to SEQ ID NO: 95362

SEQ ID NO: 192012 - DNA, 601 bp, Human; identical to SEQ ID NO: 95363

SEQ ID NO: 192013 - DNA, 601 bp, Human; identical to SEQ ID NO: 95364

SEQ ID NO: 192014 - DNA, 601 bp, Human; identical to SEQ ID NO: 95365

SEQ ID NO: 192015 - DNA, 601 bp, Human; identical to SEQ ID NO: 95366

SEQ ID NO: 192016 - DNA, 601 bp, Human; identical to SEQ ID NO: 95189

SEQ ID NO: 192017 - DNA, 601 bp, Human; identical to SEQ ID NO: 95190

SEQ ID NO: 192018 - DNA, 601 bp, Human; identical to SEQ ID NO: 95191

SEQ ID NO: 192019 - DNA, 601 bp, Human; identical to SEQ ID NO: 95192

SEQ ID NO: 192020 - DNA, 601 bp, Human; identical to SEQ ID NO: 95193

SEQ ID NO: 192021 - DNA, 601 bp, Human; identical to SEQ ID NO: 95194

SEQ ID NO: 192022 - DNA, 601 bp, Human; identical to SEQ ID NO: 95195

SEQ ID NO: 192023 - DNA, 601 bp, Human; identical to SEQ ID NO: 95196

SEQ ID NO: 192024 - DNA, 601 bp, Human; identical to SEQ ID NO: 95197

SEQ ID NO: 192025 - DNA, 601 bp, Human; identical to SEQ ID NO: 95198

SEQ ID NO: 192026 - DNA, 601 bp, Human; identical to SEQ ID NO: 95199

SEQ ID NO: 192027 - DNA, 601 bp, Human; identical to SEQ ID NO: 95200

SEQ ID NO: 192028 - DNA, 601 bp, Human; identical to SEQ ID NO: 95201

SEQ ID NO: 192029 - DNA, 601 bp, Human; identical to SEQ ID NO: 95202

SEQ ID NO: 192030 - DNA, 601 bp, Human; identical to SEQ ID NO: 95203

SEQ ID NO: 192031 - DNA, 601 bp, Human; identical to SEQ ID NO: 95204

SEQ ID NO: 192032 - DNA, 601 bp, Human; identical to SEQ ID NO: 95205

SEQ ID NO: 192033 - DNA, 601 bp, Human; identical to SEQ ID NO: 95206

SEQ ID NO: 192034 - DNA, 601 bp, Human; identical to SEQ ID NO: 95207

SEQ ID NO: 192035 - DNA, 601 bp, Human; identical to SEQ ID NO: 95208

SEQ ID NO: 192036 - DNA, 601 bp, Human; identical to SEQ ID NO: 95209

SEQ ID NO: 192037 - DNA, 601 bp, Human; identical to SEQ ID NO: 95210

SEQ ID NO: 192038 - DNA, 601 bp, Human; identical to SEQ ID NO: 95211

SEQ ID NO: 192039 - DNA, 601 bp, Human; identical to SEQ ID NO: 95212

SEQ ID NO: 192040 - DNA, 601 bp, Human; identical to SEQ ID NO: 95213

SEQ ID NO: 192041 - DNA, 601 bp, Human; identical to SEQ ID NO: 95214

SEQ ID NO: 192042 - DNA, 601 bp, Human; identical to SEQ ID NO: 95215

SEQ ID NO: 192043 - DNA, 601 bp, Human; identical to SEQ ID NO: 95216

SEQ ID NO: 192044 - DNA, 601 bp, Human; identical to SEQ ID NO: 95217

SEQ ID NO: 192045 - DNA, 601 bp, Human; identical to SEQ ID NO: 95218

SEQ ID NO: 192046 - DNA, 601 bp, Human; identical to SEQ ID NO: 95219

SEQ ID NO: 192047 - DNA, 601 bp, Human; identical to SEQ ID NO: 95220

SEQ ID NO: 192048 - DNA, 601 bp, Human; identical to SEQ ID NO: 95221

SEQ ID NO: 192049 - DNA, 601 bp, Human; identical to SEQ ID NO: 95222

SEQ ID NO: 192050 - DNA, 601 bp, Human; identical to SEQ ID NO: 95223

SEQ ID NO: 192051 - DNA, 601 bp, Human; identical to SEQ ID NO: 95224

SEQ ID NO: 192052 - DNA, 601 bp, Human; identical to SEQ ID NO: 95225

SEQ ID NO: 192053 - DNA, 601 bp, Human; identical to SEQ ID NO: 95226

SEQ ID NO: 192054 - DNA, 601 bp, Human; identical to SEQ ID NO: 95227

SEQ ID NO: 192055 - DNA, 601 bp, Human; identical to SEQ ID NO: 95228

SEQ ID NO: 192056 - DNA, 601 bp, Human; identical to SEQ ID NO: 95229

SEQ ID NO: 192057 - DNA, 601 bp, Human; identical to SEQ ID NO: 95230

SEQ ID NO: 192058 - DNA, 601 bp, Human; identical to SEQ ID NO: 95231

SEQ ID NO: 192059 - DNA, 601 bp, Human; identical to SEQ ID NO: 95232

SEQ ID NO: 192060 - DNA, 601 bp, Human; identical to SEQ ID NO: 95233

SEQ ID NO: 192061 - DNA, 601 bp, Human; identical to SEQ ID NO: 95234

SEQ ID NO: 192062 - DNA, 601 bp, Human; identical to SEQ ID NO: 95235

SEQ ID NO: 192063 - DNA, 601 bp, Human; identical to SEQ ID NO: 95236

SEQ ID NO: 192064 - DNA, 601 bp, Human; identical to SEQ ID NO: 95237

SEQ ID NO: 192065 - DNA, 601 bp, Human; identical to SEQ ID NO: 95238

SEQ ID NO: 192066 - DNA, 601 bp, Human; identical to SEQ ID NO: 95239

SEQ ID NO: 192067 - DNA, 601 bp, Human; identical to SEQ ID NO: 95240

SEQ ID NO: 192068 - DNA, 601 bp, Human; identical to SEQ ID NO: 95241

SEQ ID NO: 192069 - DNA, 601 bp, Human; identical to SEQ ID NO: 95242

SEQ ID NO: 192070 - DNA, 601 bp, Human; identical to SEQ ID NO: 95243

SEQ ID NO: 192071 - DNA, 601 bp, Human; identical to SEQ ID NO: 95244

SEQ ID NO: 192072 - DNA, 601 bp, Human; identical to SEQ ID NO: 95245

SEQ ID NO: 192073 - DNA, 601 bp, Human; identical to SEQ ID NO: 95246

SEQ ID NO: 192074 - DNA, 601 bp, Human; identical to SEQ ID NO: 95247

SEQ ID NO: 192075 - DNA, 601 bp, Human; identical to SEQ ID NO: 95248

SEQ ID NO: 192076 - DNA, 601 bp, Human; identical to SEQ ID NO: 95249

SEQ ID NO: 192077 - DNA, 601 bp, Human; identical to SEQ ID NO: 95250

SEQ ID NO: 192078 - DNA, 601 bp, Human; identical to SEQ ID NO: 95251

SEQ ID NO: 192079 - DNA, 601 bp, Human; identical to SEQ ID NO: 95252

SEQ ID NO: 192080 - DNA, 601 bp, Human; identical to SEQ ID NO: 95253

SEQ ID NO: 192081 - DNA, 601 bp, Human; identical to SEQ ID NO: 95254

SEQ ID NO: 192082 - DNA, 601 bp, Human; identical to SEQ ID NO: 95255

SEQ ID NO: 192083 - DNA, 601 bp, Human; identical to SEQ ID NO: 95256

SEQ ID NO: 192084 - DNA, 601 bp, Human; identical to SEQ ID NO: 95257

SEQ ID NO: 192085 - DNA, 601 bp, Human; identical to SEQ ID NO: 95258

SEQ ID NO: 192086 - DNA, 601 bp, Human; identical to SEQ ID NO: 95259

SEQ ID NO: 192087 - DNA, 601 bp, Human; identical to SEQ ID NO: 95260

SEQ ID NO: 192088 - DNA, 601 bp, Human; identical to SEQ ID NO: 95261

SEQ ID NO: 192089 - DNA, 601 bp, Human; identical to SEQ ID NO: 95262

SEQ ID NO: 192090 - DNA, 601 bp, Human; identical to SEQ ID NO: 95263

SEQ ID NO: 192091 - DNA, 601 bp, Human; identical to SEQ ID NO: 95264

SEQ ID NO: 192092 - DNA, 601 bp, Human; identical to SEQ ID NO: 95265

SEQ ID NO: 192093 - DNA, 601 bp, Human; identical to SEQ ID NO: 95266

SEQ ID NO: 192094 - DNA, 601 bp, Human; identical to SEQ ID NO: 95267

SEQ ID NO: 192095 - DNA, 601 bp, Human; identical to SEQ ID NO: 95268

SEQ ID NO: 192096 - DNA, 601 bp, Human; identical to SEQ ID NO: 95269

SEQ ID NO: 192097 - DNA, 601 bp, Human; identical to SEQ ID NO: 95270

SEQ ID NO: 192098 - DNA, 601 bp, Human; identical to SEQ ID NO: 95271

SEQ ID NO: 192099 - DNA, 601 bp, Human; identical to SEQ ID NO: 95272

SEQ ID NO: 192100 - DNA, 601 bp, Human; identical to SEQ ID NO: 95273

SEQ ID NO: 192101 - DNA, 601 bp, Human; identical to SEQ ID NO: 95274

SEQ ID NO: 192102 - DNA, 601 bp, Human; identical to SEQ ID NO: 95275

SEQ ID NO: 192103 - DNA, 601 bp, Human; identical to SEQ ID NO: 95276

SEQ ID NO: 192104 - DNA, 601 bp, Human; identical to SEQ ID NO: 95277

SEQ ID NO: 192105 - DNA, 601 bp, Human; identical to SEQ ID NO: 95278

SEQ ID NO: 192106 - DNA, 601 bp, Human; identical to SEQ ID NO: 95279

SEQ ID NO: 192107 - DNA, 601 bp, Human; identical to SEQ ID NO: 95280

SEQ ID NO: 192108 - DNA, 601 bp, Human; identical to SEQ ID NO: 95281

SEQ ID NO: 192109 - DNA, 601 bp, Human; identical to SEQ ID NO: 95282

SEQ ID NO: 192110 - DNA, 601 bp, Human; identical to SEQ ID NO: 95283

SEQ ID NO: 192111 - DNA, 601 bp, Human; identical to SEQ ID NO: 95284

SEQ ID NO: 192112 - DNA, 601 bp, Human; identical to SEQ ID NO: 95285

SEQ ID NO: 192113 - DNA, 601 bp, Human; identical to SEQ ID NO: 95286

SEQ ID NO: 192114 - DNA, 601 bp, Human; identical to SEQ ID NO: 95287

SEQ ID NO: 192115 - DNA, 601 bp, Human; identical to SEQ ID NO: 95288

SEQ ID NO: 192116 - DNA, 601 bp, Human; identical to SEQ ID NO: 95289

SEQ ID NO: 192117 - DNA, 601 bp, Human; identical to SEQ ID NO: 95290

SEQ ID NO: 192118 - DNA, 601 bp, Human; identical to SEQ ID NO: 95291

SEQ ID NO: 192119 - DNA, 601 bp, Human; identical to SEQ ID NO: 95292

SEQ ID NO: 192120 - DNA, 601 bp, Human; identical to SEQ ID NO: 95293

SEQ ID NO: 192121 - DNA, 601 bp, Human; identical to SEQ ID NO: 95294

SEQ ID NO: 192122 - DNA, 601 bp, Human; identical to SEQ ID NO: 95295

SEQ ID NO: 192123 - DNA, 601 bp, Human; identical to SEQ ID NO: 95296

SEQ ID NO: 192124 - DNA, 601 bp, Human; identical to SEQ ID NO: 95297

SEQ ID NO: 192125 - DNA, 601 bp, Human; identical to SEQ ID NO: 95298

SEQ ID NO: 192126 - DNA, 601 bp, Human; identical to SEQ ID NO: 95299

SEQ ID NO: 192127 - DNA, 601 bp, Human; identical to SEQ ID NO: 95300

SEQ ID NO: 192128 - DNA, 601 bp, Human; identical to SEQ ID NO: 95301

SEQ ID NO: 192129 - DNA, 601 bp, Human; identical to SEQ ID NO: 95302

SEQ ID NO: 192130 - DNA, 601 bp, Human; identical to SEQ ID NO: 95303

SEQ ID NO: 192131 - DNA, 601 bp, Human; identical to SEQ ID NO: 95304

SEQ ID NO: 192132 - DNA, 601 bp, Human; identical to SEQ ID NO: 95305

SEQ ID NO: 192133 - DNA, 601 bp, Human; identical to SEQ ID NO: 95306

SEQ ID NO: 192134 - DNA, 601 bp, Human; identical to SEQ ID NO: 95307

SEQ ID NO: 192135 - DNA, 601 bp, Human; identical to SEQ ID NO: 95308

SEQ ID NO: 192136 - DNA, 601 bp, Human; identical to SEQ ID NO: 95309

SEQ ID NO: 192137 - DNA, 601 bp, Human; identical to SEQ ID NO: 95310

SEQ ID NO: 192138 - DNA, 601 bp, Human; identical to SEQ ID NO: 95311

SEQ ID NO: 192139 - DNA, 601 bp, Human; identical to SEQ ID NO: 95312

SEQ ID NO: 192140 - DNA, 601 bp, Human; identical to SEQ ID NO: 95313

SEQ ID NO: 192141 - DNA, 601 bp, Human; identical to SEQ ID NO: 95314

SEQ ID NO: 192142 - DNA, 601 bp, Human; identical to SEQ ID NO: 95315

SEQ ID NO: 192143 - DNA, 601 bp, Human; identical to SEQ ID NO: 95316

SEQ ID NO: 192144 - DNA, 601 bp, Human; identical to SEQ ID NO: 95317

SEQ ID NO: 192145 - DNA, 601 bp, Human; identical to SEQ ID NO: 95318

SEQ ID NO: 192146 - DNA, 601 bp, Human; identical to SEQ ID NO: 95319

SEQ ID NO: 192147 - DNA, 601 bp, Human; identical to SEQ ID NO: 95320

SEQ ID NO: 192148 - DNA, 601 bp, Human; identical to SEQ ID NO: 95321

SEQ ID NO: 192149 - DNA, 601 bp, Human; identical to SEQ ID NO: 95322

SEQ ID NO: 192150 - DNA, 601 bp, Human; identical to SEQ ID NO: 95323

SEQ ID NO: 192151 - DNA, 601 bp, Human; identical to SEQ ID NO: 95324

SEQ ID NO: 192152 - DNA, 601 bp, Human; identical to SEQ ID NO: 95325

SEQ ID NO: 192153 - DNA, 601 bp, Human; identical to SEQ ID NO: 95326

SEQ ID NO: 192154 - DNA, 601 bp, Human; identical to SEQ ID NO: 95327

SEQ ID NO: 192155 - DNA, 601 bp, Human; identical to SEQ ID NO: 95328

SEQ ID NO: 192156 - DNA, 601 bp, Human; identical to SEQ ID NO: 95329

SEQ ID NO: 192157 - DNA, 601 bp, Human; identical to SEQ ID NO: 95330

SEQ ID NO: 192158 - DNA, 601 bp, Human; identical to SEQ ID NO: 95331

SEQ ID NO: 192159 - DNA, 601 bp, Human; identical to SEQ ID NO: 95332

SEQ ID NO: 192160 - DNA, 601 bp, Human; identical to SEQ ID NO: 95333

SEQ ID NO: 192161 - DNA, 601 bp, Human; identical to SEQ ID NO: 95334

SEQ ID NO: 192162 - DNA, 601 bp, Human; identical to SEQ ID NO: 95335

SEQ ID NO: 192163 - DNA, 601 bp, Human; identical to SEQ ID NO: 95336

SEQ ID NO: 192164 - DNA, 601 bp, Human; identical to SEQ ID NO: 95337

SEQ ID NO: 192165 - DNA, 601 bp, Human; identical to SEQ ID NO: 95338

SEQ ID NO: 192166 - DNA, 601 bp, Human; identical to SEQ ID NO: 95339

SEQ ID NO: 192167 - DNA, 601 bp, Human; identical to SEQ ID NO: 95340

SEQ ID NO: 192168 - DNA, 601 bp, Human; identical to SEQ ID NO: 95341

SEQ ID NO: 192169 - DNA, 601 bp, Human; identical to SEQ ID NO: 95342

SEQ ID NO: 192170 - DNA, 601 bp, Human; identical to SEQ ID NO: 95343

SEQ ID NO: 192171 - DNA, 601 bp, Human; identical to SEQ ID NO: 95344

SEQ ID NO: 192172 - DNA, 601 bp, Human; identical to SEQ ID NO: 95345

SEQ ID NO: 192173 - DNA, 601 bp, Human; identical to SEQ ID NO: 95346

SEQ ID NO: 192174 - DNA, 601 bp, Human; identical to SEQ ID NO: 95347

SEQ ID NO: 192175 - DNA, 601 bp, Human; identical to SEQ ID NO: 95348

SEQ ID NO: 192176 - DNA, 601 bp, Human; identical to SEQ ID NO: 95349

SEQ ID NO: 192177 - DNA, 601 bp, Human; identical to SEQ ID NO: 95350

SEQ ID NO: 192178 - DNA, 601 bp, Human; identical to SEQ ID NO: 95351

SEQ ID NO: 192179 - DNA, 601 bp, Human; identical to SEQ ID NO: 95352

SEQ ID NO: 192180 - DNA, 601 bp, Human; identical to SEQ ID NO: 95353

SEQ ID NO: 192181 - DNA, 601 bp, Human; identical to SEQ ID NO: 95354

SEQ ID NO: 192182 - DNA, 601 bp, Human; identical to SEQ ID NO: 95355

SEQ ID NO: 192183 - DNA, 601 bp, Human; identical to SEQ ID NO: 95356

SEQ ID NO: 192184 - DNA, 601 bp, Human; identical to SEQ ID NO: 95357

SEQ ID NO: 192185 - DNA, 601 bp, Human; identical to SEQ ID NO: 95358

SEQ ID NO: 192186 - DNA, 601 bp, Human; identical to SEQ ID NO: 95359

SEQ ID NO: 192187 - DNA, 601 bp, Human; identical to SEQ ID NO: 95360

SEQ ID NO: 192188 - DNA, 601 bp, Human; identical to SEQ ID NO: 95361

SEQ ID NO: 192189 - DNA, 601 bp, Human; identical to SEQ ID NO: 95362

SEQ ID NO: 192190 - DNA, 601 bp, Human; identical to SEQ ID NO: 95363

SEQ ID NO: 192191 - DNA, 601 bp, Human; identical to SEQ ID NO: 95364

SEQ ID NO: 192192 - DNA, 601 bp, Human; identical to SEQ ID NO: 95365

SEQ ID NO: 192193 - DNA, 601 bp, Human; identical to SEQ ID NO: 95366

SEQ ID NO: 192194 - DNA, 601 bp, Human
ataacccagatactccatttagatagagtacagtggtttttcactatcaaaaggatattatgtgaaaatgctctaaaaacaacagttttgtacgagatgatgttaagaataaaaatataacatcgttggtaacatgagaaaattgatgcacatcaaatgtggagcatccaaagtgtctatttttccagtaagtttaaacatcttttgctctggtgcactatttgcctaataaagtgtttcagaaagtgggataaaagtgggaccattgttcataaggctgtcagaacttcatggcacgcaygtgtttgccataatttgcttccagtttgactacagatccttacttttgattatgctgacatttttacaggtaagtaaatctgaaataactggaactttctctaacaaaaaaatgacaactcactgagaatgaaatatgtaaatgtttaattttaacaagcagttacaaatcgtaacagacaagaactcttggatctaagagaccaaaatgtaatttcttacataacagacaaagttacaagttataatcgttcactaattacagtgaaattccggactttgacacatcaatcaatagatg

SEQ ID NO: 192195 - DNA, 601 bp, Human
atatttattgagtgtgtacataaattctcttgtctgcgttaagccctttttggtataaggcagataagggaactataacccagatactccatttagatagagtacagtggtttttcactatcaaaaggatattatgtgaaaatgctctaaaaacaacagttttgtacgagatgatgttaagaataaaaatataacatcgttggtaacatgagaaaattgatgcacatcaaatgtggagcatccaaagtgtctatttttccagtaagtttaaacatcttttgctctggtgcactatttgccwaataaagtgtttcagaaagtgggataaaagtgggaccattgttcataaggctgtcagaacttcatggcacgcatgtgtttgccataatttgcttccagtttgactacagatccttacttttgattatgctgacatttttacaggtaagtaaatctgaaataactggaactttctctaacaaaaaaatgacaactcactgagaatgaaatatgtaaatgtttaattttaacaagcagttacaaatcgtaacagacaagaactcttggatctaagagaccaaaatgtaatttcttacataac

SEQ ID NO: 192196 - DNA, 601 bp, Human
aactatattttttgttgttaatggtcagctcactcaccagaacacaacctagtgtaaagatgctgtctttctcgctgtcagttgagtatacagaggctagcactgtgtctggcttataatagatgttctaaggatatttattgagtgtgtacataaattctcttgtctgcgttaagccctttttggtataaggcagataagggaactataacccagatactccatttagatagagtacagtggtttttcactatcaaaaggatattatgtgaaaatgctctaaaaacaacagttttgtacsagatgatgttaagaataaaaatataacatcgttggtaacatgagaaaattgatgcacatcaaatgtggagcatccaaagtgtctatttttccagtaagtttaaacatcttttgctctggtgcactatttgcctaataaagtgtttcagaaagtgggataaaagtgggaccattgttcataaggctgtcagaacttcatggcacgcatgtgtttgccataatttgcttccagtttgactacagatccttacttttgattatgctgacatttttacaggtaagtaaatctgaaataactgga

SEQ ID NO: 192197 - DNA, 601 bp, Human
aaaaaaagaaaagaaaaaaaaggtggtaaaagcaaaatactacaatcagcccagtgcacacctgcaatgacagataatgaagaagttgacacgagagtgaagaagattcagactaaagcacagagaggcttgggaagattttcttatctgacataaagagggaaaatacattggtccaatcactgttatttccatatcatttggtctccatggataccacctaactttccttctgacaggaaaaaattcactgacaatatcggattccactgtgaaatttttttgatactttatataaaaattattccatgtttaatcttttatcattatttatatatgctcagaagtaaaatccctccttgctggaaattctatgagaaagatagtgtctaatccagtcatgattatctggcctttttacactaagaataatctgatataattttgaaagttaatgccttacacatttgtagactgccataatttatgcaatgttctttcatatacagtatctcaattgttcatgaaagcaacacttacgagatatagttaaaaattattattatcctccttacagctaaccccaaaaggtaataactat

SEQ ID NO: 192198 - DNA, 601 bp, Human
cggcgcagtggctcatgcctgtaatcccagaacttcagaaggctgaggtgggcagatcacctgaggtcaggagttcgagacaagcctggccagcatgctgaaaccccgtctctactaaaaatacaaaaattagccaggcatggtagcgcacgcctgcgcacacctgtagtcccaactactcgggaagctgaagcacaggaattgcttgaacctggaagcagaggttgcggtgagctgaaagtgtgccactgtacaccagtctgggcaacagagcaagactctgcctcaaaaaaaaaaaaaraaaagaaaaaaaaggtggtaaaagcaaaatactacaatcagcccagtgcacacctgcaatgacagataatgaagaagttgacacgagagtgaagaagattcagactaaagcacagagaggcttgggaagattttcttatctgacataaagagggaaaatacattggtccaatcactgttatttccatatcatttggtctccatggataccacctaactttccttctgacaggaaaaaattcactgacaatatcggattccactgtgaaatttttttgatactttatataaaagttattcc

SEQ ID NO: 192199 - DNA, 601 bp, Human
agttaatatttactttcatgtatgttgtcacatatacagtgttgggcacacagtaagcattcaataaatgcacatgagccaagatggtaaagcaggccggcgcagtggctcatgcctgtaatcccagaacttcagaaggctgaggtgggcagatcacctgaggtcaggagttcgagacaagcctggccagcatgctgaaaccccgtctctactaaaaatacaaaaattagccaggcatggtagcgcacgcctgcgcacacctgtagtcccaactactcgggaagctgaagcacaggaattkcttgaacctggaagcagaggttgcggtgagctgaaagtgtgccactgtacaccagtctgggcaacagagcaagactctgcctcaaaaaaaaaaaaagaaaagaaaaaaaaggtggtaaaagcaaaatactacaatcagcccagtgcacacctgcaatgacagataatgaagaagttgacacgagagtgaagaagattcagactaaagcacagagaggcttgggaagattttcttatctgacataaagagggaaaatacattggtccaatcactgttatttccatatcatttggtctccat

SEQ ID NO: 192200 - DNA, 601 bp, Human
tgctatcagttaatatttactttcatgtatgttgtcacatatacagtgttgggcacacagtaagcattcaataaatgcacatgagccaagatggtaaagcaggccggcgcagtggctcatgcctgtaatcccagaacttcagaaggctgaggtgggcagatcacctgaggtcaggagttcgagacaagcctggccagcatgctgaaaccccgtctctactaaaaatacaaaaattagccaggcatggtagcgcacgcctgcgcacacctgtagtcccaactactcgggaagctgaagcacrggaattgcttgaacctggaagcagaggttgcggtgagctgaaagtgtgccactgtacaccagtctgggcaacagagcaagactctgcctcaaaaaaaaaaaaagaaaagaaaaaaaaggtggtaaaagcaaaatactacaatcagcccagtgcacacctgcaatgacagataatgaagaagttgacacgagagtgaagaagattcagactaaagcacagagaggcttgggaagattttcttatctgacataaagagggaaaatacattggtccaatcactgttatttccatatcatttgg

SEQ ID NO: 192201 - DNA, 601 bp, Human
tggaaagaggtttcatctgagccaaggaaaagatcaactatttggccctgggaagagatcctcgattcagtggctttccatttctactctggccacacacctgagggaggctggggagcagggatccaatggtgaataagaggctcgctatcaaggcaggaaggggaaggaagggaaagggggctacagatagtctcaaatctaaaaggtcccgtgtaatttctaaaagtcccctccccaggtgattttcacaacacacacaggttctgtctcctgaggatgacagaattatccagccacwttttacagtgaaaacttccaaaggaggaagtgattggagaactaaaaggccactctaggcatctgagttcatgcaccttccaccgcagagccttgtacacagctggctgtcaagaaatatttaataaacaaatgaaataataacacaatgtgtgcatttaagaaaaccattgcatgtgttactacatttaacaaaatcaattattcatttaaaataattgcatggggtccctggatccccaagcagaccaagttattgatggagggtcccggctagtttcagtgcctcagaaagcctaac

SEQ ID NO: 192202 - DNA, 601 bp, Human
atggaaaactgggctgggcgcggtggctcacacctgtaatccgaatactttgggaggctgaggcgggcagatcacctgaggtcaggagttcgagaccagccggccaacatggcgaaacctcatctctactaaaaatacaaaaattagcccggcgtggtggcatatgcctgtaatcccagctactcgggaggctgaggcagaagaatcactttaacccaggaggcggaggttgcagtgagccgagatcacaccactgccctccagcccaggagacaagatcgagactctttctcaaaaaagaaaaaaaaaaggaaaattcaatgtatcacaaacttaacatgagtcccatttctgtatggcaagcaagggcaagtgggcagagccaacagagtgaccacaggcccctgtccgaagtgctttttaaaatgtggaaagaggtttcatctgagccaaggaaaagatcaactatttggccctgggaagagatcctcgattcagtggctttccatttctactctggccacacacctgagggaggctggggagcagggatccaatggtgaataagaggctcgctatcaaggcaggaaggggaaggaag

SEQ ID NO: 192203 - DNA, 601 bp, Human
aacaaaaccaaacgcctaattctccatggccttcctggacaaagagacaaatacataaaataaaataaagtccttcttgcctcttcaaaatggaaaactgggctgggcgcggtggctcacacctgtaatccgaatactttgggaggctgaggcgggcagatcacctgaggtcaggagttcgagaccagccggccaacatggcgaaacctcatctctactaaaaatacaaaaattagcccggcgtggtggcatatgcctgtaatcccagctactcgggaggctgaggcagaagaatcacttkaacccaggaggcggaggttgcagtgagccgagatcacaccactgccctccagcccaggagacaagatcgagactctttctcaaaaaagaaaaaaaaaaggaaaattcaatgtatcacaaacttaacatgagtcccatttctgtatggcaagcaagggcaagtgggcagagccaacagagtgaccacaggcccctgtccgaagtgctttttaaaatgtggaaagaggtttcatctgagccaaggaaaagatcaactatttggccctgggaagagatcctcgattcagtggctttccatttc

SEQ ID NO: 192204 - DNA, 601 bp, Human
cctttgggataaaaatacttagaatccatcatcagaaggaacctcacacacctgcttctcatctgcagccattctttgtcaactccgctctttcttgcttatcagaagggaatactaaactgataaaggagttataaaccaaaatagaaacaaaacaaaaccaaacgcctaattctccatggccttcctggacaaagagacaaatacataaaataaaataaagtccttcttgcctcttcaaaatggaaaactgggctgggcgcggtggctcacacctgtaatccgaatactttgggaggcygaggcgggcagatcacctgaggtcaggagttcgagaccagccggccaacatggcgaaacctcatctctactaaaaatacaaaaattagcccggcgtggtggcatatgcctgtaatcccagctactcgggaggctgaggcagaagaatcactttaacccaggaggcggaggttgcagtgagccgagatcacaccactgccctccagcccaggagacaagatcgagactctttctcaaaaaagaaaaaaaaaaggaaaattcaatgtatcacaaacttaacatgagtcccatttctgtatgg

SEQ ID NO: 192205 - DNA, 601 bp, Human
aaggtattttgctgaactaaattagtcttgcctttgggataaaaatacttagaatccatcatcagaaggaacctcacacacctgcttctcatctgcagccattctttgtcaactccgctctttcttgcttatcagaagggaatactaaactgataaaggagttataaaccaaaatagaaacaaaacaaaaccaaacgcctaattctccatggccttcctggacaaagagacaaatacataaaataaaataaagtccttcttgcctcttcaaaatggaaaactgggctgggcgcggtggctyacacctgtaatccgaatactttgggaggctgaggcgggcagatcacctgaggtcaggagttcgagaccagccggccaacatggcgaaacctcatctctactaaaaatacaaaaattagcccggcgtggtggcatatgcctgtaatcccagctactcgggaggctgaggcagaagaatcactttaacccaggaggcggaggttgcagtgagccgagatcacaccactgccctccagcccaggagacaagatcgagactctttctcaaaaaagaaaaaaaaaaggaaaattcaatgtatcac

SEQ ID NO: 192206 - DNA, 601 bp, Human
ctgaaaggtcaatctcatgaaatgggaaaattggtaggattctaagcttagggggccaggacagcgtattctgtctacagagtacttctttggatcttcccaaaatctgacattcataagaacaattaaaatgtacactcaataagaacaaattaaagtgtatactcatctctcctttgatggcattaggtgtgcgagtatcaaatgccttcagcagatagcaacagtgttaagtatgcccaaatgaaattatttatgaaaatcacacagcaagtagttaattctcaaaaatcgtcatttratgaaaacaggacaggcttttatcacacaaaatcctaaattaaggtattttgctgaactaaattagtcttgcctttgggataaaaatacttagaatccatcatcagaaggaacctcacacacctgcttctcatctgcagccattctttgtcaactccgctctttcttgcttatcagaagggaatactaaactgataaaggagttataaaccaaaatagaaacaaaacaaaaccaaacgcctaattctccatggccttcctggacaaagagacaaatacataaaataaaataaagtccttc

SEQ ID NO: 192207 - DNA, 601 bp, Human
acttcagccatgtccaagtgacaactactcacaacttcatgtttcctggtggtataatgtcagcagctgcctagcagttttcccatcagcctttctcatccccaggataaaaggatctgatcccacagtcagcagtggagggtcctccagtctttcaactggtccttgagttatcactaattgcctaaccaacttcacctcacccctccgatctctaaaactctttcagtgacatttatgcaaagacagaaaatctccctgcctgattgtctcttcactctctcccattcaagaatccagragtcactagtcacctattttccttctcatcaccccatcccccaactctcactttccaccagcctcccattgctatcctttcacccgacacacccatcatatctaggtgttaagacactcttatcaccactgtaatttttctcatcttttccaatagatctagggtaaaaaggacaaaagaattctttcaaaaataacatggtagatattacttgaaataaagcaatttgtatgcagtccctcctcatctgaaaggtcaatctcatgaaatgggaaaattggtaggattctaagcttaggg

SEQ ID NO: 192208 - DNA, 601 bp, Human
agtttttacataacaaaagctaattcaataaacatccgtgtacatacatctttgttcccatctctggttacttcacgtaagtaggttccaagaagcagaatttctggaacagagagcttaacatttttaagactttaagtatatagcaccaaggtaaattccagaaagtttatttcaatgtagaatcctgactacagtcactgtggagtactcagtgccccactcagtgacccacactacccacttatggaattcatagttcagttttaacttgtcccatctggttgttttttgttttttktttttttttgagatgaagtctcacgcttgtcacccaagctggtgcgatctcggctcactgcaacctccgccgcctgggttcaagcgattctcctgcctcagcctcccgagtagctgggactacaggtgcccgccaccatgcccagctaatttttgtatttttagtagagacggggtttcaccatgttggccaggctgatcttgaactcctgacctcaggaaatccgcccgcctcggcctcccaaagtgctgggattacaggcgtgagccaccgcgcacggccaatcccatctgttcttta

SEQ ID NO: 192209 - DNA, 601 bp, Human
agtgtctccaagtagccacagctgtctgaggacaaaggcttccaagagcctggccaggaaagccctggctctagagcctgctccacacatggaggcagaaaggctcgagaatggccccgtccatgcacagcctcctcctcggcagcacccagtgtgtttttcctaaccttacgtggaccagaggtgagggcagagatgacatattagcactctcttgagaatatttttctggttaaaagggtaattggtaattgtgcttgctgttttaaatttggaaaatacaaaaatgtttcaagaaggaaaaaaaaaagccaaacacccacaatttcaccatcaaaaagatatgttttcttccaggtttttaaaaataccccaatatacacatatgttttaaaaataaaactagaagcacaatttcatatccttttttccccacccaatcagcatagatcataaatattttcccatcactaaacgctgctcgaaaacacgagctttataagctacctatagtctgtctggatgtgccgtaattcgttcaaatgtgtctctattgttggatatttagcttgtttccaagtttttacataacaaaagctaa

SEQ ID NO: 192210 - DNA, 601 bp, Human
cttaccttcaaaggtcagctaaacagtgtgtatgagttaagttttcccatatgaacaaaaatcccagcatcctaagaaagagccaatagagatttaccttcaggactattattttaaagtgagattacactttgctgttcttctgtcagttgcaaatccccaaacctactagaattcacttaaaactaatctacagtgttttcattggaagaaagcaatcaggaaagctctgagccactgagcagctgggaatttcgctgctgaaggtttggtttagtctttatttttctagctgctggcyctgctaacatgattccatgaaggtcgcatttaatcttgcagagaaaagctacctaagcagttcttaggtagtcttcagtaaaaataaattgccttggctctctggataagtctgttgcttcaacccaacaattacagtcaaagagaacaaatgaaggcaactgtaaaatactatacttgatttcaaaagaatttcatcgcctagatgttgtgggctgtgtttgttaataacaaagttattgttaacaaagaacccatggaaaaagtagcagcttccaaatgtttatctccaggtcatcac

SEQ ID NO: 192211 - DNA, 601 bp, Human
ttccttcactttaccgcggggggcaggagtactgattctgcagctctgctggttacagtgtctccccacaagggaaggggaagtagagaggggagataattatcaggatttaaccccatcagttttccttaatgacaccagaccatagttccatgttccaaactaaatgtgggagaattgtggaaaaacagaaagaacaacaaaacaatatgttgttctatgcctattttacaatctattaagagtctgttttaaaaaaaataaaatgtatacacttggcaaaaaaatctgtcacattagyactgcggcttcccctacaatctgaaacaaccccacagggcccatggaagaactataaaagggattcacagataagtaaaatcgtttctggaactgtcatcttacttgcctaattgtgttttctctatctggaagaattaggctcctaactgtaaggaatgcagaccatctacctacctggctacctcaaatcgaagataattttctttcgttttatacctccctctacatatcgttagcactgaataaacacctgctaaataaatgactgaatggatgaatgatcaaaatagtcaacggt

SEQ ID NO: 192212 - DNA, 601 bp, Human
ttcactatagccaaacacacacacacgcatgcacgcacacacacacacacatgcacgcgcacacacacacacatgcacgcacacacacacatgcacacgcacacacacacacgcgaagagagaaaaggaagcattttcaaaatgaagtaaggaccagtttccccttcaaggcaatgtcttctcaagccctgtgaggagagggtactaaatgatatctaaagtaggacctacgtagaaaaagagctacataaaatcccttttagatcgacgtggggaagcaaacaaaggaacttacaaatayactctattaggctgttattttaaataagcaacagtaactctagagcactaatgggaagccttaaaaaaacctttttattttgaaattatttccaatccacataaaaatttcaaaaatagtgccaagagttcctggatatctttcatcagcttccttcactttaccgcggggggcaggagtactgattctgcagctctgctggttacagtgtctccccacaagggaaggggaagtagagaggggagataattatcaggatttaaccccatcagttttccttaatgacaccagaccatagtt

SEQ ID NO: 192213 - DNA, 601 bp, Human
tgggtatagagattctgatccagatactgaaaaagttctggagatggatggtggtgatgcttaggcaaccttgtgaatgtaattaatgtcaccaaattatacactttaagatgattgtaatggtaaattttgttttgtaaattttaccacagttttaaaaagaatgcttcaacatgcatttatgaattccctacttgctgccactgtttccttcagtgcttttatggatgataattattccttaatttcaggcaacttaaagtattcactatagccaaacacacacacacgcatgcacgcrcacacacacacacatgcacgcgcacacacacacacatgcacgcacacacacacatgcacacgcacacacacacacgcgaagagagaaaaggaagcattttcaaaatgaagtaaggaccagtttccccttcaaggcaatgtcttctcaagccctgtgaggagagggtactaaatgatatctaaagtaggacctacgtagaaaaagagctacataaaatcccttttagatcgacgtggggaagcaaacaaaggaacttacaaatatactctattaggctgttattttaaataagcaacagta

SEQ ID NO: 192214 - DNA, 601 bp, Human
gttgtgatatttcactgaatttctttatctactatggctcttgtaagaacaaatgaatggcttctcctgctgtcaacaattcacaataaatacacaaatgcttttatccattttacttaacagatctgttattacggcaatatttttttttcatccactcagtaatactattgaaccatgattgaatggattatatttaaattcttaagtccccaaatgttactctgaggctgtttttactaatctttatcctgaaataccacagaagtgaagaactctaaggcttttttcatgagtcccragcagacagagcagccgcaatgataaattcactaccatatccgagtcccaagcagagaggctaccacaagggcagccgcgaggataaatccactaccatattcaagcactgctatttctcctctcacaagacatttctggattcaaaatacaacagaaaaaaaataattatttactgcacagttcaacaaaacatactaagtacttaacctggctacaatacactgagcaggttacttgatttctccagctgaaaaaatgaagggaaggggcaggcaatcgttgctacagaaactcccaa

SEQ ID NO: 192215 - DNA, 601 bp, Human
ctatgaaggcattgtttctgggggtcttgccattatccttgattctctaacttgggtttcttacctgaatttgagccaactgtctttaattcctcctcacttgaggattataaacttactataatcactctctttacaaaccaattcaaaacaaacaaaagagagtacaaaaaatatttttgtacctattcatcatttcctcttagaaacttatataaaagcacctcaaagacaggcctggctattatcaaaggcacaacccagtccttcccgcaatggaccgcagactacaaatgcacamgcctcagagctcctctccaacgctgcaggtgcacagctgcgacacgccctgctgctaacagtcattagctatcattttctgaaatgcacaggggaaaatgttccaaatcctcaaaaaccttccaaaaaaaaaagaaaaaagctggctgtatcctcggaacaaaacccttccttactgggaaacaggaacacatgcactgagtgagatatttgtggccaccaggaactggctctgacactccctccttcatctgtttgttccagccaccctggagagtggtccatgcaccaggaacggaag

SEQ ID NO: 192216 - DNA, 601 bp, Human
atcttccaatttatcgccccagggaagtgaagagtccggcaaacatccagtcaatgccatcaaggcagccggtcaccccagctgtgagggcctcggcccctgatggccacatctccccaaacactctgtagctgcgtcggatgaagagtgtgaggtggttgggttaacacatgatacaggtggaataatgcctcccaagtatcccacacgctagcctctgcgacctgtgaatagactgtgttatgtgacaaatgggaattaaggaggcaggtgatttaaaggttgtctgttgaccttgacrgaggggaattttcctggatcatccatgtggtcccaatgcagggaagaagcctcaatatggcacgggcagctctggggctccctccagttcctgagtcccactggctaaggtttgcacctgaggtgttcgcccagcccttctgtggcccggcgtgacgtcactcggaagacctggggacactctgggcggataggaagccctgtcctaacttctgccctatgaaggcattgtttctgggggtcttgccattatccttgattctctaacttgggtttcttacctgaatttgagccaactgtc

SEQ ID NO: 192217 - DNA, 601 bp, Human
gagggtaccgagtctacgcgagtcctgtggctcggccctccacaacatacaaccggttcaaacacggcagttagtgataatacagtggagacggtgaaatactgaaataaaccacaggaatatctaggcctttgaataacatcttccaatttatcgccccagggaagtgaagagtccggcaaacatccagtcaatgccatcaaggcagccggtcaccccagctgtgagggcctcggcccctgatggccacatctccccaaacactctgtagctgcgtcggatgaagagtgtgaggtggttkggttaacacatgatacaggtggaataatgcctcccaagtatcccacacgctagcctctgcgacctgtgaatagactgtgttatgtgacaaatgggaattaaggaggcaggtgatttaaaggttgtctgttgaccttgacagaggggaattttcctggatcatccatgtggtcccaatgcagggaagaagcctcaatatggcacgggcagctctggggctccctccagttcctgagtcccactggctaaggtttgcacctgaggtgttcgcccagcccttctgtggcccggcgtgacgtca

SEQ ID NO: 192218 - DNA, 601 bp, Human
gacagcaaataacaattggaggaccaagtcagtcactgcaactgaattcagccaacacgtactgagggtaccgagtctacgcgagtcctgtggctcggccctccacaacatacaaccggttcaaacacggcagttagtgataatacagtggagacggtgaaatactgaaataaaccacaggaatatctaggcctttgaataacatcttccaatttatcgccccagggaagtgaagagtccggcaaacatccagtcaatgccatcaaggcagccggtcaccccagctgtgagggcctcggcmcctgatggccacatctccccaaacactctgtagctgcgtcggatgaagagtgtgaggtggttgggttaacacatgatacaggtggaataatgcctcccaagtatcccacacgctagcctctgcgacctgtgaatagactgtgttatgtgacaaatgggaattaaggaggcaggtgatttaaaggttgtctgttgaccttgacagaggggaattttcctggatcatccatgtggtcccaatgcagggaagaagcctcaatatggcacgggcagctctggggctccctccagttcctgagtc

SEQ ID NO: 192219 - DNA, 601 bp, Human
gagagccgcggtggagaaactgctggaaggtttccctgaagctgcgagttcagagtcagccatgtgtcctcgcacctcagcgagggtccctgccgactgagcggaggaaacccctcggtccagccagggcacacacccggctgacgcgctttcctgcggcccggtccgccctccctaccgggaaaccgggtgcctgagcccaggggcaccaatgtcctgcaggcgcctctgtgtctggacagcaaataacaattggaggaccaagtcagtcactgcaactgaattcagccaacacgtactragggtaccgagtctacgcgagtcctgtggctcggccctccacaacatacaaccggttcaaacacggcagttagtgataatacagtggagacggtgaaatactgaaataaaccacaggaatatctaggcctttgaataacatcttccaatttatcgccccagggaagtgaagagtccggcaaacatccagtcaatgccatcaaggcagccggtcaccccagctgtgagggcctcggcccctgatggccacatctccccaaacactctgtagctgcgtcggatgaagagtgtgaggtggttg

SEQ ID NO: 192220 - DNA, 601 bp, Human
cgaagcaagaatccatgtctcctctgcaagctgcagaactgtcttcaaatatttttggaagatacctactgcctctcaccagtttccgaatggtagccagaggtgggagggtcggatctggcatccattggatggtcactatttcccctctctgccaacccctcccaggaccacaatgatttcttttctttccctctccttgttaaagcataatatggtagtgggagctcagatttggcatcaagcacacctgaactggaacctcaccactcacaaccttcaacttcgccaagccatagtytcctcatcactaaacagagatcttaatagcaacttagcagagctaccgtgagaagaaacagataaaggctagtttatgttaggaggaaaagtatgaggtgagatttccttggtctcccctaagacttccccaaagaaattccaaacagtagggcccgtgctccacctaactgcagtgactaagtcagtgttccacaaggagcaagacgatgtccagggtccaccttctgtaatagaagcatattctccaccctgcacattcttggccagattaatctccccaaatggctcctgaccttgc

SEQ ID NO: 192221 - DNA, 601 bp, Human
tttgtgaaaagtcaaataacagaaactcaaagagccagcatactggaactggaacctaagaaaacctatttgcatagagcaacaaaattgctgctttctgacttcaatcacatcactagcagactaccttgaaaaccaacgccttcccaaaaaccagttgcctgaaaataacctgttctgaaaggttgatttgaagggcactatcttttcccctggatgagagtaaatgatttcctcccacactccacatccacaggctggccctcaggatctgcttcttgctgccacttttcctttgagratttcctttaagctgtcccctctgccagggagctctccataaaggttaccagctattcttggtgttattattattaattattatggagacatccaatttaactctttatgttcaaatctggtcaagctccagcacacaaactataaacttacgcactacagtttccgctagtttgattctattcctgggataaaccatcccaattaccaatgaattccaactggaaaaagagccaaaattgctaccactctaagtacaggaatacctccgaagcaagaatccatgtctcctctgcaagct

SEQ ID NO: 192222 - DNA, 601 bp, Human
ggtgtgttttgccccttcaggaacacagaaaagacaaggggacaagagagaggagatgtcaatgtggtcagtatttgtgaaaagtcaaataacagaaactcaaagagccagcatactggaactggaacctaagaaaacctatttgcatagagcaacaaaattgctgctttctgacttcaatcacatcactagcagactaccttgaaaaccaacgccttcccaaaaaccagttgcctgaaaataacctgttctgaaaggttgatttgaagggcactatcttttcccctggatgagagtaaawgatttcctcccacactccacatccacaggctggccctcaggatctgcttcttgctgccacttttcctttgaggatttcctttaagctgtcccctctgccagggagctctccataaaggttaccagctattcttggtgttattattattaattattatggagacatccaatttaactctttatgttcaaatctggtcaagctccagcacacaaactataaacttacgcactacagtttccgctagtttgattctattcctgggataaaccatcccaattaccaatgaattccaactggaaa

SEQ ID NO: 192223 - DNA, 601 bp, Human
caaaaggtgtgttttgccccttcaggaacacagaaaagacaaggggacaagagagaggagatgtcaatgtggtcagtatttgtgaaaagtcaaataacagaaactcaaagagccagcatactggaactggaacctaagaaaacctatttgcatagagcaacaaaattgctgctttctgacttcaatcacatcactagcagactaccttgaaaaccaacgccttcccaaaaaccagttgcctgaaaataacctgttctgaaaggttgatttgaagggcactatcttttcccctggatgagartaaatgatttcctcccacactccacatccacaggctggccctcaggatctgcttcttgctgccacttttcctttgaggatttcctttaagctgtcccctctgccagggagctctccataaaggttaccagctattcttggtgttattattattaattattatggagacatccaatttaactctttatgttcaaatctggtcaagctccagcacacaaactataaacttacgcactacagtttccgctagtttgattctattcctgggataaaccatcccaattaccaatgaattccaact

SEQ ID NO: 192224 - DNA, 601 bp, Human
accgtggagctctgcggcactgcctgctttcgcccccagctctatcatttagctgtgactttgggcaggttactgaccttctctgttctcatcaggctttgtgaggattaaatgaagaagcatgtaaaataaggcaatgcggtggctcacacctgtaatcccagcactttgggaggccgaagcaggaggttcatttgagcccaggaggtagaggctgcagtgagctatgatcatgccactacactccagcatgagcaacagagcaggaccctgtctcaaaaaaaaaaaaaaaaaaaaaggraaagaaagaaagaagaaatagagagagaagaaaaaagcaaataaacatgtaaaatatctagaatagtgttttgcatcttacatgcactatgggagtataaaataggtacaaaatttccaaacagcagcttggccaaggtattaaaaattttaaaactacacccttggacccagccatgtcacttctaggaatgcttcccaagtaatctaatcatgtgtgaaacatgctgtcttaaaattaaaaaaagaaaaaactacaatgatcttgaaatctgatgcagatacacatgtaatattcttt

SEQ ID NO: 192225 - DNA, 601 bp, Human
gttcagagtgaaaggcaattaaaaatacaaatcccccataaacagggatggaacaagaagataagttagcagctgtctgggactcttcctaaaagaggaagccttttgaccctgtatgaccctagggttgcaccgataaaaacatacacattttttgcaatctctcacaccaaatgcagcagcaaagacaagcaagggtttaaagcctgaaatccctacacaatctctgtaaaaccttcacacctctatttggagaccctcctcaggtgatgtagggacccaggccaggcccaagtccccscagcactgcagtcatgggaaatgatgctggcagaggtgacaggggcaacgacagcagcacaggggcacaggagagctgagcaaaggggctggctctccaaagtgaccattgcttctttccaaattataccgctgcacaaagaatgcgaagaccataggcttcggcccaggaaaagcattctgcacctgtcctacctgatgaatcaagaagcagagtgaaagacgaggccatagccatatccagaggctcccagaaggaaggagtctcatcacagcctctctttgctcatgttctcatgcc

SEQ ID NO: 192226 - DNA, 601 bp, Human
tggtggtggggattgtgagagcaatgactattcactgggcacccatgatgcactcagcattaaactctatacattatctcatttaaccctcacagtaaccccatggggtcgttctcattactatcctcattttaaaagggtgctctggcttagcccatgccaaagctgactctaggtcatcaaactccattatcatgagaactgaggatccaaaaatgggcttcatcttcaggggtattcttggtaatatagaacccctgggatatagtatttttctacatgtgccattgatcctgaaacrtaaatgctaggaaactggtttccttccccagctggcactggacaccacactagttcctatggttgtctcctcctgtcaggaaagtgaacattgaagtcccccaggcccacagatcagaaagaaaacacaagccagaatgttccctggggcccttcccaacactttctgcttgctcagtctttgttcagagtgaaaggcaattaaaaatacaaatcccccataaacagggatggaacaagaagataagttagcagctgtctgggactcttcctaaaagaggaagccttttgaccctgtatg

SEQ ID NO: 192227 - DNA, 601 bp, Human
gtctagggagataatagtggtggtggggattgtgagagcaatgactattcactgggcacccatgatgcactcagcattaaactctatacattatctcatttaaccctcacagtaaccccatggggtcgttctcattactatcctcattttaaaagggtgctctggcttagcccatgccaaagctgactctaggtcatcaaactccattatcatgagaactgaggatccaaaaatgggcttcatcttcaggggtattcttggtaatatagaacccctgggatatagtatttttctacatgtkccattgatcctgaaacataaatgctaggaaactggtttccttccccagctggcactggacaccacactagttcctatggttgtctcctcctgtcaggaaagtgaacattgaagtcccccaggcccacagatcagaaagaaaacacaagccagaatgttccctggggcccttcccaacactttctgcttgctcagtctttgttcagagtgaaaggcaattaaaaatacaaatcccccataaacagggatggaacaagaagataagttagcagctgtctgggactcttcctaaaagaggaag

SEQ ID NO: 192228 - DNA, 601 bp, Human
gcccctccaccaccagttctctgcaggacacttcagggttcccagcgccccaaatctggcattcccagaatagtttcattttcgatcatgacaacagttcccactcccacagcttttcaagcacttggctcagggaagacccactaggagtaagggctttgctttttgtttcttgtttacaacgtttcctcgacgtgtgcaagacggaagcctgaacaactgtcagttccacttgctcgtacttggctgaacactgcagttactcccctggcctcggactccggagaagagcacacagcaytgtccaagaacagctcccacactgagaacagaaaccgaaaccaggggtgaagaaccgatccttccttccacaaagcctggaccaggcagccattcagactgctctcctcggcccccaaccccaacccagctctgccctacagccagaacacccttccaaaagcacaaacagactctcatcattccactgcctaaagcctgtccttaccccacaagcctccagcgaggggtccgtcccaagtctctgcgtctgtcacccctcagcctcaagagcatcccctctcacaagctaactcttact

SEQ ID NO: 192229 - DNA, 601 bp, Human
aattggtttccaagtcactctgcctcacctcaaagttaaggtggaagaaaaaccgccagaagtgccatcgctgggtcactgatagatttgcaaattgtagatgtttgtcctccagaggcccctccaccaccagttctctgcaggacacttcagggttcccagcgccccaaatctggcattcccagaatagtttcattttcgatcatgacaacagttcccactcccacagcttttcaagcacttggctcagggaagacccactaggagtaagggctttgctttttgtttcttgtttacaacrtttcctcgacgtgtgcaagacggaagcctgaacaactgtcagttccacttgctcgtacttggctgaacactgcagttactcccctggcctcggactccggagaagagcacacagcactgtccaagaacagctcccacactgagaacagaaaccgaaaccaggggtgaagaaccgatccttccttccacaaagcctggaccaggcagccattcagactgctctcctcggcccccaaccccaacccagctctgccctacagccagaacacccttccaaaagcacaaacagactctcatcatt

SEQ ID NO: 192230 - DNA, 601 bp, Human
ggagactatcttcgttacagcaaagacacattcaagtactcaggagtgatgggatatcagtattggcaagttactctccaaagatgtagaaaaataattctttgtactattgttaaactgtggtggaagtctgaaattagctcaaaagaaaacgacttggccagaaagacaataccaagtaggtaagtaatttccagtacagagggaaagacgacgacagcctttctgcaaatacaacaaactctaggaaaccccctttgtggtgcttaaatgaagctgctggcggtttattcgtcctccrtgcaccaggatggtattaataagcacatgcatcaatcactttatctatccatccataaggggcagcttaatcaagcaacaattagctgaacaaggaggctctaagcttcatttcctgggggagatgaggagtgatggtccataattcatttaaattgttcagttgtgtagaagaggagaaataagacggccaaagagctctcgtgcgtatttgagagaaaagcgctcagatttaggcgccaaagatttacctccagccaaacttctgtgctaattcaatagaagttatttatgttttata

SEQ ID NO: 192231 - DNA, 601 bp, Human
taggggaatgaaaaagctttcccataatgtagaatgcaaacaaataaatgtaggaagaatgatggacttagaagatcgacatttggtagctatcaaagtagtactcagccaagaaataccaatggatgctaaccagtgagtaaaaggctggtgaaaaatgggatacttacatagcctcaaaaatacctcccacaaaatattttttatgacaaagggaaaaagactaactttatcatggagaaggctgactgatggctccttaattaaaagatcaaatgaacgttacgaattaaggggcaartcaaaagcatgtatcacctgtaaggatgcaagaagaagaaagtctcaccgccgtgatattcttgtaagaaatgcataaccagaaacgtcaacaagcccaaacggatacacattctctaagaaaattgccttgtcattgtcaaaagtgtcaagttcatggaagtcaaggaataatgaaggaggcagggcaccgaaattcaacacctagccctgcatcagattctcctgctgcaagggacatgactgagacattccaacaggaacagggtctgccggtgggaggcgactcacacagcggtgc

SEQ ID NO: 192232 - DNA, 601 bp, Human
gaattgcttgaacccaggaagtggagcttgcagtgagccaagatcgcgccattgcactccagcctgggtgacagagcaagactccgtctcaaaaaaaacaaaaaaagcatgcatatgtgtaagtatatatgcaactaatacacatattctctaaccttgacactaaaagggcctgggaacagcaagaccccaacagcaatgagcacaggcagtgcccaaatcttggtttccaaacaccatcctccaccaaaaggaatcagggctccttggagaaatggctgactccagagctggggcaggraaagcaaaagataagcctgggaaaggaaataaggaagggctcaaaagataatagcaacatgtcaaaaaaaagtcacagaacccaacctgatggagctcccactggccacatctaagacaatctgagcacccaaatacatgactgaaatgtatttctgtcattgaacaaaattggaatctacgaataaataaataggggaatgaaaaagctttcccataatgtagaatgcaaacaaataaatgtaggaagaatgatggacttagaagatcgacatttggtagctatcaaagtagtactcag

SEQ ID NO: 192233 - DNA, 601 bp, Human
gtctctactaaaaataaaaaaaaaattagccaggcgtggtgacgggcacctgtagtcccagctactcgggaggctgaggcagggagaattgcttgaacccaggaagtggagcttgcagtgagccaagatcgcgccattgcactccagcctgggtgacagagcaagactccgtctcaaaaaaaacaaaaaaagcatgcatatgtgtaagtatatatgcaactaatacacatattctctaaccttgacactaaaagggcctgggaacagcaagaccccaacagcaatgagcacaggcagtgcmcaaatcttggtttccaaacaccatcctccaccaaaaggaatcagggctccttggagaaatggctgactccagagctggggcagggaaagcaaaagataagcctgggaaaggaaataaggaagggctcaaaagataatagcaacatgtcaaaaaaaagtcacagaacccaacctgatggagctcccactggccacatctaagacaatctgagcacccaaatacatgactgaaatgtatttctgtcattgaacaaaattggaatctacgaataaataaataggggaatgaaaaagctttccc

SEQ ID NO: 192234 - DNA, 601 bp, Human
aataggaggacttgatttgaatttgtgctttttcatatatctcgataaacacagaaataaatacagaggtaaaaaagcatgcataggaggcggacggatcacgaggtcaggagatcgagaccaccccggctaacacggtgaaaccccgtctctactaaaaataaaaaaaaaattagccaggcgtggtgacgggcacctgtagtcccagctactcgggaggctgaggcagggagaattgcttgaacccaggaagtggagcttgcagtgagccaagatcgcgccattgcactccagcctgggygacagagcaagactccgtctcaaaaaaaacaaaaaaagcatgcatatgtgtaagtatatatgcaactaatacacatattctctaaccttgacactaaaagggcctgggaacagcaagaccccaacagcaatgagcacaggcagtgcccaaatcttggtttccaaacaccatcctccaccaaaaggaatcagggctccttggagaaatggctgactccagagctggggcagggaaagcaaaagataagcctgggaaaggaaataaggaagggctcaaaagataatagcaacatgtcaaaaa

SEQ ID NO: 192235 - DNA, 601 bp, Human
taaattatattatataccagggtaatggaagtgaggcttttgactactggagaaggaagttacagatacagaaagaaagaaaactacaataacccaggctgtggcactagaataggaggacttgatttgaatttgtgctttttcatatatctcgataaacacagaaataaatacagaggtaaaaaagcatgcataggaggcggacggatcacgaggtcaggagatcgagaccaccccggctaacacggtgaaaccccgtctctactaaaaataaaaaaaaaattagccaggcgtggtgactggcacctgtagtcccagctactcgggaggctgaggcagggagaattgcttgaacccaggaagtggagcttgcagtgagccaagatcgcgccattgcactccagcctgggtgacagagcaagactccgtctcaaaaaaaacaaaaaaagcatgcatatgtgtaagtatatatgcaactaatacacatattctctaaccttgacactaaaagggcctgggaacagcaagaccccaacagcaatgagcacaggcagtgcccaaatcttggtttccaaacaccatcctccaccaaaaggaatca

SEQ ID NO: 192236 - DNA, 601 bp, Human
caactgagtaaattatattatataccagggtaatggaagtgaggcttttgactactggagaaggaagttacagatacagaaagaaagaaaactacaataacccaggctgtggcactagaataggaggacttgatttgaatttgtgctttttcatatatctcgataaacacagaaataaatacagaggtaaaaaagcatgcataggaggcggacggatcacgaggtcaggagatcgagaccaccccggctaacacggtgaaaccccgtctctactaaaaataaaaaaaaaattagccaggcttggtgacgggcacctgtagtcccagctactcgggaggctgaggcagggagaattgcttgaacccaggaagtggagcttgcagtgagccaagatcgcgccattgcactccagcctgggtgacagagcaagactccgtctcaaaaaaaacaaaaaaagcatgcatatgtgtaagtatatatgcaactaatacacatattctctaaccttgacactaaaagggcctgggaacagcaagaccccaacagcaatgagcacaggcagtgcccaaatcttggtttccaaacaccatcctccaccaaa

SEQ ID NO: 192237 - DNA, 601 bp, Human
gggggtgtgccccaaccccgggttggcacagaacagaaggtgaacgtgtttcctgaacagcccagtgtcatcacactaagtgccatcctgtgctcactcttaagtcctgagttttccaagactgtcctgatgtcagcagggtgccctaattttagatgagaaaataagaacaataggccaggcacagtggctcacacctgtaatcccagcactttgggaggccaaggcaggcggattacgtgagctcaagagatcaacaccagcctggtcaacatggtgaaagcccatctctactaaaatwtatataaattagctgggcatggtggtgtgtgcctgtaatctcagctactcaagaggctgagtcaggagaatcgcttgaaccctggaggcagaggttacagtgaattgagatcatgccactgcactccaacctgggcgacagagtgagactccatcacaaaaaaaaaaaaaagaagaagaagaagaacaatacagtaatagagaacattcttctcaaaacaactgagtttccttcttcccttccttcctccacccttcctttatgaatgatttactccaaaagcccatttgatgcaacgca

SEQ ID NO: 192238 - DNA, 601 bp, Human
atatttaatttgtgcaggaatgcacagagcataatgtgaaaaaagtcggggagcaggtggttttaaccatcagggcaatcaaggaccacgcgcaaacttccaggccctgccgtaccatggtggcttccccatgagtccccagctgagtccacgtgctgacacgctgctctcttcccccacagcaccaatgacagtcagagttccccgttcactcacccttacagaactcagagcatgcgccgggctgacaacatgcaccaagagacagttgtttgacctggaactgggcctctggggggcrggggtgtgccccaaccccgggttggcacagaacagaaggtgaacgtgtttcctgaacagcccagtgtcatcacactaagtgccatcctgtgctcactcttaagtcctgagttttccaagactgtcctgatgtcagcagggtgccctaattttagatgagaaaataagaacaataggccaggcacagtggctcacacctgtaatcccagcactttgggaggccaaggcaggcggattacgtgagctcaagagatcaacaccagcctggtcaacatggtgaaagcccatctctactaaaatt

SEQ ID NO: 192239 - DNA, 601 bp, Human
agtgggcaggagccagccttggctagtgacgcttttttatcactatactgtatatgagatgaggagaggaaccttatctcatatacagtatagtgataaaaatgagaccttaaatgagaaatcaacaagccattgccccaaaaattcagaaatcccctggtgctggtcaccatctccacaactgtagaagccattcaggtctccatccggcaactatagccacttcccagggcactgcttcaggaaccaaacgcagaaggtaacagaacccaagaccctatgcctcagttttctcctctgyaaaatgggataacttccgcatggtttgcggtaaggattaaataagatgtgtaacatgcctagcctagtacctgatccatcaatagttgatatttaacaaataatagtttctgcagacacaaatttatggtcaacattgttcaaagagcattatttatatagcaaaactaacccaaataccagacagtgggaagatgtttaaagaaaatgtaatagagtcaaataatagagtattgggactacagcagattccctcatctcaacaaagggatgatttatgtcctgggcaggaagaggtggg

SEQ ID NO: 192240 - DNA, 601 bp, Human
acaaaacatgctgcgtttcctggccaacccgagctttccttttgtagtccggactaggaaaacactcccatactccaaaataaagatactcgccctctctccaccccttcacctccatgctctctttaaggaaacaagagagaaccagaggggctttttcctggctttgcatcacctggatgcagatgaatcagttgtttcattttagttgctgcttctgccataaagcagggccacctgggtgcttccagggtcttttgaaggcagaaggggaggaaagtgtgccctgcccagcccatawccgattaacctgaagaactatttcagaagcacaagtaagtcccatagaaggcaaacgcgccactatcttaatgttaatttcacattaacatttatttaaggtgctgaaaaccagtgaagtagtaagcatcctcaatatttgtcagtttccacctcctgccgtttcagtgcatatgaagagcaaacacttcgttatggggccgttttgcttcccactctaaaaatgacctcatttttagtatcaggacctccaagaagtacaaaaaccccgtgccccaaaactcctttctccaacctactt

SEQ ID NO: 192241 - DNA, 601 bp, Human
gcgtccctgtcccggccaccctcccttcaatccacttccacattccacacagcggaggcctatacttactgcgtgtctgctgggtgagagtacaagactacgtaggcttatatattaacgtgggcagcaacgttaacatgggattccagctccaggggcctccccggccccattctccttcccacacagtggcctggccactttcccactacaaacgggccttcatgcctccgtcttgtttgctcacactgcaaacatttgtgagaggctggagaacctcgcagcagatgggcggctgatygcctcatctgagctctcagagtctctgcctctgcagatcttttttgctttcttctccccaggtcctgttcccattttccacaggtgcaatttcagatccctccctgcctccagcttcacagagaaaagagatctgcgaggctcttctttctgaatgtctacctcgcctccctcttcatactcacttgggtgtgacctttttccctttcttagactagatgggtgggagtgccactctgcaacagaagatgtgggatgtttgaggagagatactgagagtggtttggggcctacagggttg

SEQ ID NO: 192242 - DNA, 601 bp, Human
atacggaaaaaaccatgcctctcagtgtacatattatctgcaccaatgcaaaactgatttttatgttttgttgaactttagaaagtcataggttcatttaagaatgggagtctccagccagtcttcctcataaggtttcaagcaattcaaccaccaattctcctactacgtagatttttcaggatgaatgatgaggcaggactgctactccaaatacatcataacccacctttattcttttctgttctgttcatgccactatcccaaaactgccttgcaatgctattaccttaaaactttaaaaaaaaaaaaaaaaaagcggggcggagcgggggtacttaaaaaaaaaaaaaaggtccctggccccactctaataagaaccgggaattttttttattatcctagaataattttgataagcaattaagtatgaaaatcactgttatttagtatccattaacccaatggacttccagattccagatgtttaataaacatctccagttgagtcatgggaaaacaggaggccagtggtgaatagatttcatcattaatggaatagaaacgtatatgaaatcaaaagtctaaaatgcttttaaat

SEQ ID NO: 192243 - DNA, 601 bp, Human
caacgacttctgtgtgctttttcagcaaaagtaagaatttccatgaaagttatgtaaattgaaagctggagttagaagttgaacatcatcatcatcatccccatcattaataccattccagccctaactagagcctgaccctcagcccaaatgcctttcatgcgttatttcacttaatcttccaacaagccacatgaggcagagtagctactctccattctacagatgaggaaatgaagctacttacaaagctccacttacagccattaagtggtaaagcaaacattcaaatctacatccktctgactccaaagaatatgccagaaacctctagacctgtgttttgcaagtctctgctaacaacccaccagagggtcgtgggatcatttgttgcattaagatcagcacttttaacttaattttaatttacaatatgatagaatggaaaatgagggagcaccccgaacaaagtgaggtaagcattgttttatgaaacgtttgcttccatttaatgtcacattatattatactggtcctggggttgaaggggtataaaaacattgcactaggctggactgcctcccgacagtgtgtgtgcagg

SEQ ID NO: 192244 - DNA, 601 bp, Human
cggggtttcaccatgttggtcaggctggtcttgaactcttgacctgatgatccacctgctttggcctcccaaagtcctgggattacaggcatgagccaccgcgcctggcctaattttttaaaatatttttgtagaaacaggggtttcactacctatgttgcccgggttggtttgaactcctggcctcaagtgatcctcctacttcaacctcccaaactgctaaggttagaggcataagtcaccgtgcccagcctattatcatcattttagagattaggaaaagcatagccaaaaaggcagyccccacaaaaaataagaagaagaaataagaaagaaaagaaaatgtctaagtcacccacgcctctagatgaggaggcaggacttgaacctcaggagggtctcagatgcccagctagagtctgagcttgtttacgcaggctgctataatgacttctgagtgcacgacttgggaaaagccatgcttcagtttcacgagtcatgcagcactctatacagagccaaatggagggaaggaggtgagctagaactactgctctgggtcaggacagtggctattggaacgtacaaaaaaaaaaaaaaa

SEQ ID NO: 192245 - DNA, 601 bp, Human
gggttttttgagatggagtctcgctctgtcacccaggctagagtatagtcgtgcaatcttggctcactgcaacctctgcctcccgggttcaagcaattctcctgcctcagtctcctgagtagctgagattacaggcatgcgccaccacgcccagctaatttttttgtatttttagtcgagacggggtttcaccatgttggtcaggctggtcttgaactcttgacctgatgatccacctgctttggcctcccaaagtcctgggattacaggcatgagccaccgcgcctggcctaattttttaaaatatttttgtagaaacaggggtttcactacctatgttgcccgggttggtttgaactcctggcctcaagtgatcctcctacttcaacctcccaaactgctaaggttagaggcataagtcaccgtgcccagcctattatcatcattttagagattaggaaaagcatagccaaaaaggcagcccccacaaaaaataagaagaagaaataagaaagaaaagaaaatgtctaagtcacccacgcctctagatgaggaggcaggacttgaacctcaggagggtctcagatgcccagctagagtc

SEQ ID NO: 192246 - DNA, 601 bp, Human
ccctcacaagctttgtaagtaatacaactaagtagaaataaactaatatcaaaggctgaagcccagctttgaatcatctcaatccctgatctaatgaaaatgacctggaactaccaaaagtaaatagaaatcagatcttgaggaacataacattaccctaggattcatattatctctggagcttttcttttttctttttctttttcttttttcttttttttttttgagacagagtctcgctctgtcgttgggctggagtgcagtggctcgaactcgactcactgcaacctctgcctcccasgttcaagcaattctcctgcctcagcctccggagtagctgggactacaggtgcccgccaccatgcccagctaatttttgtattctcagtagagacagggtttcatcatgttggccaggatgatctcaatctcttgacctcgtgatccgcccactttggcctcccaaagtgctgggattacaggcgtgagccactgcgcccggccatggaacgccttttcttattacccagtcacccaatggatcagcaaaaattcattaaacacacattgttacaaggaactgtgctgagtgctgtggggg

SEQ ID NO: 192247 - DNA, 601 bp, Human
gtaggtaattcagacctgactcccaggctgaataactaagaaacatggacaaaatatatttttaaaatccatttaaatgcatcagagagctaacaaggtagttaaaaattaggggggcaagatctaggagaaaaagaaacccaggaaggtgaacctgacatttagggctgctgtcgtcctagcgcagggacagctgctcctttctgaagaggaggctgtggggctttgaaagcagagcttttgacacactcaggtgactgaggagacaaaaattgaacatcaggacgcagctaggaaaagrggttcctggaaacaccctcacaagctttgtaagtaatacaactaagtagaaataaactaatatcaaaggctgaagcccagctttgaatcatctcaatccctgatctaatgaaaatgacctggaactaccaaaagtaaatagaaatcagatcttgaggaacataacattaccctaggattcatattatctctggagcttttcttttttctttttctttttcttttttcttttttttttttgagacagagtctcgctctgtcgttgggctggagtgcagtggctcgaactcgactcactgca

SEQ ID NO: 192248 - DNA, 601 bp, Human
aggttgaattttcacccaaataactgaattttggttcttggaatagtaagagcaacggttaccatttacagagcacctactatgtgctgggcattaaaactagggttttcttgctaggtgtggtgggacacacctgtcttttcagctccttgggaggctgaggtgggacaatcacttgaagccaggagttcgaggctgcagtgagccatgatcacaccactgcattctagcctgggtggcagaaagacagcccctctctaaaaatagaaaataaaaaacctagggttttctacaagttttsccatttaacccttacaaccctaggacatagggactttattatcctttattacctgctagtaagtggagagccaagactctcatttaaattcaggcctatctaacgtgaaacacccaggcttatccactctaacctctgccttcatcgtactttagaaagcactgagttatgaagacctcttaattgttctacttactgagactttccaaactcctctccgtcttgcaaaccactgacagtcatcttcctaaaataccatttaatcatgttaattctctgttccagagacttctaaatgtg

SEQ ID NO: 192249 - DNA, 601 bp, Human
ttgtgattcgtaagtcacgaatgatcccccatgaagttgacagtactatccatgattagtgctattaacagtgaggttgaattttcacccaaataactgaattttggttcttggaatagtaagagcaacggttaccatttacagagcacctactatgtgctgggcattaaaactagggttttcttgctaggtgtggtgggacacacctgtcttttcagctccttgggaggctgaggtgggacaatcacttgaagccaggagttcgaggctgcagtgagccatgatcacaccactgcattcyagcctgggtggcagaaagacagcccctctctaaaaatagaaaataaaaaacctagggttttctacaagttttgccatttaacccttacaaccctaggacatagggactttattatcctttattacctgctagtaagtggagagccaagactctcatttaaattcaggcctatctaacgtgaaacacccaggcttatccactctaacctctgccttcatcgtactttagaaagcactgagttatgaagacctcttaattgttctacttactgagactttccaaactcctctccgtcttgca

SEQ ID NO: 192250 - DNA, 601 bp, Human
tctcttcttgcacatcaggttgtttttagaagtaaaatgctaaaattttatggttctgcaaacctaatatatgagcaacctgtacttcaaagtaagtaaaagagttgaagcatctaccctggagcctgacgaaaggcacgttgtaaaatcatctacctttacacctttgagatttgaggctgggactggcttcaaaactgtggcatctggccataagtcaattcagcccatggtgggtactgagaatatcactggtgccaagcctgctatataaggcatgcaagctattcattgtgattcrtaagtcacgaatgatcccccatgaagttgacagtactatccatgattagtgctattaacagtgaggttgaattttcacccaaataactgaattttggttcttggaatagtaagagcaacggttaccatttacagagcacctactatgtgctgggcattaaaactagggttttcttgctaggtgtggtgggacacacctgtcttttcagctccttgggaggctgaggtgggacaatcacttgaagccaggagttcgaggctgcagtgagccatgatcacaccactgcattctagcctgggt

SEQ ID NO: 192251 - DNA, 601 bp, Human
ctcacttacgcaacatgcctgtctagtaaggatgcagctcagccaaaccgcaaacttattagaaaagttcacaatcttcaatcaggactgttactaattataggtaacttttagaaaaagcaaaaaatcgaacaagtatttcatcagagtaaaaaataaacttaaaaagggctacacttatttcaggttttgtttgcttgggttggttggttggttggtttgtttgtagctaggacatctccaatgagactcaatgaaaagctaacccagtcacatgaaggcccttctcctttgtgacttratttttctcccctgacccatctcccacgccctgggcaggtagtgcattaccagtgcgcttgcctcgcgacacggtacaaagtttgccatttgacacaggtttctcacgactagccgagggtgagcgtacatctttacttctgtgaaaaacagcaaaggcagaatctacctcaagcctagcaccagaaacggatcatttagttggacactaaaaacagattaattatgtttccggagattaaaagactgagatgacaggcacagagggtcagaggactgaggactggaaagaaagatgctt

SEQ ID NO: 192252 - DNA, 601 bp, Human
tctgacctccagaattgtgatggaatacatttctgttgtgtgagagccatctgttacggcagccctgagcaactaacagagaagggagagctgcaaaggccctgaggcaaggtggcccctgtggacagcagtcagtgacagggagggcccagagacccggctcacccagaagaccatgcctaggattttggtcatgaccacgatctaagactgaagaggaaaccgaaggattttagcaaaagaatgatagggtcagtttggccaacgtaaagggaagagctgagtgtgaaatcctgaaatycagcgcttcgccaacttgaacgtgcacaggaatcccaagtcagtggattccaggcgaccgctgtggtctgcatctctgacaagcccctaggtccttgggtcacactctgagaagcaaagctctagagtccccttattgttcatgctcaatggcctggctctcccatgctcctgccgtgtggtcattttggccattctgatagactcctccactggtcggcgtgccgggcttgtcatccaccggctgggtgcattcctcacttacgcaacatgcctgtctagtaaggatgcagctcagcca

SEQ ID NO: 192253 - DNA, 601 bp, Human
aagctttgctcaggcatgcattatagtgctgtgagttcaatgctcatcaatcaacaataaatattacagagggtgtcttcaaacagaaacacataagacaaggttatacaatgatcagctgacaaaatattgtgaccagtagctcgcaggaacccgatgtccttataagaagagggaagtgtggacacagacacagagaagaatgccgcgtgaagacacagacacagagggaggatgggcacgtgaagccaaaggcagagactgcagtgaggctgctgcagctaaccatgcctggagccaycagaagctggaagaggcaaggaaggattctccccaagacccttgaggcagagcagggccctactgatgccttgatctgagacttctgacctccagaattgtgatggaatacatttctgttgtgtgagagccatctgttacggcagccctgagcaactaacagagaagggagagctgcaaaggccctgaggcaaggtggcccctgtggacagcagtcagtgacagggagggcccagagacccggctcacccagaagaccatgcctaggattttggtcatgaccacgatctaagactgaaga

SEQ ID NO: 192254 - DNA, 601 bp, Human
ttgctgtttaaaatggcccccaggcattgtgctgaagtgccttcccgggttcctaagaaccagaaggctatgatgcgccttacagggaaaatacgtatattagataagctttgctcaggcatgcattatagtgctgtgagttcaatgctcatcaatcaacaataaatattacagagggtgtcttcaaacagaaacacataagacaaggttatacaatgatcagctgacaaaatattgtgaccagtagctcgcaggaacccgatgtccttataagaagagggaagtgtggacacagacacasagaagaatgccgcgtgaagacacagacacagagggaggatgggcacgtgaagccaaaggcagagactgcagtgaggctgctgcagctaaccatgcctggagccaccagaagctggaagaggcaaggaaggattctccccaagacccttgaggcagagcagggccctactgatgccttgatctgagacttctgacctccagaattgtgatggaatacatttctgttgtgtgagagccatctgttacggcagccctgagcaactaacagagaagggagagctgcaaaggccctgaggcaagg

SEQ ID NO: 192255 - DNA, 601 bp, Human
caagtgttcttttcacaggctacagagtgcgacatttgtcacatcgttgtgctttttttggtgactttgctgtttaaaatggcccccaggcattgtgctgaagtgccttcccgggttcctaagaaccagaaggctatgatgcgccttacagggaaaatacgtatattagataagctttgctcaggcatgcattatagtgctgtgagttcaatgctcatcaatcaacaataaatattacagagggtgtcttcaaacagaaacacataagacaaggttatacaatgatcagctgacaaaataytgtgaccagtagctcgcaggaacccgatgtccttataagaagagggaagtgtggacacagacacagagaagaatgccgcgtgaagacacagacacagagggaggatgggcacgtgaagccaaaggcagagactgcagtgaggctgctgcagctaaccatgcctggagccaccagaagctggaagaggcaaggaaggattctccccaagacccttgaggcagagcagggccctactgatgccttgatctgagacttctgacctccagaattgtgatggaatacatttctgttgtgtgagag

SEQ ID NO: 192256 - DNA, 601 bp, Human
cctcaagacacagattggagaccactaaatccagagcggtcaagaaaatagagggaagagcgagggaagagtagttacaggataggggtaggtatagtggtcacgagtagagagcaacagacgccagttctcctgacagcctgacgtgcagaagtgctgtgcgtggtccctggcgctgcagctgagcctgagcctggcaatatggaaacacgagaggcgtgtggaagtggccctgcctccagctagtactcagaatataatatttcctccattatgtttctcacaaataaccagttggggraaaaaaaaaaaaaaacaatggtcacatctgaaatagttcaaaaagccatatggtatggttcctattcaggtgaccccctccagcccacagtggttcccgttcttatattagtgatggcttttaaagttctcacagacaggcatctctctgaaagacagcgaagatcagttttaaacggaaacagtagttgaaaaagtcaattgtcaggtaaagcaaagcaccaagacaaaaaacccaactttctgtctttaaaactaaagcctgtgtgtgaagacacattcgatccacactgttcgcaga

SEQ ID NO: 192257 - DNA, 601 bp, Human
gtgctgagattacagacatgagctcccatgctccgccctcttctaggtcttttgctagtcctacaaagcgcaaatgttgccttccacataggaaacactcactgccaggcccaggccagctctgaagacggctctgagggcctaggtggggtgccgtcagaggttggcctcctccactcatatggaggctccagccaccattctttgagacacaaacgggaaccttagagatatttcacaagaacacggaatggccacaaggagttgcagatactgctgctcttggtctcattcattcatytgttccattcattcatttgttcatccacccattcaaaggtcatgtattgagaatgatgctccaggaacagggaaagatgacattccctgccatctaggaactcccaacctaacaggacactggaaagaagggaggtaccatgccccatgaagatgataaagagtttcagaaaagactagggagtgctgggaaaagctgtgcacagaggagtgcactggtgacccctcaaaggctcaccctgcaagagctctgcccgccagggtggtgaccaccagcccagcctgatcttccctctggaaa

SEQ ID NO: 192258 - DNA, 601 bp, Human
tgcactgcagagttctacaccccgcctgactctttccttctctcctttcctggggctggggaccagggggctggggggtcggtgtactcaggggctgtgccacctgtgcaagcccagccctcgcaccggccagggggctatctggggacacaggatggtccaggcctgccctccgctgggagggtcctatggacattggagaccaggacccacactcctccccaggaatttgcctagagggaggctttatccccactgcactggccgtgttttgaggcttccgttgctcagaggccccaaygcctttggggatgatccttccaagagccaaggggtgggcagagcaaagcagttgtgggaaaaaattatgatagccaagccattccttttgagaatctgggttatacaaacgctttcaacccccaatattaacatttaaagctcgaaaggaatcagttaatttggctttcccaaagttttccaccaactacccgtccctcctgactttacttccagagcccctggaaccctgcacaggtatctcctttgcttttgcttttacccgaatgcagtctctcacccaagtgtctttcttcaatgc

SEQ ID NO: 192259 - DNA, 601 bp, Human
acccactcaccttgttaagccacttgagccccgggatcgtgttggagtttatctgctcctccagccacgggcgcatgcgcatcctttccaccggcatggtgcccttgagggagagaaacacagcgtcaggcgttggtgccactcagtgtggtgtctgcactgcagagttctacaccccgcctgactctttccttctctcctttcctggggctggggaccagggggctggggggtcggtgtactcaggggctgtgccacctgtgcaagcccagccctcgcaccggccagggggctatctggrgacacaggatggtccaggcctgccctccgctgggagggtcctatggacattggagaccaggacccacactcctccccaggaatttgcctagagggaggctttatccccactgcactggccgtgttttgaggcttccgttgctcagaggccccaacgcctttggggatgatccttccaagagccaaggggtgggcagagcaaagcagttgtgggaaaaaattatgatagccaagccattccttttgagaatctgggttatacaaacgctttcaacccccaatattaacatttaaagctcga

SEQ ID NO: 192260 - DNA, 601 bp, Human
attttactttcagcagtccgcatgggcgtgtttcagccaggacctctctcacacatacacccaccctgacccactcaccttgttaagccacttgagccccgggatcgtgttggagtttatctgctcctccagccacgggcgcatgcgcatcctttccaccggcatggtgcccttgagggagagaaacacagcgtcaggcgttggtgccactcagtgtggtgtctgcactgcagagttctacaccccgcctgactctttccttctctcctttcctggggctggggaccagggggctgggggrtcggtgtactcaggggctgtgccacctgtgcaagcccagccctcgcaccggccagggggctatctggggacacaggatggtccaggcctgccctccgctgggagggtcctatggacattggagaccaggacccacactcctccccaggaatttgcctagagggaggctttatccccactgcactggccgtgttttgaggcttccgttgctcagaggccccaacgcctttggggatgatccttccaagagccaaggggtgggcagagcaaagcagttgtgggaaaaaattatgatagccaa

SEQ ID NO: 192261 - DNA, 601 bp, Human
gcattgactcagaactgttctggtaggagaggaacttctctcctgggcctccttaaagaaggcatgatatatatttagttgcttttctagattatatagttctagaagtttttcatttttgccgacattatctctttctgattcacccctaacagctaggatcaattaaattaagagtttttaggttaacaaagtaagggagtgtttgtgcctggaaggggcaggttgtaaatgactggctgctttcttaggaaaggtggacacacagatagggcttcattacagaggtaaaaagaaggcyttttttaaagacaaaaacaagctttctttaaacagagaacatggaaaaggaaatgctccattcctaatataaaaccctggagtttccatgtcctctagtcctaaaaggccaggagaagcaaaaaaaaggaatttggagaaggaagagggtaagaatcctcaaagaagcaaggagctttccaaaaaaagcaaggagctttcgagaggcagtcagccaaaacaccaaaggtgagcagacattggagactccaggctgaggctacagtcgtacaggatacaaatccttttgtgaccgggttca

SEQ ID NO: 192262 - DNA, 601 bp, Human
tgggcaacatagtgaaaccccatctctacaaaaaatataaaaattatccaggagcgcacctgtggtcccagctacttgggagacaaaggtgggaggatcgcttcagcacagaggcagaggttacagtgagctgagatcgtgccactgcactccagcctgggtgacagagggagaccttgtctaaagaaaacaaaaaaaaaatcaaaataagtggataaaaggaaaatagtaaaaagaaataagatttgaaagatatctgaaaagacccaataaggccaggaatgatattagttaaaaaaarttatactgcaatatcctgttcccttgttggaagcaggctacaatctgcaatctggctctaagctcttgtacctgatacaaagataaagcctggccagctaaattattcattgtgtccttaagattaaaaaagaaaaggggagggagtggagaagaggaaaaaggcattgactcagaactgttctggtaggagaggaacttctctcctgggcctccttaaagaaggcatgatatatatttagttgcttttctagattatatagttctagaagtttttcatttttgccgacattatctcttt

SEQ ID NO: 192263 - DNA, 601 bp, Human
ctgagtacaagtcagctttcattcagtgtcatttgctaccctggctctccagctcccctttactctggtccccccttccttatacctccacggcacccctgctaactgagctgaccaaggagcaactccatttcttgtttgtttctttggaagaagctgattacatatgtaaatctaaaacactatagatagagcaaccctagaaaaatacattgtggtaagaccttgagatatgggacaggtcacaggaaataagcagatggtttcttcatttctatttacttagtgcctcaccttgttwcagaaaggctcagacagacatattcaacacagtaacattaaattcaaaatcaggctgggcactgcggctcatgcctgtaatcccagcactttggaaggccaaggcgggcagcacttgagtcctgaagttccagaccagtctgggcaacatagtgaaaccccatctctacaaaaaatataaaaattatccaggagcgcacctgtggtcccagctacttgggagacaaaggtgggaggatcgcttcagcacagaggcagaggttacagtgagctgagatcgtgccactgcactccagcctgg

SEQ ID NO: 192264 - DNA, 601 bp, Human
ttctccactgcatcctgccaaccaaaactagtggaggtatttttgaaaaaggaaaagcagaagcagaccacttgcttctctttagaacacaggagcatttgctttcctctcccactccacatcaaacagtaatgctaccttgttcctcaaaacagaatcttacttaacctctctgtgccttggtttccttgtctgtaaaatggaaaatattaactgtacctaccccatggtggcggaacgtgagctaatgcatgtaccttgcttagaagggtgcctggcacacagtaagtgctgagtacamgtcagctttcattcagtgtcatttgctaccctggctctccagctcccctttactctggtccccccttccttatacctccacggcacccctgctaactgagctgaccaaggagcaactccatttcttgtttgtttctttggaagaagctgattacatatgtaaatctaaaacactatagatagagcaaccctagaaaaatacattgtggtaagaccttgagatatgggacaggtcacaggaaataagcagatggtttcttcatttctatttacttagtgcctcaccttgtttcagaaaggc

SEQ ID NO: 192265 - DNA, 601 bp, Human
tctgtctcttataaagacactcctcattggcatcagggcccacccagaaaatccaggatgatttcatctcaaggtccttcactatatctgcaaaaaccctttttccaaatgaggtgacatccacaggttctggaggttaggatgtggacatatcttctccgggagccacagttccatctactacagcaccaagaagggactaatggttagtctaaaccaaccacagcggtcaacatatcaggcacctgctcaacaggagaggtgtgagacactgtctcttctccactgcatcctgccaacsaaaactagtggaggtatttttgaaaaaggaaaagcagaagcagaccacttgcttctctttagaacacaggagcatttgctttcctctcccactccacatcaaacagtaatgctaccttgttcctcaaaacagaatcttacttaacctctctgtgccttggtttccttgtctgtaaaatggaaaatattaactgtacctaccccatggtggcggaacgtgagctaatgcatgtaccttgcttagaagggtgcctggcacacagtaagtgctgagtacaagtcagctttcattcagtgtcat

SEQ ID NO: 192266 - DNA, 601 bp, Human
cctctgtgtgtgccttctcctcttctgtctcttataaagacactcctcattggcatcagggcccacccagaaaatccaggatgatttcatctcaaggtccttcactatatctgcaaaaaccctttttccaaatgaggtgacatccacaggttctggaggttaggatgtggacatatcttctccgggagccacagttccatctactacagcaccaagaagggactaatggttagtctaaaccaaccacagcggtcaacatatcaggcacctgctcaacaggagaggtgtgagacactgtctsttctccactgcatcctgccaaccaaaactagtggaggtatttttgaaaaaggaaaagcagaagcagaccacttgcttctctttagaacacaggagcatttgctttcctctcccactccacatcaaacagtaatgctaccttgttcctcaaaacagaatcttacttaacctctctgtgccttggtttccttgtctgtaaaatggaaaatattaactgtacctaccccatggtggcggaacgtgagctaatgcatgtaccttgcttagaagggtgcctggcacacagtaagtgctgagtaca

SEQ ID NO: 192267 - DNA, 601 bp, Human
ggctgcggctgcctatttccagtctctgcctcagtcctcacatgcccctctcctctgtgtgtgccttctcctcttctgtctcttataaagacactcctcattggcatcagggcccacccagaaaatccaggatgatttcatctcaaggtccttcactatatctgcaaaaaccctttttccaaatgaggtgacatccacaggttctggaggttaggatgtggacatatcttctccgggagccacagttccatctactacagcaccaagaagggactaatggttagtctaaaccaaccacagyggtcaacatatcaggcacctgctcaacaggagaggtgtgagacactgtctcttctccactgcatcctgccaaccaaaactagtggaggtatttttgaaaaaggaaaagcagaagcagaccacttgcttctctttagaacacaggagcatttgctttcctctcccactccacatcaaacagtaatgctaccttgttcctcaaaacagaatcttacttaacctctctgtgccttggtttccttgtctgtaaaatggaaaatattaactgtacctaccccatggtggcggaacgtgagctaat

SEQ ID NO: 192268 - DNA, 601 bp, Human
tccctcggctgcggctgcctatttccagtctctgcctcagtcctcacatgcccctctcctctgtgtgtgccttctcctcttctgtctcttataaagacactcctcattggcatcagggcccacccagaaaatccaggatgatttcatctcaaggtccttcactatatctgcaaaaaccctttttccaaatgaggtgacatccacaggttctggaggttaggatgtggacatatcttctccgggagccacagttccatctactacagcaccaagaagggactaatggttagtctaaaccaaycacagcggtcaacatatcaggcacctgctcaacaggagaggtgtgagacactgtctcttctccactgcatcctgccaaccaaaactagtggaggtatttttgaaaaaggaaaagcagaagcagaccacttgcttctctttagaacacaggagcatttgctttcctctcccactccacatcaaacagtaatgctaccttgttcctcaaaacagaatcttacttaacctctctgtgccttggtttccttgtctgtaaaatggaaaatattaactgtacctaccccatggtggcggaacgtga

SEQ ID NO: 192269 - DNA, 601 bp, Human
gacgctcagcaggtaaggactgcctgaaaggggccaagtgttcatttgcacaaagggaaatccatttgccttctggtcctgtatcagaaaaacatggacaaaatagatggaagaaaaggcatctcaactgagagtcccagaaaggaagtgacccttagagggtgcatcaatctcctaagactgtcatgaaaaattacacaaactgggtggctcacagcaacagaaatgtattccatcacagtcctgaaggccagaagtccaaaatcaaggtctctgcagggctcactccggtttttttttktttgtttgtttgtttgtttgtttgtttttgagatggagtcttgctctgtcacccaggctggagtgcagtggtgcaatctcagctcacgcaacctccaccactgcaacctcaacctcccaggttcaagtgattctcttgcctcagcctcccaagtagctgggattacaggcacctgccaccacacccagctaatttttgtgtttttagtggagatggagtttcaccatgttggccaggctggtctcaaactcctgacctcaggtgatctgcccaactcagcctcccaaagtgcggggatta

SEQ ID NO: 192270 - DNA, 601 bp, Human
catgagggccctgccctcatgaatggattaatccattcagggattaatggattaatgagttgtcatgaggggtaggattgtggctttttaagaggaagagagacctgtgctagcacgtgagcatgctctttccccgcaccgggtgatatcctgcactgcctcaggactttgcagagggtccccaccagcaagaaggccctcaccagatgcagcccctcaaccttggacttctcagcctccataactataagaaataaattcctcttctttacaaattatccagagtcaggtattctgttakaagcaacagggaacagactaagacaatagaggatggaaacaaatttaaggcattaattaaccaactctttctctcttactaagaatggagtaggttgaatggactttctgagagccatgtgacaactgccaagccagtgtccataaatctgattatcttaacagaacaaaaacaccaccaatgttgctccccttcaagtccatgacattcatctgtgtattcccagaacaattttgacagagggcctcccacttaccaggcactaggcctggccctgagcatgcagacatgaagaagata

SEQ ID NO: 192271 - DNA, 601 bp, Human
ttaatccccaatgtggcagtactgagaggtgaggcctttaagaggtgattgagtcatgagggccctgccctcatgaatggattaatccattcagggattaatggattaatgagttgtcatgaggggtaggattgtggctttttaagaggaagagagacctgtgctagcacgtgagcatgctctttccccgcaccgggtgatatcctgcactgcctcaggactttgcagagggtccccaccagcaagaaggccctcaccagatgcagcccctcaaccttggacttctcagcctccataactrtaagaaataaattcctcttctttacaaattatccagagtcaggtattctgttagaagcaacagggaacagactaagacaatagaggatggaaacaaatttaaggcattaattaaccaactctttctctcttactaagaatggagtaggttgaatggactttctgagagccatgtgacaactgccaagccagtgtccataaatctgattatcttaacagaacaaaaacaccaccaatgttgctccccttcaagtccatgacattcatctgtgtattcccagaacaattttgacagagggcc

SEQ ID NO: 192272 - DNA, 601 bp, Human
aacttcctcgctgttccttcagaggaatccaagggacccattccattcccaccctccttcaaacttattaaaagtaggtgctatggtttgaatatttgccccctatgacacttatattgacatttaatccccaatgtggcagtactgagaggtgaggcctttaagaggtgattgagtcatgagggccctgccctcatgaatggattaatccattcagggattaatggattaatgagttgtcatgaggggtaggattgtggctttttaagaggaagagagacctgtgctagcacgtgagcaygctctttccccgcaccgggtgatatcctgcactgcctcaggactttgcagagggtccccaccagcaagaaggccctcaccagatgcagcccctcaaccttggacttctcagcctccataactataagaaataaattcctcttctttacaaattatccagagtcaggtattctgttagaagcaacagggaacagactaagacaatagaggatggaaacaaatttaaggcattaattaaccaactctttctctcttactaagaatggagtaggttgaatggactttctgagagccatgtgac

SEQ ID NO: 192273 - DNA, 601 bp, Human
cctggtctcaacaagtcaatggcgagaaggaaaaaaacagaggcccacagtcagcagagacttagagtcataaacaccaaacacaacctgtggacagtctttgaattctgatttgaacaaatcaactgtaaaaagattatttgggaatactcaaggcattcttaatatgaatggagcagtgatgatattaaacagtactaattttgtccaattaacaatggtatattgtggatatataagaaaatgcccttatgtcttacaatgtatgctgtcagggagctgctttaatataccagatacrcacagatacacacacacacacacacaaagataaggcaaaatattcatacatctagatacaggcatatgaaaatttgctatcctatttctttttgtcattgggctactcaaacatgctatgcacatttgcaaatacccataaccaaaggtaaattgccccagccaaggtctcattcatgagctggttataatgcacttttccaaacttcctcgctgttccttcagaggaatccaagggacccattccattcccaccctccttcaaacttattaaaagtaggtgctatggtttgaatatttg

SEQ ID NO: 192274 - DNA, 601 bp, Human
tctcatccccgagtgaccagtcctgcacacgtggtggtggtacatgctgtgtatagacagacgcgccatgccagggcccaccatttgtacgtgtgtgcacaactctgcccatctgaaggaaggcaggagagatgagcgctgcttgacttcagaaaagcatctgacattattttgagcaatgtagaacaatgttccttggccccacatggaaactagttctgttatctcctctgcctcttcttccccccaacatttgcaagacgttccaattagtgtgctatttttgtctggactccttacygtggtcagagatagcctgatgtttacacaaacacaagtctactctcaaagtgaaaaaaagggaaagatctgatgattcccctgccttagtgcatggatccaggaagaactaagaacatcaataaccccaccagagttgggggtcacatggagccacgagagaaaccaggaccccggatgtgactgcctccttccttcctcaagaaatggcccagggaaccacaagcaagcatgtggacaaacccaaaactaacctggtctcaacaagtcaatggcgagaaggaaaaaaacagaggcccac

SEQ ID NO: 192275 - DNA, 601 bp, Human
acggtgttgctatgtgtgtgtagaccccgtgacgtcagtatgtgccaggtgtctcatccccgagtgaccagtcctgcacacgtggtggtggtacatgctgtgtatagacagacgcgccatgccagggcccaccatttgtacgtgtgtgcacaactctgcccatctgaaggaaggcaggagagatgagcgctgcttgacttcagaaaagcatctgacattattttgagcaatgtagaacaatgttccttggccccacatggaaactagttctgttatctcctctgcctcttcttccccccarcatttgcaagacgttccaattagtgtgctatttttgtctggactccttaccgtggtcagagatagcctgatgtttacacaaacacaagtctactctcaaagtgaaaaaaagggaaagatctgatgattcccctgccttagtgcatggatccaggaagaactaagaacatcaataaccccaccagagttgggggtcacatggagccacgagagaaaccaggaccccggatgtgactgcctccttccttcctcaagaaatggcccagggaaccacaagcaagcatgtggacaaacccaaaac

SEQ ID NO: 192276 - DNA, 601 bp, Human
aataacaaacgttggtgaggatgtggagaaactggaatcctcacacatcgctgtggaaatgcaaaatggtacagccactctggagaaaaagtttggccattcctcaagaaagtgaaacacagaattacctgatgatccaggaattttacacctggatatatacccaaagaattctaagccaacattcaaaccaaaacataaatgttcatagcagcactactttcaaaagccaaaagatggaaacaacccgagtgtccatcagctgatgaatgggtaaacaaaatgtggtatatccatacartggaatattattcagccacaaaaaggaatagagtattgacacatgctaccatgtggacgaaccttgaaaacattatgctggatgaaagaagccagacacaaaaggccaaaaattgaatgattccatttacatgaaatattccagaaaagacagagagcagagagcagacagagagcagagatccatagagacagagagcagattactggttgccacaagctaggggggagggaaatgggaagtgactgattaatgggtacagcatttccttttggagggataaaaagttctggaactgga

SEQ ID NO: 192277 - DNA, 601 bp, Human
cctcccatcctgaggccttaacagaggcagatgccaaggtcatgcttcttgtacagcctagaaccctgacccaaagaagcctcgtttttttataaattacccagccccaggtagtcctttgtagcaacatgaaacagactaacccacagacatgtctccaaaaaaagatacacaaataacaaacgttggtgaggatgtggagaaactggaatcctcacacatcgctgtggaaatgcaaaatggtacagccactctggagaaaaagtttggccattcctcaagaaagtgaaacacagaattrcctgatgatccaggaattttacacctggatatatacccaaagaattctaagccaacattcaaaccaaaacataaatgttcatagcagcactactttcaaaagccaaaagatggaaacaacccgagtgtccatcagctgatgaatgggtaaacaaaatgtggtatatccatacaatggaatattattcagccacaaaaaggaatagagtattgacacatgctaccatgtggacgaaccttgaaaacattatgctggatgaaagaagccagacacaaaaggccaaaaattgaatgattccat

SEQ ID NO: 192278 - DNA, 601 bp, Human
tccacctcctgggttcaagagattctcccacctcagcctcctgagtagctaggattactggcatgtgccaccacgcctggccaagttttgtatttttggtagagatggggttttgccatgctggccaggctggtctcgaactcctgacctcaagtgatctgcccacctcaggcttccaaactgctgagattacaggtgtgagccaccacacccggccctgtgcctcttttttttataaaaccacagaaaaatggccacctaccgaaacttctaatgcttactcttataatttattctcgtygtttggtaaatagtaactccagctatcttaggtaaattaaaaattagacaagtttccaaaacccttgatgctactaaagaaaagtcgggtacatctgaggccactgtcacagaaaccaaatatctccatttgcttgtgcatccaacagaaatagaaagtaatgttcgaatccctgtgggtctactgcctgcaagaaatagcaagaagtgcaaacaaagaggtagaggttatgaaatgacacatttttctggagaaacatccctcaatacaatccttatatcagactatctctacatctct

SEQ ID NO: 192279 - DNA, 601 bp, Human
actgaagctcgtccccagttttgcagggcatattcggctcttctcttactatttaacaagggccacctaatctatgcataaagatcctcagactgtaggggagttcagacgacacagcctagtgagaagctgacacacacatgcacatcccatggaaaacccttgtggggtgtgagagatgattctacagtggacagaaggcagccattgagagctgtgctgatagagtgctgacattgaccactctgtcccccaccgaagggcctgtgacggaatgtctgtaacatagagttcatacatygtatagaggtctataacatttaatacatattaaagtatacttaatagcctgaaaatatacttaatagtatgagacataagctgttgtggagtttagctggcacaaaatgaccactggcaacggctgtggtggccagatggaggcctcagcctgccgagcacagtgagaatctgtgacttcattcataaatttcccagagaaacgggatgaggcagggccctgtgtacctccatgtctgcaagtggatacatgctgaagagcaaacatgtaaagcacagaagacacaagcaaaggaagaaa

SEQ ID NO: 192280 - DNA, 601 bp, Human
ataaataaattacttctgtaagtcaaaaatggttgaagggctgcaatttcatgttagaagtcaggaaatgggaggggctattgatgaagcaaaactggccaggagctgattaaggttaaaattaatctgaatgatggcctatggggtaaattttactcaactgtctccttcctatgtgcataaaatctttccacaatgaaaagttaaaacaaaattaggcctttaatacagtacaatatttaaatttagttaaaaataaaaactagtaaaagtgaaactgaaagcatcactgcaaaaacascctccgcctaaatttcttcatctgcaaagggaggccagggagctcgacaatctctctgagatccctgggtctgtgaccgcagtgtatgctctctgctcagccactgaagctcgtccccagttttgcagggcatattcggctcttctcttactatttaacaagggccacctaatctatgcataaagatcctcagactgtaggggagttcagacgacacagcctagtgagaagctgacacacacatgcacatcccatggaaaacccttgtggggtgtgagagatgattctacagtggacaga

SEQ ID NO: 192281 - DNA, 601 bp, Human
ggaagaaatgctatgaggtttggaatttgcttcaaattccaaaaaatagttcaaaaaaaaagctgaactataaaaaattgttttggggccgagtgccgtggctcacgcctgtattcccagcactttgggagactgaggtgggcgaatcacttaaggtcaggagttcaagaccagcctgtccaacatggtgaaaccccatctctactaaaaatacaaaaattagctgggcatggtggcacgtgtttgtagtctcagctactcgggaggttgaggcaggagaatcgcttgaacccaggaggcrgaggttgcaatgagccaagatcgcgccattgcactccagcctgtgccaatagagcaaaactccatctcagtttaaaaaaaattaaataaataaattacttctgtaagtcaaaaatggttgaagggctgcaatttcatgttagaagtcaggaaatgggaggggctattgatgaagcaaaactggccaggagctgattaaggttaaaattaatctgaatgatggcctatggggtaaattttactcaactgtctccttcctatgtgcataaaatctttccacaatgaaaagttaaaacaaaat

SEQ ID NO: 192282 - DNA, 601 bp, Human
atgtgtgagaaagctgtgcttttctgactaaataacatgaatcaaaacgtaggccttaaaaatacaaactcagccaggctcacacttgtaattccaacattttgggaagccgaggcaagaggattacttgaggccaggagtttgagaccagcctgggcaacagaatgaaacctcacctctataaaagaaaatttttttaaattatccatgcttggtggcacacacctgtagacccaactactagagggaggctgaggtgggaggatcacctgagcccgggaggttggggctgcagtgagcyatgatcgcgtcacttcactccagcctgggtgacagagtaagaccttgtctcaaaaaaaaaacaaaaaaaaaaaaaacgaaaaaaaaaactgtgagaaacgatatggctaacaactaggtttgttcaattgtaaaaaaaaaaaaatgttttaagaggtaatataggagaaacatatatccttaaaaaatacttaaaagacattcaaaaatcacatgtggattttatatgggtcttaatttaagtaacaaactacacgaatgttataacatgtatgaaacaactgaaactctgaccactggc

SEQ ID NO: 192283 - DNA, 601 bp, Human
aatacgattcagtcacacttgaaattgtagcaaattctcacacatgtgtgagaaagctgtgcttttctgactaaataacatgaatcaaaacgtaggccttaaaaatacaaactcagccaggctcacacttgtaattccaacattttgggaagccgaggcaagaggattacttgaggccaggagtttgagaccagcctgggcaacagaatgaaacctcacctctataaaagaaaatttttttaaattatccatgcttggtggcacacacctgtagacccaactactagagggaggctgaggygggaggatcacctgagcccgggaggttggggctgcagtgagctatgatcgcgtcacttcactccagcctgggtgacagagtaagaccttgtctcaaaaaaaaaacaaaaaaaaaaaaaacgaaaaaaaaaactgtgagaaacgatatggctaacaactaggtttgttcaattgtaaaaaaaaaaaaatgttttaagaggtaatataggagaaacatatatccttaaaaaatacttaaaagacattcaaaaatcacatgtggattttatatgggtcttaatttaagtaacaaactacacga

SEQ ID NO: 192284 - DNA, 601 bp, Human
tccacaacttgctcatttcagggccatgtgaagacaccaccagtgcccatgtggctgtagagatcccagacaaacgggaccaccacatggcatgaactactaagatgtacatttcctcgcattgccacatccctgaaagaggacatgcctttcaatccattacgtgtcatggtttcattgcaagcagtttttctaagagatacataaaataacagtgcatcttagcatcattggcatctggcgttcgatggaatacagtgggtacatgtgagcaaagtgtgctgaaaaggcaacatctgtcactccgttcttatttctccattaactgcgattatgaaattaaatctgcatcctaatggaaaacccctcactcccaccccacatatcctacttatttatacatctatttagtcaacaaatgcggatgcatctattcagttatcaaatacgtattagtgatctgttctgggccaggcactgagctagataatgggaaaagagtagtaaatacgattcagtcacacttgaaattgtagcaaattctcacacatgtgtgagaaagctgtgcttttctgactaaataacatgaatcaaaacgtag

SEQ ID NO: 192285 - DNA, 601 bp, Human
cccacccaggaccgtgccttccacaacttgctcatttcagggccatgtgaagacaccaccagtgcccatgtggctgtagagatcccagacaaacgggaccaccacatggcatgaactactaagatgtacatttcctcgcattgccacatccctgaaagaggacatgcctttcaatccattacgtgtcatggtttcattgcaagcagtttttctaagagatacataaaataacagtgcatcttagcatcattggcatctggcgttcgatggaatacagtgggtacatgtgagcaaagtgtgytgaaaaggcaacatctgttactccgttcttatttctccattaactgcgattatgaaattaaatctgcatcctaatggaaaacccctcactcccaccccacatatcctacttatttatacatctatttagtcaacaaatgcggatgcatctattcagttatcaaatacgtattagtgatctgttctgggccaggcactgagctagataatgggaaaagagtagtaaatacgattcagtcacacttgaaattgtagcaaattctcacacatgtgtgagaaagctgtgcttttctgactaaat

SEQ ID NO: 192286 - DNA, 601 bp, Human
tctctcacttacttccctgggccaggatggtcaagcccacccaggaccgtgccttccacaacttgctcatttcagggccatgtgaagacaccaccagtgcccatgtggctgtagagatcccagacaaacgggaccaccacatggcatgaactactaagatgtacatttcctcgcattgccacatccctgaaagaggacatgcctttcaatccattacgtgtcatggtttcattgcaagcagtttttctaagagatacataaaataacagtgcatcttagcatcattggcatctggcgttcratggaatacagtgggtacatgtgagcaaagtgtgctgaaaaggcaacatctgttactccgttcttatttctccattaactgcgattatgaaattaaatctgcatcctaatggaaaacccctcactcccaccccacatatcctacttatttatacatctatttagtcaacaaatgcggatgcatctattcagttatcaaatacgtattagtgatctgttctgggccaggcactgagctagataatgggaaaagagtagtaaatacgattcagtcacacttgaaattgtagcaaattctcac

SEQ ID NO: 192287 - DNA, 601 bp, Human
ttgggaaaagcttgcttcaacagcaaatattcatacctagttaccatatgaaagacaaatttcctcagtagaagaaacctacgtagtgtatccagttacatatttggatagactaagtaggtttagtatatttgcacaggatatattaactcagtgcttgggtgttttgatacacaattaaaaagtaatatattaatagctagtaattgtcctctgactttccaattccagacgccctagggagttcacttttcaaacactctacagagacactgagtccacacaatagcttgaacagccrggaagcacagaactcgggaagcccactggcctcttctgagcttccctgctacactggaaagcacaatgcaagtagatctaaattcaaaagtaaggctgtgtttaggcctaatgaatcacctgccttccgctgaaggaatcaggtcctttcaagaaaaaagtttcaggtatgaatcatatcttcacggcacaaggatttcataaaacacacttggctgaggtggctcttgacccacacggctgcacctaacgggatctctcacttacttccctgggccaggatggtcaagcccacccagga

SEQ ID NO: 192288 - DNA, 601 bp, Human
ggggtcctgctctgttgcccaggctggagcgcagtggtgcaatcacggctcactgcagcctcaaactcctgggctcaagccatcctcctacacctcagcctcctgagtagctgggacaggcatgtaccactgtacccagctgtttttcttgttcttatttccttagataaccagttaccgccgcacaggtggggcttagctcaaggaaaacatggctgactgagtttgtagggatatgctcacaaagcgaaatgtcagaggatgctgaggccgtttctgcacctgccacatggccaatggkccttgggtgttccagtcttggggagactatttgttgggggacatatagcatggagataaatcatgagtgaccccaagaaaattctaatacttggcctacatgttgtaaacattgtttgctaattaaaacttcaacttgaagattgggaaaagcttgcttcaacagcaaatattcatacctagttaccatatgaaagacaaatttcctcagtagaagaaacctacgtagtgtatccagttacatatttggatagactaagtaggtttagtatatttgcacaggatatattaactcagtgct

SEQ ID NO: 192289 - DNA, 601 bp, Human
atgcctgtatttcccattgccctctcacacaaactcctgctctaattaagccagtttcctgtctcatccaggaaagacaaaccaactgtaatctccaggccttcattcctgatgcccctagtgctgcggaaggaccagtttgaccctgtccacccctcaaggcctggcttaggccccaaaggctacgaggcacccggtggacaaacttggattcaaatctcagctctgtaaagcaatgcagccttgggaaaatgaatcagcttctctgtgcacccatttcctaaatgtataaaagggaaaygacctgcccatcacagggagaactcagtgagacaaaaatcatagctgggaacttggaatcagctcaaaaatatcaactagcacccctctgttttaactacttctattcttactgttcttggccttgtctgaagtctcagagcaaaccgttccatgatattttctgaaacatatacatgcactgatgatgtagaatccaggatttctcattattgtttttctttcttttttgaggtggggaaggggtcctgctctgttgcccaggctggagcgcagtggtgcaatcacggctcactgcagc

SEQ ID NO: 192290 - DNA, 601 bp, Human
acatgcctgtatttcccattgccctctcacacaaactcctgctctaattaagccagtttcctgtctcatccaggaaagacaaaccaactgtaatctccaggccttcattcctgatgcccctagtgctgcggaaggaccagtttgaccctgtccacccctcaaggcctggcttaggccccaaaggctacgaggcacccggtggacaaacttggattcaaatctcagctctgtaaagcaatgcagccttgggaaaatgaatcagcttctctgtgcacccatttcctaaatgtataaaagggaratgacctgcccatcacagggagaactcagtgagacaaaaatcatagctgggaacttggaatcagctcaaaaatatcaactagcacccctctgttttaactacttctattcttactgttcttggccttgtctgaagtctcagagcaaaccgttccatgatattttctgaaacatatacatgcactgatgatgtagaatccaggatttctcattattgtttttctttcttttttgaggtggggaaggggtcctgctctgttgcccaggctggagcgcagtggtgcaatcacggctcactgca

SEQ ID NO: 192291 - DNA, 601 bp, Human
gtctcaaccctgtgctaatgccccttgtccctgaagtcccatttaatgggcctccagcccacctcccaccttccaaaatgctctaactcatctgtgcaaagccagtctctttgaagccagatttaaggacatcaaatttaaggacatctctaagtctctgctaacagaacgtgtaggctgacagctggacttcactagcaggtcagggaactggaccttggcgagtgcacacacccagcacagaggcgcaatgccactgacaacagaagctctcgtaagacaggctggggcctcctgcccrgtcccagaaccaccttccttctgctccttgcttggaatgaggccatcgtcattctcttcctcccttctctcactgcagcttccctcttgactttttcccttagctcacttttctctgcatcttctctgcgggcctttgtctgcatctcttagagaaggcatcagtttccaaagctaccaacgccattctcaagtaaatgaccacacatctgcccgttgggcactcactcaagtgctgtaccctccaactttctagctggcatttaccttcagggctctctgtcacttcaaaggcagcatg

SEQ ID NO: 192292 - DNA, 601 bp, Human
aatacacctttagctggtcttgaagctacacttgctgaatgggcttggggacagaccagagttagaggacagcagagggactcccctctgctccgagcccatgctgtctcaaccctgtgctaatgccccttgtccctgaagtcccatttaatgggcctccagcccacctcccaccttccaaaatgctctaactcatctgtgcaaagccagtctctttgaagccagatttaaggacatcaaatttaaggacatctctaagtctctgctaacagaacgtgtaggctgacagctggacttcacwagcaggtcagggaactggaccttggcgagtgcacacacccagcacagaggcgcaatgccactgacaacagaagctctcgtaagacaggctggggcctcctgcccggtcccagaaccaccttccttctgctccttgcttggaatgaggccatcgtcattctcttcctcccttctctcactgcagcttccctcttgactttttcccttagctcacttttctctgcatcttctctgcgggcctttgtctgcatctcttagagaaggcatcagtttccaaagctaccaacgccattctcaagta

SEQ ID NO: 192293 - DNA, 601 bp, Human
aatgaagaaaaggggtgtggagttctctatgtaaaataaacacagagatcctgcaggccctgaacactcttcgcccgaagcctctcctggacccccgatgccccactcctgccctggctcaactcctgctttgctgcaccataacctggcccggttaatcctggtcaggattcacatcccctctgtctgctccctttctcactttagatagaggctcttctgtaaatcaagtaacccatagctttcttggcttttaattttctccccttgctccaaagattaaaaaaaaaaaaaaaaaaaraaaagactctgcttgggtccagacttctccacggtgcatgaactccagcaaacatttatgttcaaaaatctttgctctaattgtagaatccaaggattgatctacgtgggtgcatgaactccgccaaacattgacgctcaagaacctttgctataattacagaatccaaggtttggtctctggtttaagggattttaagcaaaagcaaactggcacaagagagagttcaggggcaggagcacacttctttagacctgtaaaataatacacctttagctggtcttgaagctacacttgctg

SEQ ID NO: 192294 - DNA, 601 bp, Human
atcttcactaaactgggtcacaatttttgaaatgattagaagtaggaatatctaaatctaaggtatattaaaaatccaaggatctcaaatgaagaaaaggggtgtggagttctctatgtaaaataaacacagagatcctgcaggccctgaacactcttcgcccgaagcctctcctggacccccgatgccccactcctgccctggctcaactcctgctttgctgcaccataacctggcccggttaatcctggtcaggattcacatcccctctgtctgctccctttctcactttagatagagrctcttctgtaaatcaagtaacccatagctttcttggcttttaattttctccccttgctccaaagattaaaaaaaaaaaaaaaaaaaaaaaagactctgcttgggtccagacttctccacggtgcatgaactccagcaaacatttatgttcaaaaatctttgctctaattgtagaatccaaggattgatctacgtgggtgcatgaactccgccaaacattgacgctcaagaacctttgctataattacagaatccaaggtttggtctctggtttaagggattttaagcaaaagcaaactgg

SEQ ID NO: 192295 - DNA, 601 bp, Human
acggagccagcacctcccgaaacacctccatccagggtgcagaacaggcccaggagagaaggatcttcactaaactgggtcacaatttttgaaatgattagaagtaggaatatctaaatctaaggtatattaaaaatccaaggatctcaaatgaagaaaaggggtgtggagttctctatgtaaaataaacacagagatcctgcaggccctgaacactcttcgcccgaagcctctcctggacccccgatgccccactcctgccctggctcaactcctgctttgctgcaccataacctggccyggttaatcctggtcaggattcacatcccctctgtctgctccctttctcactttagatagaggctcttctgtaaatcaagtaacccatagctttcttggcttttaattttctccccttgctccaaagattaaaaaaaaaaaaaaaaaaaaaaaagactctgcttgggtccagacttctccacggtgcatgaactccagcaaacatttatgttcaaaaatctttgctctaattgtagaatccaaggattgatctacgtgggtgcatgaactccgccaaacattgacgctcaagaacctttgc

SEQ ID NO: 192296 - DNA, 601 bp, Human
tttctgtcttaagaagcccttgtatcctgccctaattccagcggagactgagacactcttttgaacactgttctactctctctccacacttttttttttttttttgacatggggtgtcacactatcacccaggctagagtgcaatggcgtgatcttggctcactgcaacctccacctcccgggttcaagagattctcctgcctcagcctcccaagtagctgggattacaggtgcctgccaccatgccgggctaattttttgtatttttagtagagatggggtttcaccatgttggccaggytggtctcgaacccctgacctcaggtgatctgcccacctcggcctcccaaagtgctgggattacaggcatgagccaccatgcccagccttctactctctccattcttaccctgtatcctgcactgaccacttctataatggcatcatatattccaccgatggaggctaggagagactattccaaacactgtgttactcccctcaccccacttcaaaagaaaccctgtcatttcagagccatcagtgccaatcatctcactgacaccgtcactctggacagacagtacagtcaatggcacag

SEQ ID NO: 192297 - DNA, 601 bp, Human
gcgtcctcaatgacccctggtcagtttccccaccccgagtcatgccccacctttcactagtccacctccatctcttcaactccctcaaaaagaactaagcacaggcctctgaagaagttacaagagaactgctcatttgtatgggcttcctttgctgtctgaccttatttttttagtcattctgtttctaggtttcttataaaagtaatgaggcagtcaggcttgcatatatttaaaaagctaaattaattctgatttctccattgaagacctctaagtgttacacatgatctacagtttrattagtgacaagtgatacttttatcacttgagaaaacgatgactcagagactaaattaattttccaagatcacgctacttttagcctgcagagacaccggaactgaactctgtctttggtcacgaaatatggttcaattccaggagctttctgtcttaagaagcccttgtatcctgccctaattccagcggagactgagacactcttttgaacactgttctactctctctccacacttttttttttttttttgacatggggtgtcacactatcacccaggctagagtgcaatggcgtgat

SEQ ID NO: 192298 - DNA, 601 bp, Human
agtgggcagggcctagatcatgccagaccccggggacctgggggaactcagctccttctcttaggggcagtggtgacatgatgacactggcattctttattttgtgagaagaagaaatggggagcagaatggaagcagagcccaggtgacagccaaggcaggcccacacacagtgtcagaaacaaggggatggacttgagaagtacggtgagggaagataggaggagctgacagctaattataaacgaggcagcggcagccagggagagagggaaggagaaaataatatatagcctcacamaaagatgacagctttcttgagtaaataaaaacttcttaaggctgaaaacacagcagcccaactccactgcccaggtctctcggttggcacctggtgactgaggagtggccccacagtctcacctcagtgcccaggtgctccaggtccaatacagccaagaataaagtatgttgttgtgggttctgtgtctgggcatattgcgatgtaagggttcacatctcatatggagtttcatcttgctaagagcattctaggggtgtggataaaatcgaatgccttgtctcaggccccttctcctaa

SEQ ID NO: 192299 - DNA, 601 bp, Human
gtttaggcactcgagagccatggtgggagagaaggtcaccgcggggccggtgactccgagacagggatctgtaggtgcctgggccaggctgtccctgactacaggctgcatacacctcaccagggtgacagagtgcaggaggaggcaagagtgggacagggcagcgtgcaccttgcaccccgtgagaaaacagcatctcaggctactacacgaagggaagcacaggatgtatcccagtaaaaactcagtagaggccaggcgcggtggctcacacctgtaatcccagcactttgggagaccraggtaggtggatcatttgaggtcagcagttcaagaccagcctgaccaacatggtgaaactccatctctactaaatacaaaaaaaattacccaggcatggtggcgcatccctgtaatcccagctacttgggaggctgaggcaggagaatcgcttgaacccaggaggcggaggttgcagtgagccgagattgtgccactgcactccagcctgggcaacagagtgaaactcggtctcaaaaacaaaacaaaacaaaacaaaactcagtagaggtaaccagtgtctcaagggtcaatgatctgg

SEQ ID NO: 192300 - DNA, 601 bp, Human
agtcacccacaggaatgcaattttatctgaatctagttgctgagaattataacaatattatttatggctggttactgatgaaccggtttgcttctttaaaaggtcattctcactttattagcaattgttgacttaatgtaggtctccacctgagaaagcaacttgctcccatgcctcagagaaagtgcttaaaagcagattattagaaacagaggggtccttggaggtggtttggtcctaccattttacagttgaaaaaagctgaaacccagagctcaggtaaattgctaaggtcacccakgtagctgcagagtcaagaatgaaacttactagcaggcataaaaaatcaggccatcagcagagcatcatgcagggaaatttcccctgacccctctgaaagtttcaggagttaaacttcacaccagccttgatgacatggcacagatggaggctacttttcttaatcaaatatattttaatatgattttggtaatatgataatcatatcattttacccccttctagccccagagtgatttatctgtacatttcacttcatcctcacaataactctgcgagatgggcaggatcagtacgatta

SEQ ID NO: 192301 - DNA, 601 bp, Human
atagtgacatttcttttcaacagttatctattgtgtgccagggaaattctcaaacagaagaactagaaatccactaagtttctccagtttattaaagtcagcacatctgaaaagagtcacccacaggaatgcaattttatctgaatctagttgctgagaattataacaatattatttatggctggttactgatgaaccggtttgcttctttaaaaggtcattctcactttattagcaattgttgacttaatgtaggtctccacctgagaaagcaacttgctcccatgcctcagagaaagtrcttaaaagcagattattagaaacagaggggtccttggaggtggtttggtcctaccattttacagttgaaaaaagctgaaacccagagctcaggtaaattgctaaggtcacccatgtagctgcagagtcaagaatgaaacttactagcaggcataaaaaatcaggccatcagcagagcatcatgcagggaaatttcccctgacccctctgaaagtttcaggagttaaacttcacaccagccttgatgacatggcacagatggaggctacttttcttaatcaaatatattttaatatgattt

SEQ ID NO: 192302 - DNA, 601 bp, Human
ctaccacctcccaagacctcacaacccatgaggaaggcacaatagtgatccccattctagacatgctgaaacaaccatacaagacagaactacatgactaattcaaggtcagacagacaatcagcagcagaaccgggattcaatgttagccttacccaactccaaatttcaactctttataatatgctctccctaacagagagagttaatgaagtccaaactgagttactgagggctttcttagcccctctcaggataaaaacttttgaatctcaccttagtgagtctccaggctcagaaytaatagtgacatttcttttcaacagttatctattgtgtgccagggaaattctcaaacagaagaactagaaatccactaagtttctccagtttattaaagtcagcacatctgaaaagagtcacccacaggaatgcaattttatctgaatctagttgctgagaattataacaatattatttatggctggttactgatgaaccggtttgcttctttaaaaggtcattctcactttattagcaattgttgacttaatgtaggtctccacctgagaaagcaacttgctcccatgcctcagagaaa

SEQ ID NO: 192303 - DNA, 601 bp, Human
attgtgtcacatctagctgtgtgaatgtttgtgttcaggttttgtatgaacataagtttccatttctctgggataaatgcccaaggtccccatctagctgggtggcgctctgcttacgctcccagctctcttcctgctctacaggcaacatgtccaactggctgaaatatcagcacaatggaatagagtcagatctccaattctggcaaacattagtagcatcagctccccggaacactgataagatggattctgaccaccctggctctgaaaactgcctcaaatatttttcttatattgkttattttgagatcattgtaaactcacatacagttgtaagaaataatacagagagatcctgtgtgccttttactcaacttcttccaatggttataggctacaaagctagaatacaatatcgcaaccagagtattgacataaataacaatccacccatcttgttccgatttcctcagttttacttgcactcttttgtgtgagtgtgtacctgcaccaggactaagtgcaattttatcacacataaaggttcatgtacctaccaccactgtcaaaacaccaaacagttccatcacgaccaatc

SEQ ID NO: 192304 - DNA, 601 bp, Human
tggttgtaggttcactctctatccagtccagtttttaacgcctcgctgaggatatacatattgtctaagcaggaacactgcgggaagggagaggatgcattttcacctgaaaggctttttgcactctgacattctgctacactttctggaaggctcttgttcagcaagtttgatttgaatttctttctattgatcatattctcaattactttcaccaggagtaaattattttcaaatcggaatcctcttaatctcaaagcgattgtgtctttgctctgcccaacaaaatgcaagcctggtrtggtttcccgaaggattcaaagcctttactgatggctgctggtcagcaggcgatctccactctctcattatagccagtgagtccttcagatgatgttttcttctcgagtctactctccagcccctcttacccatcctcccccaccccattattctactgtggttttcttctactaaaccatcaaccacctaataaaattctgatgccacagatcaggcaaggggtcactttgtaatgcacctttaaacatgacatgtctctccgccagagcttcccaaagtggcactttgaaatgtccct

SEQ ID NO: 192305 - DNA, 601 bp, Human
cattcactcaagcgcagacccccagcaggtggccagcaggaatgctttccatctccattccagccactttctgccattgtgcacgccccatctatgggagggagaggggacgggacccactcggaatcgagatggggcacacaaccagctctgggcacgggtcacagcgggagggaacccacgcacacgtggaagaggcttttgcttagcattttgtgacgtgtactggtcactgcttctggctgggaaggctgctctatttttgccggtgaagtaggatgtttaagtggtaagagcatcrgcatttcccagcctccacttcaattcccttttcctgctatcacagcttctctacctgatggtaacatttaactccctttcctcctttcagttccaacgccgaattttataaccccaaacccaaaagtatggtaaattctggtgatgcatatttcaccacacaagaaaatcccaaagtgaagcttgtgatctaaaggaaaggtgcataaccagcagcaaggaaagcccggagctggtcgggaggcttttccttggcagcatcgtgggcaggctgggcagtggcttacctcggcactctctt

SEQ ID NO: 192306 - DNA, 601 bp, Human
gaaaccactaattcaaacaaccatgagcttccctctctcttgctccctccctctctctctctcattcactcaagcgcagacccccagcaggtggccagcaggaatgctttccatctccattccagccactttctgccattgtgcacgccccatctatgggagggagaggggacgggacccactcggaatcgagatggggcacacaaccagctctgggcacgggtcacagcgggagggaacccacgcacacgtggaagaggcttttgcttagcattttgtgacgtgtactggtcactgcttytggctgggaaggctgctctatttttgccggtgaagtaggatgtttaagtggtaagagcatcagcatttcccagcctccacttcaattcccttttcctgctatcacagcttctctacctgatggtaacatttaactccctttcctcctttcagttccaacgccgaattttataaccccaaacccaaaagtatggtaaattctggtgatgcatatttcaccacacaagaaaatcccaaagtgaagcttgtgatctaaaggaaaggtgcataaccagcagcaaggaaagcccggagctggtcg

SEQ ID NO: 192307 - DNA, 601 bp, Human
gggtgtatgggagcgtgtacatctgtcttttcagaatccctgcactttttctcaaagtgtttagtacatgggaaaccactaattcaaacaaccatgagcttccctctctcttgctccctccctctctctctctcattcactcaagcgcagacccccagcaggtggccagcaggaatgctttccatctccattccagccactttctgccattgtgcacgccccatctatgggagggagaggggacgggacccactcggaatcgagatggggcacacaaccagctctgggcacgggtcacagsgggagggaacccacgcacacgtggaagaggcttttgcttagcattttgtgacgtgtactggtcactgcttctggctgggaaggctgctctatttttgccggtgaagtaggatgtttaagtggtaagagcatcagcatttcccagcctccacttcaattcccttttcctgctatcacagcttctctacctgatggtaacatttaactccctttcctcctttcagttccaacgccgaattttataaccccaaacccaaaagtatggtaaattctggtgatgcatatttcaccacacaagaaa

SEQ ID NO: 192308 - DNA, 601 bp, Human
tttttttaaaaaatcaattcccatttgctacctcccagaaatactttccagactactctgtgaaggcaggaaaagaaggcagcagcttggtttctggttcccttgtgctctgcggctcggcccgattattcgataggtttcaggtcaccatggccagtgtggcacagcgactcggtccctcaatgctggcccagtcaacctgagccaacctgcattttcagagaaaaggcagcgaggaacttagtgacaggcaatgaatgccccttgattgctttcaaatgggggcggcttagagctccayggtgtacagcaagcagcggcctcagggctggcttcattcagagaagtggctagagctgcaaccttgaagaaatcaggccagggtgtatgggagcgtgtacatctgtcttttcagaatccctgcactttttctcaaagtgtttagtacatgggaaaccactaattcaaacaaccatgagcttccctctctcttgctccctccctctctctctctcattcactcaagcgcagacccccagcaggtggccagcaggaatgctttccatctccattccagccactttctgccattgtgcacgcc

SEQ ID NO: 192309 - DNA, 601 bp, Human
aacgctcagcacgggcccctgctcaggcgagcactcaagagaagaagtcaactgaagcctcacagtaagaacctccacggtttcttgtggtcaacaagggaaaacattttggtccccaaaaagaaacaatcctttgtcagtcctattccgtgattatgctcttttaaagcagacacagacaaagccaggagtgatgccccttaaaaatttaactatatatcatattcatttattatcaatccacaggaaaatctgattgctacatgagctcataaaagcttttttcacctttacaaaattaaaaaaaaaaaatgtgccacaaggatgtaataacaactgctgataaacaagaaaaggaatcttaaaattataaatttgctgtagaaaagataaaaaacaattatattttatttagaattttaccttgaataaaatattcccctgtataaaaaataaaaaagcttgctctggttagaattagagtatttttgtcttcaaatctgggaatttgcataatatttccatgatactttttcctttgtaccgcgtggcattcaagcatagcagattagaaggattttttttaaagcagtctgaaaat

SEQ ID NO: 192310 - DNA, 601 bp, Human
ggaccctgtgtgcccagtgcagtccatgagacctccctacagtcctccggcctgttgtttgtattaccttgacaactttacaagactaggcccaagttagtgggctggtgacttgtggctaagctggaaatggatcagctccagttcagagggcaggagaagagcccctcaaatcagagataatagtatctattccctaagactttgaagagtccccgtctcctccctttctaacccgtttcaacctttgaccacactcagtggcaaaaataagtaaacaaaacaaaagaacaacttgctsaaatacatctgttcttccatctgaggatccagcaaagctccagcctgggctgttagggtttcaagaaaatcagtacatccacacaggcccaagcatcacatgtggggtgtcgtgacatccagaaaagttaagaagcgatgcaggcagtggctctggagactccccagcctttctccctctcacagcttccttcttgctcctgtggtgttggatccaggctcttccctctctcttagtttgggttccctggtttattcatcatgtacttgtccataatgactacccagacctgatttactc

SEQ ID NO: 192311 - DNA, 601 bp, Human
atgtcagcatccatcgtaattggatattccccttctccttccagttttctgggcttgatgcatctgatagctctgagccttttaaagttgtggtgagccacctcaagccagctgctgcccaatgccaaaggccgtggtttgccctgggctagtggcccagggctaatttgcatcattaatttaaaaaaatgtgagtggctctggggccctggacaactgccctaaccctacacctgtcaccctgtggccagggactctgcttcagggggatgaaagagaccctagtgatgatatctttgaytgtggaaagcagaggctctgattgaagctggggctgtagcactccaacagggcacagttgtgccttactttgagtaacagggatttcagaaagctctgtccacatcacacttaatgaatcctattcagggtgggagagtcagttgagggaagcaatggttatttcaagaatcaaagattatgaagtgtaaagaagctaacgatgctggaagccagaggtcagccccctcgtctgatggttgaaggcgaggctctgagatggaaagtatcacacggggcattaattaatagccagcctgga

SEQ ID NO: 192312 - DNA, 601 bp, Human
aaagttgtggtgagccacctcaagccagctgctgcccaatgccaaaggccgtggtttgccctgggctagtggcccagggctaatttgcatcattaatttaaaaaaatgtgagtggctctggggccctggacaactgccctaaccctacacctgtcaccctgtggccagggactctgcttcagggggatgaaagagaccctagtgatgatatctttgactgtggaaagcagaggctctgattgaagctggggctgtagcactccaacagggcacagttgtgccttactttgagtaacagggwtttcagaaagctctgtccacatcacacttaatgaatcctattcagggtgggagagtcagttgagggaagcaatggttatttcaagaatcaaagattatgaagtgtaaagaagctaacgatgctggaagccagaggtcagccccctcgtctgatggttgaaggcgaggctctgagatggaaagtatcacacggggcattaattaatagccagcctggaaactggaaagatatgaggagaaatcaccccctgttctcttgggttcaaatagacagattttcatataatgggtttatttaaag

SEQ ID NO: 192313 - DNA, 601 bp, Human
ccacctcaagccagctgctgcccaatgccaaaggccgtggtttgccctgggctagtggcccagggctaatttgcatcattaatttaaaaaaatgtgagtggctctggggccctggacaactgccctaaccctacacctgtcaccctgtggccagggactctgcttcagggggatgaaagagaccctagtgatgatatctttgactgtggaaagcagaggctctgattgaagctggggctgtagcactccaacagggcacagttgtgccttactttgagtaacagggatttcagaaagctcygtccacatcacacttaatgaatcctattcagggtgggagagtcagttgagggaagcaatggttatttcaagaatcaaagattatgaagtgtaaagaagctaacgatgctggaagccagaggtcagccccctcgtctgatggttgaaggcgaggctctgagatggaaagtatcacacggggcattaattaatagccagcctggaaactggaaagatatgaggagaaatcaccccctgttctcttgggttcaaatagacagattttcatataatgggtttatttaaagtgagggtcacttgt

SEQ ID NO: 192314 - DNA, 601 bp, Human
tcgctactaaaaatacaaaaattagccaggcgtggtggtgggtgcctgtaatcccagttactcctgaggcaggagaattgcttgaacctgggaggcggaggttgcagtgagccgagatcgcaccacaccactgcactccaacctgggtgacagggtgcgactccatctcaataaataaatacataaataagcccaggaaggtctaaggagaaggtggtgtcagaactgatcccggacaggtgagcgagtgttcagtccaggagggaaaggccagatgccaggcatgctggtcggtcaggaygggacctgctctacctgggggagggaacatgccaggcttcaggacgaagtgaacgacgggggcattgacagatgaaacttctttctgcctctcactttctccctgcctcccattttctttccctttttcttgcctccgctccttttgactttagccacccctgctctcttcctgtctgcgtcatcctcgccctccttcatacccccgcctgcctgcctgccttccttctcccagactctctttatatttggggggactaatgcagcagctgtgctggggctccccctacccccctgcagg

SEQ ID NO: 192315 - DNA, 601 bp, Human
gcggaggttgcagtgagccgagatcgcaccacaccactgcactccaacctgggtgacagggtgcgactccatctcaataaataaatacataaataagcccaggaaggtctaaggagaaggtggtgtcagaactgatcccggacaggtgagcgagtgttcagtccaggagggaaaggccagatgccaggcatgctggtcggtcaggacgggacctgctctacctgggggagggaacatgccaggcttcaggacgaagtgaacgacgggggcattgacagatgaaacttctttctgcctctcrctttctccctgcctcccattttctttccctttttcttgcctccgctccttttgactttagccacccctgctctcttcctgtctgcgtcatcctcgccctccttcatacccccgcctgcctgcctgccttccttctcccagactctctttatatttggggggactaatgcagcagctgtgctggggctccccctacccccctgcaggccaggccaggccgtgggatggaatctgcaggtttgttccattagcctctgtccttctgtgacagtccagacaatttatacaccctgttggctat

SEQ ID NO: 192316 - DNA, 601 bp, Human
gctctcttcctgtctgcgtcatcctcgccctccttcatacccccgcctgcctgcctgccttccttctcccagactctctttatatttggggggactaatgcagcagctgtgctggggctccccctacccccctgcaggccaggccaggccgtgggatggaatctgcaggtttgttccattagcctctgtccttctgtgacagtccagacaatttatacaccctgttggctatggccgtatgttgtcataacctgggtcatttcctcatttaatgctgcccataaactccaataaaactgtgctggagcccagtcgtccaggggagaaggagagactctgggtttcgaagggttggagcaggggcctgggcagcgggtgtgcagaaggtgagggggcagcgggtgaagaggagaggactgggccatggcgcaagcccgacctgatgagtgctttgcttctttccctgtccctgccgctggctgcagtgtgtcagatcctccccaagggggtggtcgctgtcctcggaccatcgtccagcccagcctccagctccatcatcagcaacatctgtggagagaaggaggtgagtgtgaggcagggc

SEQ ID NO: 192317 - DNA, 601 bp, Human
cctgccgctggctgcagtgtgtcagatcctccccaagggggtggtcgctgtcctcggaccatcgtccagcccagcctccagctccatcatcagcaacatctgtggagagaaggaggtgagtgtgaggcagggctggggaatatctgtgtgctggagcctgtgcccagggtccaaagatagggttgattctcaagggctggaagagcctgtcaaggctgggttggtatcattaataacaacaacataaatacaaatacagaagcagtgggcttgccctgctccaggatgtttgcatggaggrgtctcggaggaggtgtttgacagcaggaatctgaagcggagctcctccctgtcttagggtcccatggcggtgcccccagcggcctcttggtggtggtgggtagagggagaggctggagaggctgatgggcatggcaggccaagcgggcagacgtctgagcgtccactctcgtgtccacgtgagcagctccctggttatctgtttacatatcgggattctggggaagaatgccttcggggaaggcattgccacattttattgctaaaataaagtttgaaagcctctgtcatataagttctc

SEQ ID NO: 192318 - DNA, 601 bp, Human
cctcattcaccagttccagtgtttgcttcttcaagcagcacattcttcctcagatgtgactcgaactggaggctctccagtttcaaagtgttgagtccatttgctctagttctgtttccatgggagaaaaaaaatggtagggcacaagtttcagagtgactgcccccctccctattctgccaactctccccctcctttttccccagagaagacaaactcagaaattcagagattctgtctagtcctggcatctttcctggtccttcctggatccatcaatccttccccttcagatatatcstcgggagacagtgagaaattggccccttagcccctgtctgccccaagggccttccagccaggtccttagtgggcagatggagcttggtggtcaggcatgaggtcaggagctgggtgggggcgggggcagggacatgggaggaaggctcagtctcgcttctgccctagaggcctggaggctcagccttccagaagctctagtctcaggaggacacagttcttagaaacaggaggagcacttgctgcaggagggactggatgcctcctcagtgagccgctcctgccagggcaggagcaacag

SEQ ID NO: 192319 - DNA, 601 bp, Human
ggctctccagtttcaaagtgttgagtccatttgctctagttctgtttccatgggagaaaaaaaatggtagggcacaagtttcagagtgactgcccccctccctattctgccaactctccccctcctttttccccagagaagacaaactcagaaattcagagattctgtctagtcctggcatctttcctggtccttcctggatccatcaatccttccccttcagatatatcgtcgggagacagtgagaaattggccccttagcccctgtctgccccaagggccttccagccaggtccttagkgggcagatggagcttggtggtcaggcatgaggtcaggagctgggtgggggcgggggcagggacatgggaggaaggctcagtctcgcttctgccctagaggcctggaggctcagccttccagaagctctagtctcaggaggacacagttcttagaaacaggaggagcacttgctgcaggagggactggatgcctcctcagtgagccgctcctgccagggcaggagcaacagacagtcctctgcccaccccacgcctgctgggagtctacccctctgatgccaccactgtctcttatgatcc

SEQ ID NO: 192320 - DNA, 601 bp, Human
tgtctagtcctggcatctttcctggtccttcctggatccatcaatccttccccttcagatatatcgtcgggagacagtgagaaattggccccttagcccctgtctgccccaagggccttccagccaggtccttagtgggcagatggagcttggtggtcaggcatgaggtcaggagctgggtgggggcgggggcagggacatgggaggaaggctcagtctcgcttctgccctagaggcctggaggctcagccttccagaagctctagtctcaggaggacacagttcttagaaacaggaggarcacttgctgcaggagggactggatgcctcctcagtgagccgctcctgccagggcaggagcaacagacagtcctctgcccaccccacgcctgctgggagtctacccctctgatgccaccactgtctcttatgatccagggctcagtgagtccctgacgctttgggcagaagaatatttatcttcccgattttaggagcccactctcagaattgtgtgcacgtttaagtgccgcgatcctagtcctggtcgcgttggtcctgctcctccagtagctgggcctctctctgtaggctgcaccct

SEQ ID NO: 192321 - DNA, 601 bp, Human
ggccccttagcccctgtctgccccaagggccttccagccaggtccttagtgggcagatggagcttggtggtcaggcatgaggtcaggagctgggtgggggcgggggcagggacatgggaggaaggctcagtctcgcttctgccctagaggcctggaggctcagccttccagaagctctagtctcaggaggacacagttcttagaaacaggaggagcacttgctgcaggagggactggatgcctcctcagtgagccgctcctgccagggcaggagcaacagacagtcctctgcccaccccaygcctgctgggagtctacccctctgatgccaccactgtctcttatgatccagggctcagtgagtccctgacgctttgggcagaagaatatttatcttcccgattttaggagcccactctcagaattgtgtgcacgtttaagtgccgcgatcctagtcctggtcgcgttggtcctgctcctccagtagctgggcctctctctgtaggctgcacccttgagccttcttacatgggctggggctgacaagtccccatcctcctcccggtcacatatcctcaaatacaactctgaggccagccca

SEQ ID NO: 192322 - DNA, 601 bp, Human
gaggagcacttgctgcaggagggactggatgcctcctcagtgagccgctcctgccagggcaggagcaacagacagtcctctgcccaccccacgcctgctgggagtctacccctctgatgccaccactgtctcttatgatccagggctcagtgagtccctgacgctttgggcagaagaatatttatcttcccgattttaggagcccactctcagaattgtgtgcacgtttaagtgccgcgatcctagtcctggtcgcgttggtcctgctcctccagtagctgggcctctctctgtaggctgyacccttgagccttcttacatgggctggggctgacaagtccccatcctcctcccggtcacatatcctcaaatacaactctgaggccagcccaggccacagaggagctctgtcctactaggtccctcccagcctctcccaggccgtggcccaggaagttagacctcacgtgtaatttacatctttcttgcggcactctgagaaacagcttaaatctatggcaggtcattattgtagcagtggctctgatcttcactaagtggggcagccaagacttcagctccccatcttctctcttctgca

SEQ ID NO: 192323 - DNA, 601 bp, Human
agggaaaagcaatggagttctcacccaggagtccattgctttaaatgctgctgacatctctgcagcccttgtggctggctgccttctgccttgctgctcccctctccattctgctcacctcttcttgtcccccacacacctccgtgatggcttcctgggatacatttgcaattgcacattgagtatagatcgatctttgtcccagagagggaaccataggaccaggactgggctgggctatccctgcctagacccagcagagcccagtgggcttcaaggagactgtgccgaaggctccccwtcagctccccttcctcagccctcaccccctgtacgcacaactccaagagctttgcgggagctcctacatttggggaggaaggagaaagagccttgcacaagcacttattatacattaggtattgaactattatataccctacacacaggttcacattttatcctcccagagctctaagaagcacctgtggttatctccattttaatgatgttttgacaagttaagtggtttatctgaaaatcacacagcagaacctggatgcaaacccaagtctgtagactccaaaacccatttgttctt

SEQ ID NO: 192324 - DNA, 601 bp, Human
tcccctctccattctgctcacctcttcttgtcccccacacacctccgtgatggcttcctgggatacatttgcaattgcacattgagtatagatcgatctttgtcccagagagggaaccataggaccaggactgggctgggctatccctgcctagacccagcagagcccagtgggcttcaaggagactgtgccgaaggctccccttcagctccccttcctcagccctcaccccctgtacgcacaactccaagagctttgcgggagctcctacatttggggaggaaggagaaagagccttgcrcaagcacttattatacattaggtattgaactattatataccctacacacaggttcacattttatcctcccagagctctaagaagcacctgtggttatctccattttaatgatgttttgacaagttaagtggtttatctgaaaatcacacagcagaacctggatgcaaacccaagtctgtagactccaaaacccatttgttcttcaccttcctgagtccttcccatccatctctaggatccgtggattcacggtatctctaaggggtccacagtactagggggtgctaaggggttgtgctc

SEQ ID NO: 192325 - DNA, 601 bp, Human
tctgaaaatcacacagcagaacctggatgcaaacccaagtctgtagactccaaaacccatttgttcttcaccttcctgagtccttcccatccatctctaggatccgtggattcacggtatctctaaggggtccacagtactagggggtgctaaggggttgtgctctattggattcgctgctaatggaatgtggtaggctagagggttacacagggacgaccttggtcagaggtgttcaaacgttcaaaccagccagccaggctaccctgcccctgtcgggccttcccctctatcttgcccwtttgtgaccttttcctttcaaggtctgtttgttattcactttagacagagtggatgggatacaaaatacaagcgggaagaaagatccgttatgacacagatcaatgtcactctttagaattgcctttcataactcaccagactctcccccattctgcatttttcagtttctggtggaaaatattggttgccctctccctatggtttaaaggctaatcctagttgaattcagaagtttttcccctagtttctgctaaatctttatcctcttcccacctcagtctcagaggagctctggtct

SEQ ID NO: 192326 - DNA, 601 bp, Human
cagaaggcaggacagtgggtcctggaaatgtcagtaatagatgcagagggaagctgacactgtcctaatgaagccaaaccacgtatttatttacctggctgtgttcagaggttctctagatggtttctccgcctgcagggcttccttcctccatgtgcgcatgtgtgtctgtgcgggagcccatccccgccccacttcctctccctgggcattccccactgaagtttgttgggagctggttactatacacctgttggctgggctgggctgatgggactcttctcttagtcccagggtagcratttttctctttctgccatctctgctctgatgtattaactacaaataaaatattctaaggattatgctttcaagagccaactgtctctctgccagcagcaggcagttcctctaagaataaagatagattcttttgccttctcaggaccacagaccccagcttgcagacccacggtgcattcatccgggtctctggacaaatagttttctgtcctggggctgcttctttgaagcatcatcagggatgtcatcgctcgtcttcctcccacggagtgggtgccctgggagctccttctcccat

SEQ ID NO: 192327 - DNA, 601 bp, Human
gtcctggaaatgtcagtaatagatgcagagggaagctgacactgtcctaatgaagccaaaccacgtatttatttacctggctgtgttcagaggttctctagatggtttctccgcctgcagggcttccttcctccatgtgcgcatgtgtgtctgtgcgggagcccatccccgccccacttcctctccctgggcattccccactgaagtttgttgggagctggttactatacacctgttggctgggctgggctgatgggactcttctcttagtcccagggtagcaatttttctctttctgccrtctctgctctgatgtattaactacaaataaaatattctaaggattatgctttcaagagccaactgtctctctgccagcagcaggcagttcctctaagaataaagatagattcttttgccttctcaggaccacagaccccagcttgcagacccacggtgcattcatccgggtctctggacaaatagttttctgtcctggggctgcttctttgaagcatcatcagggatgtcatcgctcgtcttcctcccacggagtgggtgccctgggagctccttctcccattggtgtctggcgaaggtg

SEQ ID NO: 192328 - DNA, 601 bp, Human
gttggctgggctgggctgatgggactcttctcttagtcccagggtagcaatttttctctttctgccatctctgctctgatgtattaactacaaataaaatattctaaggattatgctttcaagagccaactgtctctctgccagcagcaggcagttcctctaagaataaagatagattcttttgccttctcaggaccacagaccccagcttgcagacccacggtgcattcatccgggtctctggacaaatagttttctgtcctggggctgcttctttgaagcatcatcagggatgtcatckctcgtcttcctcccacggagtgggtgccctgggagctccttctcccattggtgtctggcgaaggtgttacataaaagaactcaccctccacaacctcagctcactcatccctctttcttccttttcacccacctggatcctccctgctgtccgtttttgctcctcttgccaggtccctcacttcaaagtggccccagaggagttcgtcaagttccagttccagagattcacaaccctgaacctccaccccagcaacactgacatcagcgtggctgtagctgggatcctgaacttcttcaa

SEQ ID NO: 192329 - DNA, 601 bp, Human
cccagacctctgtgcctggcatgtgctttaattcatttatccagtacaattttattgaatattcaatctgtgctacccaagaaatcaaggaactgagttccaactcagctgtgaccacccagtgggtttggaggtgttagatctccccatttcaaagttgaggaagttgagactctaggaggtgaaatgacttgcccaaggccacacaacttaagcaccagggcccaaactcaaatacaggcctcctcacttcaagttgaaagctcttccagagccctgcagtggatgcagagaaaatagrgcccttgccactgatctgagaaggcccagagtggtttatgctaagtgtcaaatgtgcaatgtggccagtcgaggagagtgtccctgagtacagggtgctagataggctttgggatgtgggcagggcttcaactggatctcaaaggataaaaatgatttagaaaaggagggaaagagataggtcatgccagatgaggagcaagagagggaggcagggatcctgatgctgtgcctaggggaagtaggttggagcctagagtccatgctggataaagatggaaagagaggctggggaaggtag

SEQ ID NO: 192330 - DNA, 601 bp, Human
tcacttgaaccctggaggtggaggttgcagtgagccgagatcatgccactgcactccaacctgggtgacaggagggaaaccctatctcaaaaaaaaaaaaaaaaaaaaaaaagacagtaaaatgataattgaggtacactggagttctccagcagggcttccatgaaaggggtttggcaagaaatcagtgaacatagattctaaccccctcagctagagaagaagaaagggaggcccagaaggtagcttggtttggctagagtctcataattagtaagtggtagagcttggatttgaatcsagattctgtgaatcacagtccagtgcaccatcgtcattacacctgtatttatcaaatgggtttcctctggatctgtgatgaccaaagcagtagccacaagccacgtatggctattcaagtgtacatatgaattgattaaaattaaataaacttagaaatccagttcctcagtcttgttacatttcaagtggtcagtagccacgtggctggtggctgctgtgttgggcagcacaagtgtggaacattcccatcatggaggaaagttctacaggacagctcggctttgatgatacgtgtttt

SEQ ID NO: 192331 - DNA, 601 bp, Human
ttactgttattttattctgcaactctgcttatggcagtgggggtggaggatggggagtaggcagtgatacccaaggccctggaagagtaaccaggatggtagtgggccttccctgtgctgtcccccggaggccctgtgggaggccttttgctcataatgataaaaaattaaccatgcagctctgtgctgataccaggaaggtcacagtcctcccattacagagcacttactacgtgcccaacaccatgctaagggtttttatattatctcatttaaattttagattctcttatttaaaccrtataactcatgataaccgtataagatgggctctatcaacattctcattatatgcagaagaaaagagagattatctccatcttcaaggtcacatgattcctgctaccttctctcccagctttcctaaagaagacagagaagtgagggaccatctttcctacagtatgggacgaccgagaccatcccatgtatcagagaccagaatgtggaatcagataatctgggtttggatcctggcctgtcccgggacctctgaccgtatgatctcagtcactgaatttctcccgccccagcaattctg

SEQ ID NO: 192332 - DNA, 601 bp, Human
tcatgtccccagactgggttctttgtgctgagccaggtgtgtccaggttgggaaatggaacaactgactgataggcaattctgggcgggatgcggacctcccagaggactcgccgcctcctcctctctcctgtccccgccccgcgtctcagcacacagagcatgttatatgggatggggaatgatgctgttctttgtttaaaggacagcagaactctccaaggggtagcaggctgggaattgattggaataggtccccagtttatctgacatctggggggctctctttccctgggagtttygtgcacctgccatttgcaaaggaataaagcatccccggcagcctctgccaggcagcaccatgctatgcataaccctgctgtcatcccccagccttccctgtctcgtcccactgaatttcattgcctgtctgaagaatcccagggaatttggcctctttcccagtcaggctccaaagattcttcatgctccattctaggacgtggggaggttgcctttgccaccccttgcttgttcacctctccagctgtggggcaccctcacccacagcctgctcaggagatagctgagactccagatgc

SEQ ID NO: 192333 - DNA, 601 bp, Human
ggggggctctctttccctgggagtttcgtgcacctgccatttgcaaaggaataaagcatccccggcagcctctgccaggcagcaccatgctatgcataaccctgctgtcatcccccagccttccctgtctcgtcccactgaatttcattgcctgtctgaagaatcccagggaatttggcctctttcccagtcaggctccaaagattcttcatgctccattctaggacgtggggaggttgcctttgccaccccttgcttgttcacctctccagctgtggggcaccctcacccacagcctgcycaggagatagctgagactccagatgcaccagctccgtggcctccctccacctccttgttaagagtgtcttttggatcagacacccagacctttgtccaggtaggagttagcttttcacatcatctctgaggaagaggcggtaaatactctctccactttacatataggacaaaatgaggctgccccctaaaaaaaaaattaaattcaggctgccaaacaaaacggggatgtgatttgaacttcatcagcaacttagctgcgagtgccgggaccctaaactcctgagggcagggactgtat

SEQ ID NO: 192334 - DNA, 601 bp, Human
ccccttgcttgttcacctctccagctgtggggcaccctcacccacagcctgctcaggagatagctgagactccagatgcaccagctccgtggcctccctccacctccttgttaagagtgtcttttggatcagacacccagacctttgtccaggtaggagttagcttttcacatcatctctgaggaagaggcggtaaatactctctccactttacatataggacaaaatgaggctgccccctaaaaaaaaaattaaattcaggctgccaaacaaaacggggatgtgatttgaacttcatcakcaacttagctgcgagtgccgggaccctaaactcctgagggcagggactgtatgtgacccgtcttctctgcctggtgtcctgtctgcacaatgcctggcactcaggacatgccagagactgttggttgaacagatgtgtccttgcctgactcttcatctgcctcaccgcgcctgcccttggagcacttctgggaatgggtaaatacaggagtaacatggagaccgtacatcccacttcccggcagcctttctcatacgatcacagtgagttctcatcctcctttgcccattctacagatga

SEQ ID NO: 192335 - DNA, 601 bp, Human
gggcctgtgaggggcacagatggcggcagcagagagtctttacaagtctccatcgaaaccctgtcagggaagagaggaaaggccagcattgtggtttgcacagctgggctgtttctgaagcatcttaataaataacaggccttcccagggcttcttcccaacctgccacagcctccagctccctagaaagccttctcaaaacaggtgacaggaagacgggttggcagcaccttcccagagctgtctctatcaggccagtcccttgggctccaactccactaccctctccttcctatgaagraaaaaaaaaaaaaaagcacagacacacaaccagcatcagcttccctctcctaatccctgagacacgtgtctctggaccttcccaggcactgtgcccactgcctccagctgagtttgtcctccgaggcagcctggtctcatggtaagagggttggatagaaatcagaaaactgagatcagaattctggtcccagctgtgtccccgtgtctctgtttgctgagtaagtcatgtcaccaatctgcaatgcgaggaggtggatgggaggctctccctcctttttggcctgggtggtgagtaacc

SEQ ID NO: 192336 - DNA, 601 bp, Human
tagctggtgggtgggagaggagggagtgagggagggcaggggtaggtccttggtgcacagtcccttttttctgttttgttctgggcccagattcttgcctgctggagtgcagttcaaagcctgttcccttatgatcatcataatactttgtcttaatgcagccacaaggctctgaggagttcaaagcgttttactagatctgttttctgggccttgggatcttaagggaattgctcctccacctccaaaatgaaaacaaaggctcttacagagcccagtgtaacatttgtgagggtttaaygtgtccgaggctcgggcctgagcccttcacacgtggcctcttgtaatccttgccttggacctgagtgctggctgctgtgataattctaacttctcaattgaggaaactgaggccaagacaactggccacatggagaagtccatgaattagggaagcagactcaggcctggtggtctctgaacccaggtcttggtctctgtgcatcctatccggctttcgagggtggtggggaggaggggggattctcttattccacccaagggagcttccgtctctaccttaaaagaacgttctcgaggg

SEQ ID NO: 192337 - DNA, 601 bp, Human
cccacatctccgtgccttcctgcttctgcccaggtgtctctagaggcagctctgtggaccctcaggggcttcatcctctctcccctccaggccttttaaacctagagaagctgctccggcaattccttatctccaaggacacgctgtccgtccgcatgctggatgacacccgggaccccaccccgctcctcaaggagatccgggacgacaagaccgccaccatcatcatccacgccaacgcctccatgtcccacaccatcctcctgaaggtgggagcctccctctctcccccaccccctgmtgagctccaccctcccccctccttgccttgagggtcctcctgagctgaggctgacggagccccgggctggacctgaactcttacaaacctctctctgtgcttctgttttcaatgagcggttcccgaaaaatgaaagaagaaagcagggtgagggtgatgtcgttttcagcactggggcagcagggcagtaggcaacggagacacctagatgctgccaaacttagaccctgctaagggctctgtggagaggtctgcgggttcctaggaggggctagggtggggcacctaaggggcttgggc

SEQ ID NO: 192338 - DNA, 601 bp, Human
acaacaggaccatcacaccagtgtgtactgctgaatgccagctctgtctttagtcctgacacggtgcacaacagttacacagcacttctgtgtagtcgatctcccagcgtagagctctcagcaatgacatgaggtaggtataatgtcttccctcacagaagagggaactgagactctgggagatgaacagatgcgtccaaggcccagccctgagtggagcagggctgagcctgcacaaccctctcttatctgcaaatcaggtagtgtctcctaagctcctggagttggaggggcagtgccrgcccctgagtcagaacatgcacactggaaaccagaactctgtgagtgaggctgatccaagagagagagacgtcgggagcctaggggccccacacaggacaaactgctggaaatagctgggtagcatcggagtcacctgacgtcagttcctgggctggtggctgggctgggcatgaacttcggagagaacgggccccgtttccaggctccttggcggctcccccaacctctccaggcgcactggcctcttctaatgccattttaattgcacgtttaagcacaacctgccgtcttccactgg

SEQ ID NO: 192339 - DNA, 601 bp, Human
ccagtgtgtactgctgaatgccagctctgtctttagtcctgacacggtgcacaacagttacacagcacttctgtgtagtcgatctcccagcgtagagctctcagcaatgacatgaggtaggtataatgtcttccctcacagaagagggaactgagactctgggagatgaacagatgcgtccaaggcccagccctgagtggagcagggctgagcctgcacaaccctctcttatctgcaaatcaggtagtgtctcctaagctcctggagttggaggggcagtgccagcccctgagtcagaacrtgcacactggaaaccagaactctgtgagtgaggctgatccaagagagagagacgtcgggagcctaggggccccacacaggacaaactgctggaaatagctgggtagcatcggagtcacctgacgtcagttcctgggctggtggctgggctgggcatgaacttcggagagaacgggccccgtttccaggctccttggcggctcccccaacctctccaggcgcactggcctcttctaatgccattttaattgcacgtttaagcacaacctgccgtcttccactgggggagcgaggctcctcg

SEQ ID NO: 192340 - DNA, 601 bp, Human
gccgtcttccactgggggagcgaggctcctcgttaacctctgccaagctgtgaggagcccgcagacactcagatgattgtctcccctccttccctccctccctcccagctgcccctcctcagctcgtttttgactcagagttaataagagatttgaatgagttctctcagtactgagggctgtcccttcagcccgttgctatagtaatcttccagagctccaaagccatgtctgtctgtgtgcgtatacccaactcacattatctctctctctttctttctctctctctctttctctctgacacacacacacacacacacacggaaacacaatatttttctcttttcttccttttcctctgttttctcttatgcctggagccatgatcaatgaagtcattaagggtagaaaagctccaccaagtttcacgagaggagaggggccctctttagggaaggttgggagcaggcagtgagagcttcagcttagtagatagatgtccctccaccacccttgtggaaggtagctcagaatacacaggttccccctgtggtagctggagcctgcctgaacagcccccaggtagaagcttctgggggcc

SEQ ID NO: 192341 - DNA, 601 bp, Human
agacactcagatgattgtctcccctccttccctccctccctcccagctgcccctcctcagctcgtttttgactcagagttaataagagatttgaatgagttctctcagtactgagggctgtcccttcagcccgttgctatagtaatcttccagagctccaaagccatgtctgtctgtgtgcgtatacccaactcacattatctctctctctttctttctctctctctctttctctctgacacacacacacacacacacacggaaacacaatatttttctcttttcttccttttcctctgtyttctcttatgcctggagccatgatcaatgaagtcattaagggtagaaaagctccaccaagtttcacgagaggagaggggccctctttagggaaggttgggagcaggcagtgagagcttcagcttagtagatagatgtccctccaccacccttgtggaaggtagctcagaatacacaggttccccctgtggtagctggagcctgcctgaacagcccccaggtagaagcttctgggggccagccttgtgccctccatagctcccagcatctgatgttgcactattattttttttattcgaat

SEQ ID NO: 192342 - DNA, 601 bp, Human
cccttcagcccgttgctatagtaatcttccagagctccaaagccatgtctgtctgtgtgcgtatacccaactcacattatctctctctctttctttctctctctctctttctctctgacacacacacacacacacacacggaaacacaatatttttctcttttcttccttttcctctgttttctcttatgcctggagccatgatcaatgaagtcattaagggtagaaaagctccaccaagtttcacgagaggagaggggccctctttagggaaggttgggagcaggcagtgagagcttcascttagtagatagatgtccctccaccacccttgtggaaggtagctcagaatacacaggttccccctgtggtagctggagcctgcctgaacagcccccaggtagaagcttctgggggccagccttgtgccctccatagctcccagcatctgatgttgcactattattttttttattcgaatagcattactagttcattgttgaaattttggaacatatagaacagaaagcacatagaagaaactaaaaattattcacaatcctatcacccagagctatttaaccactgttaaattttgatgt

SEQ ID NO: 192343 - DNA, 601 bp, Human
ttaaccatcactttattgttggagatacaggttgtttcaaatcttttgctacaataaataatgctgaggtgcacatctttgtacataaatctttatacacattcatgaatatttccccagcatacatttctagaagtggaattactgagttaaaggtacgcatgcttttaaggattctgatatgatttgccagattgcattttagaaaggctgtaacagtttacactttcgccagcagcatataggtgtcttatagcacccttgccaatactgggtatgttaattaaaaacactttatagttgtgtgtgtgtgtgtgtgtgtgtgtgtgtgtggccatgcttttgaaggaagctctgcctgtagtgtagtgatcattattagcaaatggttctgctcgatgcctcagggctgtctttcctgagctcacctgtcagccccaactcctgtgacattggagccacactgatcaatgagcagcaaggcttcaggaaagcctgttccctttgcccatttgccttcccaatggcccaggcaggcaggcgttccatcaggcctggcctctgtcctcatgcttccctggggctccgtactcttccctcc

SEQ ID NO: 192344 - DNA, 601 bp, Human
aaatctttatacacattcatgaatatttccccagcatacatttctagaagtggaattactgagttaaaggtacgcatgcttttaaggattctgatatgatttgccagattgcattttagaaaggctgtaacagtttacactttcgccagcagcatataggtgtcttatagcacccttgccaatactgggtatgttaattaaaaacactttataggtgtgtgtgtgtgtgtgtgtgtgtgtgtgtgtggccatgcttttgaaggaagctctgcctgtagtgtagtgatcattattagcaaayggttctgctcgatgcctcagggctgtctttcctgagctcacctgtcagccccaactcctgtgacattggagccacactgatcaatgagcagcaaggcttcaggaaagcctgttccctttgcccatttgccttcccaatggcccaggcaggcaggcgttccatcaggcctggcctctgtcctcatgcttccctggggctccgtactcttccctccaggagggcacaacagggcctctcagggcctcagcaaggatgggaagcagagtgggcagggagcacacggggcctctgggagactca

SEQ ID NO: 192345 - DNA, 601 bp, Human
gcgtaggatgggttggtcatcttgccacatcatcctcttgaaagtgaaggaggaaatatagcttggcctggaggaagaaggagcctcaccaaagaggctttgagctcccttgtgccctgagactcctgccccagtcactgagcatttgccctccagcttcccattggaacaaccatgatagagttacccccgacctgctcctcagggagcctgcaagtgttcctataagaatcctataagattacaggcgcggtgcctcacgcctgtaatcccagcactttgggaggccaaggcaggcagwtcacttgaggtcaagagttcaagaccagcctggccaatatggcgaaatcccatctctactaaaaatacaaaaattagccaggtgtggtcgtgggtgcctgtaatttcagctacctggcagcctgaggcaggagaatcacttgaacccaggaggcggaggttgcagtgagccatgatcgcgccaatgcactccagcctgggtgacagagtgagactctgactcaaagaaaaaacaaacaaacaaacaaaaaaagaagctcacaaaattatttgagttccttgggagatgaacactatgtaa

SEQ ID NO: 192346 - DNA, 601 bp, Human
cagtttctatagtacctgtcacactcaaagccaggcacactgacggggaaggttggctaggggtatttatgacgggtacaaagatcagacaaaagggagactcttctgatgtagcagttctcaactgtggagtgatgccacactgatgcgctgtgatcaagggtgaggcatgccacaggcaactgattccttacgacaaataaaggacccaagtttgcaaatgagtcacttgtttccgacgtcactgcagattcaagaatacccttatgactctgccctgcactctgacagagtggagttsatttgcattgctacaacctacggactctcttatctatgccagggccccaaagagagttgtgtttgtggttccatcagtgtgacagtcctgaagggggagtatagagtttggataaaagcactgaaattaggctgcctggatttgcttttatcttttccattaatgagacatgtgatcttgtgcaagtcacttagcctttcgttgtgtcagtttcctcagctgtaaaatggggttggggaggaataatagcgccaacctcatagagttatcccatgtagaatgcttgagagtgcctgacac

SEQ ID NO: 192347 - DNA, 601 bp, Human
ggttggctaggggtatttatgacgggtacaaagatcagacaaaagggagactcttctgatgtagcagttctcaactgtggagtgatgccacactgatgcgctgtgatcaagggtgaggcatgccacaggcaactgattccttacgacaaataaaggacccaagtttgcaaatgagtcacttgtttccgacgtcactgcagattcaagaatacccttatgactctgccctgcactctgacagagtggagttgatttgcattgctacaacctacggactctcttatctatgccagggccccaragagagttgtgtttgtggttccatcagtgtgacagtcctgaagggggagtatagagtttggataaaagcactgaaattaggctgcctggatttgcttttatcttttccattaatgagacatgtgatcttgtgcaagtcacttagcctttcgttgtgtcagtttcctcagctgtaaaatggggttggggaggaataatagcgccaacctcatagagttatcccatgtagaatgcttgagagtgcctgacacatactaaacagtgggttagtgttagccattgttattgttaatagctgtgg

SEQ ID NO: 192348 - DNA, 601 bp, Human
ctgacacatactaaacagtgggttagtgttagccattgttattgttaatagctgtggagatcattattgtagtcttttttattatttgcttcatttccctaaaagtcattttggtttcagtaatgtctggctatatccatgggagtatgttgtgtacaagaacaccagctactacgcatgccactgcaggggtagggggccaggcggaggtggagagaccccgctcttgagaccagaatttctgtgctccatcctctaagatcaagggcaacataagaactaatcaagatgttctgttctrcctggtgccaaggggcagtgggccagacaaatggtagacacttggaacccctactgctcatttgcttcaagtgagtttttgttttcttctctaatctccttctcttcgccttgcaggcagccgaacttgggatggtgtcagcctattacacatacatcttcactaatctggtaagatgttctcacagctcacctccttggaagagagtgttgtcagtggtcaggattgatggattataagggaaaaagcccaggggatgatgagtacaggagatagaagcagaggagcagaagccaacca

SEQ ID NO: 192349 - DNA, 601 bp, Human
tcaagggcaacataagaactaatcaagatgttctgttctgcctggtgccaaggggcagtgggccagacaaatggtagacacttggaacccctactgctcatttgcttcaagtgagtttttgttttcttctctaatctccttctcttcgccttgcaggcagccgaacttgggatggtgtcagcctattacacatacatcttcactaatctggtaagatgttctcacagctcacctccttggaagagagtgttgtcagtggtcaggattgatggattataagggaaaaagcccaggggatgaygagtacaggagatagaagcagaggagcagaagccaaccagagaggcagggcgtcctggaaattctcatcccaataattctgagccacaggagaatgaggatttggggaatctaatgcctccattcaaatgccgctagctacataaagcgaattctgggctgtagtgtgatggacgagcctcctcagtaggtccagttactggcctgcagtctagtctctacatggacttagggatcaggtgtcctaaaaagtcctgtgaggtttagaagatgacagcccagagagacaggcttggactct

SEQ ID NO: 192350 - DNA, 601 bp, Human
aggtccagttactggcctgcagtctagtctctacatggacttagggatcaggtgtcctaaaaagtcctgtgaggtttagaagatgacagcccagagagacaggcttggactctgagatccttgttcttttccagctgtcggtgtctatgaacagtcctttccaggggctgctgtgggattgttaaccctgtagcatctgacaggcctttgttctcagagttgaaacagaccttagaggaatttagtgtgacctttcttctggtatagggactcccacaacaggcttgtcaggaagccgttyagccttctcttgaacttgagtagaagtgcctagtttgccaccaccatccaaatacctgccccattgttgggcatcttcatggtagtctagcgtgcacatagatgaaagccacacatattatatgcgcgtagcttaagaaaactttttccaagtaagcacacctgtgtaagcagcacacagctccagaaatagagcattaccagcaccccagaatccccctcatgcccctcaaaacataaaacagatgaacttgtttcctttttttttttttaacctaacactgctgctataaattagagc

SEQ ID NO: 192351 - DNA, 601 bp, Human
ctttttttttttttaacctaacactgctgctataaattagagcattaatatgtaaaaagggagaaaaggattagactactcccagagcaaagcaaaagcatttgcttaaagtaaggaggcatctgggggagcctgggcaagttggcaaaggagcaaagagagattaaagtacagttgtgttccattttgggagcctgggaaatagaaggaggagagggaaaaggcaggccagtgccagcctgccagagaggctccctaaattaggccggcaacatgagtagaggaggaaggaactgggcarcgaggtgtcgctggggtgatttagcagatggaaggaagccattcatttggaatatgagttcccaggacagtcaccggaatgaggtggagttgcttggcttagaggtttttaagacagcatcctccacagtgtaccactatttcccattcatagaaatcataagaatgatggtgatgatattatctagtggaaaaagcactggcctgtgaagtcaggaggcccagagtcaagtcctgactcagccttatgctcactgtgagcctttggttgagtcgcagtgactctctgaaccacagtttt

SEQ ID NO: 192352 - DNA, 601 bp, Human
gatttagcagatggaaggaagccattcatttggaatatgagttcccaggacagtcaccggaatgaggtggagttgcttggcttagaggtttttaagacagcatcctccacagtgtaccactatttcccattcatagaaatcataagaatgatggtgatgatattatctagtggaaaaagcactggcctgtgaagtcaggaggcccagagtcaagtcctgactcagccttatgctcactgtgagcctttggttgagtcgcagtgactctctgaaccacagttttctcattttaaaaatgggracataaaaccttacaagtttattatgaggattaactggaattctgtaagtaaaaatgtattttaaataacaaagtcctatatgtttctaaggcattatatttagaaaaatatatagctctatgatgctttcagttttcaaagagcttttctcctttttgggtgggcatgaatgagatcagctttgggaattaacaggactcatggaattaacagtttgtaagtttgcaagaggaaatcatgatgaaaagtaactgtataaatgatgctggttgaataatagtcaagaaaacgacagcaga

SEQ ID NO: 192353 - DNA, 601 bp, Human
atatgtttctaaggcattatatttagaaaaatatatagctctatgatgctttcagttttcaaagagcttttctcctttttgggtgggcatgaatgagatcagctttgggaattaacaggactcatggaattaacagtttgtaagtttgcaagaggaaatcatgatgaaaagtaactgtataaatgatgctggttgaataatagtcaagaaaacgacagcagaaccattgcaaaaatctgccagtaagagaatattctagaagcttctcatgagtgtgttggctttctaaaagggacaaacytctaataggagtaaagaaactgtttttaggaccactctttctgcccagttgcagttggtgttttttttgtttgtttgctttttattttgtttttgtgtgtgtgtgttttgtttttgctttttttgagacagaatctcgctctgtcacccaggctgaagtgcagtagtgccatcttgattcaccttccaacctctgcctcccaggttcaagccattctcctgcctccgcctcccaagtagctgggattacaggcacacgccaccatgcctcgctaatttttgtatttttagtagagacggc

SEQ ID NO: 192354 - DNA, 601 bp, Human
gcatggtgaacgggaaaggcatggatggaccttggcattaggtactcatgactcaaaacttttgtttgactagctactggctgtgtgatcctgtgcagtttacttaacctttctgagccccaggaacctcttctgtaagtggacactaatagtacctgcctcgggagataatgtacacatagcaatggactcacaatacgagtttatttaggagaaggtgttattttaagaagtccagcttatgcctcccatgggctaaaatgaatggaagatgcttattttgctccccagccatgcatgrcctgtgaaagtgactcctaaaatgccattttatttatttccagataagaaataggactaggtagtatggttattgtgtgtgactgaactgaccattgtagggtttatttgtgtcggtaattactgagtaattgatcaaatgcccatacctcactcccatccaggcataaagaaaagtgattgatttagggcatctgtaataaatgaattaggttgactgctgtggattctgtcagttgattacccatcacaagaattgggacaaaattatccatcacgaatcgaacttctaaaccatcag

SEQ ID NO: 192355 - DNA, 601 bp, Human
actcctaaaatgccattttatttatttccagataagaaataggactaggtagtatggttattgtgtgtgactgaactgaccattgtagggtttatttgtgtcggtaattactgagtaattgatcaaatgcccatacctcactcccatccaggcataaagaaaagtgattgatttagggcatctgtaataaatgaattaggttgactgctgtggattctgtcagttgattacccatcacaagaattgggacaaaattatccatcacgaatcgaacttctaaaccatcagttcatttgacccyatagaaacacagcttctctctctgtcagggtccagtcagcagaagagtgagtgttctaaccctgagccttgggtgacagaggtgactgatgcaataagaggaactgagccagagagagcggaggctgctcgggggtcacacagccatcacaggcggagctggaagaagctgggcaagtccagggaagggccaggtctctggtgcaggggaagctgggctcagtgacagggtgacagtgaggtgtcaggcaatggagagagacacttctgcaggaggggagagagcagcagacagggacag

SEQ ID NO: 192356 - DNA, 601 bp, Human
actctgtacccattaagcaatagctccccattccccctccccatggcctgtggtaacctccatgttattttcttctcagtgagtttgcctattctagctaggtgcctcatagaagtggaattatacaatatttatcttttgtgtctagtttatttcactcagcataatgttttctaggttcattcatgttgtagcatgtgtcagaaattgcatttcttttttttaagctttgtattattgtggtgaaatatatgtgacataaaatttgccattgtaaccatatttaagtacacttttcagyggcatgaagtacatccacattgttatgcaaccaccaataccatccacctccagaacatttttcaccttttcagaatgaaactctgtacccattagacgcaaactccccatgtctttttgcacccaggccctggcaaccaccattctaatttctctctgtatggatatgactactctaggtatttcatataagtggaatcatataatatttgtccttttgtgtttggctctgtttacttagattcatgtctttagggttcattcatatgtcagaattgcctgcctttttaaggccaaataa

SEQ ID NO: 192357 - DNA, 601 bp, Human
tgcaaccaccaataccatccacctccagaacatttttcaccttttcagaatgaaactctgtacccattagacgcaaactccccatgtctttttgcacccaggccctggcaaccaccattctaatttctctctgtatggatatgactactctaggtatttcatataagtggaatcatataatatttgtccttttgtgtttggctctgtttacttagattcatgtctttagggttcattcatatgtcagaattgcctgcctttttaaggccaaataatatactatgtgtgtgtagacacacayataccagattttgtgtatccgttcattcatcgatggacacgtgggtcgcctccaccttttggctattgtgaataatgctggcatgaacttgggtgtgcaaatgtctgttcaagtccctgctttcaatccttttgtgtatatgcctaagagtggaattgctgggtcatgtggtaattatccgtttatttattgagaaaccaccgaacattttccagaatgaccacaccatttttcgttcctgtcagcaatgtacaaaggtcccggtttctctgcaaccttgacaatacttgctatttttca

SEQ ID NO: 192358 - DNA, 601 bp, Human
ggataactgatcctaaaagtggaaatcagcacttagttataaggatgtcagcttcccgtgttctcttacccgaggagggcatgcatagggcagttatagatgcactgtgcttattcggctctttactctgcaagggagtctctgtcttccagtcagcctctgggtttggttgggggaaacctttgttgtgcaagactgatggaagtttgaataaaagacataaagaattaagggcctctgggcaaccagtctaccgttgagacagcagggtggttgatgccgtaagagaagagatgaaggrggaagctcaatttgagctaataaatctggagggattatccagcaactaatgaacccagagagatatgcagtcactgcctaacagaaaagataagatcaccctaatctattatcagagagcataggtgggccctgtgcctatggcaggagctgccatctcagcagagagaagtgttgagatttaagggtaaaggtcaaaagtcagggactgccaatgaaagatgggaaataattgggcactggaagcaggaggctgtgtggtctgctgaccactgagctgctacggcattgcaggtggtgt

SEQ ID NO: 192359 - DNA, 601 bp, Human
agcttcccgtgttctcttacccgaggagggcatgcatagggcagttatagatgcactgtgcttattcggctctttactctgcaagggagtctctgtcttccagtcagcctctgggtttggttgggggaaacctttgttgtgcaagactgatggaagtttgaataaaagacataaagaattaagggcctctgggcaaccagtctaccgttgagacagcagggtggttgatgccgtaagagaagagatgaaggaggaagctcaatttgagctaataaatctggagggattatccagcaactartgaacccagagagatatgcagtcactgcctaacagaaaagataagatcaccctaatctattatcagagagcataggtgggccctgtgcctatggcaggagctgccatctcagcagagagaagtgttgagatttaagggtaaaggtcaaaagtcagggactgccaatgaaagatgggaaataattgggcactggaagcaggaggctgtgtggtctgctgaccactgagctgctacggcattgcaggtggtgtgactagctggactccagcgccaccatttcattgccatgccccaggcagg

SEQ ID NO: 192360 - DNA, 601 bp, Human
cagcgccaccatttcattgccatgccccaggcagggccagagctccctgctctcggcaccgccgctgtgctggagggtagaatgctatttgtggggtgtcaacagaggcagtgggcacccagagtttttcttttggggaatctagagagaagggactgagagctgggtatgccatgttagaagacagggagaaggagtacatcagcaggaggcctcattattatagagggcaaggccctggactagcagtgaagcagctatggcttcaagttccagtcctgctactaactagctgggtgtrtggcaatatcaatagttgatatttacgtgagtaagtgctaataagtgcttcacagttttttcccatttaaacctcacgacaactctagcaggagacacagttttatccctgttttagagatgagcaagttgagaccctcttcactctaccgcctgtatctgggtgagctattttaccttgctgggcttcggttttttatctgaaaaattgtgaggttgtattaggtgatctctaagggccttttcagccttggacctgtttcatcctatatgtggtttggggcatttcagttcacaatgc

SEQ ID NO: 192361 - DNA, 601 bp, Human
ctgtgttcttgtttttgtagcattcatctcaagtgggaatccatttttctacgctaacctttccaccagactttgagcttcataaaagcaagatcaaatcagtcttgttcatcaccatagatccagtggcctcctacatagtaggcactcaataaatattgtatgagtgaagggagcattccataacatctggagttcttggggtagaagggctggccaagtaagataagtcatctctttagatcccacaggaattcagttcatcccaactaagcctcagacacaaaggaacctatctgcrtttcagctggggagagctgggccctattccctgttccgcaggacccccggtacttgcttagcctacatgacaactactccatctggaatacccttcctcccattctgagctggacagatttgaagtcaacgttgtgcaggaccatgtagggtggtttagttcaggatccaagagacacaatttcaggggttctgctgagtgagagtgatgtcaaaacctgaggcccagggttggcaccaagaatgatcactgaggcaggggagggcagaagagtgcaaggacagtcaggctgattgtgac

SEQ ID NO: 192362 - DNA, 601 bp, Human
tccctgttccgcaggacccccggtacttgcttagcctacatgacaactactccatctggaatacccttcctcccattctgagctggacagatttgaagtcaacgttgtgcaggaccatgtagggtggtttagttcaggatccaagagacacaatttcaggggttctgctgagtgagagtgatgtcaaaacctgaggcccagggttggcaccaagaatgatcactgaggcaggggagggcagaagagtgcaaggacagtcaggctgattgtgacaagtggtctctctgtcacctgggactgkttccttcactggccacaccatgcctgccttggtcagccttgatcatgtggtgtcttcaggccaacacctggcagctgactcatagagccagaacccaagggtctttagaagaaacctctccttcaggttataaaggccattatgaagtgatctagtcctgtcctctgtcccaatggcttggcatatgaggttgggtgagcctgattactgtgttgacactgagaatagagaaagggtttaatggaagctgccagggcctcagatcagagagaacttgagttcctatctgggccctgccgt

SEQ ID NO: 192363 - DNA, 601 bp, Human
gtctctctgtcacctgggactgtttccttcactggccacaccatgcctgccttggtcagccttgatcatgtggtgtcttcaggccaacacctggcagctgactcatagagccagaacccaagggtctttagaagaaacctctccttcaggttataaaggccattatgaagtgatctagtcctgtcctctgtcccaatggcttggcatatgaggttgggtgagcctgattactgtgttgacactgagaatagagaaagggtttaatggaagctgccagggcctcagatcagagagaacttgrgttcctatctgggccctgccgtacattagatgtacatgcggcaagttacttaacctgttggcctatcagttttccctcttgtaaaatggagataatcatgcttatctcataacattattttgtgaagacgatgggaagtttctaatcctgagggttgttagtaaatattatttcccttccctctcttttttctcacttacctgtcaagtatttccatccttagacctcagtttcctgatttactgcctctagctttccaaaactctacagctgttatcagaaacatttcagttggcctct

SEQ ID NO: 192364 - DNA, 601 bp, Human
atgtggtgtcttcaggccaacacctggcagctgactcatagagccagaacccaagggtctttagaagaaacctctccttcaggttataaaggccattatgaagtgatctagtcctgtcctctgtcccaatggcttggcatatgaggttgggtgagcctgattactgtgttgacactgagaatagagaaagggtttaatggaagctgccagggcctcagatcagagagaacttgagttcctatctgggccctgccgtacattagatgtacatgcggcaagttacttaacctgttggcctatyagttttccctcttgtaaaatggagataatcatgcttatctcataacattattttgtgaagacgatgggaagtttctaatcctgagggttgttagtaaatattatttcccttccctctcttttttctcacttacctgtcaagtatttccatccttagacctcagtttcctgatttactgcctctagctttccaaaactctacagctgttatcagaaacatttcagttggcctctcacctagttgaactgtaattcccaggatgcttgagcctttcagttcttcacggaaaatgcaacaggc

SEQ ID NO: 192365 - DNA, 601 bp, Human
cacagcagtttcttacagagatgctattgatccaaacctgtgttttccaaagctgctaaccctcctgtacctattctctgcacatggttgttggaagatggaaatatgttcagaaggagaaaaaacagagagaatcacaaggggattcaggaggcattgactgaagatttattttttgcattgtggaaactgtggctgacagcttgaagttccttggcccaagttataggattataaaatgattagccagctatgattaagcaatttgcatatggaaaatgctaccatcaactacactgaktcagcaaacatctattaagtgcctgctgtgtggtgggagaaacaaggactaggaggatgtggtccagcaggatgtgaattgaagaggtctgcgtctattaatgtgaggtgtggcagcccagaggagagagcatgtagttcttctttgggagtttggatgagggtttacagatatggcttcccttactgaagcatgggttagagatggcaattggagagtgacatgtaggcagtggtaagttatagttccttttgtgcctggagcaggagagtgtgatggagagaggtggacccagagcca

SEQ ID NO: 192366 - DNA, 601 bp, Human
gcattgactgaagatttattttttgcattgtggaaactgtggctgacagcttgaagttccttggcccaagttataggattataaaatgattagccagctatgattaagcaatttgcatatggaaaatgctaccatcaactacactgagtcagcaaacatctattaagtgcctgctgtgtggtgggagaaacaaggactaggaggatgtggtccagcaggatgtgaattgaagaggtctgcgtctattaatgtgaggtgtggcagcccagaggagagagcatgtagttcttctttgggagtytggatgagggtttacagatatggcttcccttactgaagcatgggttagagatggcaattggagagtgacatgtaggcagtggtaagttatagttccttttgtgcctggagcaggagagtgtgatggagagaggtggacccagagccagccaaggaagtctcaggtgagatgatgtccttctgctatgcacgtttgctggacttttcagcattggaattggcgtcagtaggcccagggtcttgttttggctgtcccactgactgtgtgatcttggacaagccctttcttctctggagacaa

SEQ ID NO: 192367 - DNA, 601 bp, Human
gtgccaaggtgctaatgtccatgacaacattaaattcttttggattgttgagagcatctaactaaatctcatccttctacagttgagtaaacagaactgaagagggaaagtgacttggccaggctctcacagtgagtcaggagtagagagaggaggtctcctcactcacacagttcacacattccctagatcagcattaactgagcacttactgtgctgtgtgttggggatacaatgaagaataaaattctgattttccaggaggtcagactagaggggaagaagaacacaagcagattawcataaatcagtgggttcaataaagtgatgaagatatgcacagggtattagggggccatcaaaggaaggcctccagactagcctggcaggttcatcaaaagcttcctggaataggccaatccaaagggccttggagaatcaatgggagttagtcaggtagagaaggacattctaagtgggggatacacacagttaatggctcatgcatcccagacatttgctttttagctaaggccttaaccaaggaagcagattgcatgagaaattgtggagcttgtaaggaaggtattttggaggtggg

SEQ ID NO: 192368 - DNA, 601 bp, Human
aaccagagcttccctagggcaggagcagggagattaggccagtcctaaagatggcatagccttggttcgcttccagtgccagctaggaataagtatctgaaaggtgaactttattctgccaacactggagtgcatccctgttcctgaccctggaagccttctcaccctgagatccaagtcatgagaaactccctcctggaggaggaatgctgcagggaggatggctgggcagccgttgagggggcaggggatgtagtaggcacaggtacagactgactctaagatgctatgtgccattgaygaactacatccagagctccaggagaccccaggtgggcagggcttacctcctatgctctgttcacctttctttttgtcagcatttataggtggccgctctttcctcagtacttctgactttccctctccttatgctaacagtacctagcgcaggctctggttcagggggcatttgaatcaagccactgccttacttggctggtgggtatgtggctgttcacccattcctgttgggctaggggaagaggaaaaagtggtatcagagaagggacccttcccttggcaagctcaggtgatcaga

SEQ ID NO: 192369 - DNA, 601 bp, Human
cagataccctcaattcctaaccgagggggacagggggtgtgagaacagaatggatattgccaggaagtcaatagaaactgaagaagcattcaacaggggatgttgagaccctggtggaggtaaagaaactcttctttgcttcggaggaaccaattatcagacaacccctttgctgatgtttgacaaatagcatgacagggaagataagtcccacggggctcccagagctgagtttgagatacttgtgtagcatccatttaataaaaattgaaacgcattgcttgtatctgcccccaacgcrcgcacacacacacacacacacatttctatgcccatgtgccttggtgagtgggtgcatcagactgtgcatataaaatacatcaaactgaaataagaacaagaccctggagactactgtggttcagtatctctggacacataatggaaatgctcccctttgactgcccaggccttctatctaatagagctttgggagaaaaggaagctgccttgaccctctatcacaaagttgttaaagattcagaagttgcattaatttaatgagagatgcctcggccttccgtctactgatccaacaatt

SEQ ID NO: 192370 - DNA, 601 bp, Human
gaaactcttctttgcttcggaggaaccaattatcagacaacccctttgctgatgtttgacaaatagcatgacagggaagataagtcccacggggctcccagagctgagtttgagatacttgtgtagcatccatttaataaaaattgaaacgcattgcttgtatctgcccccaacgcgcgcacacacacacacacacacatttctatgcccatgtgccttggtgagtgggtgcatcagactgtgcatataaaatacatcaaactgaaataagaacaagaccctggagactactgtggttcartatctctggacacataatggaaatgctcccctttgactgcccaggccttctatctaatagagctttgggagaaaaggaagctgccttgaccctctatcacaaagttgttaaagattcagaagttgcattaatttaatgagagatgcctcggccttccgtctactgatccaacaatttccaattattcacaatcaagagagtctaataataaaaatctacccatttcccaaagctggtattctcacaataggcgctgctggctcttgagtaccagcaatgtaccagatgccatgcccagca

SEQ ID NO: 192371 - DNA, 601 bp, Human
gagtgctggagacacttgaggcaggaaatccatacatcccttgatcatgcaaatgataaactctgtgttgtctctgctgaagcaaggcagagctcagggcagggcccatcccttgcctcctgatgatggcctgtaaaccagcccctgagggaaaactgacagccaaggcaaagggggaaaccaaggcctctctcttgaaactgctgtggctagcagggaggctggtggccctgaggaatttgggccctgctgagaagagtgtttgagatttaatgaatgtttggaaagcagaaggagactaaaaataaaaggcattatggcaaatcacattattattattattattattattattattattacattataagtgctattgtattacaagcaccattaggagtagcaattgctgttattattaagcaatccagcttctccatcctcagcatcaggcttcactccatgtcaaaggcgtcaacagctccgtaaatcaccatctggggcttccctcacattcatagcccagtggcaagcctgatgcctgcccatcccactgaagcctccagccatagctcatgtggtagacgcatctcctgtgaat

SEQ ID NO: 192372 - DNA, 601 bp, Human
agaaaagaccaccttatacgtgccatgccgtgtaattaactactcttcaggacttaccttccacctgctactaagtttaagcatcttgaggacaggcatggagtgtgcttatcattctatttctagtgcccaacatgttgtgtgttctcaaggagacactcatgtttttgttgaatgaatgaaggaatgagtgagactaactaagatctaaaaagtgtccaagagctgaaaatctgttatgcatatccctgcccctcccccgcccccactgtgggaacctatctgagagcctggtggcctmtggaacacagcagagtcagcaagatgctcagtccttgtggagaacccattatttgatcctgctgccaatgtggagcacataaattagtaaggaggcagagtccactgattaacagcatcgctcatcttcctaaacaactccttgtacccctggtgggatggtggagctgggggtgcctgggatctctacgtgcctgaggctaatgtgttgggacctgggaaaggagaggtttagcaactgatgtatagacaggaggcctgaccagtgaatgctgatcagtgcctgaagaaggaagcaagc

SEQ ID NO: 192373 - DNA, 601 bp, Human
aacaagaaggaatatggtctgcctttgaagtcctgtttgtggactcatgttgggaaagaagagcagagaaaggacagagttcctgggaggaagggatgtgcatgtccaggttatggggtaaatgaataggaaacatgcagggagaagaatccaaagctgggagatttaggaccaaatctcctattaaatagaattcattgacaggtgtgaattagcctcccagctgctactgtcttcaaagacctacaacacaaaaagccatctcccagcctacacagagagcacaggctttgatgcagakaaatagacagacgggtaccgcagtcaagtgggctcaggagggaaggagaggatgtaagggtgcccaggagattttggacttctggtggctccagggctttcctgcaaaaaggctaagagaggacttctgagacaagggtctggggcctggcttctgtgatgcattagatctagctatgaagaagagccttgggcaggtgaaaggaccaggctgccaatggggtgagatgaggcacagcctgacaagtgctgccttcctaaatgtttttagtcaacagccttgacttctttctatatgggg

SEQ ID NO: 192374 - DNA, 601 bp, Human
tctggggcctggcttctgtgatgcattagatctagctatgaagaagagccttgggcaggtgaaaggaccaggctgccaatggggtgagatgaggcacagcctgacaagtgctgccttcctaaatgtttttagtcaacagccttgacttctttctatatggggtgcaccagagtgaacactgataatgtaagtgcatttctttcaaatggcatctagtccttggagaggtagctttgaacaaactcgtgataaaaagctccaagtgatgacaggtatgtagatgaggtgtaaagggggcatkattgagtggccgcttcttccaggcttgggagatgcaggaggtcaaggtggacactgaggaaaaggtaggcaggaatcatagcatgaaaagacttgtgtgtctagccaaggggtttctgtcctgtattcagtaaaggagtattcggcgagggggaagttcatgatcaaatgtggagtttaaaaagatctctccagcaataacatggagaaggaacttggagaagtgcaagactaaaggaggagaaaccagtgagtccgtagtctaggtaccaagctggtgaggatctgatttgagttagag

SEQ ID NO: 192375 - DNA, 601 bp, Human
gggaagttcatgatcaaatgtggagtttaaaaagatctctccagcaataacatggagaaggaacttggagaagtgcaagactaaaggaggagaaaccagtgagtccgtagtctaggtaccaagctggtgaggatctgatttgagttagagatgatggggtggagggcagggatcagattcaagagatgtaaaggaattataatgtcctcaaatgacaataaatgagtgcatacctgcttacatgaatgaatgaatgagatgtggacagtgagagcatggaaggggaggatgcattctaaawtctagcttgattgacaggtggatcatgtgacattcacaaacagggaaccaagggagggaagcagatccaagtggcaagataaggagttcaagttaaagagcgatacggtcttaaggatatcttcctccttttcagcttcataataatattttaagaaattagaatcgtttagtgtttcaggactcctggggtgagaacatttgaagttgtcaatcattaacaatcacagtgatggagtatgctttgacaccacctcctagtggcctagcccagtgctgagcacacagtagggaagataga

SEQ ID NO: 192376 - DNA, 601 bp, Human
atttttctaggtgccagggacacagcagtgagtgagacagtctattctaccttccaggagttcacaggccagcggggaagcatttgaggctcaaataatgatgaccgtggagagattttactaggggcggctgaggctgctggacagctctcagcagaagttggccaagttcaccaagctgcattcgactgcctgtttctctgagccatcttagccacacaagcctgcagttatactgcattgacttctaattccttcccacctgctgcaccctggtacttgctgtgactccttttctggrttcttcatgctgaacagatgcgatgtgaggcaaacctcagctctctcatgttctcagtgaagtgctcagttttgcctggcgcacagttggtggtcagtaaattgtagtagttattattagaattattgctttcttgtgattattcatggttggaagatctggaacttcaactaaaggcttctctctcaacacaaatagccagaccaagcaattagcatcttatggtgacttttttttttttttttcgagacagagtctctgttgcccaggctggagtgcagtggcaccatcttggctcac

SEQ ID NO: 192377 - DNA, 601 bp, Human
cagcagtgagtgagacagtctattctaccttccaggagttcacaggccagcggggaagcatttgaggctcaaataatgatgaccgtggagagattttactaggggcggctgaggctgctggacagctctcagcagaagttggccaagttcaccaagctgcattcgactgcctgtttctctgagccatcttagccacacaagcctgcagttatactgcattgacttctaattccttcccacctgctgcaccctggtacttgctgtgactccttttctgggttcttcatgctgaacagatgcratgtgaggcaaacctcagctctctcatgttctcagtgaagtgctcagttttgcctggcgcacagttggtggtcagtaaattgtagtagttattattagaattattgctttcttgtgattattcatggttggaagatctggaacttcaactaaaggcttctctctcaacacaaatagccagaccaagcaattagcatcttatggtgacttttttttttttttttcgagacagagtctctgttgcccaggctggagtgcagtggcaccatcttggctcactgcgactctgcctcctgggttc

SEQ ID NO: 192378 - DNA, 601 bp, Human
cttatggtgacttttttttttttttttcgagacagagtctctgttgcccaggctggagtgcagtggcaccatcttggctcactgcgactctgcctcctgggttcaagcgattatcctgcctcagactcccaagtagctgggactacaggcagatgccacacaaccacgcccagctaatttttgtatttttagtagagatggggtttcaccatattggccaggctggtcccggactcctgactccaggtaatgccccggccttggcctcgcaaaatgctgggattataggcgtgagccaccrcgcccggcctatggtgacttatttagcaaaacttttcccatttgacaagtagctaagagtcacctcttgccaaacaaagaggaagagaaagaggaaggcgaagcctccaggccagatctttccttttggcagggcccagcagttcagggggaccaggaaaaggaaggagattggggcagtgcacccactttggtgacaccggcagcacggaggatggattgcacttggacagaagaggactcccaggccatgagtacctgtgtgccaggcacttctcatggattacctgtgcaaggtaga

SEQ ID NO: 192379 - DNA, 601 bp, Human
atttagcaaaacttttcccatttgacaagtagctaagagtcacctcttgccaaacaaagaggaagagaaagaggaaggcgaagcctccaggccagatctttccttttggcagggcccagcagttcagggggaccaggaaaaggaaggagattggggcagtgcacccactttggtgacaccggcagcacggaggatggattgcacttggacagaagaggactcccaggccatgagtacctgtgtgccaggcacttctcatggattacctgtgcaaggtagatgctcttacccgcactttacrggtgaacacatcgaaagttcagagatccgcctgaaatcagccagccagtatgtggccaaatgagggtttgaaaccaggactgtcttatttcaaaacttgtgctctttctaatacatgctactgtttcctgatgagattgccacattgcacaatgtggcaccaaggggcaccattcacatggtcatcagtataaatggcacctgggaattgaacagcatagtggctaggtatcctaagatcagaggcacgatctccattaaatagcagctattgcagaggagaaatgacgaggacctaacc

SEQ ID NO: 192380 - DNA, 601 bp, Human
cttttagctgtagttgactaacctggtcctgtcctcaggattgactaaatcccacccccagtgatgggacttgcctgcttagcccagctgaacatgtccccggggccctgcttcccctagacctcccttgcagaagctgcccacaaggtctgcccaacctttcccttatccctccatgttcccagacaccagacactaaagctctacatttcttggcactggaccctgtgtggtataaggcatggtcggccccttgcagccatggtaatctcacagtttcccagaccctctcttcctctcwtcctccaacaaaactacctgagctctaggacctccacctgtctggggccatgcccaactcagcccccactcagagcctgtccttgctccctggcccaggcgatgaacaggctgtagacccataaagcttcctgcagcttgcagtgaatggatgcctgtttgtaaaccaggacattggacatggcacgtctgctgcagaaagtgaggggcgcccttccacgtagctctcaagccattatccgtgaagcattccttcatctcagggtaacatctgcccgtatccacttgtggctctgacctg

SEQ ID NO: 192381 - DNA, 601 bp, Human
aatgaggcagacatatctttgcttcctggaaacacacagccccctgtagagagagaccacatgtgtgaacaaacaatgcaacatggggtccatcacaaagccacccacacttggagtagtggaagacctggtcctggtctctgccccaccacttggctttaccaggtcccatttgctctgttcttcaccctcattccctggtttgggacaatgggagtcgattcctgttgggagcagggaccctcaggatatcccttcctgggatatttataagaagaggatcaaggtccccatgagaacmtgttccacccgagggactgttcctttctgtcattgtatgaaggttacaaccagccaggcagtgtggctggggcggggttggggaggcataatgggagcctaagtgagccaggtgtgcattcttaggtagggctcaagatgggtgggcagcggaaactgggtgaactttaatcccttccattcctgaaatgtgttcgttttatgaaatatctctctccgcaaaatgtctccaccacttgactttggatttctaagaaatgtttctctgaatagatgtagagtagcatttcccagattgcgt

SEQ ID NO: 192382 - DNA, 601 bp, Human
aggccccttggtttgcccacaacagtctggctctgccccagtccctgcacccttgccaaatgcatcttcttccattagccatctgcccccttgtgcctaccgatagcccacagcacatgggcagctgccctgttagagagataggagataatatcagtgtaggaatcaatacattctctggcatgtcctttttcccctaatgggaatgtggcaggatccaaaatacacttaaaccttatccaaatccactctgtcaggcattggtggcttcaaaggaagcttggtacctccagtttgcacrtgtaagctaatgaagccgggctctgggtaggtgagctgaggcctgtaacctgaggccttggcagtgtctggagctgtgtggcaaggatgcaagggtggcgccaggggcctacagcagctaagtcttcagaagaggagactgcctggaggaaagcaatctttcttcctggccagaaggaaagcctaaggcacttgccatctgtcatgtcaggctgagtggctgacgggctagtcctagggtctggaagtcctgtgtacccccagggtgtggatctgtgtgcaaggcacttggaatgaacat

SEQ ID NO: 192383 - DNA, 601 bp, Human
cacaacagtctggctctgccccagtccctgcacccttgccaaatgcatcttcttccattagccatctgcccccttgtgcctaccgatagcccacagcacatgggcagctgccctgttagagagataggagataatatcagtgtaggaatcaatacattctctggcatgtcctttttcccctaatgggaatgtggcaggatccaaaatacacttaaaccttatccaaatccactctgtcaggcattggtggcttcaaaggaagcttggtacctccagtttgcacgtgtaagctaatgaagcygggctctgggtaggtgagctgaggcctgtaacctgaggccttggcagtgtctggagctgtgtggcaaggatgcaagggtggcgccaggggcctacagcagctaagtcttcagaagaggagactgcctggaggaaagcaatctttcttcctggccagaaggaaagcctaaggcacttgccatctgtcatgtcaggctgagtggctgacgggctagtcctagggtctggaagtcctgtgtacccccagggtgtggatctgtgtgcaaggcacttggaatgaacatgaaatgaatgtgatttt

SEQ ID NO: 192384 - DNA, 601 bp, Human
acccttgccaaatgcatcttcttccattagccatctgcccccttgtgcctaccgatagcccacagcacatgggcagctgccctgttagagagataggagataatatcagtgtaggaatcaatacattctctggcatgtcctttttcccctaatgggaatgtggcaggatccaaaatacacttaaaccttatccaaatccactctgtcaggcattggtggcttcaaaggaagcttggtacctccagtttgcacgtgtaagctaatgaagccgggctctgggtaggtgagctgaggcctgtarcctgaggccttggcagtgtctggagctgtgtggcaaggatgcaagggtggcgccaggggcctacagcagctaagtcttcagaagaggagactgcctggaggaaagcaatctttcttcctggccagaaggaaagcctaaggcacttgccatctgtcatgtcaggctgagtggctgacgggctagtcctagggtctggaagtcctgtgtacccccagggtgtggatctgtgtgcaaggcacttggaatgaacatgaaatgaatgtgatttttgtgtgaaaaggtggcctgacgcacatttga

SEQ ID NO: 192385 - DNA, 601 bp, Human
cagggctcagagctcagaggaggacactgcccctctctataacactaactggcctcggtgcactcacacctgcaggctaacacgtggccccaccagcgttattgcatgaggaccatgggttgcagggagaactcctttgagcttctaaatgtcactgcctttagatgggatttccctgactgcgtcatctaaagtagcagtccctcaccccaagtcccatccccatagctatatgaaatgacgatgaatttgtttccttactatctgtctcttccactaactgcaagcttcctgagggcarcaagtgtgtctctctcatccatatcctccatgcctagaaccatgtctggcacatgataaatgcttaaatgtgtatcaagtgaatgaaaaaattagtggtaaatgaaagcaccaccctacccgcaaaccttcgggttgaggttcttagaaagcaaacttggttttggcattcctccactgacagttcccctgggtcccatcacacataggacaaagggcacattcccaagcctggcatcctgactcttatggtctggtctctgctgactgccccagcttcgtttctcaccatccctctccc

SEQ ID NO: 192386 - DNA, 601 bp, Human
gaggaccatgggttgcagggagaactcctttgagcttctaaatgtcactgcctttagatgggatttccctgactgcgtcatctaaagtagcagtccctcaccccaagtcccatccccatagctatatgaaatgacgatgaatttgtttccttactatctgtctcttccactaactgcaagcttcctgagggcagcaagtgtgtctctctcatccatatcctccatgcctagaaccatgtctggcacatgataaatgcttaaatgtgtatcaagtgaatgaaaaaattagtggtaaatgaargcaccaccctacccgcaaaccttcgggttgaggttcttagaaagcaaacttggttttggcattcctccactgacagttcccctgggtcccatcacacataggacaaagggcacattcccaagcctggcatcctgactcttatggtctggtctctgctgactgccccagcttcgtttctcaccatccctctcccaggcccccttgtatccagtgtgctaacccacacttcaggtgtataagacttagggtcctgctggaaatgcaagctcctgggcctcagctccccagattcggattcag

SEQ ID NO: 192387 - DNA, 601 bp, Human
tcaagtgatccatccttctcggcctcccaaagtgctgggattatgagcgtgagccactgcacccggccctatcattttttaaaaaggaacctggatgatgctgatggtagaatcacactttaagaagtgatgtcttcatcaaagtacaagcacaccatgggcagttcactgaaagggccatgcactttctcagctctgccctatacatggggatttctggctggaggagcctttgaccactcacaattctccacccagaaaatgcctatgtatccttcaagacacagttcaagcatcccayctcccgtggaaaaaaccctgtgtgcctagtgctgcccccactaggcacatggcttttttctttctctctctagctagtgcatcttgtatataacttgtgtagagatcattctgctattttttttctcctccatcctccaccatcacagtgttaactcctagaaaaactgctctcattaactctggacccctaggtcccaacagagtgtctggtgttcactggactagaatgtggtacccagatatgctttaccaaagtccatccctcacttcaccccttcctaactacattcttatttct

SEQ ID NO: 192388 - DNA, 601 bp, Human
ggcagttcactgaaagggccatgcactttctcagctctgccctatacatggggatttctggctggaggagcctttgaccactcacaattctccacccagaaaatgcctatgtatccttcaagacacagttcaagcatcccacctcccgtggaaaaaaccctgtgtgcctagtgctgcccccactaggcacatggcttttttctttctctctctagctagtgcatcttgtatataacttgtgtagagatcattctgctattttttttctcctccatcctccaccatcacagtgttaactccyagaaaaactgctctcattaactctggacccctaggtcccaacagagtgtctggtgttcactggactagaatgtggtacccagatatgctttaccaaagtccatccctcacttcaccccttcctaactacattcttatttctgatgctgggtctttccaggagttctcactccagagaatggacagccttgtggatgatcgtgtcaacatcctgggattttccattttcaaccaatcccatgctttcttccaagagtttgcccagagcctcaaccagtcctggcaggagaactgtgaccat

SEQ ID NO: 192389 - DNA, 601 bp, Human
caagaatcggttggaagggcctttaagctgatctgctccctcatttttcagataaggaaactaaagcccagactggaatgggatgtggagtggggatgtgggggtcttgttcaagggcaaacatcgaggctgttgcagagtggaactagaccccaggaatcctggctcctggtctggtgctctgtccaccccctggccacttcctgcgtcacggctcatccagaatggctcccttctgcccagtccctctgcttcctctctgcagttctggccccttccggcatgtgtgacgggagcaaayctttccatggccattctccactgagttggatgttcttctccgtggggcaggccaagaatatctgcttgtgtacatttgttaaaaggcaagttctcaggagactaggattatgtggctttttatgccctgtcctagccccattatacacaatattttatttttaaaagccccatgaggcagcccttgtgatgctaaccccaacttcctgaggcagctactatcagtatctccatttcacagatgataaaaccgaagcccagaaaggttaggcaaatagcccagggtcacatagccagtgag

SEQ ID NO: 192390 - DNA, 601 bp, Human
ggccacttcctgcgtcacggctcatccagaatggctcccttctgcccagtccctctgcttcctctctgcagttctggccccttccggcatgtgtgacgggagcaaacctttccatggccattctccactgagttggatgttcttctccgtggggcaggccaagaatatctgcttgtgtacatttgttaaaaggcaagttctcaggagactaggattatgtggctttttatgccctgtcctagccccattatacacaatattttatttttaaaagccccatgaggcagcccttgtgatgctmaccccaacttcctgaggcagctactatcagtatctccatttcacagatgataaaaccgaagcccagaaaggttaggcaaatagcccagggtcacatagccagtgagcagaggaccaggatcagaacccaggccgtatggctttacagtttatatttttaacctctgttccactgtgcatctctctaggactgtcatttccttgccacgctgtactgtaattgagcctggctagatggaagtacagtgatacatgcgtaatgacattttggtcagcgatggacaacttatatgatggtggt

SEQ ID NO: 192391 - DNA, 601 bp, Human
cacttcctgcgtcacggctcatccagaatggctcccttctgcccagtccctctgcttcctctctgcagttctggccccttccggcatgtgtgacgggagcaaacctttccatggccattctccactgagttggatgttcttctccgtggggcaggccaagaatatctgcttgtgtacatttgttaaaaggcaagttctcaggagactaggattatgtggctttttatgccctgtcctagccccattatacacaatattttatttttaaaagccccatgaggcagcccttgtgatgctaacyccaacttcctgaggcagctactatcagtatctccatttcacagatgataaaaccgaagcccagaaaggttaggcaaatagcccagggtcacatagccagtgagcagaggaccaggatcagaacccaggccgtatggctttacagtttatatttttaacctctgttccactgtgcatctctctaggactgtcatttccttgccacgctgtactgtaattgagcctggctagatggaagtacagtgatacatgcgtaatgacattttggtcagcgatggacaacttatatgatggtggtccc

SEQ ID NO: 192392 - DNA, 601 bp, Human
tgtactgtaattgagcctggctagatggaagtacagtgatacatgcgtaatgacattttggtcagcgatggacaacttatatgatggtggtcccatagatgataataccacatttttcttgtcccttttctatgtttgggtatgtttagatatgcaaatacttaccactgtgttgctgttaactacattattcagtacagtcacataccgtacaggtttgtagcctaggagcactacactataccatatagcctaggagtgtagtaggctatagcatctatatttgtgtaagcacacactrtgatggtcacacaatgaagaaattgcctgatgatgcatttctcatcatgtgtccccattgttaagcaacacatgactgtagttactaggtatttgttgaatgaatgagtgagtgagtgagtcaggcggaatgatgagttacagatagaaagaagtggaaaagcattaggtctaggagatggcaatggaattgggtacactcctggagtgggaaattctctggtgagtttttaaaataggagcgatgcctgtctctgataagacatgcccagaggcaaaggcatatctagacatctataca

SEQ ID NO: 192393 - DNA, 601 bp, Human
tatttgtgtaagcacacactatgatggtcacacaatgaagaaattgcctgatgatgcatttctcatcatgtgtccccattgttaagcaacacatgactgtagttactaggtatttgttgaatgaatgagtgagtgagtgagtcaggcggaatgatgagttacagatagaaagaagtggaaaagcattaggtctaggagatggcaatggaattgggtacactcctggagtgggaaattctctggtgagtttttaaaataggagcgatgcctgtctctgataagacatgcccagaggcaaagkcatatctagacatctatacacttggcatctaattagtacttggccaacacggtgaccttggaggtggcctgcggaagccagggcctggacttaatgacctttcacaaaactctgtgcttttatgatcatgcagcctcgtggacatctcaggaaggaaggggtagctaaggaggtcagagctcatggaaaactcaggaagctttgatccagggagtgggacagaaggagcgggtttgagaaagagtttcatgcaggtttatggaacccatcccaacaagatattttagacctaaaagaggc

SEQ ID NO: 192394 - DNA, 601 bp, Human
gaaggactgggaagggcagctgaaggaaggagtcatgtccattaaatggtttaagggacagagagggacatctcaaagcacagtgtcatgtgcaggatcagactcaacccctagcagcaatgcaagccctgttctcccagctgcgtctgctgttcttacagttctcattccagtatttttatttttatttatttatttatttatttatttatttatttatttatttatttttgagatggagtcttgctctttcgcccaggctggagtgcagtggcgcgatctcggctcactgcaagctccrcctcccgggttcacgccattctcctgcctcagcctccggagtagctgggactacaggtgcccgccaccgtgcctggctaattttttgtatttttagtagagatggggtttcaccgtgttagccaggagtgtctcgatctcctgacttcgtgatccgcccgcctcggcctcccaaagtgctgggattacaggcgtgagccatcattccagtattttaataggtgctgacaaacttgaaaggcttgcagtacaatatcaagaaaggagaaaaaaacatctgtctctttcccttcaacccaag

SEQ ID NO: 192395 - DNA, 601 bp, Human
atttggcatctggcctagtgaagtaaatggtcccaggctctatttcctcattctctctaagggtatcttcctttgcattgatgctcacattggccacgagcagacagatgagggtccttcggttcctagtgggcttctttgtaaggatccagcacaaaggccaggagtgcctttcacagagctgtgggtcagcgctgccatggtcagacaggctgaaaaggccactggccttggagtcacagagcctggagtcaaatactggccttgacattttctcaccgtgtgatctgaggtagtgacrtaacccccgtgggccgcagattctttttccataactttaggtgaattatacctgaccatcttagagcattattgtgaagacggaatcagatacgattctatttccaattcacaatcattcactaagttaatataacaacctatatatgccagatgctggaataggcattactaaatatatcaggtagcttttgctacataaatactgtgtaacagccaactcctaaatctcatgatacacaataaatatgcatatacgattctatctccaattcacaatcattcactaagttaatataac

SEQ ID NO: 192396 - DNA, 601 bp, Human
tttaggtgaattatacctgaccatcttagagcattattgtgaagacggaatcagatacgattctatttccaattcacaatcattcactaagttaatataacaacctatatatgccagatgctggaataggcattactaaatatatcaggtagcttttgctacataaatactgtgtaacagccaactcctaaatctcatgatacacaataaatatgcatatacgattctatctccaattcacaatcattcactaagttaatataacaacctatatatgccagatgctggaataggcattatyaaatatatcaggtagcttttgctatgtaaatactgtgtaacagccaactcctaaatctcatgatacacaataaatatgcatacaatacacatttatgtagcccgtggacctgtgggtcagcgagggagcagcttgtctaagctggctcagttgggcagctctgctgctctgtctgagatctctcagcatgcaagggttggctaatccagactgggcctacttggggccagtacctctcactcttcccctggaccagcaggccagcccagcatattcttatggtgatggcagaagggcagc

SEQ ID NO: 192397 - DNA, 601 bp, Human
tatatatgccagatgctggaataggcattactaaatatatcaggtagcttttgctacataaatactgtgtaacagccaactcctaaatctcatgatacacaataaatatgcatatacgattctatctccaattcacaatcattcactaagttaatataacaacctatatatgccagatgctggaataggcattatcaaatatatcaggtagcttttgctatgtaaatactgtgtaacagccaactcctaaatctcatgatacacaataaatatgcatacaatacacatttatgtagcccgyggacctgtgggtcagcgagggagcagcttgtctaagctggctcagttgggcagctctgctgctctgtctgagatctctcagcatgcaagggttggctaatccagactgggcctacttggggccagtacctctcactcttcccctggaccagcaggccagcccagcatattcttatggtgatggcagaagggcagcaaagcaagtggaaacgcaaagacctcttagtcctaggctcccagaaaggcacactctcattttcttggccaaagaaaggcacacacacaaactcagtgttaggga

SEQ ID NO: 192398 - DNA, 601 bp, Human
cattcttggtggaaggcaaggggagggggcgtatgcagctcacatggcaagagagaaagcaaaagagagaggggaagaggtgccaggctcttttcaacagccagttcttgtgggaactggagtgaaacttcactcactcctgtgagaatggcacaaagccatttgtgaagcatccaccccctttatccaacccacccgggtcactgccacatgagacttgggaccaaacaaaccatggcagagtgggatgaaggattggctccatcacatagtcacacagtgaagatcaaagccgctgttmtccggatgcgccatgcaggagcagggttcacctccacctctgggaaggtgactcctcggcatatgttactctcatggaagcggaggaaagcccctgagttcttcctgcagaggtcggggaaggcttgcccgaaaagagggaagccagtaattcaccgctcttctgtgtgcaaagcaccaggcagggtccacagcatcccaatggagcaggggtcccgtgctgacttgctcagtggactggagagggtgtcctgtcctgaggatgccgcccagggctgtttaaaagatagaaaccctgacc

SEQ ID NO: 192399 - DNA, 601 bp, Human
catagtcacacagtgaagatcaaagccgctgttatccggatgcgccatgcaggagcagggttcacctccacctctgggaaggtgactcctcggcatatgttactctcatggaagcggaggaaagcccctgagttcttcctgcagaggtcggggaaggcttgcccgaaaagagggaagccagtaattcaccgctcttctgtgtgcaaagcaccaggcagggtccacagcatcccaatggagcaggggtcccgtgctgacttgctcagtggactggagagggtgtcctgtcctgaggatgccrcccagggctgtttaaaagatagaaaccctgacctcgtttgtctccttcccagtccaatgtcagacctcccaaggcctcagcatcttatgctccccaagaatgcttgggggatattcagtgagtgggggtgttctctgaggctctcttggtgctgccggcggagaacaagagtaaagatgggctgagctgcaccggctcaaggctgtctcagggaaccatgcgaggagcatccatgtgggcctcaggactgcagctggtccttgtgctgatcagattctgcgtctactttagtcagctttc

SEQ ID NO: 192400 - DNA, 601 bp, Human
ccgtcatctggggcatggagagagatgagggttacaggtgtgtatgtaggagatattcttattttcatgtcatgggagggggaaggaactcagccacagctccctgagtcagaactgattcatcttaatttatacagagccttgcattcccctaaacaatttgcaaacagctcaaaagaaaataacaatgaagaaccaaatgaaaatataaaaacaagagaatcgagggttcattgccaagcaacgttttggggccaagaaagaggagaggattttaaatgaggattgagccatttggggkatttaatatttagaagagacagggacaggagaagcagagacaaaagcgagaggcgtgcacacacagatgaggagtagaggccatggaaagacagaaaggaaaaggaaatgtattgagagagcagagaaggggtggaaatgggggggggggcggtgcctccttcccctgatgagcccagaagtggagacatggatggagggctttttttttttgagacggagtcttgctcgcccaggctggagtgcagtggcacaatctcggctcactgcaacctctgcctcctgggttcaagcaattctc

SEQ ID NO: 192401 - DNA, 601 bp, Human
cttgcattcccctaaacaatttgcaaacagctcaaaagaaaataacaatgaagaaccaaatgaaaatataaaaacaagagaatcgagggttcattgccaagcaacgttttggggccaagaaagaggagaggattttaaatgaggattgagccatttggggtatttaatatttagaagagacagggacaggagaagcagagacaaaagcgagaggcgtgcacacacagatgaggagtagaggccatggaaagacagaaaggaaaaggaaatgtattgagagagcagagaaggggtggaaatgggggggggggcggtgcctccttcccctgatgagcccagaagtggagacatggatggagggctttttttttttgagacggagtcttgctcgcccaggctggagtgcagtggcacaatctcggctcactgcaacctctgcctcctgggttcaagcaattctcctgcctcagcctcccaagtagctgggagtacaggcatgtgccaccatgcccagctatttttttttttgtatttttagtagagatggggtttcaccgtgttggccaggatggtctcgatctcctgacctcgtgatctgctc

SEQ ID NO: 192402 - DNA, 601 bp, Human
gcacacacagatgaggagtagaggccatggaaagacagaaaggaaaaggaaatgtattgagagagcagagaaggggtggaaatgggggggggggcggtgcctccttcccctgatgagcccagaagtggagacatggatggagggctttttttttttgagacggagtcttgctcgcccaggctggagtgcagtggcacaatctcggctcactgcaacctctgcctcctgggttcaagcaattctcctgcctcagcctcccaagtagctgggagtacaggcatgtgccaccatgcccagctatttttttttttgtatttttagtagagatggggtttcaccgtgttggccaggatggtctcgatctcctgacctcgtgatctgctcgcctcggcttcccaaagtgctgagattattataggcgtgagccactgtgtccggccaggagggcttttgtaacagaaactgcttctccctgactgtagccccaaatgctttccagagctaaatgagtaagtaatagcggagggaaaaaacaattaggagagggagaaagatgctttgggatggagatctgaaacaaggtggaaaaattgatgaggca

SEQ ID NO: 192403 - DNA, 601 bp, Human
gtgatctgctcgcctcggcttcccaaagtgctgagattattataggcgtgagccactgtgtccggccaggagggcttttgtaacagaaactgcttctccctgactgtagccccaaatgctttccagagctaaatgagtaagtaatagcggagggaaaaaacaattaggagagggagaaagatgctttgggatggagatctgaaacaaggtggaaaaattgatgaggcagagagatgacaggctcgcacgccatcagaggagaaattcggtgagggcaggagattggtgactgtgaggagakagctgcaggcacaagggttgggaggtgaattctcagagcagtttgaaggatccaggtgagaagcgtgggcagattggcaggagcctgcagaagacagtgcctggtgatgggtggaggaacccgaggagactgcagcgggggagaagacgtttggggtttagaaagggtcagctctgaccagcccaggctgaaccacagagaggaactgtgaagcccagagcctacgggggacacgtcagtggtttcacccctctgaaggccacacacaggtggagaggagaccacaaccttgaggatttt

SEQ ID NO: 192404 - DNA, 601 bp, Human
catcccttcctgcccccaccccggtgccagagtcccatgctcccatctgctgcagagaaggcaacaatgaaagattgccccaagttgtcctgggagatgaggcataagaataaatctgatagagcaatgacaacctaggcttctcggagggagggaggtggaagacagtgctgtggagaggggaggaagccagtctggacaaagggtactgggcctccaggccttgctttgtgaccttgggcaagagaagaatgccttgtgcctcagtttcttcattcgtgaaagaagacagatgagtggtttttttttttttggttttgtttgtttgttttctgagatggagtcttactctgttgcccaggctggagtgcagtggtgcaatcttggctcactgcagccgccgcctcccaggttcaagcgattctcctgcctcagcctcccgagtagctgggattacaggcgcacacaaccacacccagttgatttttgtatttatactagagatggggtttcaccgtgttggcaagggtggtctcgaacctctgacctcaaagtgatccacctgcctcggcctcccaaagggttgggattacaggcatga

SEQ ID NO: 192405 - DNA, 601 bp, Human
tcttggctcactgcagccgccgcctcccaggttcaagcgattctcctgcctcagcctcccgagtagctgggattacaggcgcacacaaccacacccagttgatttttgtatttatactagagatggggtttcaccgtgttggcaagggtggtctcgaacctctgacctcaaagtgatccacctgcctcggcctcccaaagggttgggattacaggcatgagccactgcgcccggccggatgagttgtcttctagaatttcttccagctcaatcactccacgattttgggaatctgagaatrgtgagattaactgggaggcaagggagaaggtgggacagaaattggtttatagcatcatttaaatagccaaacagaaggatctagaagccagtttcagttggggcagctaacttgctgtcaatttgtctaagccggaaagggagaatctgcagcattagtctgtggcatgtgagaggcccattaataaaagagccacatgtgctcaggggaaagcgagttacatggaaggacaaggacggttgtaggcttgcaaaggagcattcattaccatgcagggcgaatcaaatgaagaaggagctg

SEQ ID NO: 192406 - DNA, 601 bp, Human
tactagagatggggtttcaccgtgttggcaagggtggtctcgaacctctgacctcaaagtgatccacctgcctcggcctcccaaagggttgggattacaggcatgagccactgcgcccggccggatgagttgtcttctagaatttcttccagctcaatcactccacgattttgggaatctgagaatggtgagattaactgggaggcaagggagaaggtgggacagaaattggtttatagcatcatttaaatagccaaacagaaggatctagaagccagtttcagttggggcagctaacttsctgtcaatttgtctaagccggaaagggagaatctgcagcattagtctgtggcatgtgagaggcccattaataaaagagccacatgtgctcaggggaaagcgagttacatggaaggacaaggacggttgtaggcttgcaaaggagcattcattaccatgcagggcgaatcaaatgaagaaggagctgagggcaaaggggaagagcagggaagcagagaagagagagtagaagatgatggatggagggactcgggagtgtggtggctcagcccacctcatcctagctcagcaagactgcaga

SEQ ID NO: 192407 - DNA, 601 bp, Human
ctagagatggggtttcaccgtgttggcaagggtggtctcgaacctctgacctcaaagtgatccacctgcctcggcctcccaaagggttgggattacaggcatgagccactgcgcccggccggatgagttgtcttctagaatttcttccagctcaatcactccacgattttgggaatctgagaatggtgagattaactgggaggcaagggagaaggtgggacagaaattggtttatagcatcatttaaatagccaaacagaaggatctagaagccagtttcagttggggcagctaacttgcygtcaatttgtctaagccggaaagggagaatctgcagcattagtctgtggcatgtgagaggcccattaataaaagagccacatgtgctcaggggaaagcgagttacatggaaggacaaggacggttgtaggcttgcaaaggagcattcattaccatgcagggcgaatcaaatgaagaaggagctgagggcaaaggggaagagcagggaagcagagaagagagagtagaagatgatggatggagggactcgggagtgtggtggctcagcccacctcatcctagctcagcaagactgcagagg

SEQ ID NO: 192408 - DNA, 601 bp, Human
aaggatctagaagccagtttcagttggggcagctaacttgctgtcaatttgtctaagccggaaagggagaatctgcagcattagtctgtggcatgtgagaggcccattaataaaagagccacatgtgctcaggggaaagcgagttacatggaaggacaaggacggttgtaggcttgcaaaggagcattcattaccatgcagggcgaatcaaatgaagaaggagctgagggcaaaggggaagagcagggaagcagagaagagagagtagaagatgatggatggagggactcgggagtgtggyggctcagcccacctcatcctagctcagcaagactgcagaggtgtgcactgttccccatggtgagaattgggtgtcctttgttgcttagtcttcgggttccaggaggctctgggaccaagggacagacaggaagggagttggagcaggggaggcaggagactcgacggaggccgagggcagtggcctgatccagtatctctgtggagagtgggaaggtgttgaggtctatggtacctgccagatggtagtggctgaataaaagtgggaataaagcaaagaagcaaggcaaggaggagaagc

SEQ ID NO: 192409 - DNA, 601 bp, Human
ctcacttggagggattcacatgcctgggatcactcagcacatagtgaggggctgggatctggactctggacttggtgttcatgcttttaagctctttcctcgacacctcactgtctcacactgcttacactctgcctggagagcttgaaaaaccccgagacagcatccctccatccaaccgtggaggggccggtgtcccagggctggctaggagggaggcaggctgtaagcagttggtcccctggaatggtggtctcacaagggtgctctcacaagggtctcatgtgggaccctcacaagkatgccatcagttgaaagaggaggctcggaaggggcaatgttgagtcgccagtgatggaatgtcgtgtttcagtgaaggaacttgccttgtaatgggactctgtgtggacttctagccctgtaacaccactcctcccaggaggcctccacctgccttcctggaccccctcagggccttggcacagtactgagtgtatagtcaattgcacttgctagggttttgtttgtttgtttgtttgtttgttttttgccagggaccccgcatacattaacatagtgtggtattatctcctccttagat

SEQ ID NO: 192410 - DNA, 601 bp, Human
gagagcttgaaaaaccccgagacagcatccctccatccaaccgtggaggggccggtgtcccagggctggctaggagggaggcaggctgtaagcagttggtcccctggaatggtggtctcacaagggtgctctcacaagggtctcatgtgggaccctcacaaggatgccatcagttgaaagaggaggctcggaaggggcaatgttgagtcgccagtgatggaatgtcgtgtttcagtgaaggaacttgccttgtaatgggactctgtgtggacttctagccctgtaacaccactcctcccargaggcctccacctgccttcctggaccccctcagggccttggcacagtactgagtgtatagtcaattgcacttgctagggttttgtttgtttgtttgtttgtttgttttttgccagggaccccgcatacattaacatagtgtggtattatctcctccttagatggcacgttcctcaaggacaggtgtcttctgtctttccactcctaccacctccaccaagatacccagctttcccctccccacaggctgcaaacattgtatccacttattgggtagtgggcaaatttcagccagaagtta

SEQ ID NO: 192411 - DNA, 601 bp, Human
atatattttctcttttaaccctacaaaatagatactttttattagtcccaattttatacttgaagaaactgaggctcagggtgactgactgacttatccttgaacaaacagtaatgacagagctggttttggacccagagagatctacctctaaagtctaagttcttaaccattacaacaaattatgcatcagaatcaccttggaaatgcaataaaaacacagatttttaaactctacctcacaagagtctagttgggtaggcctatgacaggccccgggaactgatgcagttgtcaagcmcccaaggtgattctaatgaagccctacggccgtggaggccctgtcatgtctgcctcctgcttctgggtcccagcatctgagaggctccgatcagccctccttagagtccagtggagttctttctaggagatcgtaattatgctgggccctgaggccaggtcacccttcttggaagacgaggcagtaaaaggaaagagtctcagacagagaggagcccagagtcctgctgctgactctcagaaaggcctcgtatctctggggcagagctgcattgtctgtaagcaataacagctaccattt

SEQ ID NO: 192412 - DNA, 601 bp, Human
acaaattatgcatcagaatcaccttggaaatgcaataaaaacacagatttttaaactctacctcacaagagtctagttgggtaggcctatgacaggccccgggaactgatgcagttgtcaagcacccaaggtgattctaatgaagccctacggccgtggaggccctgtcatgtctgcctcctgcttctgggtcccagcatctgagaggctccgatcagccctccttagagtccagtggagttctttctaggagatcgtaattatgctgggccctgaggccaggtcacccttcttggaagaygaggcagtaaaaggaaagagtctcagacagagaggagcccagagtcctgctgctgactctcagaaaggcctcgtatctctggggcagagctgcattgtctgtaagcaataacagctaccattttgtataatttctcaaatgagagcagggttaggtaggcagccagaaatttcggggatggcatttcacaaaatggtcattttattcatctaacaagtcatatattgagcatgcactgtgtatcaggtaccatgctgggcctgggggaaaggaagctgaaaaagattcagcccctgcaca

SEQ ID NO: 192413 - DNA, 601 bp, Human
ctctttcttaccagctcttcaaatattttttaaaagtttgattttacttcattcacttactctttcatgcctgaatttagcatagaatttttgagcaccttctctgtgtcaggggccgggaatgtaagattcatgaatcatggttccctcaagagctcataatcttttggggaaggcaaaaactgcagccaggtcttactgtacagggctggtattgtcatgctcttccattttttcctttctcaggcagcggttcccaacatgacgtggctgccacatctctcaccactagtgcttttcrgttcgtctaggttgtctattaaaacacaaggcccagattgaacaccacactccagatggggctgaacagcacagagctgagagcactggaggattatgaatttcctcaaactgaacgccaaatttctatttgccacattagcttgcttgctggaatttgttttccaatttttttattcattctgaactctgggccttgggatcaattaattattccacttgcctttctcccaccaggtacacaggtttcttttcatgtgaacttttctagaaattagacctgagccacactttccttaga

SEQ ID NO: 192414 - DNA, 601 bp, Human
tgggtggctggggggctgctttgaaggttactgagaagtcacttatttcttctttttaattaaggggaattggaatgaggtttaaaatagttgacaacatctcatagaatgtcaaaaattcttaagagttggaggtcagcgagtccatctttcctaccagagaacacatcagtgagagtatcattcctgggcttaaaaccccttggcggcccccatttgctttcaggatgacaggtgctgggtgctgcatacctttgagtcccctcgtctgcactggcccttctgaggctctgccccagcrataccagatgctgtgatggtcaggcatgccaggctctctcgcatgcccttgccagtgcacccgtacccactcccatttctcacctggctactcctactcacgtctccaaaactcagctcagtgaggcttccctaatccccagctcctgcaagcaccggtccagtgctccgtttatgtgctccctctactgtagccttttcacactattattcagtgctgggggctccctgagccagctgagagtggtgctcagtgcaggcttggagagcgaatacggagcgaacgagggactggtgtgtg

SEQ ID NO: 192415 - DNA, 601 bp, Human
gctttgaaggttactgagaagtcacttatttcttctttttaattaaggggaattggaatgaggtttaaaatagttgacaacatctcatagaatgtcaaaaattcttaagagttggaggtcagcgagtccatctttcctaccagagaacacatcagtgagagtatcattcctgggcttaaaaccccttggcggcccccatttgctttcaggatgacaggtgctgggtgctgcatacctttgagtcccctcgtctgcactggcccttctgaggctctgccccagcaataccagatgctgtgayggtcaggcatgccaggctctctcgcatgcccttgccagtgcacccgtacccactcccatttctcacctggctactcctactcacgtctccaaaactcagctcagtgaggcttccctaatccccagctcctgcaagcaccggtccagtgctccgtttatgtgctccctctactgtagccttttcacactattattcagtgctgggggctccctgagccagctgagagtggtgctcagtgcaggcttggagagcgaatacggagcgaacgagggactggtgtgtgcacagcccacctccctg

SEQ ID NO: 192416 - DNA, 601 bp, Human
tttatgtgcatcataaaattattgtgagagcaaaatgaaacattgtttatagctgtgctttgaggattctactatatttgcaaattttagttctgtcatctcacacagagatgactatctatgtatctgtctatctttgtgtgccgtattcccggagtctcgcttctaggctggctcagggcagagagaagaacaaaacgggggtgagcgagacgcccagggccaggtcactctggctgtaaccacgcaaagaccggcccatgccagccaggcggggtgcacaccagctgtaccaggctgkccactcagggcttcaggatggcctccccacagcctctccctctcctgcctctctccttcctccacccctgacccctcctttttccactctctaatgtggcagcctcactggttccacttggcagtggctctggttttgtgtgaagctgagggaagcagaagctatggtcccactcctatgagaatcccagcaccccaaaggcctgcccgacagagcgctgctcagacaagagctgccgacaccctcaaaactaaaatttccccatccagccagagcgctgcaaggcccgggcacatgcta

SEQ ID NO: 192417 - DNA, 601 bp, Human
tgtgtgaagctgagggaagcagaagctatggtcccactcctatgagaatcccagcaccccaaaggcctgcccgacagagcgctgctcagacaagagctgccgacaccctcaaaactaaaatttccccatccagccagagcgctgcaaggcccgggcacatgctagctgcctgctgtgagccagcttccagctaggggcagagccgggccatgctcaggccatcgcagaaagctcagaagttgcatcctcccctgccctccagcatgctactgacttcagtgtcctgagttccagaaggacrgcaagtaaccggcttccttccacccgggtgcttcattaaaaccgtgagttcaattggcatctgccactcagagcgcaaagttgtgttattaatacaaccagctttcccaaggtacttctccacctggtgcgtttaacaaatgaagccaggcatggcctgcctgtgtcatgttctttggcagtaaatctccagcatgcctgagctctctgataaattctttcctcggcagctaattcaaaacaccttctagcttcctggaggtgagagaggggtatgcagatgagtcctcgtgttgactga

SEQ ID NO: 192418 - DNA, 601 bp, Human
tcactggaatctctgagaacagccaatgtggttttattctctttggcaagaggagtggtgagggctagaccaaattctgcttcttatgccagacgttggggattagggatggaagtctgggcaggtcttggcacaagctacacattcgagagcagacaagtacggttgatcctcattatttgtggattccatgtttgcaaattcaactacttgctaaaatctatttgtaacccccaaatcaatacagtgcttttgcagacatgtacagagcagcaaaaaattggaatcactgatgtgcacrttcccagctgaggctgaacaaggctgcaccgtgtcttcttgtttcagctctcatactgtaaacaagtgtccttctcacagtccacttcatgtcacatcttgtctatttttgtgctttttcttggtaatgtttctgtttaaaatgacccctaagcatagtgctgaagtgctatctcgtgttcctacctacaagaaccagtgatatgccttccagagaaagcatgtgtgttaggtaagctgcattctggctgagtgagcgtgctgttgtttaatgttaacgcatcaacagcatatattaagc

SEQ ID NO: 192419 - DNA, 601 bp, Human
cctgtttgagctggaaggggcaagcctgtatccttcttttataggtaagataactaaagataaaaagaaatgacttgcccaaaagaactttgtaattcaattcaacagatatttactgagtaccctgtataggccaggcactgccctggaagctggggccacaaacgggaatttattcacgcatccagccaatatgtagtaagtgccaatttcatgctaggtattgggcatatgatagtgaacaagacagagtctcttcactctggtacaggagaggggcgtgaaacaaataattacctawataactatatgattacaaacgtgatgagtgctacaaagcagtagttcagggcactatgcacaagtctgtgatgtgggtcttgatggagacaaaagactgggaggggcctccctgaggggtgacattcaggctgaagcttggtgggtgactgggaaaccccaggtgaaggggagtgtgaggagcctgagtgggaccacccagaggcggttgtggtggatggcagagctggttgggaagccagaactcccactctgcttatttctctgccgcctagcctccccttcctcaagctttatttac

SEQ ID NO: 192420 - DNA, 601 bp, Human
ctctcccaaattttaatgcctcaggagcaagatcattattaatttatatccacctgtgtcccttggggatgttgggtaaatgatacattctatgtacgtgcaaacacatcccatatcggttatatttacctaaattttaatatttgactaagcagtcctatcataaaatgtttcttgtaatggcattaagaatctgtaggtagaaggactatacatttgttttaaatattgtggaaccaattaagcagccattggccttgtctggaatcctattttttctactcaccagctctgcgagttrggtaaattattaacttatctggaccctgctttccttatgaatacagtgggggtgggaatgggattagtatgcatcaccttctaatgcccagcacagagcccctgtgagtatggcgggcaccagtcatgtgctagagctggcttgccccagcctgcaagagtccgttgtacacatccgttcccagctctgtgcttggtgacatcatgttggcagctttaaatcagccatagcgggtgtgtttacaccacagaaattggcaaatgctacacatgagggtctttttttttccccccaggagag

SEQ ID NO: 192421 - DNA, 601 bp, Human
ttgctgggtgcctgctgtgtacaaaacaggaccctcccccaccacatcctgaagcggacatgggaatgtcagtgggtttacatggtctgtttcttcatttccaggtggtaaaaagagagttctcaatctatagggcaagaggccaggtgcagtggctcatgcctgtagtcctagcattttgggaagctgaagtgggaagatcacttgaggccaggagtttgagaccaagctggccaacacggcgaaaccctgtctctactaaaaaaaaatagaaaaattagctgggcacggtggcacacgyctgaaattccagctacttgggaggctgaggcacgagaatcactttaacccaggaggcagaggttgcagtgagccgagatcgtgccactgcactccagcctgggtgacagagtgagactgtctcaaaaaaaaaaaaaaaaaaaaaaatacagggcaagagaccatgtgcccttttttatttgattctcctctattcagtaattgccaagttcaccctcccttccctgtccccctgccatgtgccaggtgctgtacccagtcctggagaccaaagatgagtaggactcagctctgttctcta

SEQ ID NO: 192422 - DNA, 601 bp, Human
acttttccctgcctggcccagcatcttattagcaggagatagccagtggaacctcaatgatatcattgcagcccagagcaaagaggcgatgcatgagttcgcctcctcagccttatcattgctaactgtgcaaggtctgcaaatgtgtccatgtcttttaggcttttggagataataaaaagagttcaaggacctccatcactatctttatgaactcctggggcccaggcgccctgggctgaaatgattgatctactataaacagaaagagataaaagctggaaagagacacacacctagractgtggggtttcaaggagagagaggtcccctcccatggggaggtcagcaaagccttcaggaaagaaggggcattgacgatgggctctgaaagacagggaatgagtggggaggagaggtcaatgaaggagggcattgtcgggtgttcaggaaaagctgaaaggtacaggttttcctgagaaatagacactggtaagaaagggaagaggcataagccagaaaagtgggttgggtccatagagcttaggaacttgaatgccaggctactaagtttcccttcactgtgaggagatggggtcac

SEQ ID NO: 192423 - DNA, 601 bp, Human
ttccctgcctggcccagcatcttattagcaggagatagccagtggaacctcaatgatatcattgcagcccagagcaaagaggcgatgcatgagttcgcctcctcagccttatcattgctaactgtgcaaggtctgcaaatgtgtccatgtcttttaggcttttggagataataaaaagagttcaaggacctccatcactatctttatgaactcctggggcccaggcgccctgggctgaaatgattgatctactataaacagaaagagataaaagctggaaagagacacacacctaggactrtggggtttcaaggagagagaggtcccctcccatggggaggtcagcaaagccttcaggaaagaaggggcattgacgatgggctctgaaagacagggaatgagtggggaggagaggtcaatgaaggagggcattgtcgggtgttcaggaaaagctgaaaggtacaggttttcctgagaaatagacactggtaagaaagggaagaggcataagccagaaaagtgggttgggtccatagagcttaggaacttgaatgccaggctactaagtttcccttcactgtgaggagatggggtcactgaa

SEQ ID NO: 192424 - DNA, 601 bp, Human
gagacacacacctaggactgtggggtttcaaggagagagaggtcccctcccatggggaggtcagcaaagccttcaggaaagaaggggcattgacgatgggctctgaaagacagggaatgagtggggaggagaggtcaatgaaggagggcattgtcgggtgttcaggaaaagctgaaaggtacaggttttcctgagaaatagacactggtaagaaagggaagaggcataagccagaaaagtgggttgggtccatagagcttaggaacttgaatgccaggctactaagtttcccttcactgtkaggagatggggtcactgaacattttcattcattcatttatttatgtgatgactgtttattgggtgctgctatatgctgggcactgttgtaggtgctcagagtgcatccatgaaccaaaaagacaagaatccctgcctgtaaggagcttacattccagcaaggaatgtgtgatagacagtaaaaagcaatgttgtcaaacaatgaattagaaggcagcaaggctgaggaaaaagagctggagccgggaagggcctggggtgctgagagggttggtgatgttgatacccaggggtcagggtg

SEQ ID NO: 192425 - DNA, 601 bp, Human
gaaaggtacaggttttcctgagaaatagacactggtaagaaagggaagaggcataagccagaaaagtgggttgggtccatagagcttaggaacttgaatgccaggctactaagtttcccttcactgtgaggagatggggtcactgaacattttcattcattcatttatttatgtgatgactgtttattgggtgctgctatatgctgggcactgttgtaggtgctcagagtgcatccatgaaccaaaaagacaagaatccctgcctgtaaggagcttacattccagcaaggaatgtgtgatagacagtaaaaagcaatgttgtcaaacaatgaattagaaggcagcaaggctgaggaaaaagagctggagccgggaagggcctggggtgctgagagggttggtgatgttgatacccaggggtcagggtggcctctccgagaaagggagcattgagcagagacctggtggaggtgaggacgcagccaagtagttgccgggggaggggtattcttggcacagggagctgtcgaagcaagcactgagagagcagttccagcccccagggtttcacccacgcccatctctgctcagccttagctta

SEQ ID NO: 192426 - DNA, 601 bp, Human
ttgggtccatagagcttaggaacttgaatgccaggctactaagtttcccttcactgtgaggagatggggtcactgaacattttcattcattcatttatttatgtgatgactgtttattgggtgctgctatatgctgggcactgttgtaggtgctcagagtgcatccatgaaccaaaaagacaagaatccctgcctgtaaggagcttacattccagcaaggaatgtgtgatagacagtaaaaagcaatgttgtcaaacaatgaattagaaggcagcaaggctgaggaaaaagagctggagcygggaagggcctggggtgctgagagggttggtgatgttgatacccaggggtcagggtggcctctccgagaaagggagcattgagcagagacctggtggaggtgaggacgcagccaagtagttgccgggggaggggtattcttggcacagggagctgtcgaagcaagcactgagagagcagttccagcccccagggtttcacccacgcccatctctgctcagccttagcttatctgaaccagtgtgaaaatgccagaaagatgagagggttgcggtgtcgctgtccagcagagagctgggaa

SEQ ID NO: 192427 - DNA, 601 bp, Human
ccttcactgtgaggagatggggtcactgaacattttcattcattcatttatttatgtgatgactgtttattgggtgctgctatatgctgggcactgttgtaggtgctcagagtgcatccatgaaccaaaaagacaagaatccctgcctgtaaggagcttacattccagcaaggaatgtgtgatagacagtaaaaagcaatgttgtcaaacaatgaattagaaggcagcaaggctgaggaaaaagagctggagccgggaagggcctggggtgctgagagggttggtgatgttgatacccagkggtcagggtggcctctccgagaaagggagcattgagcagagacctggtggaggtgaggacgcagccaagtagttgccgggggaggggtattcttggcacagggagctgtcgaagcaagcactgagagagcagttccagcccccagggtttcacccacgcccatctctgctcagccttagcttatctgaaccagtgtgaaaatgccagaaagatgagagggttgcggtgtcgctgtccagcagagagctgggaacagcctggctgagtccactttgggggagggggtgcagcacccagtgt

SEQ ID NO: 192428 - DNA, 601 bp, Human
actgtttattgggtgctgctatatgctgggcactgttgtaggtgctcagagtgcatccatgaaccaaaaagacaagaatccctgcctgtaaggagcttacattccagcaaggaatgtgtgatagacagtaaaaagcaatgttgtcaaacaatgaattagaaggcagcaaggctgaggaaaaagagctggagccgggaagggcctggggtgctgagagggttggtgatgttgatacccaggggtcagggtggcctctccgagaaagggagcattgagcagagacctggtggaggtgaggacrcagccaagtagttgccgggggaggggtattcttggcacagggagctgtcgaagcaagcactgagagagcagttccagcccccagggtttcacccacgcccatctctgctcagccttagcttatctgaaccagtgtgaaaatgccagaaagatgagagggttgcggtgtcgctgtccagcagagagctgggaacagcctggctgagtccactttgggggagggggtgcagcacccagtgtgattgctgggacctgcttcccgctgtcttcttagtctctaaaaatcttctggatctgtcct

SEQ ID NO: 192429 - DNA, 601 bp, Human
atgaaccaaaaagacaagaatccctgcctgtaaggagcttacattccagcaaggaatgtgtgatagacagtaaaaagcaatgttgtcaaacaatgaattagaaggcagcaaggctgaggaaaaagagctggagccgggaagggcctggggtgctgagagggttggtgatgttgatacccaggggtcagggtggcctctccgagaaagggagcattgagcagagacctggtggaggtgaggacgcagccaagtagttgccgggggaggggtattcttggcacagggagctgtcgaagcaagsactgagagagcagttccagcccccagggtttcacccacgcccatctctgctcagccttagcttatctgaaccagtgtgaaaatgccagaaagatgagagggttgcggtgtcgctgtccagcagagagctgggaacagcctggctgagtccactttgggggagggggtgcagcacccagtgtgattgctgggacctgcttcccgctgtcttcttagtctctaaaaatcttctggatctgtcctcttctatccatccgcaaagcccctgccctaatccaggatcggggcccctctacttctt

SEQ ID NO: 192430 - DNA, 601 bp, Human
tgccgggggaggggtattcttggcacagggagctgtcgaagcaagcactgagagagcagttccagcccccagggtttcacccacgcccatctctgctcagccttagcttatctgaaccagtgtgaaaatgccagaaagatgagagggttgcggtgtcgctgtccagcagagagctgggaacagcctggctgagtccactttgggggagggggtgcagcacccagtgtgattgctgggacctgcttcccgctgtcttcttagtctctaaaaatcttctggatctgtcctcttctatccatcygcaaagcccctgccctaatccaggatcggggcccctctacttctttctctggagccgctccatactctgctggcaggctcccttctttgtctgcctgtcccccgaccctcctgtcagcgtggtcatttgaaaatcagaattggcctggcatttccttccttacaatccttcagccactgcccaggccctgctgccccttaccttgggacataacccttgtaaccaggcccagcccacctcgccttctcctccccatgcagcatggggtctagtggatggctcaagacctgctcgctgcat

SEQ ID NO: 192431 - DNA, 601 bp, Human
gcccctgccctaatccaggatcggggcccctctacttctttctctggagccgctccatactctgctggcaggctcccttctttgtctgcctgtcccccgaccctcctgtcagcgtggtcatttgaaaatcagaattggcctggcatttccttccttacaatccttcagccactgcccaggccctgctgccccttaccttgggacataacccttgtaaccaggcccagcccacctcgccttctcctccccatgcagcatggggtctagtggatggctcaagacctgctcgctgcatcctgcgcctccctgccttggcacatgctgttccttatgcctgggttacccttccctctaatttctgtttccagctggaaatgtctatgcatccttcaaggctctgctcagatgtcacgtctcccacgaagccttccctgctctaactcctgtcctctccttgtctccagcatttttccctgccccctcccatttctcttattagaggtcattatttaaagctttacctccccttctaggatgagagctcctcgaaggtagaggggctgacacaaagtaggagctcaataattagaatctgagtgaa

SEQ ID NO: 192432 - DNA, 601 bp, Human
cccctgccctaatccaggatcggggcccctctacttctttctctggagccgctccatactctgctggcaggctcccttctttgtctgcctgtcccccgaccctcctgtcagcgtggtcatttgaaaatcagaattggcctggcatttccttccttacaatccttcagccactgcccaggccctgctgccccttaccttgggacataacccttgtaaccaggcccagcccacctcgccttctcctccccatgcagcatggggtctagtggatggctcaagacctgctcgctgcatcctgcctctccctgccttggcacatgctgttccttatgcctgggttacccttccctctaatttctgtttccagctggaaatgtctatgcatccttcaaggctctgctcagatgtcacgtctcccacgaagccttccctgctctaactcctgtcctctccttgtctccagcatttttccctgccccctcccatttctcttattagaggtcattatttaaagctttacctccccttctaggatgagagctcctcgaaggtagaggggctgacacaaagtaggagctcaataattagaatctgagtgaag

SEQ ID NO: 192433 - DNA, 601 bp, Human
ccctgccctaatccaggatcggggcccctctacttctttctctggagccgctccatactctgctggcaggctcccttctttgtctgcctgtcccccgaccctcctgtcagcgtggtcatttgaaaatcagaattggcctggcatttccttccttacaatccttcagccactgcccaggccctgctgccccttaccttgggacataacccttgtaaccaggcccagcccacctcgccttctcctccccatgcagcatggggtctagtggatggctcaagacctgctcgctgcatcctgcccgtccctgccttggcacatgctgttccttatgcctgggttacccttccctctaatttctgtttccagctggaaatgtctatgcatccttcaaggctctgctcagatgtcacgtctcccacgaagccttccctgctctaactcctgtcctctccttgtctccagcatttttccctgccccctcccatttctcttattagaggtcattatttaaagctttacctccccttctaggatgagagctcctcgaaggtagaggggctgacacaaagtaggagctcaataattagaatctgagtgaagg

SEQ ID NO: 192434 - DNA, 601 bp, Human
cctgccctaatccaggatcggggcccctctacttctttctctggagccgctccatactctgctggcaggctcccttctttgtctgcctgtcccccgaccctcctgtcagcgtggtcatttgaaaatcagaattggcctggcatttccttccttacaatccttcagccactgcccaggccctgctgccccttaccttgggacataacccttgtaaccaggcccagcccacctcgccttctcctccccatgcagcatggggtctagtggatggctcaagacctgctcgctgcatcctgccccgccctgccttggcacatgctgttccttatgcctgggttacccttccctctaatttctgtttccagctggaaatgtctatgcatccttcaaggctctgctcagatgtcacgtctcccacgaagccttccctgctctaactcctgtcctctccttgtctccagcatttttccctgccccctcccatttctcttattagaggtcattatttaaagctttacctccccttctaggatgagagctcctcgaaggtagaggggctgacacaaagtaggagctcaataattagaatctgagtgaagga

SEQ ID NO: 192435 - DNA, 601 bp, Human
ctgccctaatccaggatcggggcccctctacttctttctctggagccgctccatactctgctggcaggctcccttctttgtctgcctgtcccccgaccctcctgtcagcgtggtcatttgaaaatcagaattggcctggcatttccttccttacaatccttcagccactgcccaggccctgctgccccttaccttgggacataacccttgtaaccaggcccagcccacctcgccttctcctccccatgcagcatggggtctagtggatggctcaagacctgctcgctgcatcctgccccttcctgccttggcacatgctgttccttatgcctgggttacccttccctctaatttctgtttccagctggaaatgtctatgcatccttcaaggctctgctcagatgtcacgtctcccacgaagccttccctgctctaactcctgtcctctccttgtctccagcatttttccctgccccctcccatttctcttattagaggtcattatttaaagctttacctccccttctaggatgagagctcctcgaaggtagaggggctgacacaaagtaggagctcaataattagaatctgagtgaaggaa

SEQ ID NO: 192436 - DNA, 601 bp, Human
ataacccttgtaaccaggcccagcccacctcgccttctcctccccatgcagcatggggtctagtggatggctcaagacctgctcgctgcatcctgcccctccctgccttggcacatgctgttccttatgcctgggttacccttccctctaatttctgtttccagctggaaatgtctatgcatccttcaaggctctgctcagatgtcacgtctcccacgaagccttccctgctctaactcctgtcctctccttgtctccagcatttttccctgccccctcccatttctcttattagaggtcrttatttaaagctttacctccccttctaggatgagagctcctcgaaggtagaggggctgacacaaagtaggagctcaataattagaatctgagtgaaggaattccttcctacagggtaggggtgtcccttaaaagccagcaagactttgggagggagatggggaagtggctgggctgtactgccagcctctcagagccgggaattacaccgtgcttggagttctggcacagatccacagctacgccaagtccacagggtcctgttgctagtctgggaaagtcaccctgatttgtgcatgtg

SEQ ID NO: 192437 - DNA, 601 bp, Human
gagtagtgagtatttggggagaagaatttgtgacaccccttgggacaatcaaagatacaatgggacattaccagtcctgagatggaaacccccagccatgccctgtccaggaagccatttgtttgcttcttactcacatgatcggcaagtgcttaatgctgagccaggtaggggaaccaagcaggtgacgagtctgtcccaggacccactcccattctacctagagcaggcgcaaatcggaaaacattggagggtgattgtgtgggccctggcatgagagcaggggagttctgagacatgsgttggcacagaaggaggcagtgtgactctgcggacaaagatgactaggtgaggtggaagatgggggagtgtgtggagagtttgtgcagggagaagcccttgtgctgaggacggcgtgtgtggaaggcaggctgaccgttcctatctcattgacgtgacagtggactcatccagaatcagaatcacgtcaccttccactcagagctcccgctccctgacacatgacctttgccttctggctgcccacttcatcacgcccacatcctgctctccctcacagtccctccatgaccttgtgtct

SEQ ID NO: 192438 - DNA, 601 bp, Human
acggcggtgtcagtgcacagccatctccttattagccccctaatgagctgtgacatagactggaggacaaggagaggagtctgggactcatagacatgcagccacacaccgagtgacttgaacagtcagaatcttagaattcaccccagatctttcaagcaaaaatactgctgctttggcctcattgagacttggctacttgacatgaactaattaattaacccattaattcaataaatatttattgaacatcttccactgttgtagacactggagatacaatgggggacaaaataaacayggacacagccctcacagatcttctggactagtgagtgagacggagatcaatgaatgatcgcattcttgtgtaatttcaagctgtgataagtgcaggggaggcagagtggaaggcgttgtaggagaacatctagaggagagtaggatgcacggtgggcgcacaatggggctgtagggggaaggcttcccttgggatgtgtgcgctggcttagggaggatgggtgggagtttcctgggcaagcaaaaggtagaaggctgaaggccgttggtgtgccactggggttggtcctggatgggagtt

SEQ ID NO: 192439 - DNA, 601 bp, Human
gtcccttatacagatgaggaaatggtggcccagggaggttaggtaacctgataaagatcacacagctagtaagttcagagccagcatttaagccctggtctgtctgatctcagtactcgtgatctgagaaaacacacatcttgatgttagacagacctaagctaaaatttcagttcattcatttactagctgtgtgtgcttaaacacattattttatcctttccaccccttcccccacagctctagtgttcatctgcaaaggatttttttggtaaagatttaaaataacacacacacacayatacacacacacacacacacacacagagagattgagaatttggcatacaggaagtatgagagctgtcttaggccaggctccctagaaaacagagccgaaggtcaaatcttgcatgctaaatcagggagtgcaagtccacagacacagaggtgagggaaaggggaaggtggcaggcaggcggggagagtatgcagaaggggtgtgttagctgctggtcatagctttgtattaagcacagatgactgttcagcctgcagaggccctatgaaatgattgcctcactaaacagtccaccgcaag

SEQ ID NO: 192440 - DNA, 601 bp, Human
cccttatacagatgaggaaatggtggcccagggaggttaggtaacctgataaagatcacacagctagtaagttcagagccagcatttaagccctggtctgtctgatctcagtactcgtgatctgagaaaacacacatcttgatgttagacagacctaagctaaaatttcagttcattcatttactagctgtgtgtgcttaaacacattattttatcctttccaccccttcccccacagctctagtgttcatctgcaaaggatttttttggtaaagatttaaaataacacacacacacacayacacacacacacacacacacacagagagattgagaatttggcatacaggaagtatgagagctgtcttaggccaggctccctagaaaacagagccgaaggtcaaatcttgcatgctaaatcagggagtgcaagtccacagacacagaggtgagggaaaggggaaggtggcaggcaggcggggagagtatgcagaaggggtgtgttagctgctggtcatagctttgtattaagcacagatgactgttcagcctgcagaggccctatgaaatgattgcctcactaaacagtccaccgcaagga

SEQ ID NO: 192441 - DNA, 601 bp, Human
aatggtggcccagggaggttaggtaacctgataaagatcacacagctagtaagttcagagccagcatttaagccctggtctgtctgatctcagtactcgtgatctgagaaaacacacatcttgatgttagacagacctaagctaaaatttcagttcattcatttactagctgtgtgtgcttaaacacattattttatcctttccaccccttcccccacagctctagtgttcatctgcaaaggatttttttggtaaagatttaaaataacacacacacacacatacacacacacacacacamacacagagagattgagaatttggcatacaggaagtatgagagctgtcttaggccaggctccctagaaaacagagccgaaggtcaaatcttgcatgctaaatcagggagtgcaagtccacagacacagaggtgagggaaaggggaaggtggcaggcaggcggggagagtatgcagaaggggtgtgttagctgctggtcatagctttgtattaagcacagatgactgttcagcctgcagaggccctatgaaatgattgcctcactaaacagtccaccgcaaggagggggaaacttgtatctg

SEQ ID NO: 192442 - DNA, 601 bp, Human
agggaggttaggtaacctgataaagatcacacagctagtaagttcagagccagcatttaagccctggtctgtctgatctcagtactcgtgatctgagaaaacacacatcttgatgttagacagacctaagctaaaatttcagttcattcatttactagctgtgtgtgcttaaacacattattttatcctttccaccccttcccccacagctctagtgttcatctgcaaaggatttttttggtaaagatttaaaataacacacacacacacatacacacacacacacacacacacagagaggttgagaatttggcatacaggaagtatgagagctgtcttaggccaggctccctagaaaacagagccgaaggtcaaatcttgcatgctaaatcagggagtgcaagtccacagacacagaggtgagggaaaggggaaggtggcaggcaggcggggagagtatgcagaaggggtgtgttagctgctggtcatagctttgtattaagcacagatgactgttcagcctgcagaggccctatgaaatgattgcctcactaaacagtccaccgcaaggagggggaaacttgtatctgtgagtcccatc

SEQ ID NO: 192443 - DNA, 601 bp, Human
agctaaaatttcagttcattcatttactagctgtgtgtgcttaaacacattattttatcctttccaccccttcccccacagctctagtgttcatctgcaaaggatttttttggtaaagatttaaaataacacacacacacacatacacacacacacacacacacacagagagattgagaatttggcatacaggaagtatgagagctgtcttaggccaggctccctagaaaacagagccgaaggtcaaatcttgcatgctaaatcagggagtgcaagtccacagacacagaggtgagggaarggggaaggtggcaggcaggcggggagagtatgcagaaggggtgtgttagctgctggtcatagctttgtattaagcacagatgactgttcagcctgcagaggccctatgaaatgattgcctcactaaacagtccaccgcaaggagggggaaacttgtatctgtgagtcccatctctcactgactgaagttcataccacaggaagtcacctccccaacacttctaggctgtgcgcccagaccctttggccaccttcaaagaagttggttcccaagacactggtaacagcactcgaggtgcaa

SEQ ID NO: 192444 - DNA, 601 bp, Human
tatcctttccaccccttcccccacagctctagtgttcatctgcaaaggatttttttggtaaagatttaaaataacacacacacacacatacacacacacacacacacacacagagagattgagaatttggcatacaggaagtatgagagctgtcttaggccaggctccctagaaaacagagccgaaggtcaaatcttgcatgctaaatcagggagtgcaagtccacagacacagaggtgagggaaaggggaaggtggcaggcaggcggggagagtatgcagaaggggtgtgttagctgctrgtcatagctttgtattaagcacagatgactgttcagcctgcagaggccctatgaaatgattgcctcactaaacagtccaccgcaaggagggggaaacttgtatctgtgagtcccatctctcactgactgaagttcataccacaggaagtcacctccccaacacttctaggctgtgcgcccagaccctttggccaccttcaaagaagttggttcccaagacactggtaacagcactcgaggtgcaaagcataaaatgtgggctgatctagcaagtgggtgagagctgtgaccctctccttg

SEQ ID NO: 192445 - DNA, 601 bp, Human
aggctccctagaaaacagagccgaaggtcaaatcttgcatgctaaatcagggagtgcaagtccacagacacagaggtgagggaaaggggaaggtggcaggcaggcggggagagtatgcagaaggggtgtgttagctgctggtcatagctttgtattaagcacagatgactgttcagcctgcagaggccctatgaaatgattgcctcactaaacagtccaccgcaaggagggggaaacttgtatctgtgagtcccatctctcactgactgaagttcataccacaggaagtcacctccccaayacttctaggctgtgcgcccagaccctttggccaccttcaaagaagttggttcccaagacactggtaacagcactcgaggtgcaaagcataaaatgtgggctgatctagcaagtgggtgagagctgtgaccctctccttgcccgcagccttgcctgcagctggatgcaccagtgttcttgcatcacagcagcccaaagacgcctcagggctggaggctcgaggacagggtgcaaggagtgaggtgaggcaatacaaaggtcagccagagcagacaccatgggccgggccaggccagcaggc

SEQ ID NO: 192446 - DNA, 601 bp, Human
tggcattcaactccatgttggcggaatggcacatttaagttcaaagagaaaagggctttggaaggcttagattcaaggctcataagccttggacatcaaatagctcttaccaatgacattttgatgaattaagtgtaaatgaagctgaaacgcctcattccattttttctcctgggtgcccaggagaaaggattgtggagggagcttcccagaggcctggtgggtcaggctgttcgtggcctcaattcactgggaaggttgtccggagacattttgctgaactaaaaaaaaaaaaaaaaaatacaagtggtcccctgagattacttttcaccttgaagccagagactattttaactacaaataggtcacagaattctattcagcattctttaaaataaagatactgatccaggggccaaagtggagtgttccactccttccccgtgtgacagccgagctcagcgagggctttgctttaccttccccattaaggcttagtttctgcatttatgcaaatctgaaagagatgagcttctgttataattcaaccattcattcattcatcaaagtgcgtgctgtctgacaagcaccgcttggatat

SEQ ID NO: 192447 - DNA, 601 bp, Human
ccataattaatccaagctcagacacacagcaagtggccagagcccagactcagaccccaatcttgggctcttctcactgcaccaaaggggcatgtgagaactggtgtctggaacaaaggatgacttgggtggcatcgtcttgttctctgcatcagcctcctagaagaatgaggaggaaggaataagttggcccaggagaatggtaaacaaggaggtggctctgagtggccagtttgacagggacatttggctgacacttctgtcctcaaccctcttatctggaaactggacttcttatgaycacctcgtttttcagactaagaaaacagagccccaagaagctaacgcccaggagtgctaggagttgaagtcaggtccttttcctctaggagcctttcagctaaaaaggcagacagatgcgagcagaagttattttaatgaggtcatacaggataagtgctgtattagacatagcaaagtacatcgtaaatgactaggaaggtaggggcagaaatgacttctgaatcgggacaaccaggatggattcctagtggaagtaagactggcaactctttgaaggaaagtacaatgtcttatgcat

SEQ ID NO: 192448 - DNA, 601 bp, Human
ggagtaagaatcctattcctgaacccggggtgacaaccctattgacccattctgatgtacttaccatcctcagccagtggtgcctgcctctagatgcattgattccatattggttgtgccttcagcttttactttcatagagttcacacagtttttactttcatagagttcacatcctgtatacataggacctccatgtatggtttgtgcaggttaagacatggtgaaggaggaatggggtgtgaaacccagccctcactctgctcaccaaacacgtgctctgggatgggggggtatctayttgtcgatttttttcctacaaaaatgcctttagcttgccaaggcatgtgcccactaagtctgctcagagggccaatctttataattcatacaacgtccccaactgtactgggaatgagacccggtgtataagttagtttgagacgttagcatgtgatatatacaaaagggaatcctacgcaaaatggtatgggagcacagagaaggagggaagcatttcagccggaggaagccaggcaaggcttcagagcagagctaatgagaattgtcgccagtgtttattgaatacctactacctgcc

SEQ ID NO: 192449 - DNA, 601 bp, Human
aagacatggtgaaggaggaatggggtgtgaaacccagccctcactctgctcaccaaacacgtgctctgggatgggggggtatctacttgtcgatttttttcctacaaaaatgcctttagcttgccaaggcatgtgcccactaagtctgctcagagggccaatctttataattcatacaacgtccccaactgtactgggaatgagacccggtgtataagttagtttgagacgttagcatgtgatatatacaaaagggaatcctacgcaaaatggtatgggagcacagagaaggagggaagcrtttcagccggaggaagccaggcaaggcttcagagcagagctaatgagaattgtcgccagtgtttattgaatacctactacctgccaggcatttatcatgcatcatttcctctccacataacaatcttacgtgataaatattattattcatatttcataaccaagatgccaaggttgactttggcttaacagagaaggccaaatcagggtcacacagctaacaagtgattgatctggaattcaaagccaaacctgtctgacatcaaagcccacggtcattctaaccactgcaatgcctctc

SEQ ID NO: 192450 - DNA, 601 bp, Human
atggtctctgggatgacggatggggaagtcattaatggcacacagggaaagagtagctttagacggcagagataaggaattagacatgggtataggaagtcagtaggtagggggagtgaggaaggctggcaagaggcagcactgggcctgaaccccatttggaagttgtcagcatacaggtggtagtaaaatgggaggaatgtgcccacccctgtcctcacactgccttccatcccgactggacacctaggtacaaatcgctgctctgccagctatgagctgtgtggacttggacaagtcwcccaacgtttctcaaccctggtgtcttcaccctcaaaatgaaaataatagtacccacccctggattactatgagaaataaatggaatataattcctgtagcgtgcctgcactttgtggacgctctgtgagtgttcgctctctcctctccttccctccccacgtagggctgtattttcacctcctcttctggcctggagctcagctcctcagcctcacccacctcggtccccaaacacatgcccatctacgtgcatgtctgcctgctcccctgggacatgctcatccaggccccagtcttc

SEQ ID NO: 192451 - DNA, 601 bp, Human
tggtacctcagtcaccccatcctgctgcttttgctccctgccctaccccacagctaggccctgctcatcccttgccttcctgtgaatagatagtcctgcttcaaagaattccaaatgtggcacctccttctatcttccctctgccctctggccatccctcaccagaaggtcttgtggtgtgttcgatgtgcgtactgcctggcttggcctcgccaactcacagttcctggccagagtcattatatgctctgggagcttatttacagatgatttttcttgccatcctatagcttgtcaggarcaactgacatcctcccatttgtcagcgtgagagccaggcctggcttagttgtgccgatggcggtgtcggcagctacagaggcagccatctgagagtcctgttgtattacacccctttccagaacctatggaattattccttatcttatgcagccttcagataggctgcctcgcttgatgccaagctctggccctagctgtgtctgcatttgctcttgaggcaacaatgcaaaggcccagatccttagaaatagcagcatgtagtatggtcgatgcatttggactgcactgaaaggcattg

SEQ ID NO: 192452 - DNA, 601 bp, Human
cctcccgggttcacaccattctcctgcctcagcctcctgagtagctgggactacaggcacccaccaccacccctggctaatttttttgtatttgtagtagagacggggtttcaccctgttagccaggatggtctcgatctcctgacctcgtgatccgcccggctcggcctcccaaagtgctgggatcacaggcatgagccactgcgcccggccccattcgctcatttaatcctcagaataaacccgtgaagcggaaactggtaccattcatactttactcatgagaaagcaagttcagagrggctaagtaacttgcccaggatcacacagctagccagaggcagacttaaacccaggaccctctgatggctctctggcctagtgtcagattctggtgggtagttcatccacccagcacactgtcagggcatcactgttgaatctaggacagactggtccctctcccctgggctttaggacctctagggtgatggctggcaagtcctggggggcgattacagctcccagcagggaggcaagtcttccccctgggctttgcctggtgttcgcagcaggcagagttggctcctctgggaatttc

SEQ ID NO: 192453 - DNA, 601 bp, Human
attggccgggcacagtggcttacacctgtaatcccagcactttgggaggccaaggcaggctgatcacttgaggtcagaagttcgagaccagcctcgccaacatggcaaaacccatctctactaaaaatacagaaattagctgggtgtggtggtgcgtgcctgtagtcccaggtactcaggaggctgaggcaggagaactgcttgaacctgagaggcggaggttgcagtgaaccacatcacatcactgccctccagcctaggtgacaaagtgagactctgtctcaaaaaaaaaaaaaaaaaagaaagaaagaaagaaagaaaggaaaaattaacatctatatatttttctaagttcaaacagaaatgtaatatttccttcaattatgaatgtggtcaacaaagcttcatggtattaaccacacctgtgactttgtcaccaatggtattaatttagtgttgctgttagacacacttccagctcttgttatgtaaagaggcacagataccactatagcacaaaaagtgtacacatattttgataactgaatttctatgtagtcattttaaaatattttaaaataagaggttaacaggtatcagc

SEQ ID NO: 192454 - DNA, 601 bp, Human
gcaggagaactgcttgaacctgagaggcggaggttgcagtgaaccacatcacatcactgccctccagcctaggtgacaaagtgagactctgtctcaaaaaaaaaaaaaaaaaagaaagaaagaaagaaagaaaggaaaaattaacatctatatatttttctaagttcaaacagaaatgtaatatttccttcaattatgaatgtggtcaacaaagcttcatggtattaaccacacctgtgactttgtcaccaatggtattaatttagtgttgctgttagacacacttccagctcttgttatrtaaagaggcacagataccactatagcacaaaaagtgtacacatattttgataactgaatttctatgtagtcattttaaaatattttaaaataagaggttaacaggtatcagcagactgttaaagaggtccatggcataaaaaaatactaagaaggcaggccaggcatggtggctcatgcctgtaatcctagcactttgggaggccgaggcaggcggatcacctgagatcaggagtgtgagagaccagcctggccaacgtggtgaaaccgtgtttctactaaacatacaaaaattagccgg

SEQ ID NO: 192455 - DNA, 601 bp, Human
acctgtgactttgtcaccaatggtattaatttagtgttgctgttagacacacttccagctcttgttatgtaaagaggcacagataccactatagcacaaaaagtgtacacatattttgataactgaatttctatgtagtcattttaaaatattttaaaataagaggttaacaggtatcagcagactgttaaagaggtccatggcataaaaaaatactaagaaggcaggccaggcatggtggctcatgcctgtaatcctagcactttgggaggccgaggcaggcggatcacctgagatcagsagtgtgagagaccagcctggccaacgtggtgaaaccgtgtttctactaaacatacaaaaattagccgggcatggtggtgcacaactgtaatcccagctactcgggaggctgaggcaggagaatggctggaacctgggaggtggagctgcagtgagccgagatcgcaccactgcactccagcctgggagacagagcaagactccgtcttaaaaaaaaaaaaaaaaaaagctagaaggcgacacggagaaaaatggcatcgtctgctttagctttcccaaagacccctctggctgcaacggg

SEQ ID NO: 192456 - DNA, 601 bp, Human
tgccctctataggccaataacacagccctgtgccgagccaactaaatatttcatggggactttaatttaactctaaagaaattcatccagccccgagagtaagctgtaacctcgagaaatagcaccagggagcacttggacctgcggatgacattgccactttcccaggaatgctaatgctccactgggcctctgcctcttcaatcattgctgtggataggcctggcccagtgagcagggatgatttctacaaacatgggctcgcactggttagcaaagacgtgtgtgtgtgtgtgtgtgygtgcgtgcgtgcacgcgtgtatgtgtgtgtgcgcacgtgtgtgtgtgtgtgtgtgtctgtgtgttggcacaggtgaacaattgggtgctatttactgttcctttattccctgatctttgttcctatatcctggttctgaaagaagggagaggtggtggggttggcatccagtctccccagtggacaaggacaccaaatattttgcaggtgccatgtgacccctaagagtttctctttgtctccagcccgcggcgggtggcgtgggcagacagcctgactcatgtggcaggagagcagatg

SEQ ID NO: 192457 - DNA, 601 bp, Human
cctctataggccaataacacagccctgtgccgagccaactaaatatttcatggggactttaatttaactctaaagaaattcatccagccccgagagtaagctgtaacctcgagaaatagcaccagggagcacttggacctgcggatgacattgccactttcccaggaatgctaatgctccactgggcctctgcctcttcaatcattgctgtggataggcctggcccagtgagcagggatgatttctacaaacatgggctcgcactggttagcaaagacgtgtgtgtgtgtgtgtgtgtgtgcgtgcgtgcacgcgtgtatgtgtgtgtgcgcacgtgtgtgtgtgtgtgtgtgtctgtgtgttggcacaggtgaacaattgggtgctatttactgttcctttattccctgatctttgttcctatatcctggttctgaaagaagggagaggtggtggggttggcatccagtctccccagtggacaaggacaccaaatattttgcaggtgccatgtgacccctaagagtttctctttgtctccagcccgcggcgggtggcgtgggcagacagcctgactcatgtggcaggagagcagatgtgt

SEQ ID NO: 192458 - DNA, 601 bp, Human
ctataggccaataacacagccctgtgccgagccaactaaatatttcatggggactttaatttaactctaaagaaattcatccagccccgagagtaagctgtaacctcgagaaatagcaccagggagcacttggacctgcggatgacattgccactttcccaggaatgctaatgctccactgggcctctgcctcttcaatcattgctgtggataggcctggcccagtgagcagggatgatttctacaaacatgggctcgcactggttagcaaagacgtgtgtgtgtgtgtgtgtgtgtgcgygcgtgcacgcgtgtatgtgtgtgtgcgcacgtgtgtgtgtgtgtgtgtgtctgtgtgttggcacaggtgaacaattgggtgctatttactgttcctttattccctgatctttgttcctatatcctggttctgaaagaagggagaggtggtggggttggcatccagtctccccagtggacaaggacaccaaatattttgcaggtgccatgtgacccctaagagtttctctttgtctccagcccgcggcgggtggcgtgggcagacagcctgactcatgtggcaggagagcagatgtgtgtg

SEQ ID NO: 192459 - DNA, 601 bp, Human
tgtgtgtgtgtgtctgtgtgttggcacaggtgaacaattgggtgctatttactgttcctttattccctgatctttgttcctatatcctggttctgaaagaagggagaggtggtggggttggcatccagtctccccagtggacaaggacaccaaatattttgcaggtgccatgtgacccctaagagtttctctttgtctccagcccgcggcgggtggcgtgggcagacagcctgactcatgtggcaggagagcagatgtgtgtgttctcaggcatgtgacgctgaagtctaagggatgagcyctgcggatgctcgtgtgggccaggagtgggagtgagcctccctggctccttctgatcccattgccctgcagctcggtgaccccagtgagtcctggcaagttccctgggcatctcaataggtgcgggtgggagggagaaagccgcccgcaggtaaactgatcaaaagacaggaagtgagcagataatctaatttgaaatgggctgagatacagatgttattctgctcaaatgcacagcacaaaaggactggggcctggggagaattgggaagcagctccgtggagccagtcttctggcctc

SEQ ID NO: 192460 - DNA, 601 bp, Human
atgttattctgctcaaatgcacagcacaaaaggactggggcctggggagaattgggaagcagctccgtggagccagtcttctggcctctggctcagcctgggcctgtcatctccattccttcccgggctgtaattaacacccctccgctgatagctgctttaagccagattggagcatggggcccttcctcttctggttgggcgtcccacatgacaccgtccaaggtgttagagggaaccgggtctggggcagggcaaggggagaagggcgccctctagtggggaacctacggcttcaagtccttaggttggaggatgtctgatcgcatccacagcatgacctgaatctggttctaatgttccagcctcctgacaaaaatccctcctgcatacaggcatctgtcagaaatcagcctgcttcagctgccagcaagaaggggctcgagggcaggccacgtttagagggggggggtcccctccttacccacgctgttggctgcactggctcttcactagggactgactgtgtgccctcttggggaaagtcactgcgaacagtgcagtaataagaaagccaagcgcacagtcctgagaatgtgta

SEQ ID NO: 192461 - DNA, 601 bp, Human
aaatcagcctgcttcagctgccagcaagaaggggctcgagggcaggccacgtttagagggggggggtcccctccttacccacgctgttggctgcactggctcttcactagggactgactgtgtgccctcttggggaaagtcactgcgaacagtgcagtaataagaaagccaagcgcacagtcctgagaatgtgtacatgggggtctgaagctagctttcttcatgtcctagctgcgtgtatttgagcaaatgatgaacctctctgggtctcagcgtctttgtctccaaaacagggctaatsgcagttttgaaatgttgtttatgttaaattttttcaaagatttgatccctgcttcaagaagtttatctaatgtagagataagatatgcacacaaatgtaaacagcagtaatagtaagagctaacatttattgtgagttatctgtgtcaggcctaagctttgtgtgggttgctcatttaattcccatagaagctccatggaggtgggaactatcattatccctactttattgatgaaaaaactgaggcacagagaagttaaggtcacgcagctcataggtggcagagttggagtgtgagtc

SEQ ID NO: 192462 - DNA, 601 bp, Human
agctgcgtgtatttgagcaaatgatgaacctctctgggtctcagcgtctttgtctccaaaacagggctaatggcagttttgaaatgttgtttatgttaaattttttcaaagatttgatccctgcttcaagaagtttatctaatgtagagataagatatgcacacaaatgtaaacagcagtaatagtaagagctaacatttattgtgagttatctgtgtcaggcctaagctttgtgtgggttgctcatttaattcccatagaagctccatggaggtgggaactatcattatccctactttaytgatgaaaaaactgaggcacagagaagttaaggtcacgcagctcataggtggcagagttggagtgtgagtccaggcatcctgtactaatacaaggaaatttatagtatatgccatggtgggtggcatgagcattgccttctctctttggcgacagacaagggagggcttatgcctgagaagatgatcagagaaggttttatgaggatggtaaactttgaatagaccttgaagagtaggtggagttgatgtttggacttttgatgtggagtaaatataactgcagaaaagtacaaggtgtg

SEQ ID NO: 192463 - DNA, 601 bp, Human
gggaactatcattatccctactttattgatgaaaaaactgaggcacagagaagttaaggtcacgcagctcataggtggcagagttggagtgtgagtccaggcatcctgtactaatacaaggaaatttatagtatatgccatggtgggtggcatgagcattgccttctctctttggcgacagacaagggagggcttatgcctgagaagatgatcagagaaggttttatgaggatggtaaactttgaatagaccttgaagagtaggtggagttgatgtttggacttttgatgtggagtaaatwtaactgcagaaaagtacaaggtgtgttgagagccagctgagttggcctggctgcaggggaggggcagtgtctgggagaggagtgatggagatggggctgaacttgcaggagtaggcagaccatgagggccagactcccacatgctggactgcagaggagtgggagtcgtgaataatttcttagggaggacaggtatagttgctgtggtgcgtaagtgagttttgctagaaatattgagcacccgctttattccaggtaatgtgttttgtgcattatatgtattatttcctttgtcctcat

SEQ ID NO: 192464 - DNA, 601 bp, Human
aaatgacattgaagaatgggaggcactctgcagccccagcagcaggtgaaacaggagatgtgaagcctgacttgtaaagttgtagaaagctgctggcatgtagagggggcaggggcagctggcctcctcaagggcagaaagctggggtgaggaggtgtactgtaaaaaggtcagagaagaaagatctggaagctgatcagagatagaagagaggatctgaaagaggattcagagggagctggagaggccatttaattcattctccccaaaggagaatcatgtttggaggaagggactgggragaatgactggctttccaagctaggtactggatttttcccagagttttccaaaggactggacagcatgaggtctgggaggcctggaccccacataggtccacatagacagacggtcacaccagagaagcacattgtgtcaacacagctgtgcatgtgctccaggtcacccgggaaaggccgcaggggccagagtgggggacgcggtgaccagttagggctgcacatacacagaacaggtctgcctgcctccaaacatgcccacaactcatcataaggtctccataagcccttgctaagat

SEQ ID NO: 192465 - DNA, 601 bp, Human
gtttggaggaagggactggggagaatgactggctttccaagctaggtactggatttttcccagagttttccaaaggactggacagcatgaggtctgggaggcctggaccccacataggtccacatagacagacggtcacaccagagaagcacattgtgtcaacacagctgtgcatgtgctccaggtcacccgggaaaggccgcaggggccagagtgggggacgcggtgaccagttagggctgcacatacacagaacaggtctgcctgcctccaaacatgcccacaactcatcataaggtcyccataagcccttgctaagatgatcctcattgtcaagttcagcagcagcatcattgtcatcccaacagcaaagacttactggctacttacttcaaaccaggccccatgctcagcatttacagacatggcctcattcatcttctcaacaattgtaggagctaggtactcttattatacccgcgttacagataagcaaactgaggcttagaaaaagttgaataaatgacttgtccaaggtcatacaacaggtaagtgagtgcgagtccaggtagttctaagccacactgaaaactaagttcag

SEQ ID NO: 192466 - DNA, 601 bp, Human
tgcccacaactcatcataaggtctccataagcccttgctaagatgatcctcattgtcaagttcagcagcagcatcattgtcatcccaacagcaaagacttactggctacttacttcaaaccaggccccatgctcagcatttacagacatggcctcattcatcttctcaacaattgtaggagctaggtactcttattatacccgcgttacagataagcaaactgaggcttagaaaaagttgaataaatgacttgtccaaggtcatacaacaggtaagtgagtgcgagtccaggtagttctargccacactgaaaactaagttcagttaccccctctactgccttaatagccccttattgatatggcagcgctctacagtgttatgatttataaggctcttctacaaccatcatctcttttgactctcacataatattgataggctggtattgccccattttacagtggagaaaaatgagtcccagagaagggaagtaaattgcacatggccatttggacggcaaggagcagaggcactggcagttctcctgacccgtcccatcctcccattagcatggctgtatgtaagggagggcagccag

SEQ ID NO: 192467 - DNA, 601 bp, Human
taaatgacttgtccaaggtcatacaacaggtaagtgagtgcgagtccaggtagttctaagccacactgaaaactaagttcagttaccccctctactgccttaatagccccttattgatatggcagcgctctacagtgttatgatttataaggctcttctacaaccatcatctcttttgactctcacataatattgataggctggtattgccccattttacagtggagaaaaatgagtcccagagaagggaagtaaattgcacatggccatttggacggcaaggagcagaggcactggcagktctcctgacccgtcccatcctcccattagcatggctgtatgtaagggagggcagccaggccaggtggaggaggcaggcctgaggctgcaagaggtcatagccaggcgcggtggctcacacctgtaatcccagcactttgggaggccaaggcgggtggatcacgaggtcaggagatcgagaccatcctggctaacacagtgaaaccccatctctactaaaaatataaaaaaattagtcgggcatggtggcgggcgcctgtagtcccagctactcaggaggctgaggcaggagaatggcgtg

SEQ ID NO: 192468 - DNA, 601 bp, Human
agtgctgcttctcctgctcctcccagcaagtttgcacagactgtgcacctgatgagattttgcctgtcagcttcttagggtcgtctttgcctgtgtttagctatttgttttcagcaaggcacagagctgcccatttcccatctggttctcacttgccctggtgctgtctcgatggagctcagtgtacttcagtggctgtgaaagcaggagcagtcaccaaaatccaggtcttctgatgtcctgttccctgctctttccgcctgggagcatgcccacccctccctggcctggcccccacctkccccccaggaggcagaggagcagaagggcttggatgagttgtcattgtacatgcccctcagcctcccacaccagtgattcctgggtggaatcacagtcccagccccctatcttactagtttggtttcatggcacattatctcttcatctgaaggctgctttatagcataatgtcttttttttgttttgtttttaagatggagtctctctctgttgcccaggctggagtgcggtggcacgatctcagctcactgcaacctccatctcccgggttcaagtgattctccctgtctcagcctcc

SEQ ID NO: 192469 - DNA, 601 bp, Human
gctcagtgtacttcagtggctgtgaaagcaggagcagtcaccaaaatccaggtcttctgatgtcctgttccctgctctttccgcctgggagcatgcccacccctccctggcctggcccccacctgccccccaggaggcagaggagcagaagggcttggatgagttgtcattgtacatgcccctcagcctcccacaccagtgattcctgggtggaatcacagtcccagccccctatcttactagtttggtttcatggcacattatctcttcatctgaaggctgctttatagcataatgtctyttttttgttttgtttttaagatggagtctctctctgttgcccaggctggagtgcggtggcacgatctcagctcactgcaacctccatctcccgggttcaagtgattctccctgtctcagcctcccgagtagctgggactacagacgtgcaccaccatgcccagctaatttttgtatttttaatagagacagagtttcaccgtgttggccaggctgatctcgaactcctgacctcaggtgatccacccagctcagcctcccgaagtgttgggattacaggcatgagccactgcgcccagcc

SEQ ID NO: 192470 - DNA, 601 bp, Human
ccacccagctcagcctcccgaagtgttgggattacaggcatgagccactgcgcccagccataatgtctttgactaggtaaaataacgaaggcacatgtgattggaataatctgatcccatgtgattgttgctgataccccagtgccttcaagctaaagtaggtaattactcctctatattgagaatataatattaaatgcaagaaacgaccgccacaaacctttcatggcttctttcagcttgtcactgccctttcctgtctccttccctgcctccctttcccccagcgtcctcttgacckgggacaaaggaaagaaagactgggactggtgggaatgtgccagcaatgtgtgcatgaagccggttccctgtttgtagggaagtgtcagtgagtgagtagacagaaatgctctgtccagacgtgaggcacaagctctcccttggcatgtggtcattctccctgtgcccagggaagaaccctggtagtgagctgctgcccatctgcagatgtgtctccacagggacatatggaattgttttggcataatgtcacagttggccaacttttatcgacttgtaaaatgatttccaaattttaatc

SEQ ID NO: 192471 - DNA, 601 bp, Human
ctcccgaagtgttgggattacaggcatgagccactgcgcccagccataatgtctttgactaggtaaaataacgaaggcacatgtgattggaataatctgatcccatgtgattgttgctgataccccagtgccttcaagctaaagtaggtaattactcctctatattgagaatataatattaaatgcaagaaacgaccgccacaaacctttcatggcttctttcagcttgtcactgccctttcctgtctccttccctgcctccctttcccccagcgtcctcttgaccggggacaaaggaaakaaagactgggactggtgggaatgtgccagcaatgtgtgcatgaagccggttccctgtttgtagggaagtgtcagtgagtgagtagacagaaatgctctgtccagacgtgaggcacaagctctcccttggcatgtggtcattctccctgtgcccagggaagaaccctggtagtgagctgctgcccatctgcagatgtgtctccacagggacatatggaattgttttggcataatgtcacagttggccaacttttatcgacttgtaaaatgatttccaaattttaatccaaagtttgccctt

SEQ ID NO: 192472 - DNA, 601 bp, Human
ggcacaagctctcccttggcatgtggtcattctccctgtgcccagggaagaaccctggtagtgagctgctgcccatctgcagatgtgtctccacagggacatatggaattgttttggcataatgtcacagttggccaacttttatcgacttgtaaaatgatttccaaattttaatccaaagtttgccctttgggaggaaagcagcgtgtgaggaaaataaacttgaggatagagttgttgactttggttaattgatttggattttttttttaaagaaccagagaaaggaatggatgccacrtttacctcatgcccatttcatcacttttaatttttctaatcttgccatctttcctccagtttcttcattccagcccatttaactcttgtttcctcccctcaagtttcaggtaggggttggctaccaatttggttcatttctgttacctgacacctgtgctcaaaagctgaattcaaatcagtgcctctgttgtggaggggctgaggctctgaacggcccaagcaactgtctaaagagtcccccaaatgaaggcactaacaatcctctaatcaaacctaactttgaatgcaagtgtcaatt

SEQ ID NO: 192473 - DNA, 601 bp, Human
tctaatcaaacctaactttgaatgcaagtgtcaattcacttgctagcagtcatcagcactgtcttggagaaatacagaatggatcattcacattttctattttgtagtgaaaatccccttcatctgcaccctagttgctttttaaggatgacctcaccatataaggctccgagtttgttaagctgtgctggatcgtgtgactgctttatggggtggaacctgaattggtgatggaggattggggttgaggtggagaagaaactgatctttgccaatggatttatccttcctgtacacaaaycataattcccttgtgtgtaaaatgagggccagcacatctgtctccccactttctttgcagtgtttgtacgtagtcattcagaactgattagcctgtttgtagattgttggaccacacttcacttttcttatttcatcttttgcatcaactgatcgaccagcattagaaaatgtcaatcattgtaggctcgtctgagatacagcgcccaggtcataaaaacatggctcttaacaattagtacagtataagttagaatcatcagggcagctttttacaaatatagattcctgcgtcctacca

SEQ ID NO: 192474 - DNA, 601 bp, Human
tagtgaaaatccccttcatctgcaccctagttgctttttaaggatgacctcaccatataaggctccgagtttgttaagctgtgctggatcgtgtgactgctttatggggtggaacctgaattggtgatggaggattggggttgaggtggagaagaaactgatctttgccaatggatttatccttcctgtacacaaatcataattcccttgtgtgtaaaatgagggccagcacatctgtctccccactttctttgcagtgtttgtacgtagtcattcagaactgattagcctgtttgtagaytgttggaccacacttcacttttcttatttcatcttttgcatcaactgatcgaccagcattagaaaatgtcaatcattgtaggctcgtctgagatacagcgcccaggtcataaaaacatggctcttaacaattagtacagtataagttagaatcatcagggcagctttttacaaatatagattcctgcgtcctaccaccagaaaatctgatccaggaagtctgggatgagactcaggaattcacattttaattgacccagcaggtgattctgaggtaggtggccccatagacagcattttg

SEQ ID NO: 192475 - DNA, 601 bp, Human
gctgtgctggatcgtgtgactgctttatggggtggaacctgaattggtgatggaggattggggttgaggtggagaagaaactgatctttgccaatggatttatccttcctgtacacaaatcataattcccttgtgtgtaaaatgagggccagcacatctgtctccccactttctttgcagtgtttgtacgtagtcattcagaactgattagcctgtttgtagattgttggaccacacttcacttttcttatttcatcttttgcatcaactgatcgaccagcattagaaaatgtcaatcatkgtaggctcgtctgagatacagcgcccaggtcataaaaacatggctcttaacaattagtacagtataagttagaatcatcagggcagctttttacaaatatagattcctgcgtcctaccaccagaaaatctgatccaggaagtctgggatgagactcaggaattcacattttaattgacccagcaggtgattctgaggtaggtggccccatagacagcattttgagaaccaccatagaggattgctgggaaggacccaggcactctccttgatttatggatgaggttaagggagcctagag

SEQ ID NO: 192476 - DNA, 601 bp, Human
gatcgtgtgactgctttatggggtggaacctgaattggtgatggaggattggggttgaggtggagaagaaactgatctttgccaatggatttatccttcctgtacacaaatcataattcccttgtgtgtaaaatgagggccagcacatctgtctccccactttctttgcagtgtttgtacgtagtcattcagaactgattagcctgtttgtagattgttggaccacacttcacttttcttatttcatcttttgcatcaactgatcgaccagcattagaaaatgtcaatcattgtaggctcrtctgagatacagcgcccaggtcataaaaacatggctcttaacaattagtacagtataagttagaatcatcagggcagctttttacaaatatagattcctgcgtcctaccaccagaaaatctgatccaggaagtctgggatgagactcaggaattcacattttaattgacccagcaggtgattctgaggtaggtggccccatagacagcattttgagaaccaccatagaggattgctgggaaggacccaggcactctccttgatttatggatgaggttaagggagcctagagaagtgaagt

SEQ ID NO: 192477 - DNA, 601 bp, Human
gtgagaacacaccaataggcagcagagtacagacacgaccttcaagtatactggccggtgggaagagcagaggaagagtcaccctggctgggtctcatccatcagtgaataatcatgacagtgccagcaaatagctgactttgctagtttatcttgctggaccagaagagccttcctttcctcttgtcagctgaactggctctaagtgcagagcgtcatacagatttgcccaatacactagtcattttcagtgcccatgattcagctgccatggtatgctccagaacagagcctgtacctmgaggctgcccaacagggtagagaccaagagatcacccaacatgcctgctgaagaagtgaccccttgccaggccccacatcccagctctagagaaaaggagatcgtccacctttgcagctccagcctatgctcccaaccctgtgatgggggttgttgttaagggttgaattgtgtcccccgccaccaaaatatatgttgaatttctaacctctaggacctgtgaatgtgacctcatttggaagtagggtctttgcagatgtactcaagtgaaggtgcagccatgctagattaggctggact

SEQ ID NO: 192478 - DNA, 601 bp, Human
tctcatttggtcctcaagatggttctttgggggaaagggggcaggtatgataattcccaatttatagacatggaaactgaagtcatgcttggagctagttgagggctgagcctggaacccaggccccttaactccaggagggtgtcttgccatcgttacatctgttggtactcactaggcagtcttccagccagcaccatttctggagctcccctcccccacattgacccctggagtcgggggacatccaaaagaaatggaggcacacagcctttgtccaaactaccctgctgtggcttgyggtagccactcaactaggctctggccttggtgtctagattcctggagggaactaaagccttcctggtgactcagtggcccatcaggaaccagatggcagaaggtacctgaccccaagtgtttttgccaccaggaaacacctactgctaggctgccctccccacctagggcaccactgtcctgaataccaactctggccagaaagaaaccacaattcaccaatcctctggacatcccaaattggattgttgactaaatgtttcctaccacctgaaaacctgtatgagtttccctgcattca

SEQ ID NO: 192479 - DNA, 601 bp, Human
acctgcctctcagccagctaacgaactctttcctggctttcaatacccagctcaaatggcacttgctcttccacgcagctcccctagatggagctgcttgccctctgcctatacttctattacaacacttttaggttgcattacattattctttgtttatctatctctccctttgtatcctccgatgggaggtatattaagggaaaggtaccctcttgtcagaccatagatttttatgatacgatttttggtatggaaaatgtggtcatcctaaacatgcagtatttacttgacaggaagraaggagggcaggccataaatccagtgatcctgtgggcagtgaatgctatgctttcctttgtgctcctgattgggcagtactgagccccaggaacctgagattctattagggaaccttacagggccagtattctaggcagcaggacaagtgacccaaattcttttttaccttctggcctttacccctgtaggtcttgagaacaaacagaagtgggatgcagatgtttcaggcagcctagatgcagcctctggctcaggtctggctgtagctgcctcctgaactcactgctctctctctctc

SEQ ID NO: 192480 - DNA, 601 bp, Human
ccctagatggagctgcttgccctctgcctatacttctattacaacacttttaggttgcattacattattctttgtttatctatctctccctttgtatcctccgatgggaggtatattaagggaaaggtaccctcttgtcagaccatagatttttatgatacgatttttggtatggaaaatgtggtcatcctaaacatgcagtatttacttgacaggaaggaaggagggcaggccataaatccagtgatcctgtgggcagtgaatgctatgctttcctttgtgctcctgattgggcagtacygagccccaggaacctgagattctattagggaaccttacagggccagtattctaggcagcaggacaagtgacccaaattcttttttaccttctggcctttacccctgtaggtcttgagaacaaacagaagtgggatgcagatgtttcaggcagcctagatgcagcctctggctcaggtctggctgtagctgcctcctgaactcactgctctctctctctctcaatgcctgcatattccacacacaacatagcatccacctgagaaagtatcagaatccgtggctagggccagatgggcttc

SEQ ID NO: 192481 - DNA, 601 bp, Human
aacggaacagtgcccggaagcaggtagtatgattctcattttacaggacaaaattctgaaactctgtgagcccagttagtgcagaggaaagaggaaaggcaacacaatgttgcagggggcattgaaaccaggtttttggtctccaaatctccatacatgtccaactacctgtctttacagtatcataggtgtatttctttcagtgtcaacgctattctttagatgatctttcaagatcctttcccatctgaggatactatctctgatcccagagaaggtcccaagccagctagaacacccragactccctggaaaatgtgagcttaccattttccctccataccaacttgttccacctttggttaacaaatgggaaagttttatactctcttctttttctcttcttaactcttagctagagtcttctttctcaagaaaaagaaaaatcagacagtgtttaaaaagtaagggagaaataggctgggcacggtggctcatgcctgtaatcccagcattttgggaggccgaggcaggcggattatgaggtcaagtgttcgagaccagcctgaccaacatggtgaaacgccatctctactaaaaa

SEQ ID NO: 192482 - DNA, 601 bp, Human
tattctttagatgatctttcaagatcctttcccatctgaggatactatctctgatcccagagaaggtcccaagccagctagaacacccgagactccctggaaaatgtgagcttaccattttccctccataccaacttgttccacctttggttaacaaatgggaaagttttatactctcttctttttctcttcttaactcttagctagagtcttctttctcaagaaaaagaaaaatcagacagtgtttaaaaagtaagggagaaataggctgggcacggtggctcatgcctgtaatcccagmattttgggaggccgaggcaggcggattatgaggtcaagtgttcgagaccagcctgaccaacatggtgaaacgccatctctactaaaaatacaaaaattagccgggcatggtggcacacgcctgtaatcccaactactcaggaggctgagacaggagaatcatttgaagccgggaggtggaggttgtagtgagccgagattgcaacattgcactctagcctgggcaacagagtgagactctgtctcaaaaaaaaaaaaaaaagtgatggagaaataaatgctgacattaaattaatgcacg

SEQ ID NO: 192483 - DNA, 601 bp, Human
ctgaggatactatctctgatcccagagaaggtcccaagccagctagaacacccgagactccctggaaaatgtgagcttaccattttccctccataccaacttgttccacctttggttaacaaatgggaaagttttatactctcttctttttctcttcttaactcttagctagagtcttctttctcaagaaaaagaaaaatcagacagtgtttaaaaagtaagggagaaataggctgggcacggtggctcatgcctgtaatcccagcattttgggaggccgaggcaggcggattatgaggtyaagtgttcgagaccagcctgaccaacatggtgaaacgccatctctactaaaaatacaaaaattagccgggcatggtggcacacgcctgtaatcccaactactcaggaggctgagacaggagaatcatttgaagccgggaggtggaggttgtagtgagccgagattgcaacattgcactctagcctgggcaacagagtgagactctgtctcaaaaaaaaaaaaaaaagtgatggagaaataaatgctgacattaaattaatgcacgacattgctggatatattacccgcttttcaagaagg

SEQ ID NO: 192484 - DNA, 601 bp, Human
agcattcttccccaaagcatctttaacatgtgtcactgtaagagagaaagtatagtatttcttgtccattgaggaaggcatcagtataaaaggaagttcccgcctttgtaacacaccatctccccactcccccttcactcacggctaccattagacagaaggagagtgaacatacatacagctctatgagttaactcactgagttcccaaaacaaccccacgaggtaggttttattattccttccatgttatacaggaggaaacagagacctagaggttacccaacttacccaggattgcrtgtcttgtaaatggtggggccagaattcaatcttgggcagtctggctgcagagtctgggttttattcactacctgtcctgactgcctggctccggtgtccccatgaatctggcttcagactctgggaaagcaattgcattcttccgagaatgtcatttcttccagtatatatagagtgaagtatcaatgagtcaacagattgtttttaaggataagaggaactttgggcatgaaaggggggtttaatgccacttcatagctccatggacagccccactactatcatgcaaaggacctaca

SEQ ID NO: 192485 - DNA, 601 bp, Human
attccttccatgttatacaggaggaaacagagacctagaggttacccaacttacccaggattgcatgtcttgtaaatggtggggccagaattcaatcttgggcagtctggctgcagagtctgggttttattcactacctgtcctgactgcctggctccggtgtccccatgaatctggcttcagactctgggaaagcaattgcattcttccgagaatgtcatttcttccagtatatatagagtgaagtatcaatgagtcaacagattgtttttaaggataagaggaactttgggcatgaaakgggggtttaatgccacttcatagctccatggacagccccactactatcatgcaaaggacctacacacaccaggattgtggtcagttgatgaccagccctttgtatctctccctccgtctaagagcatcagggatgctgattgatggtcagtctgatgcacagtccaaatgtcaagggagctaattctaattttgctgttgtctaattttcaatttcatccgcagagcttgacctgtcttcaacatttggggcatagactatatataaccacctatctacttccaaagtgattgtattcac

SEQ ID NO: 192486 - DNA, 601 bp, Human
agttcttccatctgtcagtatggaaaattgggtattgaaatcaagagaacatagtgaagcacttttagttcttcaaaagaaaggcatcactgtcatacctcctttgggctaaggaaaatcaattatttggaagaaatgcctatggcatatgacacctgatttgccccaagcgccagtaactcacatgtcttttgggaagaaagtgatctaaaccatccacatagaaaaaaatggtaggcattcagaatcttgcaagacacatacttctctttggcatcatagagacagcatggatttagcytaagccaaggctgtataagcccagacccaaatctcaaatgactgcccattccttgctcttctggttggcgtcagtcaatcacaagtagaatcagatgttgccttgccaacgtgactgatatgtttctgggggagctttgtttatgtcatggtttttgttcgtgtgatgttctctgttttataactttggtctctaggaatttttcccacagctgtgcatcattccttatcacccataaccaaatatggcagctttaaatagtgctgtcattttcctcaatttcacttgtgatataatcag

SEQ ID NO: 192487 - DNA, 601 bp, Human
acgtgactgatatgtttctgggggagctttgtttatgtcatggtttttgttcgtgtgatgttctctgttttataactttggtctctaggaatttttcccacagctgtgcatcattccttatcacccataaccaaatatggcagctttaaatagtgctgtcattttcctcaatttcacttgtgatataatcaggtatagatttctgacattgagcatctaatgggttttcagattcagaaagcaacagtaatagatttttcagttgagagacagattgaaatagtcataagtgacagggcaygtggaattcatgcacatttactcagagaaacttgggggtcaaaaaagaccccaggagtggaccacactagtgatttctattgcagtaggagtataggcatgatcggctcctttactgcttctggactctgtatatggatgctaccctctctgtgtcttcctgtgtctgcctctggctcttaggatgatgaaggaaacacagtcaagccatgatggacacaggaatgattaactggggacttggattctgctgctctggagtcctttgccttctgttagaggatttatgtaatgacgggat

SEQ ID NO: 192488 - DNA, 601 bp, Human
taaacaattcaactctgtgggccgtatgcatccataagccactggtgtgtcacctcggatctattcccactccaactgaggccagaaaggggtgggaacttgcctgagaccacacggctaaagacttggagcagatgacttaactccatccttctcattccattttgttttcccgtgaagaatggcggggagcttggtgcccaggattccattcctggctccattgtctggctcacaggactctggccagactcatccctggccttgcaacgtgttttcccacggtgcagtggagtgagcyctgggctttgagtcaggaaacatgggcttttttgggtcccggctcttccatttacgcactgtggaacctcgggcacatctctgactgccctcggctttggcttcttcacttgtaaaatgagaataataatttgtgcctcccaggactgttttgaggttgacgggggaaggtctcactgtgtgagatcaccccgcaaacaaaacccagagactccggttgtattagcatcctggtgaaaaagatgtgagtgtctaagagggatgctgtggtcgaattcagcaatgcagacagcagcagctc

SEQ ID NO: 192489 - DNA, 601 bp, Human
gatcaccccgcaaacaaaacccagagactccggttgtattagcatcctggtgaaaaagatgtgagtgtctaagagggatgctgtggtcgaattcagcaatgcagacagcagcagctcaaaggtgcttcctgagtccatcctccacccccgatggaggacacagggtggtacttcggggcactgagggttgttcctctttgccagcacaaagcctgcctcaccccagggagtggcatggcccctgctgctgttctgtgtcacctgctgaggtcagggctgggtcgtgtcatttgcgcagccyggcaacaccctcattcccagtgtcatttaaaccaatcacccagaacccacagaaatgggaactggggccagacccacactcactacctcctctaccccgccctgcctgccccaaggtcatgttgactgaatgtgtgcggtgaatcttgtttttctctccatttccagggacgcaaacccggctatttctccttcctggacccattttctccgggcgtctggctcttcatgcttctagcctatctggccgtcagctgtgtcctcttcctggtggctcggtactctcctcttcccttccctg

SEQ ID NO: 192490 - DNA, 601 bp, Human
aaactagaaggacaggagaaggactgggggcctgaaatgctctctgcccagctgtcgacctcatgctgcccatccaaacattccccactgtgcacgacgcagacaggtggcttggcttctgcacctctgcctcctgtcccctcccacttctccccagacccccacctaagccccttgcttgtgtaggagccctgggaagagaggaggggtggggttggcaggaagatgactctcattaagcactgtgcatttggctgccctggcatcagtcattgccacaaaggatctgccacaaagtgcygaatgacaaggaacagagcctgcaaatctggactgggggcactgggggctgcagtggagcaggccagggagaaggctttctctgcagacagcctgggcctgcctctgaaaacacagctgccttgtcgaatgggaaccatggaggctgctggcgggtggcaaggagacgggatggagagaggcgttttcaagaagtgctgagttgagacgcacgggccagaccagggaggggggagaataagccctgccctatccccaggaaaccaggggctgccctggccctttggaaaaacctgaggag

SEQ ID NO: 192491 - DNA, 601 bp, Human
ctctcattaagcactgtgcatttggctgccctggcatcagtcattgccacaaaggatctgccacaaagtgccgaatgacaaggaacagagcctgcaaatctggactgggggcactgggggctgcagtggagcaggccagggagaaggctttctctgcagacagcctgggcctgcctctgaaaacacagctgccttgtcgaatgggaaccatggaggctgctggcgggtggcaaggagacgggatggagagaggcgttttcaagaagtgctgagttgagacgcacgggccagaccagggagkggggagaataagccctgccctatccccaggaaaccaggggctgccctggccctttggaaaaacctgaggagcagcctgaggctgtggcctcccaagactgtgcacagcaaaggtagtttcgctccaggccaaggctgttgggccagcctgagctgcaggagagccagcttaaccctccagaagtgggatgagccctggtggctcccaggccactcactcaggtccctagtgctgctaaccctccacttactgcagtggaggctcacaaagggctgttatgtgggagcagagaactactca

SEQ ID NO: 192492 - DNA, 601 bp, Human
acaaggaacagagcctgcaaatctggactgggggcactgggggctgcagtggagcaggccagggagaaggctttctctgcagacagcctgggcctgcctctgaaaacacagctgccttgtcgaatgggaaccatggaggctgctggcgggtggcaaggagacgggatggagagaggcgttttcaagaagtgctgagttgagacgcacgggccagaccagggaggggggagaataagccctgccctatccccaggaaaccaggggctgccctggccctttggaaaaacctgaggagcagccygaggctgtggcctcccaagactgtgcacagcaaaggtagtttcgctccaggccaaggctgttgggccagcctgagctgcaggagagccagcttaaccctccagaagtgggatgagccctggtggctcccaggccactcactcaggtccctagtgctgctaaccctccacttactgcagtggaggctcacaaagggctgttatgtgggagcagagaactactcaggaggagcttctggaatctgtccgtggctctggtttgcaggtgtctcttcagttgttacctttgcctctaggccaca

SEQ ID NO: 192493 - DNA, 601 bp, Human
gccaaaaaaagacaggccttgctgacaacctggtcattttcaaacgtggcagagtttgctgcttgggcaccaccaacccctctcgggcctgtaggcatggccactgttgagtatctgctgtcagtgacggcctgcgagatggggagctagcacgctgtctgacacctcccctctccactttgccacactgctgccatgttaggaggctgtctccgtgagcctggtgccactgctctgtaattcacacttgccccttggatgtgagcccttgcgtgtggcatgccacaacactcaggtcacytcaagggccctgaaaagtcttggggtttggagagcagatacatacaagcctgcttcagcatacccacagcagcctagagctttcaaccagccctggggtgttacgctgcccctcctccctcccctccacatccaaacacaccccctccagcatctagcatcacagaaaggttaacagaaaatgtgctaaagggctaaccatacggcctctctctctcactacacacacacacacacacacacacacacacacacacacacacacacaatactggagtctagggtattctgtcttaaggta

SEQ ID NO: 192494 - DNA, 601 bp, Human
ccttgcgtgtggcatgccacaacactcaggtcacctcaagggccctgaaaagtcttggggtttggagagcagatacatacaagcctgcttcagcatacccacagcagcctagagctttcaaccagccctggggtgttacgctgcccctcctccctcccctccacatccaaacacaccccctccagcatctagcatcacagaaaggttaacagaaaatgtgctaaagggctaaccatacggcctctctctctcactacacacacacacacacacacacacacacacacacacacacacacaaaatactggagtctagggtattctgtcttaaggtagtgattttcaaacatggttctatggactgcaaaggctcctgggagcaaccagagcctttgggggtggaatgacaagaggctgggcagccagagccctgggtccccaactcctcctcatccagaccagctctacttttatttcttatatattgtacttcgggtaagattttacagggaaaaaaaaatgtctgaaaacaacagctcttaggtagccattcccaagagagctgatcttcagagtcctgtagggagcttttagacatttg

SEQ ID NO: 192495 - DNA, 601 bp, Human
gcatcatctggaaacttgggaattcttaggcctcaccccagacttaccagtgcagaagcattgaggctgggcccagccatctgtgtcagcacaccggcttggtggttctgaggtaggctaaggctggagggccactgctctaggctgagggtcttcaaaccgtggttctaagggacactaatatctctctcatcaccctgtcactggcagtgacagaacaagcggcttcccaggctgtccacctcttgacactcctagcctcaggggctccacttaatctttttttttttttttgagacarggtctcactctgtttgtccaggctggagtacagtggtgggatcttggctcactgcagcctttacctcccggactcaagtgattctcccacctcatcctcttgagtagctaggattacaggcacacaccaccacacctggctaatttttttgtattttttagtagagacgggttttcgctgtgttgcccaggctggtctcgaatccctggactcaagcaatccacccgcctcggcctcccaaagtgctgggattacaggcatgagccaccgcacctggccatcctctattctgtattttgg

SEQ ID NO: 192496 - DNA, 601 bp, Human
gacagaattactggaggagccactgggctgttaggaaggtgaaaacgcagctgagatagccatgccttcctgtctggggtttccattatccctgataaacaacaaatgtagcacgatttaaacctgggcgagatgcttgcctgttaccagatagtttggagaagtcactgaatggatcaccatggagaacaggagctcaggtctccaggaagagggatggacgatctcagcaaggagagtcacggaagtcccacccacaacatccgggaacctgggcagaagccctgggagaggagcatcrggggatgtcgatctccttctccctggggcttttccttctggagagtgcctgctcccacagatggatgcagctagaaccccattgcccactttatccgcttgtcagctctacccttaccccaggaaatccctcctccaggacccagccatcctgcaggttgccctgccctgaggggaggactcagcgctgctttaaatggctggccccaggtggcttggtcactgttccagagctgtgtgagaaggggctcagcgcgaatgcaagccgccgtgacaggcctgtgccagccccgactccagg

SEQ ID NO: 192497 - DNA, 601 bp, Human
tgttaggaaggtgaaaacgcagctgagatagccatgccttcctgtctggggtttccattatccctgataaacaacaaatgtagcacgatttaaacctgggcgagatgcttgcctgttaccagatagtttggagaagtcactgaatggatcaccatggagaacaggagctcaggtctccaggaagagggatggacgatctcagcaaggagagtcacggaagtcccacccacaacatccgggaacctgggcagaagccctgggagaggagcatcgggggatgtcgatctccttctccctgggkcttttccttctggagagtgcctgctcccacagatggatgcagctagaaccccattgcccactttatccgcttgtcagctctacccttaccccaggaaatccctcctccaggacccagccatcctgcaggttgccctgccctgaggggaggactcagcgctgctttaaatggctggccccaggtggcttggtcactgttccagagctgtgtgagaaggggctcagcgcgaatgcaagccgccgtgacaggcctgtgccagccccgactccaggtggtcactgcgcttctctcccagcacac

SEQ ID NO: 192498 - DNA, 601 bp, Human
ggaaatccctcctccaggacccagccatcctgcaggttgccctgccctgaggggaggactcagcgctgctttaaatggctggccccaggtggcttggtcactgttccagagctgtgtgagaaggggctcagcgcgaatgcaagccgccgtgacaggcctgtgccagccccgactccaggtggtcactgcgcttctctcccagcacactaacagttcctagttcttaaatcagggcctcggtttggtccgttccatggaggagtgggaggtcagaagacagggccatcgtggcctacctcgrcctcctcacccagagcacgtgatagaaaacaccatgtcgctggagagaatgccagtttgacaactgaaaatgccctttgacacaggagcgaggctccactgagccctccggaagcgggcatcattccctttctcagcagagccgatgggtttgcactgagccgcttgtgccctctgaccagtttccttgtgaccaatggcctaaatagccacctggtgtgtagccagagtgtagccaactctgaagtcatgtccacacctagggctcattaacccccagcacacaccaccacagctaagc

SEQ ID NO: 192499 - DNA, 601 bp, Human
attcagtctgatggtctctctatacatttctctatatctcacatccctctagtcctttacagattgctgatcactcatgacatattacttcattttatctcacaactctccagcaataggcagagcaggcatgattatccccatatatttattagacaagtaaatgagctcagagaaggcgagtggttttcccccacattctcacagtggaacacagccagaaccaaaacccagctcgctcatggtggtctgccatgtagacatgcccactgagtcagaggatgcccctgttgcttcactyctggggaggcagccagcaagtgttcttggtcacaatggcaaaaggggcaatgggacctgctgctcttgaaaatctacacagcagtggcaagttgccaagttctgtgtgttaatcactatgcattcatcgtcagtgtctctatgatggataaagccccatgaactcaggctccactgattcagaatttgtgattctccatcccaaactgtgcttagatctatctttgagccccttgggattgggatgtagatccatactgttgaccagatgggagaaggcttgtttaacctactaaaatga

SEQ ID NO: 192500 - DNA, 601 bp, Human
gaaggcttgtttaacctactaaaatgaacacacagtttttaatggacttagcatatatgctgcctgagctgcaaaattattctaattttaaatgagttctgtctactcagtaaaacaatcttctaatttgaaatagcatgaccattgtaagagtattttctaattccagcctttcagcagttcaaaagtgcttttcgccaggtagtctttattaaagatgttctgttgttacaatttacagaactggttttaaaatacaaatttatcagctggcacaggggctcacacctataatcccagyacctggggaggctgaggcaggaagaccacttgagcccgggagttctaggttgcattgagccctgattaagccactgcattccagcctggatgacagagcaagaccctgtctccaaaaaaaaaagaatttatcggccaggtgtggtggctcacgcctgtaatcccagcactttgggaggccaaggcgggtggatcacaaggtcaagagatagagaccatcctggccaacacagtgaaaccccgtctctactaagaatacaaaaatttgctgggcatggtggtgcatgcctatagtttcagc

SEQ ID NO: 192501 - DNA, 601 bp, Human
tgcccgggcaatgatgacttcctcgtcttttcctacataggtgggcattcacgctgatcatcatctcatcctacacggccaacctggcagccttcctgaccgtgcagcgcatggatgtgcccattgagtcagtggatgacctggctgaccagaccgccattgaatatggcacaattcacggaggctccagcatgaccttcttccaagtaaaccccatttggttgctcaccagcatcgggaattgggcagaataaagttgagatgtttctctgctggagataaaaacatctctccgcatctyattatctcttttgaacatatagtttggaggtccacatggggctcatttatctgctgctccacaaaatactcctggaatgaggtcccaaaagaactttgcgttaatatcagccggtgccagagtggtggtacttgagatgattttaggtctgatgtggtggaactgttttttagttgccatagtttcatgtttatattaatggccattagaaaaaaagtatatatatgcagtgaatcaaacctgttgttttatttatattactgcatagaatggggttaatgcatacatttacatttttaa

SEQ ID NO: 192502 - DNA, 601 bp, Human
caaaagaactttgcgttaatatcagccggtgccagagtggtggtacttgagatgattttaggtctgatgtggtggaactgttttttagttgccatagtttcatgtttatattaatggccattagaaaaaaagtatatatatgcagtgaatcaaacctgttgttttatttatattactgcatagaatggggttaatgcatacatttacatttttaaagtgatttaaatcgtataggtagtatttagacagagcaagattcatacatgaatgactgaagtttgaggaacaccagcttaagacraactggcttcactgattccagacttgataggtatcagatagggaccctgttggcttctttgagtttcccttgcaaggctcaggagaaagccctgccacagcgatgtgttcgctgtcaagcaaactgattgatcgccaagactgacagccagaccagatggaatagtggttttcatatgcctcaagctctcttggaaagcaggtttcccctggggttaaaaggtgtctaaccaacctaatatccaagaagttcattttcccatgaaacaagtccaatgccttcagctttctgttttccagg

SEQ ID NO: 192503 - DNA, 601 bp, Human
agcattgaatccagtaccccctgttgttagaaccagtttaacagtgactttacgtgggcattctaaagttttttttttttttaaagcaaacacacatatttcctttaatcaacgaccagtgctcaatccttaattattaaagagctagttgattagttactgattgattaattgactaatttaaagggctaatagtaattattaaagggcatgttaatgtctttggtgtgtatttaggccttttgttccttttctcgcttgcttctccttggccatttctctgttgattgctatctctacyagcagtgggaagaaggatgagatggtaaaatttgaatcagttaattttgctatttgttagcgttgccagtgaaaagtttacttctaaaggagacggccatgattagatggaatgctttcaaattatttgtggatttcactgatccatctatggtaggtcggtgtgggtcatggagaaggggcagtaaggctctggtgttcagcctgctgactgtcagcccgtcttgttgtattaataggaggatagagacgtttggcttccagaaaggtgtcctagctgtgctttttaaaaggacattca

SEQ ID NO: 192504 - DNA, 601 bp, Human
gcaacaggggaagaagcaggaatcgaggccatcagactctgggagaaaattggtatacggtatgctcatctttgtagttacagtacacatccctgctgttgatctttaccttagctcaaaactctgtaaattgcaggattcactcacacctgtggagtgtaacgagcacgggctgggagtcaggcagaccccgggatgtgttctggttactggctgtggtaccttagatgcattctttagcctcagttatctaattcataaaattaggtttctaatacctacattatggggttgggaggaytaaacctgataatctagttaggtgccttacctcagtgtctcacactgagcctaccttggggtatattagtgtccttctcatttcttccatggtttcctatgtttttatttatttatttatttatttatttatttatttatttatttatttatttttgagatggagcctcactctgtagcccaggctggagtgcagtggcactatctaggctcactgcaacctccgcctcccacttcaagtgattctcatacctcagcctcccgagtagctgggactacagacgtgcactaccacacccag

SEQ ID NO: 192505 - DNA, 601 bp, Human
attgcaggattcactcacacctgtggagtgtaacgagcacgggctgggagtcaggcagaccccgggatgtgttctggttactggctgtggtaccttagatgcattctttagcctcagttatctaattcataaaattaggtttctaatacctacattatggggttgggaggattaaacctgataatctagttaggtgccttacctcagtgtctcacactgagcctaccttggggtatattagtgtccttctcatttcttccatggtttcctatgtttttatttatttatttatttatttatttatttatttatttatttatttatttttgagatggagcctcactctgtagcccaggctggagtgcagtggcactatctaggctcactgcaacctccgcctcccacttcaagtgattctcatacctcagcctcccgagtagctgggactacagacgtgcactaccacacccagctaatttttgtatttttggtagagacggggtttcaccatgttggccaggctggtcttgaactcctgacctcaggtgatccacccacctcagcctcccaaagtgctgggattacaggcgtgagccaccgc

SEQ ID NO: 192506 - DNA, 601 bp, Human
ctaggctcactgcaacctccgcctcccacttcaagtgattctcatacctcagcctcccgagtagctgggactacagacgtgcactaccacacccagctaatttttgtatttttggtagagacggggtttcaccatgttggccaggctggtcttgaactcctgacctcaggtgatccacccacctcagcctcccaaagtgctgggattacaggcgtgagccaccgctacttgacaaaagcaaatgacttaaattctgatcagaaacaaagaaaatgaacataggtaataatatggttcatcyctgaactctgtaaattatggcactaggagttctgtgaactgtgaactggaggcttcactctgggtactcagaaacctgcacaccctctatatgctattatatgtcattggtgtccactaataatacagattatggacacctttgagagatatactcgctgacattttgtttcaagatggtagcgtgaactgcaaaatgaacttaaggcacacgttgatgatactctagcaatttgaactaaatttcaaatgcttccaaagttttcatggaacaaaactatggagagttggggtaagatag

SEQ ID NO: 192507 - DNA, 601 bp, Human
ccacctcagcctcccaaagtgctgggattacaggcgtgagccaccgctacttgacaaaagcaaatgacttaaattctgatcagaaacaaagaaaatgaacataggtaataatatggttcatctctgaactctgtaaattatggcactaggagttctgtgaactgtgaactggaggcttcactctgggtactcagaaacctgcacaccctctatatgctattatatgtcattggtgtccactaataatacagattatggacacctttgagagatatactcgctgacattttgtttcaagatrgtagcgtgaactgcaaaatgaacttaaggcacacgttgatgatactctagcaatttgaactaaatttcaaatgcttccaaagttttcatggaacaaaactatggagagttggggtaagatagaccacaactctagaaattttcatcaataaccaaggaaaaatggaaggaaattcatttgctctatatctgacatgacactgttttcacatgttctctcacttaatagtcccccctgcaagatagatgtggttattcccatcctatagaggacagaactcagattcagagcagatagatt

SEQ ID NO: 192508 - DNA, 601 bp, Human
gtgagccaccgctacttgacaaaagcaaatgacttaaattctgatcagaaacaaagaaaatgaacataggtaataatatggttcatctctgaactctgtaaattatggcactaggagttctgtgaactgtgaactggaggcttcactctgggtactcagaaacctgcacaccctctatatgctattatatgtcattggtgtccactaataatacagattatggacacctttgagagatatactcgctgacattttgtttcaagatggtagcgtgaactgcaaaatgaacttaaggcacacrttgatgatactctagcaatttgaactaaatttcaaatgcttccaaagttttcatggaacaaaactatggagagttggggtaagatagaccacaactctagaaattttcatcaataaccaaggaaaaatggaaggaaattcatttgctctatatctgacatgacactgttttcacatgttctctcacttaatagtcccccctgcaagatagatgtggttattcccatcctatagaggacagaactcagattcagagcagatagattacttgtccaaggtcacagaataggtagagaagctg

SEQ ID NO: 192509 - DNA, 601 bp, Human
aacatgccttgaaactgcttgaaatgctttgctgggctagacagttctctctaaacctgaaatgttcattagtctcaccacctaacaacatctgttagacaactcgttcatgtgtccattcacggcagatgtgtaataagtacttactgtacttgaagctctgctggtgtttgcccatatcacttgcacacgttcagtgctgcaggcttggggttcgggtccaacaatgtgtaagatgtgtaataagtacttactctacatgaagctctgctggtggttgcccaaatcactgacacacatycagtgctgcaggcttggggtttgggcgtccaagcatagttgtgtctatagtagggaaggttctactgtggagctgtggactgtcacagttggaagagatctgggagatgttctagttccttgcctcttaaagtgtggtccacgacccagcagcatggacatcaccttggggcttgttggaaatgcagactgtcaggccccaccccaggcctactgaatcagattctgcagttcagcgaaatccccaggtgattgcaatgcacttgaaaatttgaaaagcactcatctgtttgttccaagc

SEQ ID NO: 192510 - DNA, 601 bp, Human
taacttggatagaccatctttttaatttagaaagtgatggtgcccggctggggaggtggatggcacaactgcctggaaagccgtttcttgacccatcttggggtgtttggccatgggctggacctgccagtcagcatggagagaagggaagcagaaaagcctgagaacactgcgtgaagccagaatgccccgctcttccgggggagccccagtggagtagacagcactggccccatgggctcgccccacccgctgcatctgtctgtcccctctcgaggtgaaagcaggcagggtggccagraggtgtgccgggaaggggagcagagtgacacctaacagggcattcacaacctgtgtcctgggctctcccgtaacccccgcaggctcggttttccgggacgagtttgatctggccattctccagctgcaggagaacaaccgcctggagatcctgaagcgcaaatggtgggaaggagggaagtgccccaaggaggaagatcacagagctaaaggtaaggacgttcagggccatcctcctcctgccctagaggaccaaagtagcttgtttctcgtgttcaaattccaggtacacataatgact

SEQ ID NO: 192511 - DNA, 601 bp, Human
gcagagtgacacctaacagggcattcacaacctgtgtcctgggctctcccgtaacccccgcaggctcggttttccgggacgagtttgatctggccattctccagctgcaggagaacaaccgcctggagatcctgaagcgcaaatggtgggaaggagggaagtgccccaaggaggaagatcacagagctaaaggtaaggacgttcagggccatcctcctcctgccctagaggaccaaagtagcttgtttctcgtgttcaaattccaggtacacataatgacttgtaggacccattgagaacrgccttggaaggaacctaggtataaagtgggctggcgggggatcaggtctgtcccagggtcttgcgtatcgcaggcacccagtgtccacccggctcccaagtcctagaggctctgcctccatgttgtttcttgaacccagctgcctctgacccctagcaccatggcttctaccctggcccatcatctccacacctgtgcagtcacagtcgcctggtttcagtttcccattcttgcgtctctacagtatattctccgctactagccagagtgatcctttttaaaaatgcaaactcgatggca

SEQ ID NO: 192512 - DNA, 601 bp, Human
tatgtatttgtttactttccacttcctctactagaatgtaagtttcatgagggtagggttggtcatcacagggctgcccaaagagctggacatgtggatattttatcgaaaggatgagcaaatgttaaattaggctgaatagaaagcagtcacttactgagatgtatggctaagaagtgttgacggtccctgagcacccaggattttctgtaggggaacacttaccctagtttgcccaggatggtatagtcttgtttctatctattgtagatcagttaatgcctataaattatttctagayagtgttcattctcaaagtgtcctggtttagacaataaatcatatggtcacgtaccatatctactactccatctactgcagccttgttaaaatatgcaacagatttacctgtccacgctctgcccgaggaagacagctgaggagtaggatgaaggatatcatgtgcttgtcttttctgctcagcatgaatgattgtccctgatgagacagtgaatgaataactatgtgattctcagtgtctatacgtggatctctatcttgcaagaagaggtctcaagaatatggatatacggagcaagta

SEQ ID NO: 192513 - DNA, 601 bp, Human
atacaggcatatttatttaatgtaagaatttttttcccacccaagccctaagtaaaatcagtgtcccaggaagatgccccatcatcatgccacagctttgtcagactcctcggcacaccaacagtgccctggactgggtttgggagcattggcaatagccgtcaaaggttctggggtgagatgtggcacacggaaagctggtgtggtgggatggaattctgagctcttggcggcattcatggtcccaggggatagttattgcctcaggagaaatcaagtcaaattattggctttaagttccaaaataagttcttaaagctcacagcagagataatgtccttggagagcgaggtttttgatttgccagagaagtattttggaatacagaaggttaattcctaataggatctggtcaaaaagttaatgctagaagttagagtgaaaaaaaagagaaagaaatagaagaaccaggccaccaagtctgcaaatcagataaaaggatgccctggccaggacaggagcttctgagcagaaaaggacatgttaaaatgtggttggtccctgcccttctgggagccggagagaggcagatatcactccc

SEQ ID NO: 192514 - DNA, 601 bp, Human
atgtccttggagagcgaggtttttgatttgccagagaagtattttggaatacagaaggttaattcctaataggatctggtcaaaaagttaatgctagaagttagagtgaaaaaaaagagaaagaaatagaagaaccaggccaccaagtctgcaaatcagataaaaggatgccctggccaggacaggagcttctgagcagaaaaggacatgttaaaatgtggttggtccctgcccttctgggagccggagagaggcagatatcactcccagaattagctggatattccatgagttctaaatwgatttttacttgtgcaggggctgtgggtggtacatgtggagcagagaagaatttctggagaaattcttctggagagtttggctgtgtaatgggcttgtactgtggtatgacgcatatttctggagtttggcaaaccccagaaatatgtgccatgccttagtgaagtgggggacgtaagaggcggcacgtagggacccaaggcagagggcccagtgaaaggcctgagttttccttaactccagacaaagatattggaaatctaagtggactacggcataagaccagacacctatccccacc

SEQ ID NO: 192515 - DNA, 601 bp, Human
ggctgtgggtggtacatgtggagcagagaagaatttctggagaaattcttctggagagtttggctgtgtaatgggcttgtactgtggtatgacgcatatttctggagtttggcaaaccccagaaatatgtgccatgccttagtgaagtgggggacgtaagaggcggcacgtagggacccaaggcagagggcccagtgaaaggcctgagttttccttaactccagacaaagatattggaaatctaagtggactacggcataagaccagacacctatccccaccccaatacaatgacacaacygcaaacctgaaatacatcccgggaagaagagggaatggagaagacactggatttaagtgaatttaaacatgaaatgactgaaaattctctatgtttttggccatgtggtggaaatggaagttggaggtggaatagaaatataaagttataattgttgcagttgttggccttggaaacagttccgcatccacagaggtctagatggttccacagtttttggaagactgtgctgacagtagagttcaggatggagggagaagggaggcagaaagggagatcaggcttccaggaaagatggaa

SEQ ID NO: 192516 - DNA, 601 bp, Human
ctataggtgaatatagttctgaaatagaaagtgcttgaaagccatatggttccaagaatccatgttcttgtccaatgctcttgatgagccagtgtggcacagagcttcagcacctagcatagtgcccagctcatggaagctcctcagtcaagatctgttgaccaatgtcaaagagcaaatacattgtctcttgctgggatctcgtggcactagtcagtcctctgtgcaagtggattctctgcacctgcctccatggcttttgtggcctctgccttttttcccagccttccctcactttttsttcaaaaggagctttccctctgtattttagttgcagatttccacagtggttcgtggagatatgtgagtgttttaagggctaggacatgagtgtacctgaatccaagaagtggttattagccagacagaaccaaaggaagagcaagtgggtgggtggagattcacatctcttcacaggtgctctcttccagggtgccattcccctttgtagttcaagagacaaagaacattattcatttgcatttgtgaactatcattttttgggcaaaatatttgtgggcaatctgcgggtgacaccaaa

SEQ ID NO: 192517 - DNA, 601 bp, Human
agtgtggcacagagcttcagcacctagcatagtgcccagctcatggaagctcctcagtcaagatctgttgaccaatgtcaaagagcaaatacattgtctcttgctgggatctcgtggcactagtcagtcctctgtgcaagtggattctctgcacctgcctccatggcttttgtggcctctgccttttttcccagccttccctcactttttgttcaaaaggagctttccctctgtattttagttgcagatttccacagtggttcgtggagatatgtgagtgttttaagggctaggacatgastgtacctgaatccaagaagtggttattagccagacagaaccaaaggaagagcaagtgggtgggtggagattcacatctcttcacaggtgctctcttccagggtgccattcccctttgtagttcaagagacaaagaacattattcatttgcatttgtgaactatcattttttgggcaaaatatttgtgggcaatctgcgggtgacaccaaagttagtatttagccaaccaggagtttgtggggagagcgtgattctatttcagtgaatgcaactgattgctggggcacagctgagcctcag

SEQ ID NO: 192518 - DNA, 601 bp, Human
tttcccagccttccctcactttttgttcaaaaggagctttccctctgtattttagttgcagatttccacagtggttcgtggagatatgtgagtgttttaagggctaggacatgagtgtacctgaatccaagaagtggttattagccagacagaaccaaaggaagagcaagtgggtgggtggagattcacatctcttcacaggtgctctcttccagggtgccattcccctttgtagttcaagagacaaagaacattattcatttgcatttgtgaactatcattttttgggcaaaatatttgygggcaatctgcgggtgacaccaaagttagtatttagccaaccaggagtttgtggggagagcgtgattctatttcagtgaatgcaactgattgctggggcacagctgagcctcagagactcaagtgtcaggagaaagtcccagtttgtaaagccatctgcctgcatggtttatgtgtggtcccatctgaagaagggaaggaaagacatgactagatgtcttcccagtcccccttgccattgctgaggcatctgtgagtgccgcgtgggccttgtaggctggagggagtccacatcaagggc

SEQ ID NO: 192519 - DNA, 601 bp, Human
caagacaaaattgcatggggtgaagattgaatagcaagaacaaaagtgtattcaaaacagaattattttctcctttagatctcatagacagaattacttggagcttaaaagctttttgagtgtccaaattatgtttgaggtctgaataaaaagtactggcttcagaatgcaaaaaggaaactgcaaaattaaatgaagacatgtttaattaaatatctccaaaatgtaacattgtttcaacttcattaatctttaaatttaatatttgtaaaaacttcattacatgtagaaataatttttygattagatttttaactttgcaacattcttttgtatgtatgtgcaatgattgctgagaaagcacagccagttgtaagttaactgtttcttgccactcagtaatatcagaagcaaaaatttttaaatgcatttaacataagatctgggtgcattttgttctacttccttttatgtgagatggctcctccaaatgtaagtgtttttaagggcttttagaaggtcttaaaataattctgatgtagaccactctcaaaaagctcggccatggaaggagagagaagtgttggattagacagagttg

SEQ ID NO: 192520 - DNA, 601 bp, Human
tttctcctttagatctcatagacagaattacttggagcttaaaagctttttgagtgtccaaattatgtttgaggtctgaataaaaagtactggcttcagaatgcaaaaaggaaactgcaaaattaaatgaagacatgtttaattaaatatctccaaaatgtaacattgtttcaacttcattaatctttaaatttaatatttgtaaaaacttcattacatgtagaaataattttttgattagatttttaactttgcaacattcttttgtatgtatgtgcaatgattgctgagaaagcacagscagttgtaagttaactgtttcttgccactcagtaatatcagaagcaaaaatttttaaatgcatttaacataagatctgggtgcattttgttctacttccttttatgtgagatggctcctccaaatgtaagtgtttttaagggcttttagaaggtcttaaaataattctgatgtagaccactctcaaaaagctcggccatggaaggagagagaagtgttggattagacagagttggagagagtaaggagaatttctttgtcttcaaggagggagaaacatgagtatgtgaatgtgctgagg

SEQ ID NO: 192521 - DNA, 601 bp, Human
tgcaaaattaaatgaagacatgtttaattaaatatctccaaaatgtaacattgtttcaacttcattaatctttaaatttaatatttgtaaaaacttcattacatgtagaaataattttttgattagatttttaactttgcaacattcttttgtatgtatgtgcaatgattgctgagaaagcacagccagttgtaagttaactgtttcttgccactcagtaatatcagaagcaaaaatttttaaatgcatttaacataagatctgggtgcattttgttctacttccttttatgtgagatggstcctccaaatgtaagtgtttttaagggcttttagaaggtcttaaaataattctgatgtagaccactctcaaaaagctcggccatggaaggagagagaagtgttggattagacagagttggagagagtaaggagaatttctttgtcttcaaggagggagaaacatgagtatgtgaatgtgctgagggagagagccagtggagagaagactggaggaggaccagggaggtgactgatagggaggcagggggcacagctggaacacaggtagcagaagaagacctaaaggggaaagaaaaccc

SEQ ID NO: 192522 - DNA, 601 bp, Human
gagagaagactggaggaggaccagggaggtgactgatagggaggcagggggcacagctggaacacaggtagcagaagaagacctaaaggggaaagaaaaccccctctacagaaacaagaggaatgcgagaccctctgcaagggggccttgtcctgttttcttttgtttttgtttttgagatggagtctcactctgttgcccaggctggagtgctggggcacgatgtcggatcaagtggcagcctccacctcttgggttcgagtgattctcctatctcagccttccgagtagctgggattaacaggtgtgagccaccatgcccggctaatttttgcatttttagtggagatggggttttatcatgatggccaggctggtctcgaactcctgacatcaagtgatctgcctgccttggcctcccaaagggctaggattacaggcatgcaccactgcatccagccccttttcctgttttctatctcgagcacaactattgccaagtgatgggggcatcctgtagactctcagcagtcacttggggactccagttacctgagcaggtggccatccttcatgtcaccattgtcatttccccagtcat

SEQ ID NO: 192523 - DNA, 601 bp, Human
atgcaccactgcatccagccccttttcctgttttctatctcgagcacaactattgccaagtgatgggggcatcctgtagactctcagcagtcacttggggactccagttacctgagcaggtggccatccttcatgtcaccattgtcatttccccagtcatgggggatgtccacccagcctccctcgacaggggctggccagagaaggtaattcatccgtgttgcacagatacacatcctaatactccagttctcaccacccctaaatctgtgggctgaagtatctgcctacaaccccagcyagctccttggtacattcccttttaagtgtccctttttcatcccctacttcttgtggctcttgatgctcccagagtgaaaactttctacccaaatggcccaggttagagggacaggtgttaacgtaagatgtgggtgcattttcttctactttcttttatgtgagattgggcctccaaatataggtgttttaagggctttttgcccatttaagcaccttccccctggaaggtagaattgagtttttaaatgatcccctatttttgattgttcaaaatacaggattcccacattcacacagg

SEQ ID NO: 192524 - DNA, 601 bp, Human
tccagccccttttcctgttttctatctcgagcacaactattgccaagtgatgggggcatcctgtagactctcagcagtcacttggggactccagttacctgagcaggtggccatccttcatgtcaccattgtcatttccccagtcatgggggatgtccacccagcctccctcgacaggggctggccagagaaggtaattcatccgtgttgcacagatacacatcctaatactccagttctcaccacccctaaatctgtgggctgaagtatctgcctacaaccccagccagctccttggtasattcccttttaagtgtccctttttcatcccctacttcttgtggctcttgatgctcccagagtgaaaactttctacccaaatggcccaggttagagggacaggtgttaacgtaagatgtgggtgcattttcttctactttcttttatgtgagattgggcctccaaatataggtgttttaagggctttttgcccatttaagcaccttccccctggaaggtagaattgagtttttaaatgatcccctatttttgattgttcaaaatacaggattcccacattcacacaggtactcaagagttg

SEQ ID NO: 192525 - DNA, 601 bp, Human
agcagtcacttggggactccagttacctgagcaggtggccatccttcatgtcaccattgtcatttccccagtcatgggggatgtccacccagcctccctcgacaggggctggccagagaaggtaattcatccgtgttgcacagatacacatcctaatactccagttctcaccacccctaaatctgtgggctgaagtatctgcctacaaccccagccagctccttggtacattcccttttaagtgtccctttttcatcccctacttcttgtggctcttgatgctcccagagtgaaaactttstacccaaatggcccaggttagagggacaggtgttaacgtaagatgtgggtgcattttcttctactttcttttatgtgagattgggcctccaaatataggtgttttaagggctttttgcccatttaagcaccttccccctggaaggtagaattgagtttttaaatgatcccctatttttgattgttcaaaatacaggattcccacattcacacaggtactcaagagttgactgtggtcctgcagatcagagtgtatagttcatttggtgtgttcatcatgtgagtcctcagagtcgttcca

SEQ ID NO: 192526 - DNA, 601 bp, Human
ggggactccagttacctgagcaggtggccatccttcatgtcaccattgtcatttccccagtcatgggggatgtccacccagcctccctcgacaggggctggccagagaaggtaattcatccgtgttgcacagatacacatcctaatactccagttctcaccacccctaaatctgtgggctgaagtatctgcctacaaccccagccagctccttggtacattcccttttaagtgtccctttttcatcccctacttcttgtggctcttgatgctcccagagtgaaaactttctacccaaatgscccaggttagagggacaggtgttaacgtaagatgtgggtgcattttcttctactttcttttatgtgagattgggcctccaaatataggtgttttaagggctttttgcccatttaagcaccttccccctggaaggtagaattgagtttttaaatgatcccctatttttgattgttcaaaatacaggattcccacattcacacaggtactcaagagttgactgtggtcctgcagatcagagtgtatagttcatttggtgtgttcatcatgtgagtcctcagagtcgttccaagcagattttc

SEQ ID NO: 192527 - DNA, 601 bp, Human
tactcaagagttgactgtggtcctgcagatcagagtgtatagttcatttggtgtgttcatcatgtgagtcctcagagtcgttccaagcagattttcagttgtaggcagggacagctactgcactgtgttattttaaaaacaaaagtcagacatccacttagggctttgtaaaaggaaaccctgggcatactgaaatggccatagagctatttttccagctttccaaggtgcagaaggtagcgtcgatttctgatctggccctgtgactcatctcatagtgccgtgcgaagctgactgccctgacactgacgaggctccatgttctgtgaggacattactgactgaacattcagatgtgcaagcattcctgaaaaacacgggacacaagagaccctcctggatgaaagatgccttttgatttctgattgtggccccagttgaatcagggtgttttgtgtttgggtttctctaatgccaaaaataaaaagcatttaattacatagctgaactcaatgtttgacacagtggaaatgaaacagccatatcatatcctataagtatttattgactatatactgtgtgccaggtatcatgctttgca

SEQ ID NO: 192528 - DNA, 601 bp, Human
gcaatgaggacatgaccagaaacaatgtctgactcccaggaacttacatacttgcacaatgcttctaaaattaccaatttgtaaactaattttaggaatgactagaaaagaatcacctgtgaaacttctgtaaaaatacagattcctgggccccatgtccagagatactgattgagtaggtctggggtaaggactgggaatcaatatttttagtcagctttctaggcagttctgatggcagctggtttgtgaaccactcgtttggtgggataaaaagttttactttccaaataaatatttkagtaacatgttgacaaagataggtaaatataactttttctatccatggtttggtcaaaacagttgcttttatatcacataaatacaatgttaggaagattgagtaaaactttaatgaaactattagaactgacaggtattttggtgtcatgtctctctctataagctgtcaagagtttgcccgagcccttttcttaaatggtcctcacctcccagccccagacaccctttggtaggcttcttgccagtgtccttgattgatggcaagatctctctcttccattttatttcaactatgctg

SEQ ID NO: 192529 - DNA, 601 bp, Human
actgggtgtctacatgtcaagtagatgcatgggtgtctacttgagcatctaccatactcaagttcttgtttgaatgattttagtatttttgataaaatgattgtgtcttcctgatcttttacaatatttttcatttgttatcactttcttacaggcctgggaatggagaatattggtggaatctttgtggttcttatttgtggcttaatcgtggccatttttatggctatgttggagtttttatggactctcagacactcagaagcaactgaggtaaactttcaaaggggtatgatcgatmgtgttggcagatggggtgaagttcacaggctcatgcacatataaggttatttcagacgcttaccacaggaagtgcagcaaagagaatcccagtgcccagcagaggggatttggatcaatgcttcattacttagtaattattatgaacaacaaagccttctagaactatcatttaagatatagttgagaaaaataggtgaaagtaccaggttactatggaaaagacaacctcagtcctttcattctgagtatgtttttgccttgcagggaaagatccttagagatatcccgactcatgtga

SEQ ID NO: 192530 - DNA, 601 bp, Human
atcgtgttggcagatggggtgaagttcacaggctcatgcacatataaggttatttcagacgcttaccacaggaagtgcagcaaagagaatcccagtgcccagcagaggggatttggatcaatgcttcattacttagtaattattatgaacaacaaagccttctagaactatcatttaagatatagttgagaaaaataggtgaaagtaccaggttactatggaaaagacaacctcagtcctttcattctgagtatgtttttgccttgcagggaaagatccttagagatatcccgactcatgygaacccaagaattttatcccccttctcggggattttgaataagttcaattccccagcagtggcttagagacagggttaacataaactttacccaggttgaacagtttgaaaagaaggaagaagactatgccactcttcttccaacccaccccagggaagatatataaatccttacatgttaattgcattattagatttttttaaaagttacattagcctctatctcagtctcccaactctgaatcttcctaaaaacctttcctaattggcactgggaaaatatctcacagcaggacaaac

SEQ ID NO: 192531 - DNA, 601 bp, Human
acgcttaccacaggaagtgcagcaaagagaatcccagtgcccagcagaggggatttggatcaatgcttcattacttagtaattattatgaacaacaaagccttctagaactatcatttaagatatagttgagaaaaataggtgaaagtaccaggttactatggaaaagacaacctcagtcctttcattctgagtatgtttttgccttgcagggaaagatccttagagatatcccgactcatgtgaacccaagaattttatcccccttctcggggattttgaataagttcaattccccagcwgtggcttagagacagggttaacataaactttacccaggttgaacagtttgaaaagaaggaagaagactatgccactcttcttccaacccaccccagggaagatatataaatccttacatgttaattgcattattagatttttttaaaagttacattagcctctatctcagtctcccaactctgaatcttcctaaaaacctttcctaattggcactgggaaaatatctcacagcaggacaaacagtgcccctggaagtctgtggagtctggcctcacatggggccttaacacaacaccgcc

SEQ ID NO: 192532 - DNA, 601 bp, Human
aagtaccaggttactatggaaaagacaacctcagtcctttcattctgagtatgtttttgccttgcagggaaagatccttagagatatcccgactcatgtgaacccaagaattttatcccccttctcggggattttgaataagttcaattccccagcagtggcttagagacagggttaacataaactttacccaggttgaacagtttgaaaagaaggaagaagactatgccactcttcttccaacccaccccagggaagatatataaatccttacatgttaattgcattattagatttttttaaaagttacattagcctctatctcagtctcccaactctgaatcttcctaaaaacctttcctaattggcactgggaaaatatctcacagcaggacaaacagtgcccctggaagtctgtggagtctggcctcacatggggccttaacacaacaccgcctgccagtcctggtccactgtgctcagcctctttcctgtctccttgtaggacttccacgccgttgcccattcctcaagcccctctgcttctgcatgcgtagagcttcattttacttcccatctcccaagaaatcaggagtggcta

SEQ ID NO: 192533 - DNA, 601 bp, Human
tcccccttctcggggattttgaataagttcaattccccagcagtggcttagagacagggttaacataaactttacccaggttgaacagtttgaaaagaaggaagaagactatgccactcttcttccaacccaccccagggaagatatataaatccttacatgttaattgcattattagatttttttaaaagttacattagcctctatctcagtctcccaactctgaatcttcctaaaaacctttcctaattggcactgggaaaatatctcacagcaggacaaacagtgcccctggaagtcygtggagtctggcctcacatggggccttaacacaacaccgcctgccagtcctggtccactgtgctcagcctctttcctgtctccttgtaggacttccacgccgttgcccattcctcaagcccctctgcttctgcatgcgtagagcttcattttacttcccatctcccaagaaatcaggagtggctagccctgaattaaaacccccactaaacatctccccacagctcagccaccctgcagctgcagcagataccccagtcctcctgctgtcccttccttgatcctgtctttcctcagctgc

SEQ ID NO: 192534 - DNA, 601 bp, Human
tcagcctctttcctgtctccttgtaggacttccacgccgttgcccattcctcaagcccctctgcttctgcatgcgtagagcttcattttacttcccatctcccaagaaatcaggagtggctagccctgaattaaaacccccactaaacatctccccacagctcagccaccctgcagctgcagcagataccccagtcctcctgctgtcccttccttgatcctgtctttcctcagctgctccaggattatcctcttttgcccctgtatttttttctgcctgctctttctccagtccaccattrtgaacgtgtctgccatatttcaaaataataggaagattactgttgctcttgctctatccctctcctcttccaaaccaaggggatccagctgagagaatctcagtctccatcacctcactcccgatttggtccgaaacccagggcagcctggctcctccctacccctgcaccgaaaggccgatgcttaaaggtctgacccctcccagtggaccaaaccaaagagaatctactgggccttattggactttggtgtgtcccttgatgatggggatactttctttcagaatccctcttcccttg

SEQ ID NO: 192535 - DNA, 601 bp, Human
tattggactttggtgtgtcccttgatgatggggatactttctttcagaatccctcttcccttgccttgcgtggcacccagctctcttggttcccctcctgttgctgtctccagctttactggctttttccttttgcccaccccttaaaaggtggtggtcttatttattccctaagacctagttcaggtgttcccttccttgtgagtccttcctcatttctcctgctgtctcccagcaattggtcaccctccttcttcctgacaccagtgtaacctatgcatgaaccacttacacaccacgytgcagttattttggtatcagccccctactagagattgagctgcctgaagtaaagactgtgtcttttatccctgtgcttgacatgcagtagacagtcaataaatctacattgttatagtattgtcacatgtaatagattaggcaggtggtactgtttttattgtagttatcactagaagcacagagaggttaagtgacttgccaagagtctctgctatttagttaacaattggggggtgtgatgggggcctataatccaagtcgggaaaactaatgtaggccttattccattaagtgacat

SEQ ID NO: 192536 - DNA, 601 bp, Human
attgtagttatcactagaagcacagagaggttaagtgacttgccaagagtctctgctatttagttaacaattggggggtgtgatgggggcctataatccaagtcgggaaaactaatgtaggccttattccattaagtgacatcacctttctgtagctgcctcacattttgttattctccccaaagctcacccatggtctggaagtatattgaaaaattcagcaagtagttagagcagtcccaatagctaaaataaagagtcagtgctatgttagcgatttggctgtggtagaacaactgtsccattggtagaattggacgaaagaacattaaagaactgaggacttctgctcccatatggtctaggaaagtgtcctttcaactcagagtagagcactcaacagagcatgtacaggcttggagttgataggtttaggtccaaattcagagtcagctattagtcaatttttggcaacatacataacttctctgagcctccatttccacatttgtgaaatggatataataataatagtaatagtagtaatacaggcccatcggccaggcacagtggctcacgcctgtaatcctagcactttggg

SEQ ID NO: 192537 - DNA, 601 bp, Human
aagagtcagtgctatgttagcgatttggctgtggtagaacaactgtcccattggtagaattggacgaaagaacattaaagaactgaggacttctgctcccatatggtctaggaaagtgtcctttcaactcagagtagagcactcaacagagcatgtacaggcttggagttgataggtttaggtccaaattcagagtcagctattagtcaatttttggcaacatacataacttctctgagcctccatttccacatttgtgaaatggatataataataatagtaatagtagtaatacaggccyatcggccaggcacagtggctcacgcctgtaatcctagcactttgggaggccgaggcaggtgaatcatgaggtcggcagttcaagaccagcctggccaacatagtgaaaccccgtctctactaagaaatacaaaatttagccgggtgtggtggcacatgcctgtaatcccagcttactggagaggctgaggcaggagaatcgcttgaacccaggaggtggaggttgcagtgagctgagattatgccactgcactccagcctgggcgacagaggaagactcttgtctaaaaaaaaccaaaaa

SEQ ID NO: 192538 - DNA, 417 bp, Human
tgcagtggcaggtatcttggctcactgcaacctccgcctcccaggtttacgtgattttccccactcagcctcccgagtagctgagattacaggcacacgccaccacgcccagctaawttttgtggttttagtagagacagggtttcaccatgttggccaggctggtcccgaactcctgacctcaagtgatctgcctacctcggccctccaaagtgctgggattacaggtgtgagccactgtgcccagccctatcctgtattcttcatccacagttctgacacctaaaaagcttggagagttccaagttccttgtaagtttgatgcaaatgcactcagcggcggcgtggcttggctgatgtttgtggcctttatctcacacggtgtgagatgttgctacagaaatatgagcgggtttg

SEQ ID NO: 192539 - DNA, 487 bp, Human
tgcagtggcaggtatcttggctcactgcaacctccgcctcccaggtttacgtgattttccccactcagcctcccgagtagctgagattacaggcacacgccaccacgcccagctaaattttgtggttttagtagagacagggtttcaccatgttggccaggctggtcccgaactcctgacctcaagygatctgcctacctcggccctccaaagtgctgggattacaggtgtgagccactgtgcccagccctatcctgtattcttcatccacagttctgacacctaaaaagcttggagagttccaagttccttgtaagtttgatgcaaatgcactcagcggcggcgtggcttggctgatgtttgtggcctttatctcacacggtgtgagatgttgctacagaaatatgagcgggtttgaattcaagtctgccccagacccaccgggtgtgatacatactctactgtttgtgctttgtattaccctcct

SEQ ID NO: 192540 - DNA, 601 bp, Human
caggtttacgtgattttccccactcagcctcccgagtagctgagattacaggcacacgccaccacgcccagctaaattttgtggttttagtagagacagggtttcaccatgttggccaggctggtcccgaactcctgacctcaagtgatctgcctacctcggccctccaaagtgctgggattacaggtgtgagccactgtgcccagccctatcctgtattcttcatccacagttctgacacctaaaaagcttggagagttccaagttccttgtaagtttgatgcaaatgcactcagcggcrgcgtggcttggctgatgtttgtggcctttatctcacacggtgtgagatgttgctacagaaatatgagcgggtttgaattcaagtctgccccagacccaccgggtgtgatacatactctactgtttgtgctttgtattaccctcctcttgttttggttatcatgaggatacatccacctcctgctataaccagttggctaaaagaaataagaatccttagcctaaggaacagaatgttcatagagacatggtggccttttcaaatacttgagagactgacatgtggtggaggaattattta

SEQ ID NO: 192541 - DNA, 601 bp, Human
cagctaaattttgtggttttagtagagacagggtttcaccatgttggccaggctggtcccgaactcctgacctcaagtgatctgcctacctcggccctccaaagtgctgggattacaggtgtgagccactgtgcccagccctatcctgtattcttcatccacagttctgacacctaaaaagcttggagagttccaagttccttgtaagtttgatgcaaatgcactcagcggcggcgtggcttggctgatgtttgtggcctttatctcacacggtgtgagatgttgctacagaaatatgagygggtttgaattcaagtctgccccagacccaccgggtgtgatacatactctactgtttgtgctttgtattaccctcctcttgttttggttatcatgaggatacatccacctcctgctataaccagttggctaaaagaaataagaatccttagcctaaggaacagaatgttcatagagacatggtggccttttcaaatacttgagagactgacatgtggtggaggaattatttatttagtaggcttcaaggtccaaacttagctgggatcaatgaatgaaaatttcagggacagaaattgtt

SEQ ID NO: 192542 - DNA, 601 bp, Human
ttcagaacgttacgtatatagaatcgtacactatattgtgtagtgttttgagtccggcttccatttagcgtagaagcaatttaattttaattagtttttttccaatttagaagataatacatggtcactgaggtaattttggaactcagcaaaaactagaagttgccttgagatgagagctgttaacattttagtgtatttctttggttttttttggtggtttttcaatgtacaggtgatctgaatttcccttttttcccctcctcttaccccgtataggcagaagacacacatttggccrtaagtgtgaattgccattgatgagtttcaaagtcagttatcatgccttgaggcagtactctgtagactttgattaaagtttttgtagtagaactgaaacttcatttcacaaattaattggaaccagtgaaacgctgaagatctgaatattttacctaaaattagggtagcctttaaaaaatagtatgtacacaaatggtggcatgctaaatacattgttctgcatttaacagtggctctatagttagagatattagaaacttgatttgtgcatgttcgtagccctataaatctgcgggga

SEQ ID NO: 192543 - DNA, 601 bp, Human
cagggacgcaccaccacgcccagctaattttttgtatttttagtagagacggagtttcaccatgttggccaggatgttctcgatctccaggatggcctccatctgtccgcctcggcgtcccaaggtgctgggaatacaggcgtgagccaccgcgcctggccagagttaattacttttagagctgtctgcttccaccgtgtaactgtctacaaaacaaatctcaaagtactatatttctataattccctgtttagcttgatttaatattaagtggaatttgagcgtaatctaaattatgcagagatatattaataatgatgaccaatagaattatagtaaaaagttgcgttcagagggtatgctgacttttcaaggttagtacagaatcttgttagttggtttcattgtggagatttgtaattgaaaaaacgataattgtcttaatattaggccaccctgttaatttaaaaatacatagttccagataatttaaaatggttgttttgcatatttaaaaagataattttcattaaaatgctaagtaatgaagatttaactggatgtcaaaataaatgatcacaacagcttttattttcattca

SEQ ID NO: 192544 - DNA, 601 bp, Human
agagagatactgtcaaggccctggctttaaatacttccagaaaacattatttttccgtatttttacttttatgtacctgttattttctatgtcagatatttgtgtgccttctgtaagataatagtttaagatgagagcctgttctttactagattatgtattaagcttctatatgtatttcctgattttcttttcccaagaactctgtgaggttggttttatttttttaatttttattttttagtagagatggggtcttgctatttagatcaggctggtctcaaactcctggtctcaagctatactcccatctgggcctcccagagtgctgggattacaggcatgaaccactgagtctggccagcattagggatttttcaaagtaacttttaggatagtgagcttacattttcattaggaggaaaagggcagatactttgctggattatcactctggataagttctctatcacagtgtttaaggttgtcaaattagcttttttgtagtgggaagagcaatatgcattcattccatgattgacccctaattcttgtaatagtttttaactggcaggatcatccaggtaaacaccttggtttt

SEQ ID NO: 192545 - DNA, 601 bp, Human
ccaggtaaacaccttggttttttcatatgcagtatgaagcagttgtatttcctttaacctatttataagttgtgaaatctttgctagtttctgttgatggcagtcccatctacctctagcaactgtaactaattttcattgagtacccagactacttaccagactttgtaggtgccttactcgaatttcccatttaatcctttcaaccacagtgaagtagataactccactatttgagaatactgaggctaagtgaatccaggtctgtaaagttagatgctgattcaagattcagactctraagtttgacaccacagaaccaatttctttaaccattatggtgcaatattttttgaagtacaaatgttttgccacattattactaattttgaattgttactaatatgaggagaattatgaggaataaattgggaggttcccagagaaatgatttgagctatgcctttgctttagacaaatctgctttctaatatagtagccaccagccatggagctgaaatgtactagtctgaattgagacatgctttaaatgtaaaatacaaattgggtttcaaagccttagaattaaaaaaaaatgtga

SEQ ID NO: 192546 - DNA, 601 bp, Human
ttgcaacttccgcctcctgggttcacgtgattctcatgcctgagccacccgagtagctgggattatagctgtgtgcctccacgcccaggcaatttttgtatttttagtagagacagggtttcaccatgttggccggctggtttcgaactcctaacctcaaatgttccacctggctcagcctcccaaagtgctgggattacaggcgtgagccactgcgccgggccaataattttttacattgattacatgttggataatattttaggtatattaggttaaataatattgaaattaatattayctatttcttttcatgcattttgttttattttgagatggagtcttgctctgttgcccagactggagtgcagtggcgcaatctcagctcactgcaacctctgcctcccgggttcaagcaattctcccgtctcagcctcctgaatagctgggactaaaggtgccagccaccacgcccggctgatttttgtattagagatggggtttcaccatattggccgggctggtcccaaactgctgaccttatgatcttcctgcctcagcctcccaaagtgctgggattacaggcatgagccactacctc

SEQ ID NO: 192547 - DNA, 601 bp, Human
ccgggccaataattttttacattgattacatgttggataatattttaggtatattaggttaaataatattgaaattaatattacctatttcttttcatgcattttgttttattttgagatggagtcttgctctgttgcccagactggagtgcagtggcgcaatctcagctcactgcaacctctgcctcccgggttcaagcaattctcccgtctcagcctcctgaatagctgggactaaaggtgccagccaccacgcccggctgatttttgtattagagatggggtttcaccatattggccrggctggtcccaaactgctgaccttatgatcttcctgcctcagcctcccaaagtgctgggattacaggcatgagccactacctccttcttttaatcaagataatttatgctatcagtgtatttaacttgcctgccattctctatcttcagcgttttttgctgtctattttgggaagatgaacagaggtctccattagtaaaatagctgatgaagtttattattgttggcaaagggatgcgctcccgtgttgagatttcttcagatcaggagcctcagaggctcctgaattcctttcttaat

SEQ ID NO: 192548 - DNA, 601 bp, Human
ggagtgcagtggcacaatcttggctcactgcaacctctgcctcttaggttcaggcgattcttgtgcctcagtaattattgtagctgagattacagccatgcaccaccacgcccggctaattttgtatttttagtagagatggcgatttgccgtgttgactaggctgaccttgagctcctgatctcaggtgatctgcctgcctcagcctcccaaagtgctaggattacaggtgtgagccaccatgcccggcccagaatagttttgggtggccatttggaactgttaacttattccatttcaragagaactgttagataatacatacaaatgggtgaacctaacaagccaagaacattactggtatgtaaacagtagtagtagacacttgtgtattcttaaagaaatcttcacatcctcattgtcctttttcttttttcaaactcagaacagttacatgctcaatactaatgaatgctgaatgcttgccttgaataatttttttttcttattagagcttactccataattggctgggcgtgctggctcttgactgtaatcccagcactttgggaggctgaggcgggtggatcacttgagggca

SEQ ID NO: 192549 - DNA, 601 bp, Human
gttcgagaccagcccggccaacatggtgaaaccatctccactaaaaacacaaaaattagcagggcatggtggctggtgcctgtaatcccagctattctggaggctgaggcaggagaatcccttgaacccagggtgggggtgtgtgtggaggttgcagtgagccaagatcacgccactgcactccagcctgggcaacagaaactccatctaaaaaaaaaaaaaaaaacttgtaataattattgtaatgtataatgtaattggtaaatttgcagactttttgaatttgtggaacaagtatctrgtgatttggaataattttactttgtagatttagttgcgtagatctttttaaaaagtatattgtttgaagttaagacatttttttgattgcagtagcagccttgactatttggtacttgttggaatcaaattacaacttagatcttttagttgtggtaagcatcttataagtttatatcttataaatttgagatccctagagatggaaaaattagaagtggggagtggtgatgcacatacgtgctgtatggaaaacgtgttggctgacaataagatatattctaattcttaaaagtatacg

SEQ ID NO: 192550 - DNA, 601 bp, Human
aaactttattatgaatcttttaaattactttacttatcataaaagctccaggaagatttaccatggtagttgtggggagggagtagctttaagtactcctagcacatctttgagtgtcagggagtaccccagtttaagaatcttcacctcctttattttgcaaatagagaaattgttgtttcaggagaccggtctgttgatctgtctccctatgttgcccaggctggctggcctcgaactactaggctcaagtgatcttccccgctcagtctcctgagtgggttgggattacagaccctcrggcatccttcttgagaactttaaagttgcctagataacgatgatcacccagatctgggagacaagtcagacttttgcagcttgagtttctgtttttttttgagacagagtcttgctctgtcgcccaggctggagtgcagtggcgtggtcttggcccactgaaacctctgcctctcgggttcaagtgattctcctccctcaggctcccaggtagctgggacttcaggtgtgtaccaccatgccgagctaatttttgcatttttagtagagatagggtttcgccatgttggcctcgaactcc

SEQ ID NO: 192551 - DNA, 601 bp, Human
tcacctcctttattttgcaaatagagaaattgttgtttcaggagaccggtctgttgatctgtctccctatgttgcccaggctggctggcctcgaactactaggctcaagtgatcttccccgctcagtctcctgagtgggttgggattacagaccctcaggcatccttcttgagaactttaaagttgcctagataacgatgatcacccagatctgggagacaagtcagacttttgcagcttgagtttctgtttttttttgagacagagtcttgctctgtcgcccaggctggagtgcagtggygtggtcttggcccactgaaacctctgcctctcgggttcaagtgattctcctccctcaggctcccaggtagctgggacttcaggtgtgtaccaccatgccgagctaatttttgcatttttagtagagatagggtttcgccatgttggcctcgaactcctgacctcaggtgatctgcctgcctcgacctcccaaagtgctgggattacaggtgtgagctgtcgtgcccagccttcagcccgagtttcttatctgaactataaagcacagaaacacagtttctcagttctggtgatggcacat

SEQ ID NO: 192552 - DNA, 601 bp, Human
cgcggtcattcctaaagtggttcttcgttggtttgctgactgaaatgctcaggggttaccatcaggtgccacagaaaatcgcaagcaaaccaagtttgagtactaaagagtgacatttatgtcctgactgacatgtggctatcagctattccaagatgccatccattgtaagaagcatcctgatttcagagatgttaaatcattcaaattgatgggctggaaaggtagactggggccagagtatgaatcaataaataaactgataattgatcaagggataaaaagtgataataaaatccaytgtggcagttcttggggaagaaaaaacccgaggtactgaattttgcatgaattatgttagtacctttttctcatgggctatatattttgtaatcaaatttatccacatcagtaatatttaactgatgtagttggggtaaatggagagttaacctagtcagaggaaagacccttcactatctaacaaacagcccagtgtctctaataaagaaggatttattttaatcagtttatctttagaaatacagtaagtactttaccacaagtttgcatcaggaattaagccatgaactgcactttt

SEQ ID NO: 192553 - DNA, 601 bp, Human
cctttgtatgtgatgcttttatattttagcttctgggtagtatacttttatcaaactttgtggcttttgggttttgcttttttggttagaaaggccttccttactgcaagttatagataattggctcctgatttctcctggaattgttactgatttttttttgaagtttgaatgttttatctattgatttttttttttttctgatgaagacatccatttctgttttccccaagaattatttaaatgttccaataccattttaaaaagagtccattccttccccatttgtaaattcctaaaygactttaggcctacttttggaatctgttctgttcctttaaaatatcttttccatcttcattattgtagttttaaaataatctttaaggtttggtaagtatagagtgttattgttccctcccatcccagcccccccaccccattttagaagtttccttttttaaaattttttgagataggcttattttattaggtccccccaccccaaacacatacacactgttaatatttcaatgggatcccattgaaattataggttaattttaggggcatattgaaatttttataatatcaaggtgtc

SEQ ID NO: 192554 - DNA, 601 bp, Human
aattatttaaatgttccaataccattttaaaaagagtccattccttccccatttgtaaattcctaaacgactttaggcctacttttggaatctgttctgttcctttaaaatatcttttccatcttcattattgtagttttaaaataatctttaaggtttggtaagtatagagtgttattgttccctcccatcccagcccccccaccccattttagaagtttccttttttaaaattttttgagataggcttattttattaggtccccccaccccaaacacatacacactgttaatatttcartgggatcccattgaaattataggttaattttaggggcatattgaaatttttataatatcaaggtgtctaagaacatgatggtgttttacattttcctaaattttgtatttatatttattagagcttcagacattttttgtacatagcttttgtgcatatgtctgttgttgaggacacttgtaggatttattttttggttgttgctgtaagtagaatttttttgtataaaatttttattttacagctgcctgttgtttacatgtagaaggctaatggattgttagttaacttgctgcttaa

SEQ ID NO: 192555 - DNA, 601 bp, Human
taaatgttccaataccattttaaaaagagtccattccttccccatttgtaaattcctaaacgactttaggcctacttttggaatctgttctgttcctttaaaatatcttttccatcttcattattgtagttttaaaataatctttaaggtttggtaagtatagagtgttattgttccctcccatcccagcccccccaccccattttagaagtttccttttttaaaattttttgagataggcttattttattaggtccccccaccccaaacacatacacactgttaatatttcaatgggatsccattgaaattataggttaattttaggggcatattgaaatttttataatatcaaggtgtctaagaacatgatggtgttttacattttcctaaattttgtatttatatttattagagcttcagacattttttgtacatagcttttgtgcatatgtctgttgttgaggacacttgtaggatttattttttggttgttgctgtaagtagaatttttttgtataaaatttttattttacagctgcctgttgtttacatgtagaaggctaatggattgttagttaacttgctgcttaagtggatc

SEQ ID NO: 192556 - DNA, 601 bp, Human
gaacatgatggtgttttacattttcctaaattttgtatttatatttattagagcttcagacattttttgtacatagcttttgtgcatatgtctgttgttgaggacacttgtaggatttattttttggttgttgctgtaagtagaatttttttgtataaaatttttattttacagctgcctgttgtttacatgtagaaggctaatggattgttagttaacttgctgcttaagtggatctttgactagaacctttttttaaaaaattgttttatactagattgcttttgaaattagttcttcrgatagtgctttttcactgctcaaggattccttctactccttccatccctactttcattttacacttaatttatggcattttttgtttgtttttttttagacagagtttcactcttgttgcctaggctggagtgcaatgcgctttctcggctcactgcagcctccacctcctgggatcaagtgattctcctgcctcagcctcccaagtagctgggattatagtcatgcgccaccacaccctgctaatgttgtatttttagtagagacggggtttctccgttttggtcaggctggtcttgaa

SEQ ID NO: 192557 - DNA, 601 bp, Human
gtctgttgttgaggacacttgtaggatttattttttggttgttgctgtaagtagaatttttttgtataaaatttttattttacagctgcctgttgtttacatgtagaaggctaatggattgttagttaacttgctgcttaagtggatctttgactagaacctttttttaaaaaattgttttatactagattgcttttgaaattagttcttcggatagtgctttttcactgctcaaggattccttctactccttccatccctactttcattttacacttaatttatggcattttttgtttgtttttttttagacagagtttcactcttgttgcctaggctggagtgcaatgcgctttctcggctcactgcagcctccacctcctgggatcaagtgattctcctgcctcagcctcccaagtagctgggattatagtcatgcgccaccacaccctgctaatgttgtatttttagtagagacggggtttctccgttttggtcaggctggtcttgaactttgcctgccttggcctcccaaagtgctgggattacaggcgtgagccaccgcgcccggcctaatttatggcatttttagttttttatt

SEQ ID NO: 192558 - DNA, 601 bp, Human
gattacaggcgtgagccaccgcgcccggcctaatttatggcatttttagttttttattacatgatgcctgtttgttttgtcagagttatgtgggcattttaagatatttttttttccgcctatccatagcaagctgtgaacattttaagattttgaatacacttcagatgtgttatactgcctggttattaatgattatcttaaattatagttaagagtttcaaatgtaaacattattggactgtgcgagtgaacaagacaagtgaccatttaataaggatgccttgaaatcttctgtgtytgcatatgtatgggaagaagaaaaagacatgtcaaaggctttgttctgagaaatatgggacctgagccaggtgggtgtgaataggaagagagacagtcgaaatccccaaagattggatggagacttaaaggcataaagccccctgccatgtgcagacaaatgtggctgttatggtgtctcctatcggattttggcgaagacccagccctgtcaatttgggtctcttgagcaggcggggagacctaccatcattctggtggcttgggaatacaaaaatacatttaaaagtattgactgtgt

SEQ ID NO: 192559 - DNA, 601 bp, Human
agattttgaatacacttcagatgtgttatactgcctggttattaatgattatcttaaattatagttaagagtttcaaatgtaaacattattggactgtgcgagtgaacaagacaagtgaccatttaataaggatgccttgaaatcttctgtgtttgcatatgtatgggaagaagaaaaagacatgtcaaaggctttgttctgagaaatatgggacctgagccaggtgggtgtgaataggaagagagacagtcgaaatccccaaagattggatggagacttaaaggcataaagccccctgcyatgtgcagacaaatgtggctgttatggtgtctcctatcggattttggcgaagacccagccctgtcaatttgggtctcttgagcaggcggggagacctaccatcattctggtggcttgggaatacaaaaatacatttaaaagtattgactgtgtcctgtgtcaagtggactaaattttagagaaatctggccattagaaacacctttgtctagaatttaggacttggggattagattttatggagtaggatgttagaaatcgttcactacagtccaaatagattttaaggacttggtgtca

SEQ ID NO: 192560 - DNA, 601 bp, Human
ctgcaccgggcctaccatagcaatcttcaagagaaagatatcctgggttttaggcctcagtgaggatgtttgcatagaaatgtcccgtggcacacaaataaatgagacaacaggcagttggagctgaagaagagaactgagccattcccactgccagtttatattttatagtcttaatttgcttagaaaaatgtctaacacagagtatgcccttaaaaattagttgttgtgggttttttttttttttttttttggagatggggccactctgtcacccaggctggagtgcagcagcatggtyatggctcactgcaacctctgcctcccaggctcaagtgatcctcccgcctcagccttccaagtagctgggaccacagacacgccaccaggcctggctaatttttttatatttttggtagagatgggattccactgtcttgcctaggatggtctcgaactcttgagctcaaggtgtccgcctttcttgttcttccaaagtgctgggtgcctgggcttgctttgttttttattacttaagttacccttcttccatttactttgtaagtttcaaaaaaaaaaaaaaacaacttttttgttgttg

SEQ ID NO: 192561 - DNA, 601 bp, Human
tgcaccgggcctaccatagcaatcttcaagagaaagatatcctgggttttaggcctcagtgaggatgtttgcatagaaatgtcccgtggcacacaaataaatgagacaacaggcagttggagctgaagaagagaactgagccattcccactgccagtttatattttatagtcttaatttgcttagaaaaatgtctaacacagagtatgcccttaaaaattagttgttgtgggttttttttttttttttttttggagatggggccactctgtcacccaggctggagtgcagcagcatggttrtggctcactgcaacctctgcctcccaggctcaagtgatcctcccgcctcagccttccaagtagctgggaccacagacacgccaccaggcctggctaatttttttatatttttggtagagatgggattccactgtcttgcctaggatggtctcgaactcttgagctcaaggtgtccgcctttcttgttcttccaaagtgctgggtgcctgggcttgctttgttttttattacttaagttacccttcttccatttactttgtaagtttcaaaaaaaaaaaaaaacaacttttttgttgttgt

SEQ ID NO: 192562 - DNA, 601 bp, Human
cttctgataaatttttcattaggtggatgatactgtaattaatttcattagatcaaaactgtattcaagaatatacaagtgatagagcttgggtatgaatcctggcagccagtactccagagcttgaactctttgtcacagtagtaaatactgaactcttagtcacaatactaaataactgccttgctgaactaatacctgaggtgttccagggatgtacatttacttttgctaattcccaggtagatgacaccgggtgaaaaatgaggttcagagaggttaagtaacttaaaagatcatrtgtctcataaatagaatagatggaaatcaaactcacatctgcctaattccaaaccttgtgttcttttagtactccctattatctttgaactaatacaaccttttagagttacgaagtgctttaatatctatgcttttataatgtttttgtgtcttgcagggatttatcaaagatgttcatgaagactcccttacagttgtttttgaaaataagtaagttatttttgttgacaaaggccttaattttagagatggcagtgccaaactttttgcttttgggtgttcctactgccagtggaaa

SEQ ID NO: 192563 - DNA, 601 bp, Human
cacaaattagatgataatatgcttaatatttaaaagcccagaattttcaaatgaggttgtagaaggtcttccagttgactactggtcatcagaataagtattaagccatttttaattgcctgaggggtatgcagtctaaaaatgggaaagacagcatgctgggtttggttaggaagggctataaaagagcgctgggctgcgtgcggtggctcatgcctgtaatcccagcactttgggaggccgaggcgggcagatcacttgaggtcaggagtgtgagacagcctggccaacatggtgaaamcctgtctctactaaaaaatacaaaaaaattagctagtcatggtgggggggcgcctgtaattccagctacttaggagactgaggcaggagaattgtttgaacccaggaggtggaggttgcagtgagctgagacggcgccattgcactccagcctggacgacaagagcaaaactccatctccaagagcactgtttaattgatggtcagaaaaaaactgttcagcttccacttttaagctgtttctggaattgcctgaaaagatctttgcctaacagctgcttcatgtagaaacaagtgttga

SEQ ID NO: 192564 - DNA, 601 bp, Human
tttcaaatgaggttgtagaaggtcttccagttgactactggtcatcagaataagtattaagccatttttaattgcctgaggggtatgcagtctaaaaatgggaaagacagcatgctgggtttggttaggaagggctataaaagagcgctgggctgcgtgcggtggctcatgcctgtaatcccagcactttgggaggccgaggcgggcagatcacttgaggtcaggagtgtgagacagcctggccaacatggtgaaaccctgtctctactaaaaaatacaaaaaaattagctagtcatggtgggggggcgcctgtaattccagctacttaggagactgaggcaggagaattgtttgaacccaggaggtggaggttgcagtgagctgagacggcgccattgcactccagcctggacgacaagagcaaaactccatctccaagagcactgtttaattgatggtcagaaaaaaactgttcagcttccacttttaagctgtttctggaattgcctgaaaagatctttgcctaacagctgcttcatgtagaaacaagtgttgagatgatttctatctttgagcagctgccatttggacagtaatggt

SEQ ID NO: 192565 - DNA, 601 bp, Human
aagacagcatgctgggtttggttaggaagggctataaaagagcgctgggctgcgtgcggtggctcatgcctgtaatcccagcactttgggaggccgaggcgggcagatcacttgaggtcaggagtgtgagacagcctggccaacatggtgaaaccctgtctctactaaaaaatacaaaaaaattagctagtcatggtgggggggcgcctgtaattccagctacttaggagactgaggcaggagaattgtttgaacccaggaggtggaggttgcagtgagctgagacggcgccattgcactscagcctggacgacaagagcaaaactccatctccaagagcactgtttaattgatggtcagaaaaaaactgttcagcttccacttttaagctgtttctggaattgcctgaaaagatctttgcctaacagctgcttcatgtagaaacaagtgttgagatgatttctatctttgagcagctgccatttggacagtaatggtgaaaagaaagcatccccaaatcttttacttgtcagctgctactttgcccagccttggcagatagaaacttgagggacattttatgtcatagtatacttcccag

SEQ ID NO: 192566 - DNA, 601 bp, Human
gctttactcattcatgagggacttggctcatggcaccctgacataatttatactttgctttagtaaaagcaaaatagtacacagtgaacttagtgcaaataattaaaatccaggcagaatttttaaatggcagtaagttaagaagtaactttttgtaaggatacctgtaactatctgtgtgtattagagttcttgaggaaaatgttactggtggcatctgggggagacacgaggaaacaaagtggtgaagtgactgctgcaaatcaaggagtgtgaagtggagtccttggtgggtgctatrtatggcagtgatgctgcagattactgtgttcatttggactttagattttattgaaaatgtttttctcaatattgtatctctaatagttttctgtgagaataaagggcttgattcattttcatttttcaaaatttatttctgatacagtgttttttggattttgagtaagcaaaagttaggtcaagcaaggaatgatgtaggtttggacatgttctagaattagaaatgtgtggcactcagttttgagagtaatgcttcttacacttttttgttgtttagacacttaaaattggtagcgtc

SEQ ID NO: 192567 - DNA, 601 bp, Human
ccaggcagaatttttaaatggcagtaagttaagaagtaactttttgtaaggatacctgtaactatctgtgtgtattagagttcttgaggaaaatgttactggtggcatctgggggagacacgaggaaacaaagtggtgaagtgactgctgcaaatcaaggagtgtgaagtggagtccttggtgggtgctatatatggcagtgatgctgcagattactgtgttcatttggactttagattttattgaaaatgtttttctcaatattgtatctctaatagttttctgtgagaataaagggctygattcattttcatttttcaaaatttatttctgatacagtgttttttggattttgagtaagcaaaagttaggtcaagcaaggaatgatgtaggtttggacatgttctagaattagaaatgtgtggcactcagttttgagagtaatgcttcttacacttttttgttgtttagacacttaaaattggtagcgtcaagtctcagattaaagggaaaactactcttggtggggtggtgagggtgttgttacagtgtactttttccattcctgtccaggagggtccttccctgttcctgaacagtc

SEQ ID NO: 192568 - DNA, 601 bp, Human
atggcccagcagtggacccaagaagacaacatatgatttatagtagaaagttaattttgaaaaggtctaaaatggaaatatttatttttatacctaattagtggttttttatttgccttttaaaaatggtgtcatctctttaaaaatcttcataacacttaatagtaaatatttcataagtatttgcttaatgattgatttttgctgactaaagattgctagaaaaatatgctccgcctgtaaagtttgaaggtaatgtgaaaatgaagagttctttagatttcgtttacattgggtatcyagtacagtgttttgggctcttggaagggcagtagaaatatccctcctccctcatttcacatgtaacatttttgctttttattttagatatctgccttgctcagcaagtaatatataagcaacacacatagacacgttacatagtaagcctgacatctaaggtgataacgtgtttagtttttgtttttttctgttttcttttttttttggagatggagtttcggtcttgtccaggctctagtgcaatggcgccatctcggctcagcgcaacctccgcctcctgggttcaagtgattctcct

SEQ ID NO: 192569 - DNA, 601 bp, Human
tgattgatttttgctgactaaagattgctagaaaaatatgctccgcctgtaaagtttgaaggtaatgtgaaaatgaagagttctttagatttcgtttacattgggtatctagtacagtgttttgggctcttggaagggcagtagaaatatccctcctccctcatttcacatgtaacatttttgctttttattttagatatctgccttgctcagcaagtaatatataagcaacacacatagacacgttacatagtaagcctgacatctaaggtgataacgtgtttagtttttgtttttttctgttttcttttttttttggagatggagtttcggtcttgtccaggctctagtgcaatggcgccatctcggctcagcgcaacctccgcctcctgggttcaagtgattctcctgcctcagcctcccaagtagcagagattacaggcatgtgccaccacacccagctaattttgtatttttggtagagacgggttttctccacattggtcaggctggtctcgaactcctgacctcaggtgatccacccgcctcggcctcccaaagtgccaggattacaggcttgagccaccacgcgcagccctga

SEQ ID NO: 192570 - DNA, 601 bp, Human
attgatttttgctgactaaagattgctagaaaaatatgctccgcctgtaaagtttgaaggtaatgtgaaaatgaagagttctttagatttcgtttacattgggtatctagtacagtgttttgggctcttggaagggcagtagaaatatccctcctccctcatttcacatgtaacatttttgctttttattttagatatctgccttgctcagcaagtaatatataagcaacacacatagacacgttacatagtaagcctgacatctaaggtgataacgtgtttagtttttgtttttttctggtttcttttttttttggagatggagtttcggtcttgtccaggctctagtgcaatggcgccatctcggctcagcgcaacctccgcctcctgggttcaagtgattctcctgcctcagcctcccaagtagcagagattacaggcatgtgccaccacacccagctaattttgtatttttggtagagacgggttttctccacattggtcaggctggtctcgaactcctgacctcaggtgatccacccgcctcggcctcccaaagtgccaggattacaggcttgagccaccacgcgcagccctgata

SEQ ID NO: 192571 - DNA, 601 bp, Human
atttttgctgactaaagattgctagaaaaatatgctccgcctgtaaagtttgaaggtaatgtgaaaatgaagagttctttagatttcgtttacattgggtatctagtacagtgttttgggctcttggaagggcagtagaaatatccctcctccctcatttcacatgtaacatttttgctttttattttagatatctgccttgctcagcaagtaatatataagcaacacacatagacacgttacatagtaagcctgacatctaaggtgataacgtgtttagtttttgtttttttctgttttyttttttttttggagatggagtttcggtcttgtccaggctctagtgcaatggcgccatctcggctcagcgcaacctccgcctcctgggttcaagtgattctcctgcctcagcctcccaagtagcagagattacaggcatgtgccaccacacccagctaattttgtatttttggtagagacgggttttctccacattggtcaggctggtctcgaactcctgacctcaggtgatccacccgcctcggcctcccaaagtgccaggattacaggcttgagccaccacgcgcagccctgataatgt

SEQ ID NO: 192572 - DNA, 601 bp, Human
tttttgctttttattttagatatctgccttgctcagcaagtaatatataagcaacacacatagacacgttacatagtaagcctgacatctaaggtgataacgtgtttagtttttgtttttttctgttttcttttttttttggagatggagtttcggtcttgtccaggctctagtgcaatggcgccatctcggctcagcgcaacctccgcctcctgggttcaagtgattctcctgcctcagcctcccaagtagcagagattacaggcatgtgccaccacacccagctaattttgtatttttrgtagagacgggttttctccacattggtcaggctggtctcgaactcctgacctcaggtgatccacccgcctcggcctcccaaagtgccaggattacaggcttgagccaccacgcgcagccctgataatgttttttgtaaggtttcttccttgcatttagcatatttgaaattttaaaaacctgtttttgaactgtgaggttttctggtttagtattcatagttaaaataggaattggcaagtttttgttcttgtggcatatgcctttccttttctagtcatatggcggattgtcaggcatt

SEQ ID NO: 192573 - DNA, 601 bp, Human
ctacctcagcctcccgagtagctgggattacaggcatgcaccaccacgcctggctaattttgtatttttagtagagacagggtttctccatgttgaggctggtctcgaactcctgacctcaggtgatccacccacctcggcctcccaaagtgctgggattacaggcgtgagccaccgcgcccggcctagaatattctttttgtaaccctcagtatacttgggaaaacagtcatcactgatcgtttaccaaataattttgtagcagaaagaatgaaagggtagtaaggtcgttattggaccttttttttttttgagacagggtctcgctctgtcacccagtttagagtatagtggcatgatcatggctcactgcagccttgacctcccagtctcaagtgatcctccttcctcagcctcccaagtagctgggactagaggcatgcaccaaccacacctggctaattaaaaaaaaattttttttatagagacgaaatcttcctgtgttgtccaggttggtctcaaactcctgggctcaagcagtcctcctgcctcagcctccaaaagtgctgggattacaggcatgagccactgtgccccccat

SEQ ID NO: 192574 - DNA, 601 bp, Human
caccgcgcccggcctagaatattctttttgtaaccctcagtatacttgggaaaacagtcatcactgatcgtttaccaaataattttgtagcagaaagaatgaaagggtagtaaggtcgttattggaccttttttttttttgagacagggtctcgctctgtcacccagtttagagtatagtggcatgatcatggctcactgcagccttgacctcccagtctcaagtgatcctccttcctcagcctcccaagtagctgggactagaggcatgcaccaaccacacctggctaattaaaaaaaawttttttttatagagacgaaatcttcctgtgttgtccaggttggtctcaaactcctgggctcaagcagtcctcctgcctcagcctccaaaagtgctgggattacaggcatgagccactgtgccccccattattagacttttttaaaggccattattgactccatgctggagtatagtgaagcaaacacaactcactgcagccttgacttcctgggctcaagagatccttccaccctaccccaggcccccaagtagctgagattacaggcacatgccaccatgcctggctaacttttgtatt

SEQ ID NO: 192575 - DNA, 601 bp, Human
accatctcagacttcatagtctgaggttttgctttgtaagataatttcacatttatcagtactctttgcatctgttgtctgatatctctaataattagaaaggccttcctctgtaaatttttcttctcttcgcaattatgagtgaaaaaaattcataattatcaactggtcaacggtagctaaaagcagactacaaggatggtgtctttggtctttttgaactgttttgaaagagatgtgatacctcaggctatgcagtaaggaaactgtatgaacattaacagtttatttcactgttgtrtcctctaggtgatgccatcattcctctgttccattttagtctttatttaaagcatagctgagaataactgatgaatgttgatgaaattgtaaagtgtttcaagatataggaaaaataagatcactagattctaccttacatttataaaagggcccagtggatacatataataattacagaataagggtgagttctgttctagtcttagagaagtaaactttcttgttttttggaatatgtcgtaaggaagaatataagtcatgagatattgatccctttgaatagttagatctgtttata

SEQ ID NO: 192576 - DNA, 601 bp, Human
ttcttctcttcgcaattatgagtgaaaaaaattcataattatcaactggtcaacggtagctaaaagcagactacaaggatggtgtctttggtctttttgaactgttttgaaagagatgtgatacctcaggctatgcagtaaggaaactgtatgaacattaacagtttatttcactgttgtatcctctaggtgatgccatcattcctctgttccattttagtctttatttaaagcatagctgagaataactgatgaatgttgatgaaattgtaaagtgtttcaagatataggaaaaataagrtcactagattctaccttacatttataaaagggcccagtggatacatataataattacagaataagggtgagttctgttctagtcttagagaagtaaactttcttgttttttggaatatgtcgtaaggaagaatataagtcatgagatattgatccctttgaatagttagatctgtttataaaagaaatggaaaagctaaaattgagtttaacggaccctgattggtatattggacttcctgctttttctcatagcttttttctaatcatggtatacgataaagttcattagtaggttttg

SEQ ID NO: 192577 - DNA, 601 bp, Human
gaggaggactaggagtgaggcatcatgtggcatgtagtattaaaatattaagcttatcattatatctctgtcttatcctaaggtactctgttttgtcctgttcttccctgctacactagtaggatacttgttcttcccactcactcacactttctagatctagatgaacacatgtgcatgcacacactgtgatgtctcagagaaattaagatatgtttattatccttaggacaaatttggaaatgttctcattaatttaaaaattctgaacaagggatatgtgaacaaatctgcctgtatstggaaaagtgttttagactaataaaatagatgaataaaacagtttcttttccccattcattttatgacattagatgagtttcctttgtttcttaagaaacttgagttttggcctttttaaaaaaatttatgtgggttttcggtggttttttcttcttgggtttttctttatactgtggtaaagtacatatgaaacttagcatcttaaccatttttaagtgtacacttagtattaagtatgtttacattattgatcaatcttcagtacatctcatcttgtaaaactgcaaatctataccct

SEQ ID NO: 192578 - DNA, 601 bp, Human
tgaaagatttactaagtaattaaatatgtagtttttttattgaggtttcttaaccgcttctgagtttacttcagttttatacccgttaacaaataatctatcgaagtatttttttgaatgtttactgtgtgccaggcactggcaggagtaaatggcatatattagaatagcttttctagaacttgagtttgtataatacttcgtcactggttaatcatgacgtttgcaggggtagaaaattagtaagttatttttaaaatgttattcagccaggtgcagtggcacacacctgcagtcccasctacttgggaatctgaggcaggaggattgcttgagcctatgagtttgaatctagccagggcaacatagagtttagaaaagtatatataaatttttatatatacatacacatgcatcttatctatatttttatatatgtaaattgagaccatccttcaaattagagtaactggatttttattttttaaagagacaagattttgccatgttgcacaggcttgtctcgaactcctgagctcaagcaatccacctgcctcagccttccaaagtgccgggactataggcgtgagccaccgtgcct

SEQ ID NO: 192579 - DNA, 601 bp, Human
aagattttgccatgttgcacaggcttgtctcgaactcctgagctcaagcaatccacctgcctcagccttccaaagtgccgggactataggcgtgagccaccgtgcctggcctggagttttttttgaatgacaattttgtgtcttgacttttcatacatagctcttatgaacagctgctttcacatagtaaagctgactagaagcttcacttttaatttcaaaacctttaaaagtagacagtataacatagtaattaagaagacagacagacacggtggctcacgtctgtaaccccagcaaktttggatgctgaagcaggaagatcacttgagtccaggaatgagaggctgcagtgagctatgatcatgccattgtcctctagcctgagcaacagagagcaaggtcctgtcttgttgagaaggaggagggaaaaaaaaaaaagacgagctttggagctatactgcctggattggaattcactttaagtaggctgctttgagtaggcttggagtttgttacttgtataagtgttctcattataaaataataatagtgcttaccttaatacagttcttaaggattagatgcattgtaaaaaatg

SEQ ID NO: 192580 - DNA, 601 bp, Human
tcatgccattgtcctctagcctgagcaacagagagcaaggtcctgtcttgttgagaaggaggagggaaaaaaaaaaaagacgagctttggagctatactgcctggattggaattcactttaagtaggctgctttgagtaggcttggagtttgttacttgtataagtgttctcattataaaataataatagtgcttaccttaatacagttcttaaggattagatgcattgtaaaaaatgttgattgcatatggtatatcatgtagtgtgcacacaataatttgagctatggttttaaaattwaaaaaaaattttatttgcttttttttttttttttttttaaagagacagggtctactctgttgctcaggctggagtgcagtggcgtgatcatagctcactgcagcctccaacccctgggctcaagccatcctctggcctcagcctcttgaatagctaggactacaggcatgtgctgccatgctgggctaatttaaatatatatctgtatattttgtagagatggaggtttcctatgttgcccaggctggtctcaaactcttggccttaaacgatcctcctatattggcctcccaaagtgca

SEQ ID NO: 192581 - DNA, 601 bp, Human
atgcaatctcggctcactgcaacctctgcctcctgggttcaagcgattctactgcctcagcctcccaagtagctgggactacaggcgcctgccaccacgcctggctaatttttgtatttttagtagagatgtggtttcaccatattggccaggctggtcttgaactcctgctcctgatcttgtgatccgcccacctcggcctcccaaagtgctgggattacaggcgtgatccaccgcgcccggatgtaaaaagcctttcaattctcctcaaacatttggataggtatgacattactgccarttgtgtaagctctactttattagttcttggtataccgttgttcactgtagactgaactgctagaaagatgagatgttaaaattcaatataaacttgaagaattttgtataattataattatacaaaatataggtagggtgcacaatgttatcaaatgtttatcagtatcaaatgaaatcacctttgataagctgcttttgaaaatgctgcctttttaaagaaatcgttaattattgacatctgtcagtactaacattgtggtagctgctctacagatgtaattttgacttaactaaggtt

SEQ ID NO: 192582 - DNA, 601 bp, Human
tcatagaaatctcttggacccatagaaacttgaaaataaaagcaagattgatgaatttgctacttatgtgaattaataaagtgctaatgattaatgtcaaaatagtttttctctttgcctttatgtatacatccaaggttttgaaatgggttggatattttaaaaatatgaaaatgatataagcatattttaaaagtctagattttgagaattccttacatgtgagcactgttgtcagtcccagttagtaaccttaggcgtgctgaaagagaagtaagtttcagaccaagggtgaaatttcttggtagtctgtagggcgagttaattgatagtaaaaagatgggagcttcacttgatggttgtaatttagtagcaagttacaaataattggggctgacactgaaagaatagcagaattgagttttagcttaccattgtatttgttttctcttactaaaggaaaagtaattggaaaaaatggcaaagttattcaagaaatagtggacaaatctggtgtggttcgagtgagaattgaaggggacaatgaaaataaattacccagagaagacgtaagtatttaaaatgtaatctgcctctttaa

SEQ ID NO: 192583 - DNA, 601 bp, Human
gcacacagaagacaatttacaacagtaaattggggtgcaaatatgacaagttattgaaaatctgagtatttcaacttacatggattttagcatttttttctccttaaatcttgaagtttagtacatgtaaattgctgcgtgtttcagaagagttttcctaattatatattggggctgggtacagtggctcacgcctgtaacctctttacgaagtcaataatcccagcgctttgggaagccaaggcaggaggattgcttgaggcaaggagttgggcaacagagcaagaccctgtctctacaraaaataaaaagtaatagctggttgtggtgacacgcatctatagtcccagctactctggaggctgagacaggagaatcacttgagcccaggagtttgatgctgcagtgagctgtgattgtaacactgcactgtagcctgggcaacagagcaagacgtcatctcaaaaaaaaaaaaaaaaaaaaaaaaaaaaagtgtgtgtgtgtgtgcctgcctgtcagtttcatgtcacttttaggctagaactttgttaaaatattaaacactgaatacttttttttttttttaaacagggtatggttc

SEQ ID NO: 192584 - DNA, 601 bp, Human
agcatccattatttgtaaacagtttaattttacaaaagttaattcatctcccagggccacccatttttggaagtttctcttgctactcattgtcttagagaaagtagtggaccatatagcagtatcaggaaaagccctcgtagagtgtttctcagtgaaggtttacttagaatatactggtcagaactttagttggcagcttttctttatatgatgagggtcagatgtttctctcttcaggttttggaggcttatttaattagaattttttttgttttccctagaattttggggttatgtwtttttgtttgccagacagacccagagatttctaatgcacagagagatgtcagtacttttctatacttaatattgaaaacgaagtgaagagcattcttagctacactatgtagtactttgggaacagggaaaaattgtggaattaactaagttttttaattgttggaggaactgtgctgtaaagaggagtgtttggatgactaaagatttgagggtgtaggaaacgttttacttaattacttctgtcttctaaaatttttttatgctttacattaagttgtaggagtttccagaatatcct

SEQ ID NO: 192585 - DNA, 601 bp, Human
cgaagtgaagagcattcttagctacactatgtagtactttgggaacagggaaaaattgtggaattaactaagttttttaattgttggaggaactgtgctgtaaagaggagtgtttggatgactaaagatttgagggtgtaggaaacgttttacttaattacttctgtcttctaaaatttttttatgctttacattaagttgtaggagtttccagaatatccttggttaccataacgggctagggagttaattgccagggatagatacatagactatattaaggatataactttaacatatyattatggtataccacgttaagaaacccgcaccttccttaatgttatacccatgaaaacttatgtagtattttaatattatagaaagtgtgtgtagatacattaaatatagatgccaactgtgcttacaaattacaaaaactggaacaaatcagggcaaaaattaggaacttgttctttgtttgtttagattttctccctttccacagtaatactctttgagccttaagtttagtttacaggctttcagggtaatagtttttatattttagtacactttgtacagttaccaaggtgtttaa

SEQ ID NO: 192586 - DNA, 601 bp, Human
tccataatgtttctaaagatggagtactagtcagcattcgtttcaacattttcctttcataaccagttagaagttcaaccttatttaattggctgctttgtttcaacttgtcttgattgcttcagttcagttacggatttctattatgtcatggaatgcaggtattgaatattatttgggaaacagtccatcaacatcaacacaacaaagctgcagtcattttgaactcagttaaggggatgaaagctcgctcttataattatttcttaacagctgaatatttgtttcttttcatttttgwttttctagtctctgggcaggattaccttgaaatgtgaatgcaagaattagcatttaatacactattttctaatgtatattttaaaaacaaggcacaggaaatgttaggaagccaagatgtctgcttactttctgctttaatttttcatcaccacttaaagttttatcatatttaattatctttgttattttccaggtaaataatattgaaaacattttatttgaagacagtgcatttttattgggggagactgaagtttatttgtcattgatatagttcaatatagatcaaacattcata

SEQ ID NO: 192587 - DNA, 601 bp, Human
ccataatgtttctaaagatggagtactagtcagcattcgtttcaacattttcctttcataaccagttagaagttcaaccttatttaattggctgctttgtttcaacttgtcttgattgcttcagttcagttacggatttctattatgtcatggaatgcaggtattgaatattatttgggaaacagtccatcaacatcaacacaacaaagctgcagtcattttgaactcagttaaggggatgaaagctcgctcttataattatttcttaacagctgaatatttgtttcttttcatttttgtwtttctagtctctgggcaggattaccttgaaatgtgaatgcaagaattagcatttaatacactattttctaatgtatattttaaaaacaaggcacaggaaatgttaggaagccaagatgtctgcttactttctgctttaatttttcatcaccacttaaagttttatcatatttaattatctttgttattttccaggtaaataatattgaaaacattttatttgaagacagtgcatttttattgggggagactgaagtttatttgtcattgatatagttcaatatagatcaaacattcataa

SEQ ID NO: 192588 - DNA, 601 bp, Human
tgaaagctacaaaaatgtatttcctgtcagtaaacatttgttgttttatttttgtgtttaattaaaagtttatttttcccctttaaatctttgaaggaaagaaggtttttttgtttttttgtttgtttttgtcagaatagttcatggtaaactttgcaattacagatgatagtgaaaaaaaaccccagcgacgcaatcgtagccgcaggcgtcgcttcaggggtcaggcagaagatagacagccaggtaacttgagtggacctgtggacaccatcaggtcacaagcatgaaaaaaatgtcatatgtctgctttctaaatatattatacttacatgtacacatgtgtgcatatacattcaaaatttgcattgcataaattgtttattcaactaataagactactactattaagaaaatgcattcttccttcacagtgtgttagtaacttgtctaattgaactaatgttgtgtcctaattgtttacatggaaatactgttgagaagaccattttgttcacttggcagtttcttcacacttgagatggggcctgccatccgagggactgtgttgtagattgtgatcaaggttgattggcaaaac

SEQ ID NO: 192589 - DNA, 601 bp, Human
atattctttaccacacttagaatgtgacaatacacactggtgtccagttgattaacttggatccattcgaggaaattctagagtccatgtcattacagaaattgcctgtatttttttctagatattgttaattattaatctgtattggacttttaaggggcttgtattataaggactggctataaacaggtttttatttgaattaacagaggtttcttttggcttccttttatttaggtagcggataccccagctaagtgcttgttaatttagttgataactatatcaaaatattattctrtctctgtacacagtggatgaaaggttctagaattgtttcaacaatgtgttaggttggtgcagtttttgcacccacctcaaaatggcaaaaaccacaattacttttgcaccaacttaatttagcagcaggctttccaattagatgttttcctaggtgtcactgagggccgaacttggaaacagtgcattcactatgctgttccccacactggctagaattgttcttgtaataggtttgctaccatgtatgtagacataataaagtggattatgacaatagccctttttccaatattgtaaa

SEQ ID NO: 192590 - DNA, 601 bp, Human
tacacactggtgtccagttgattaacttggatccattcgaggaaattctagagtccatgtcattacagaaattgcctgtatttttttctagatattgttaattattaatctgtattggacttttaaggggcttgtattataaggactggctataaacaggtttttatttgaattaacagaggtttcttttggcttccttttatttaggtagcggataccccagctaagtgcttgttaatttagttgataactatatcaaaatattattctgtctctgtacacagtggatgaaaggttctagaattgtttcaacaatgtgttaggttggtgcagtttttgcacccacctcaaaatggcaaaaaccacaattacttttgcaccaacttaatttagcagcaggctttccaattagatgttttcctaggtgtcactgagggccgaacttggaaacagtgcattcactatgctgttccccacactggctagaattgttcttgtaataggtttgctaccatgtatgtagacataataaagtggattatgacaatagccctttttccaatattgtaaactctttttaatgtagttataaatatattag

SEQ ID NO: 192591 - DNA, 601 bp, Human; identical to SEQ ID NO: 19571

SEQ ID NO: 192592 - DNA, 601 bp, Human; identical to SEQ ID NO: 19572

SEQ ID NO: 192593 - DNA, 601 bp, Human; identical to SEQ ID NO: 19573

SEQ ID NO: 192594 - DNA, 601 bp, Human; identical to SEQ ID NO: 19574

SEQ ID NO: 192595 - DNA, 601 bp, Human; identical to SEQ ID NO: 19575

SEQ ID NO: 192596 - DNA, 601 bp, Human
cttcaaagcacttttgctcgacacacactggagtatcagagttagtatcctctctgtgacatttagtttttttatttatggtaactccatatcatttgagggatgaaacctaacttaatttttgattgtttactttttttttctttcgaaaagatccacagagtggagtgtgacaatcggcagtccttttttaggatgttatccataaattatttgaaaatgccattttcagattgtatggccagtgttgggcagttcccactaatagcttctaaaggtggagagggatgatggtcctaatttaagcaattgacagattgttacctccaggaagaagaaagtggcctaagttttttaggatagcacaacatggaaagtgggtcaaatgactttccccatgttttgatttgggctcttcttcaagttctgcttacaaactttgctcttggaagtttttgctgcataatgcagtggataacaggtgtgggaaaaaaggctgattgttttaattcatttccacaaatagttattgggagcttactgtgtgtgtttctagaatgttactattctagaaacatctcgtccagtgtagactgatgat

SEQ ID NO: 192597 - DNA, 601 bp, Human
tgcagtggataacaggtgtgggaaaaaaggctgattgttttaattcatttccacaaatagttattgggagcttactgtgtgtgtttctagaatgttactattctagaaacatctcgtccagtgtagactgatgattgcaatcatatcacagcagttccttaggggagactgggattatttacaaggctgatgaatcagtatatttcattatctatgtttcaggggaggaagggaaggtttgataatatttatcttaaagcacagtgcgtgataatgggaaggttttttttgttttgttttkttttttttttgagttttgctcttgttgcccaggctggagtgcaatggcacaatctcagctcactgcaacctctgcctcctggattcaagtgattctcctgcctcagcctgccaagtagctgggattacaggcgtgtgccaccacacctggctagttttgtatttttagtagaggtgggtttcgccatgttggttaggctgctctcgaactcctgacctcaagtgatccactcaccttggcctcccaaagtgccaggattacaggcgtgagccactgcacccagccagtattttgttatgg

SEQ ID NO: 192598 - DNA, 601 bp, Human
gtgatttcattgattgttggggacagtcgtgaaggagagagcccagactggcagtgtttgaatcctatctccgtcactcagtgtgtaacttctctgagccccagtttctccatctgtaaaatggagacagtaacaacctatctcaaaaggttattttgtggattaaataaattaatacataaagtgtgtctggccaattagtaatcacatacacatttgctttaaaaaaggaggaaaggccggggcgcggtggctaacgcctgtaatcccaccactttgggaggccgaggcaggtggatcwcctgaggtcaggagtttgacaggaggtggaggttgcagtgagccaggattgcaccactgcactccagcctgggcaacagagtgagactccgtctcaaaaaaataaaataaaataaaaaaattaaaaaggaggaaatagagaagaatggaaggaagaaagaagaaagaaaaatagtcagtcatggccgggtgctgtggctcccacctgtaattccagcactttgggaggctgaggtggacagatcacaacatcaagagatcgagaccatcctggccaacgtggtgaaaccctgtctctact

SEQ ID NO: 192599 - DNA, 601 bp, Human
aaggccggggcgcggtggctaacgcctgtaatcccaccactttgggaggccgaggcaggtggatcacctgaggtcaggagtttgacaggaggtggaggttgcagtgagccaggattgcaccactgcactccagcctgggcaacagagtgagactccgtctcaaaaaaataaaataaaataaaaaaattaaaaaggaggaaatagagaagaatggaaggaagaaagaagaaagaaaaatagtcagtcatggccgggtgctgtggctcccacctgtaattccagcactttgggaggctgaggyggacagatcacaacatcaagagatcgagaccatcctggccaacgtggtgaaaccctgtctctactaaaaaaaatacaaaaatcatctgggtgtggtggcacgcacctgtagtcccagctactcgggaggctgaggcaggagaatcgcttgaacctgggaggcagaggttgcagtaagccgagattgcgtcactgcactccagcctggtgacagaggggaattccgtctcaaaaaaaaaaaaaaaaaaaaaaaaagaaagaaaaagagttaatcacaagttgtaagcccaagagtctggtt

SEQ ID NO: 192600 - DNA, 601 bp, Human
atttccttccttcttaaggctgaataatattccatcatatatatgtacatgtattacattttatttgtccattcacctgttaatggacatcgggttgtttctaccttttgactgttgtgaataaagctgcttcagttgttggtgtacaagtatttgtttgagtccctgtagattctctgcattttaccattgtactatgcacgttgccttgcaggcaatgagacttcccatcataatgtttacttgtagggagaaaaaaaagttaatttaggatctctgtggaaaactcttcctcctgatrgataaactgatacaaggtagtaaagcaaaatttcagagcagacagacttttttccactttgaagatataaacttaaagtaaatcttattagtttcacatgtcaaaagcttccttccaaaagcaactagctgaaaagttgttctcgagcagtgattctcaagctttttgacctctttatactctttaactatttttgagaaccgcaaaaagcttttgtgtgatttctgttgctatttaccatattagaagttaaaactgagaaaaatttaaaacaatttgaacaattacattctattggct

SEQ ID NO: 192601 - DNA, 601 bp, Human
ttacttaaagactctggggtgtcagagggttaccaggccttactttggaaaccaaagttctagagtttaggcaagaagatataaccacttattccagtcacttacctcacctgaaatgtagcctatgggttcacattaaattattatcttaattttagctcaaccatagatgtcatatgttgcatgcacattctttttgaagcaaattaaaatttagagagtttgattgacactttttgaaaaaattagagctacttgagctgggaatttactatttcatagataggatttttttttttttattctctgaactgtgagtttcattgtagggtgacctggctgggctgtttctttggggaagcttaaatgttagtgtgatttttttttcttcctttggctaccaggtaggagactattctaatctcttgcctggaaaatacaggcctgtctaccagtatttagggaactgagtgggagtggagggtgaaggtggtctcagcatctgggtattcgataccagctggatattgcctgtaggttctcagctgtgtccctgctttgctaagcttctcccatcattgcaggggctggctcctggaca

SEQ ID NO: 192602 - DNA, 601 bp, Human
atagaaaacctttctctttattttagctcctacttcaccccatcttccagagttatcttgaattgccagttctggagtcttttgggcattctggggtgaagatcaggttggatcttggctttccctgctgctggcctaggattcagctctgttgccatcttagtcttttagcattcatttacctgccgtccagctttccagactttagtgctatagcttatgtcttgaaaaaatccctttgctgtcctttgattggggtttcagaaaggagtgaaatggatgtctttgtgtcatttgccaygtgtaccctaaaatcctgcttttctaaaatcataatcaagaagtcacttgctgtcccttttggacagtagttcattacctttaaagttgtaccatttttagagctttggaatgtgagagatgatgctgatcctgtcagaaagactttttggaaaagttcatgttctctgctcattttggatctggacatctgtgcaactctgaattctctttttcctcccctgcattcctctccctatggactggagctcagttaaaggagcggccatccattttagtgccccagattgagaggtgtatg

SEQ ID NO: 192603 - DNA, 601 bp, Human
ccagtcatctgtcagggacactgggttgcttccaccttttggctcctgtgaatagtgctgccatgaacatggctatctcactgtctcttttagcatcatatcccatcagtcaccaaattctggtatatcctcctctctcccttgcactgctaaggctcgggccctcatcctttctcacctggactgtggcagaagcttcctaacaaccaccttactttcccttccagtctgtcacactacactcttggatatttttaaaataggggtctgatcatctcatttgcccgccttgaaatcctcratggtgccattcagacttttctaacatggcacatcacctcagtttaccttgttgatccagctttcctgcccctctgcttactttctgtctgtcccaaaagactttccattctctaggtgctccatgctcttgcccctccatgtgcttgctcatgctcttgcgttggcctggaatgcattctctcaccctcatcctcctggaaaagccctgttcgtcctttaaagccagctcagatgttctttgtgaggactcctcccatcctcagaagctgagttagatatctgttttcctttgccttca

SEQ ID NO: 192604 - DNA, 601 bp, Human
tcacctggactgtggcagaagcttcctaacaaccaccttactttcccttccagtctgtcacactacactcttggatatttttaaaataggggtctgatcatctcatttgcccgccttgaaatcctcaatggtgccattcagacttttctaacatggcacatcacctcagtttaccttgttgatccagctttcctgcccctctgcttactttctgtctgtcccaaaagactttccattctctaggtgctccatgctcttgcccctccatgtgcttgctcatgctcttgcgttggcctggaaygcattctctcaccctcatcctcctggaaaagccctgttcgtcctttaaagccagctcagatgttctttgtgaggactcctcccatcctcagaagctgagttagatatctgttttcctttgccttcactttgtacatctctgtcatgggtgggatacagattgtggggatgtggaatagctgaggtcttggagaattaaaaggaaaagagtagagaactgaaaactacacaatttgtgaacctgtgccattaagcctgcatcttttctgattttctgggtgtgtttttttttttttggagt

SEQ ID NO: 192605 - DNA, 601 bp, Human
tccattctctaggtgctccatgctcttgcccctccatgtgcttgctcatgctcttgcgttggcctggaatgcattctctcaccctcatcctcctggaaaagccctgttcgtcctttaaagccagctcagatgttctttgtgaggactcctcccatcctcagaagctgagttagatatctgttttcctttgccttcactttgtacatctctgtcatgggtgggatacagattgtggggatgtggaatagctgaggtcttggagaattaaaaggaaaagagtagagaactgaaaactacacartttgtgaacctgtgccattaagcctgcatcttttctgattttctgggtgtgtttttttttttttggagtcttggtctgtcgctcaggctggagtgcagtggcatgatcttggctcactgcaacctctgcctcctgggttcaagctgggattacaggtgtgtaccaccatgcccggatattttttttgtatttttactagggatggggtttcaccatgttggtcaggctggtctcaaactcctgacctcaaatgatccacctgccttggcttcccaaagtgctgggattacaggcatgagc

SEQ ID NO: 192606 - DNA, 601 bp, Human
gtagctgggaccacaggcatgcaccaccatgcccagctaatttttgtatttttagtagaggcagggtttctccatgttggccagggcattcttgaactcctgacctcaagtgatctgcctgccttggcttctcaaagtgctgggattacaggcatgagccactgcacccagctggatatttaaactttaaacagtgtggtgcttaaaatttgtgagaggagattttagacctgggaataatcaacaaaatctagtagagttactggcgtggacaactggatggaatccgaagagacagtgytttggaggggtaggggtggacaaaggtatggagttgggaccaacttggcttgtatgtgagatagtaaattgtcttatggaagagaagattcctggggagactggaaagcaaggttgaatcctctgtgggatgtgaaagaggttggtcttgataaggttagacctgagggaccagccacttatgagcaagggaacagcatgaggatggtggtcattccggaagtggaatgaggaataggtgggagtggctacaggaagcagggttgaaagtaattcacatattgtatcatttgtgtaaagc

SEQ ID NO: 192607 - DNA, 601 bp, Human
tagtagccatgtgacttcagcaaatgctttaatgtcactgaattcctgtgagccttggtttccccctctgtagtagtgccttaccttgcagggttgttgtaatcacagctgcccattcaacatatcttattgctgtcctctctggaactctcctctccctagctctcacttttaagctagtggatctgtagcagaggtacttgcccttttatcagtggtttagtgagcggttcccttcgagaagaagatgaaatggcatttacggagtcttggggttgccgaagagagacatcttttactyggtaattctgcataaggctctccccaacagtgaaagcttttgctggcctctttgatgggaactctgttctgggccattattcatactcaaattcagatcagagggatgggcttttatgggttagcctggaaattcaatcttcatgtttatcagggggatttcatcctgaagaaaatcatcacttttaaaaaataaaataaaaataagaaatgactctaaaaggtgtactgttgacaaggtggtttcacattttctttttgtatgtgtaagccgggaactgctgcaggtgctcagttgagt

SEQ ID NO: 192608 - DNA, 601 bp, Human
atgtcactgaattcctgtgagccttggtttccccctctgtagtagtgccttaccttgcagggttgttgtaatcacagctgcccattcaacatatcttattgctgtcctctctggaactctcctctccctagctctcacttttaagctagtggatctgtagcagaggtacttgcccttttatcagtggtttagtgagcggttcccttcgagaagaagatgaaatggcatttacggagtcttggggttgccgaagagagacatcttttactcggtaattctgcataaggctctccccaacagtgaaagcttttgctggcctctttgatgggaactctgttctgggccattattcatactcaaattcagatcagagggatgggcttttatgggttagcctggaaattcaatcttcatgtttatcagggggatttcatcctgaagaaaatcatcacttttaaaaaataaaataaaaataagaaatgactctaaaaggtgtactgttgacaaggtggtttcacattttctttttgtatgtgtaagccgggaactgctgcaggtgctcagttgagtgtgttcgtatgccgatggtttccatgttccc

SEQ ID NO: 192609 - DNA, 601 bp, Human
tactgcattaacatttcaacatttatttatttatattttttttagagatggggtctcgctatgctgcccaggctggcatcgacctcctgggctcaagtggtcctcccgcctcagccttttgagtagctgggactacaggtgtgcaccaccatgcctgctgctggattaatatttctggttttttcttaacatttcatggccacagatgttttatcagtgtttagcagtaaggcctatactctcctgggattacatgcgtttgttctttcctacttagtttatgtgaacacatttacttcamtggatctgctgttgaaaccaagattttggattttgcaactattgtatgctggtaattctgttttactggtgacctgtttggttattccctgctatccagtctattttctttctttctctgtttatttgttttttgagacaaggtctcactctgttgtccaggctagagtgcagtggtgtgatcttggctcactgcaaccttgacctcctgggcttaagtaggtctcctgccttggcctcccaaagtgctgagattacaggcatgagccactgcgcccagtcctatcttctgatagtgctt

SEQ ID NO: 192610 - DNA, 601 bp, Human
gatctgtgctctggttattggaacactcatgtctttcattcggacatggaagtacctgagaggttgaattaataggtaggtggtggcttgatgaaagcaaaagttgggcagagacaggagggtgctcttatggactcagtaatgaatcagaaccattaggagttgtcctcacttccacccttttccacatgcctctacatctaatccacctcctgggctagtgcgctctatcctaaaattatatcctggctgggcgcggtggctcacgcctctaatcccagcactttgggaggccaaggcragcagatcacctgaggtcaggagtttgagaccagcctagccaacatggtgaaactccatctctactaaaaatacaaaaattagccagcatggcggcacacgcctgtggtcccagctacttgggatgctgaggcacgagaatctcttgaactcgggaggcagaggtgcagtgagctgagattgcgccactggactccagcctgggcaaaagagcaagactccgtctcaaaaaaaaaaaattaaataaataaataaaaaaaataatatcctgacactgcccgtttccctgtctctgctgtca

SEQ ID NO: 192611 - DNA, 601 bp, Human
aaagcaaaagttgggcagagacaggagggtgctcttatggactcagtaatgaatcagaaccattaggagttgtcctcacttccacccttttccacatgcctctacatctaatccacctcctgggctagtgcgctctatcctaaaattatatcctggctgggcgcggtggctcacgcctctaatcccagcactttgggaggccaaggcaagcagatcacctgaggtcaggagtttgagaccagcctagccaacatggtgaaactccatctctactaaaaatacaaaaattagccagcatggyggcacacgcctgtggtcccagctacttgggatgctgaggcacgagaatctcttgaactcgggaggcagaggtgcagtgagctgagattgcgccactggactccagcctgggcaaaagagcaagactccgtctcaaaaaaaaaaaattaaataaataaataaaaaaaataatatcctgacactgcccgtttccctgtctctgctgtcagcccccttccctcctcctcctgccatcttccccaggctaagccaccatctggccttgtttagacagaggctgtctaaaagaactttctgagat

SEQ ID NO: 192612 - DNA, 601 bp, Human
ctacatctaatccacctcctgggctagtgcgctctatcctaaaattatatcctggctgggcgcggtggctcacgcctctaatcccagcactttgggaggccaaggcaagcagatcacctgaggtcaggagtttgagaccagcctagccaacatggtgaaactccatctctactaaaaatacaaaaattagccagcatggcggcacacgcctgtggtcccagctacttgggatgctgaggcacgagaatctcttgaactcgggaggcagaggtgcagtgagctgagattgcgccactggacyccagcctgggcaaaagagcaagactccgtctcaaaaaaaaaaaattaaataaataaataaaaaaaataatatcctgacactgcccgtttccctgtctctgctgtcagcccccttccctcctcctcctgccatcttccccaggctaagccaccatctggccttgtttagacagaggctgtctaaaagaactttctgagatgatggaattgttttgtgtctcagctgtccagtaaggtagccactagccatctttggctgttgagcacttgaaatgtggccagtgcggtagaggaactgaat

SEQ ID NO: 192613 - DNA, 601 bp, Human
tccctcctcctcctgccatcttccccaggctaagccaccatctggccttgtttagacagaggctgtctaaaagaactttctgagatgatggaattgttttgtgtctcagctgtccagtaaggtagccactagccatctttggctgttgagcacttgaaatgtggccagtgcggtagaggaactgaatttttaatttaacttaatttaaatttaaatatgcacatgtggctggtggctaccatattagacagtgtgggtctagactatagcctctcaaatgtatattttcttgacccccccctccataattcttccacagtagccagagtgatctttgaaaaatgtagatgagatcatggcacttctcactttagaagcctccagtggctttgcttctgcccagtgtgcacccagctctcccctggcgtgccaggcttccttgagctgacctttgcagccctctcctcctgtactgtcgccacctttttctcatgcttctccaggaccctgctggcttcctaccctcaaagcagtagccaagccttttctggagttgggacctttgcacatgcttttgcatctggagagggtactcttcctt

SEQ ID NO: 192614 - DNA, 601 bp, Human
gggcaccacccttgctgggtctctgatgtcttgcattgagggactgaacacattccttctgccgctcacccccatggccttcttttgcctctagagaagacatcacggcctcactctcacggcttcttttccattctccacattgagcatccccttttgtaaacatgagtgggagccaactagagtacagtgttcccgattagtttcatttttcccagttgtaatcacagtctcatttgcctccctgaggttacacgccgtatcacctctattttacttgttcctgaatttcctcagctayaaatctcaagatattctcttattaatatcaaattattggccgggcgcagtggctcatgcctgtaatccagcaatttttttatttttttattttttttgagacagattctcgctctgtcacctaggctggagtgcagtggcatgatctccgctcactgcaacctctgcctcctgggttctagcgattcttctgcctcagcctcccgagtagctgggattacaggtgtgtgccaccatgcctggctaatttttgtatttttggtagagacggggttttaccatgttggccaagctggctcga

SEQ ID NO: 192615 - DNA, 601 bp, Human
tcttttgcctctagagaagacatcacggcctcactctcacggcttcttttccattctccacattgagcatccccttttgtaaacatgagtgggagccaactagagtacagtgttcccgattagtttcatttttcccagttgtaatcacagtctcatttgcctccctgaggttacacgccgtatcacctctattttacttgttcctgaatttcctcagctataaatctcaagatattctcttattaatatcaaattattggccgggcgcagtggctcatgcctgtaatccagcaatttttttatttttttattttttttgagacagattctcgctctgtcacctaggctggagtgcagtggcatgatctccgctcactgcaacctctgcctcctgggttctagcgattcttctgcctcagcctcccgagtagctgggattacaggtgtgtgccaccatgcctggctaatttttgtatttttggtagagacggggttttaccatgttggccaagctggctcgaactcctgacctcaggtgatccgtctgtctcggcctcacaaagtgctgggattacaggtgtgaaccaccatgtccggccaa

SEQ ID NO: 192616 - DNA, 601 bp, Human
cacggcctcactctcacggcttcttttccattctccacattgagcatccccttttgtaaacatgagtgggagccaactagagtacagtgttcccgattagtttcatttttcccagttgtaatcacagtctcatttgcctccctgaggttacacgccgtatcacctctattttacttgttcctgaatttcctcagctataaatctcaagatattctcttattaatatcaaattattggccgggcgcagtggctcatgcctgtaatccagcaatttttttatttttttattttttttgagacwgattctcgctctgtcacctaggctggagtgcagtggcatgatctccgctcactgcaacctctgcctcctgggttctagcgattcttctgcctcagcctcccgagtagctgggattacaggtgtgtgccaccatgcctggctaatttttgtatttttggtagagacggggttttaccatgttggccaagctggctcgaactcctgacctcaggtgatccgtctgtctcggcctcacaaagtgctgggattacaggtgtgaaccaccatgtccggccaatcccagcactttcggaggccaag

SEQ ID NO: 192617 - DNA, 601 bp, Human
aaaaatactatgtacttatttttctatcagtaaatactcatccacaagtcaattttaaatagctgaagagtgttacatttcatggaggtaccataaattatttggcaaatctgttcttggccatttgggttacttctttttataattacaagcagctcatttggttaatttttttttcctgtccgctcttttttgagtcgatgttctagaaaatacggtgttctggtcttcttggccttccttttccaagggtgtgtgagtcaccgtcttcccgcggtgttagtatgtgatttgtcctggygtggatttgttgtgactccatctacctacatcatgtttctctttgcagcaatgaccgcttgttttccacaggagacactgttctgtagttataaaaacaagtgttacgcagcgactgtttcctgagcgcgttgctcacataagctcatgctcccttcctgtcttccagtgggaaggctggttgccaagaaaacatcatcataaacaaagttctctgaacacctaccgattgacaaagtagtgtatttttatttaaaatgactattcacttgctactctgaaacatgttgcaatcttgacc

SEQ ID NO: 192618 - DNA, 601 bp, Human
agttataaaaacaagtgttacgcagcgactgtttcctgagcgcgttgctcacataagctcatgctcccttcctgtcttccagtgggaaggctggttgccaagaaaacatcatcataaacaaagttctctgaacacctaccgattgacaaagtagtgtatttttatttaaaatgactattcacttgctactctgaaacatgttgcaatcttgacctttatatttgccaccgttttaacattcttttaaacggcaggcaatataaaatcagtgactttgtctttgatgttatttctgaatagyacatagagggatacaatacaaagtagcaaatgaatggctaagtatatactgtatgtatattgaaatgcattgaagacaggattttaacaatacatggggcttctaatgctgctcctttctttttctttttttttctttttttttttttgagacagtgtgtcgctctgttgccagtctggagtgcaatggcgcgatcttggctcactgcaatctctgcctgccgggttcaagcaattcccctgcctcagcctactgaatagctgggactacaggtgtgtaccaccatgcgcggctaatttt

SEQ ID NO: 192619 - DNA, 601 bp, Human
cattttaaattcagatcagaagggcactgaggaatagtttgagagagagagacccaataacaaatagtggagacaaaaactatcattcatcctacaaaagtttgttcaatcctgccctgtagcaggtactgtttttgggattcagtggtgaatatgacacagttttcctgcccccctgccctgtaccaggtactatttttaggattcagcaataaatgatacaattttcctgccttcaaggagcaaatgtgtatttcagcttctaaaggtactggcggcaaactcaaggaagcctgggttkctcatagcgatagatttcaatgagcatgacactgattgtgaaatgaaagcagatttagggtcaaggactgtcagaagaggggctgagcagggagatgtgggagtagttcctgggcagagactggcagagtgtggcgtttgggaagcgcctgcagtgaggaggcattgatggggctgctgtgaaggctgcaggcctgaccttgtgtcctgaaagtcttttagataatgctttcctggcgggtgagacactcttagacttgggccgagttcacctagccctagacaagtgctacctaaagtg

SEQ ID NO: 192620 - DNA, 601 bp, Human
gtctctttctgtcacccaggctggatggcacaatcatggctcactgcaaccttgacctccctgggctaaagtgaccctcccacctcagcctcctaagtagctgggacaaaaggctggctaatttttgtattattatttttttgtagagacagggtttctccatgttgcccagactggtcttgaactcctgggctcaaacaatctgcctgcctcagcctcccaaaatgctgggattggatgctgttttgaagtcaagctttaaaaatttcatttgcaagtgtttgttgctaatgtctgaaaytgcagttgactctggtctattaacttgtatcctgtgatcttgctaaattcacttattgctcttactagttgttattttcactagtgtgtgtagattccttagaattttcaatatggcctgtattgtcattaggaaatagagaccactttacttctttctttgtgatctttataccttttatttatttatttatttagtttgcttattgcaatgtatatgctacagtaggaggcacatacttgagttaatgctgttaaatgttcacattgtgagaggactgtttatatcctcacttagaaa

SEQ ID NO: 192621 - DNA, 601 bp, Human
tttgtattattatttttttgtagagacagggtttctccatgttgcccagactggtcttgaactcctgggctcaaacaatctgcctgcctcagcctcccaaaatgctgggattggatgctgttttgaagtcaagctttaaaaatttcatttgcaagtgtttgttgctaatgtctgaaattgcagttgactctggtctattaacttgtatcctgtgatcttgctaaattcacttattgctcttactagttgttattttcactagtgtgtgtagattccttagaattttcaatatggcctgtaytgtcattaggaaatagagaccactttacttctttctttgtgatctttataccttttatttatttatttatttagtttgcttattgcaatgtatatgctacagtaggaggcacatacttgagttaatgctgttaaatgttcacattgtgagaggactgtttatatcctcacttagaaattccagatacaatgttagagaatttgattattagaaaattgtttaagttaacaatctttattggagttttaaacaattattggaattttaaacaattttttggaatttaaaaaattttattgg

SEQ ID NO: 192622 - DNA, 601 bp, Human
ctccagcctggggaacagagtgagacgctgttgaaaacaacaacaacaacaacaacaacaacaaaaagaaagagagagagagagaaagagaacaatatacatgaagcatatcagacatgcaataacgtgcattataagatttcatcctttattatgtacttattgttattgcagattgagtatcccttatctgaaatgcttggcactagaagtgtttcagatttttaaattttttggatcttggaatatttgcattatatttactagttcagcatccctaatctgaaaatcggaaatccaraatgctccaaaatctgaaactttttgaacagcaacatgatgctttaacaaaaatgctcattgaagcatttcagacttttggattagagatattcaagctgtatttattacatttttttttcccccaagacagagtcttgctttgtcacccaggctggagtgcagtggcacttagctcactgcaacctccacctcccaggttcaagcgattctcctgcctcagcctaccgagtagctgggattacaggcacgcaccaccacgcccggctaatttttgtattcttagtagagacggggtttc

SEQ ID NO: 192623 - DNA, 601 bp, Human
ggttcaagcgattctcctgcctcagcctaccgagtagctgggattacaggcacgcaccaccacgcccggctaatttttgtattcttagtagagacggggtttcaccatgttggccaggctgttcttgaactcttgacctcgtgatccgcctgtctcagcctcccaaagtgctgggattacaggcatgagtcaccgtgcccggcgctacattgttatagtttattcatgaatactgtcaaatatcatgtgtcaccaaaagaagggaataatatctttgaagaaccctttcctgctaaaaggrcctaaaactttgcattcctcaccaatgaatgaggaagaacgataataaaatatcacagtgaaaattttgccaactttcttctatctttctcttcctttgctctattgtcagacaagcatgtttatttcctagagcctctgaggtgagaacctcactgtgaacgtagccagcatttgggaaacgattgctcggctgtccataggagcacttggagccagggctggggtgaagccaccgctgtgggtgtctgtggagctgccgaatagtcattgatgatgactacagtgttgtgaccaagcg

SEQ ID NO: 192624 - DNA, 601 bp, Human
tgcaggggcttaaactatcacaaagagataaatgcaggggttttgggtgccatccaccgagcgcgtcctcaggagctggcggtgcagcttgcctcaatatcttatcagtaggtacattcctggacgtgctttgagtcagtttacactagttacgccttaagggaggggggtgaaagggggctgcaagtgaagaaactaaaatggagtctgtccggctctctgtctgctaggacagagtcacttgggttaaaacaaggtagggtatcacagcaggagcctcggtggccctttgccaggcctygtcttcagcgtttgccttccttccctttccctctttctacatctgactactgggctaggtgtcgtcggctaatgtactttttctctttcttctagaattctgaaggtggactctatgtatgcatgaatacatttttggcctttggaagggaacatgttgaaagacattttcgaaaaactggacagagtgtatacatgcacctgaaaagacatgtgcgagaggtgagagcggcactttcagagaactggccttgatgtcttccctgtaacgttgtctcagtgtgctttctcacgtggaaat

SEQ ID NO: 192625 - DNA, 601 bp, Human
actttttctctttcttctagaattctgaaggtggactctatgtatgcatgaatacatttttggcctttggaagggaacatgttgaaagacattttcgaaaaactggacagagtgtatacatgcacctgaaaagacatgtgcgagaggtgagagcggcactttcagagaactggccttgatgtcttccctgtaacgttgtctcagtgtgctttctcacgtggaaatttgaccatgcccacataacttccgattccctttgacgatgagaaacaaaaacagcactgcttgcaaaatccagagrgtctcccaaaccttatcgtaaccagttttatttttcttcctctaaacttctgattggtgtttttaagaatacatagattgactaattggaaaaaaaaaaccgaaactaggtttaaaaatacagaaaagtacagagacacccatggatccaaaaatcataaaaaaaaaccatttgaatgttcctgcttcagatgtgttttgttttgttttttagtataagaaatagagcttccttaaaaattcaagttccttttgtccctctccctcgccagaagtaaccactgctttgaactttttctgt

SEQ ID NO: 192626 - DNA, 601 bp, Human
aaactggacagagtgtatacatgcacctgaaaagacatgtgcgagaggtgagagcggcactttcagagaactggccttgatgtcttccctgtaacgttgtctcagtgtgctttctcacgtggaaatttgaccatgcccacataacttccgattccctttgacgatgagaaacaaaaacagcactgcttgcaaaatccagagggtctcccaaaccttatcgtaaccagttttatttttcttcctctaaacttctgattggtgtttttaagaatacatagattgactaattggaaaaaaaaaaccgaaactaggtttaaaaatacagaaaagtacagagacacccatggatccaaaaatcataaaaaaaaaccatttgaatgttcctgcttcagatgtgttttgttttgttttttagtataagaaatagagcttccttaaaaattcaagttccttttgtccctctccctcgccagaagtaaccactgctttgaactttttctgtgtcatgcatgccattatattttattaacaaatgcatattcaagaacaatatatagtataactttatatgttttaaagatgtagataaatgctatcatac

SEQ ID NO: 192627 - DNA, 601 bp, Human
atgaagtggcatctaaatatttggcacatctctttgtactttctattctggttttttttttttcttgttggatttgcctatttatatttttggcctatttctttatggatttatctttttcttataagtgtgatgagttatttttacattctggataccaaacctttgtttgttacatactagatttcctttgagtctgtgccttactaaatttcctttgagtctgtggcttgtcgttttactttgtttatgaattattttgtagaatagaagttgtaagttttgaattagttagatttaytaaactttttgtcgtatgagttgtgctttttgtatcttgtctaagaaattgtttcctacctcaaggtcataaagacattttatactagtctgttttcagttgctgataaagacatacttaagattgggcaatttacaaaagaaagaggtttaacagacttacagttccatgtggctggggaggtgtcacaatcatggtagaaggcaaaaaggagcaagtcacatcttacgtggatggtagcaggcaaagagagagcttgtgcagggaaattcccatttttaaaaccatcagatctcatga

SEQ ID NO: 192628 - DNA, 601 bp, Human
ggggacacagccaaactatatcacatttcttacagttgtttttaaatttttatttaagtgtgtgtgaacgtgactgttttaacattttaggtctttaatccatctataacttatttttgtatttgtatgaagaatgggaatctattttttcatattgataaccagttgtttcactattcatagagcagtacaacttttcccagtaatttatagtatcacccttttcgttttatttatttattttttgagacggagtctctctctgtcaccaggctggagtgcagtggcgcgatcttggctyactgcaacctcggcctcctgggttcaagtgattctcctgcctcagcctcctgagtagctgggactacaggtgcgcgccaccatgcccggctaacttttgtatttttagtagagacagggtttcaccatgttggccaggatggtctcgctatctcgacctcatgatccgcccccttcggcctcccaaagtgctgggattacaggtatgagccaccacgcctggcagtatcaccctttacacacacacacacacacacacacacacacacacacacacacacacacattttgtttgtttttt

SEQ ID NO: 192629 - DNA, 601 bp, Human
ctgttttaacattttaggtctttaatccatctataacttatttttgtatttgtatgaagaatgggaatctattttttcatattgataaccagttgtttcactattcatagagcagtacaacttttcccagtaatttatagtatcacccttttcgttttatttatttattttttgagacggagtctctctctgtcaccaggctggagtgcagtggcgcgatcttggctcactgcaacctcggcctcctgggttcaagtgattctcctgcctcagcctcctgagtagctgggactacaggtgygcgccaccatgcccggctaacttttgtatttttagtagagacagggtttcaccatgttggccaggatggtctcgctatctcgacctcatgatccgcccccttcggcctcccaaagtgctgggattacaggtatgagccaccacgcctggcagtatcaccctttacacacacacacacacacacacacacacacacacacacacacacacacattttgtttgttttttgagacatggtctcactctgtcacccaggctggagtgcagtggcgccaccacggctcattgtagcctcaacctc

SEQ ID NO: 192630 - DNA, 601 bp, Human
cagtcatatttgctgatggaggagttttattttctcaaaccttgttgattttggttgttgactgatgcagaggtgatggtctttagaaggaggttctacttttttgcaagtctaagatgtgaatctcacagtctgggacaggcttgtgttctagcaagttttcatgcaacccctccttgttatccttccggcatcatgcaggaagggaggaggcagtgagactaaaataattaaaaggacaccatacaattctgtagagagatttcaggggacctccaggattgttaaaggtgctttgcartaggttttatttcatccctttttgaagcagttaagtggaaagggggaagaaagaggctctgagataatagaggagcgactctaagagaggagatgtgcatttggcatcagtatttggagggacaggtttttgagaaagtgttctgtaatgcagattcctaagatgtgaactgtaaacctgtagtagaagctgtaaaaacttaatgtgagaatcacaaggatgagtcagccttcaaagtcaactattaaaatgtgagaaagcagacttaggactcatgagaggacaaactgagaagcagaa

SEQ ID NO: 192631 - DNA, 601 bp, Human
gtgtttgactaatggtgatttgaaaatttcccttattggaagggccagttttgtttatgcaagtgactactgatttctatatcatataattatggtcatattaagcttctgatatggttttctcaagcgaaaaagtggtttgataatatttgaccaaacaagtttatgtgcctaaatgcctcagattattgtttgaaaggatttgcaaaattgtttccatagtatgatttcatttttgtaaaaaaatcctatacatacatatacatatgtatatacagatatagacatgtatatgtatgtmtgcatgcatgtatgaatgtatatctgtgtgtgtgcacacacttctacacacacatacacatgtgtacatatataactgggagatcagaagagtctggaagaatactccaaactgttaatagtagctctttcccggtaatagaatggaagtgattctgattttcatctttttgcttctctatatttaaactttttctgtaacaaacatgttactgtgatgaaaagacacatgaattatttgaaaagtgaagccattgaaaactgttgtggagctgagtttctttcctggtttgattctcag

SEQ ID NO: 192632 - DNA, 601 bp, Human
gtaacaaacatgttactgtgatgaaaagacacatgaattatttgaaaagtgaagccattgaaaactgttgtggagctgagtttctttcctggtttgattctcagttactctgtgctggatccaaccttgctgtcttctcctgcttctcagctcatgcttttctgtacgaggcttatctgcagttggttcttctaccttggccaatcttccttacttctcaacctgtctttggaccacaacccagtttaaccaactaaacccaaaccaagctagcatgaaccccaaagctgaaattattgartatcttctgatgctttggttattagtcttccagcacctttgcactaatatagatcatatgatttcatttgaattaagtaacgtcagcaggttcttcttgaaggcagaactaactaaacatttcgacttaccattgttaatttttattattttctttggttgaatgaagaagttagctgaccttggcctttaatttttgtgtcttcttttcataagacctggaggtttgatttttttctagtgattattttggttgtagaggatattgtcaggaaactgttttagaaattaatttgaaagt

SEQ ID NO: 192633 - DNA, 601 bp, Human
caggagaattgcttgaacctgggaggcggaggttgcagtgagctgagatcgcaccattgcactccagcctgggcaaagagtgaaactccatctcaaaaaaaaaaaaaaaaaaaaaaaagaaacaaagaaaagaggagaaagaggaaggacaaaatagtctaatctcccagcagagtcaccttgcctttgtcagccttctcatagagcccccaatcagtttacgcctctctggcagaacttggtcacgtggccacatctagctgcacaggagactggaaaataaagcccaccagcgggctcygctgagtaaagttggggtctcttattaggaagaaggggacagtgggtattgggaggcagctagtagcctctgccacagactctttccctcaaagggatgctgggattgtttcctcatggagaggaagataactcagagctctcttgcagtttctctgttattttttggctaggaagtactatttcactggtactgaaatgaaattatgatgctccttcttcggcttcatgaagcagatgtaggtggccaatgctttatcttgggtggaggtgttttattcccattcatttgatgactttg

SEQ ID NO: 192634 - DNA, 601 bp, Human
cactttccctccatattactttgatgttcattcaagtgaaatgacctcagtactagcttttgctgctatttttttttttttaactagcaacgacaattattggtaattgaaaaatcatttaaattctatacttttaaaacatttaggattaaaattttttttcaatatgtacctcatgggtaaagcttaaaattgagaagttataaagggctcctcagtgaaaattaagtttttttcccctcccttccctgtatcctagccacttggttactgcctccagagacaaattttctgtgtgtayatctttgtatatattgtgtattctctcagcgattgtctatacataagtaatgcttttagatttcttttttctgtagtccctagggagccattaacccttcggctcccaaactgtgttctgaggcaccctggagtgctacagtgagctcaccagggcactgaaggatattttaagtctctgagggaacatattggtgctcaaacattgcatgaactaaacacagtgtagttttactattaggttaccctgtattccttccaataactccatatctttgtaaagctggagttttttttagtg

SEQ ID NO: 192635 - DNA, 601 bp, Human
cagatttcacagaagatccccacatggtaccatggtcttgcagccaaagggaagggaaggcacttttggttgtgttagttgtcaggaatagggagaaagtgatgatgatgatggtgatggcagatattgtttgtggagtcccctagtacctaccagatcctgtactagggtgccttaaaactttatcttgtttaatccacttaacagtcttgtggggtagataatatctatggtttacaagaagaatgaacttagaaacaaattttctagggttacatagctagtaaatgccagagtgggktttttttttttcttgtattttatttatgccaggtaagatttgaattaactttaaatgagcatgttttctgtggaaaggagacagataatatcttgtatgagctgaatctgcacacataaacacaagatttatgccctggttacttaaaattgttatatatacaatattataataaagaaaaatttaagaataaagttcactcactctatttccatttgtttaggtttctttctcatttttgtctatgagcataatataaagtctttacagtgaagatgaattttgtgtttttagcattaa

SEQ ID NO: 192636 - DNA, 601 bp, Human
aggtaagatttgaattaactttaaatgagcatgttttctgtggaaaggagacagataatatcttgtatgagctgaatctgcacacataaacacaagatttatgccctggttacttaaaattgttatatatacaatattataataaagaaaaatttaagaataaagttcactcactctatttccatttgtttaggtttctttctcatttttgtctatgagcataatataaagtctttacagtgaagatgaattttgtgtttttagcattaacatagcataaacattttctgttcctacatastctaaataactatgatttaaataatattctattgggttgaatactattttttttttttttctgagatggagtcttgctctgttgctcaggctagagtgcagtggtgcaatctcggctcactgcaacctcctcctcctgggtttaagcaattccctgcctcatcctcctgagtagctgggattacaggtgcgtgccaccacacccggctaatttttgtattttgagtagagacagggtttcaccatcttggccaggctggtcttgaactcctgacctcgtgatccacctgcctcggccttc

SEQ ID NO: 192637 - DNA, 601 bp, Human
tttattaaaacattgaaaccaggcgtggtgattcacgcctttaatcccagcattttgagatgctgaggtggggggattgcttgaggcaaggtatttgagactggcctgagccacatagtgagatcctgtttttacaaaagataaaaaaaattagccaagcctggcagtcctagcttctcaggagggtgaggtgggaggatagctagagcttgggagtttgatgttgtagtaagctatgatcacaccagtggactcaagtcttggcaacagagtgacaccctgcctcaaaaaaaaaaaaaaaagcttagattgcattttagctgtatcttatttattttatttatttatttatttatttatttatttatttatttatttttactacaaactgccctacctttgggaatttaagagcagagctgtacacaaacatatactaggtttttgattgaaaacatacaaggtaataacagaatctagatcctttggttctcaggtgggtgctccattaagtaaaataactttcttctgtctatagagcctatgtttctgtgtgtgttcatgggcctgttcatgtgtaggtttgtgtgcatgtgagtgg

SEQ ID NO: 192638 - DNA, 601 bp, Human
gattgcttgaggcaaggtatttgagactggcctgagccacatagtgagatcctgtttttacaaaagataaaaaaaattagccaagcctggcagtcctagcttctcaggagggtgaggtgggaggatagctagagcttgggagtttgatgttgtagtaagctatgatcacaccagtggactcaagtcttggcaacagagtgacaccctgcctcaaaaaaaaaaaaaaaagcttagattgcattttagctgtatcttatttattttatttatttatttatttatttatttatttatttatttttttttactacaaactgccctacctttgggaatttaagagcagagctgtacacaaacatatactaggtttttgattgaaaacatacaaggtaataacagaatctagatcctttggttctcaggtgggtgctccattaagtaaaataactttcttctgtctatagagcctatgtttctgtgtgtgttcatgggcctgttcatgtgtaggtttgtgtgcatgtgagtggaatagctagctctttgtcaccatagttccaagcataaatatacaaacatgatctgggatgctggcatccctgtg

SEQ ID NO: 192639 - DNA, 601 bp, Human
atttccctgagccttcgtttaacctttaccagagatgaaccaagcaaagaggggacgacttgataggtaacaggctagaggagctcatcttccttactgagaattctccacagctgaggacaatatgactactcacattatagggcttccacctcggatctactaggcaataactcaacactttaagagagggagagggagagagcaagagggagattttgtttttaaataatagctaacatttattgactacctattatatgccaagcctcttgttctcgtttatctcctgtataaactmtgtgagatacatgctattatcttcatgctataaatgagaaaactaaggcttagagagtttatgacttgcccaaagtaacattaagttttggagctagtcttgaacctaagtttgtcaactctaaaaccatacttccatattatgatgttgcaaaaaaaaaccccaagaaaccaaacaaccattccagcctattgttgtgaaatcaggaaccaggtacctgacacatcgtaattaccaatccttgcctttttaagagtttctaagaaattttctttctgagaaattccttctgagaattga

SEQ ID NO: 192640 - DNA, 601 bp, Human
ataacagtctttttatcatgtttattatgttggccttccatgtaacattttgtttggaaaaaaatagaagtgctccactgctgaaacaatagcgacgcagttacaaaaagaacaaagcatttacaaactacagatctgcgggagctctgggattaagtgaaccttcttttcagttttactccctatgtgaactaagactacttcctaggttttagatatttttagctgtgagcttcccccttcctcttcccttctcttttcttccttttcctttctttcgaatccagttttgtggacggascgtaattttcttgaatgacttgaagctggatctgctggtagtgatagagggaagccaggttttgttttccttcgattctcgcgtgctggaagtgggcgcagagttcctgtggggaccctgtttttcctgctctttgctcatttcttgtattgcctgtaccactttgtcctctttccttttttttgttttggtctcccatttctttttctttgttttttttcttttttgagacggagtctcgctctgttgcccaggctggagtgccgtggcgcgatctcggctcactgcaagctccacctc

SEQ ID NO: 192641 - DNA, 601 bp, Human
cccttctcttttcttccttttcctttctttcgaatccagttttgtggacggaccgtaattttcttgaatgacttgaagctggatctgctggtagtgatagagggaagccaggttttgttttccttcgattctcgcgtgctggaagtgggcgcagagttcctgtggggaccctgtttttcctgctctttgctcatttcttgtattgcctgtaccactttgtcctctttccttttttttgttttggtctcccatttctttttctttgttttttttcttttttgagacggagtctcgctctgtygcccaggctggagtgccgtggcgcgatctcggctcactgcaagctccacctcccgggttcacgccgttctcctgcctcagcctcccgagtagctgggactccaggcgcccgccaccacgcctagagatttttttgtatttttagtgcagatggggtttcaccatgttagccaggatggtctcgatctcctgacctcgtgatccacctgcctcggcctcccaaagtgctgggattataggcgtgagccaccgcgcccggcctggtctcccatttcttttcctctttccattctgtgcacac

SEQ ID NO: 192642 - DNA, 601 bp, Human
cacaccttgccttcccagagcctggccacagatggcagtggggccagggtgggttgagtttagacatgcctgttcattttttccctcctcaaaccatgccagaaccaaagccagctctttaggtcccagagtcttctggacgttgcatgactctctctgtagccatctgctcacttgtccctgccaagaggggacatttgtgcttggggtttccatgtcactagggactcggtttccaccattcattcccttttgccccaatctactttatatctaagatcacagaaatcagaattttgtrtgtatttatttattgtgcctcttcttttagtactaagtgcacagtgttcagtagggcatacagaattaaattacctttgctttctccaattccatgttgactcatgtggctgttaccaaggataaaatatattagtggacaaaatggccttacctcatcccattacctgaaattatataccaatgcttatatttctgtaatactgagagttcttactgccttgtttaatataactcttatttctgctgtcagaagagaagaaacattgtgaataaatgttatgataaattattttccttt

SEQ ID NO: 192643 - DNA, 601 bp, Human
caccttgccttcccagagcctggccacagatggcagtggggccagggtgggttgagtttagacatgcctgttcattttttccctcctcaaaccatgccagaaccaaagccagctctttaggtcccagagtcttctggacgttgcatgactctctctgtagccatctgctcacttgtccctgccaagaggggacatttgtgcttggggtttccatgtcactagggactcggtttccaccattcattcccttttgccccaatctactttatatctaagatcacagaaatcagaattttgtgtrtatttatttattgtgcctcttcttttagtactaagtgcacagtgttcagtagggcatacagaattaaattacctttgctttctccaattccatgttgactcatgtggctgttaccaaggataaaatatattagtggacaaaatggccttacctcatcccattacctgaaattatataccaatgcttatatttctgtaatactgagagttcttactgccttgtttaatataactcttatttctgctgtcagaagagaagaaacattgtgaataaatgttatgataaattattttcctttca

SEQ ID NO: 192644 - DNA, 601 bp, Human
ggactcggtttccaccattcattcccttttgccccaatctactttatatctaagatcacagaaatcagaattttgtgtgtatttatttattgtgcctcttcttttagtactaagtgcacagtgttcagtagggcatacagaattaaattacctttgctttctccaattccatgttgactcatgtggctgttaccaaggataaaatatattagtggacaaaatggccttacctcatcccattacctgaaattatataccaatgcttatatttctgtaatactgagagttcttactgccttgkttaatataactcttatttctgctgtcagaagagaagaaacattgtgaataaatgttatgataaattattttcctttcagcccctcatgaataagtctttatgttaaaaaaattaataaaaaagccttttcttattgttgtacttggagtataatttgaaatgtgaatagtcttatttaaaataagagaagtgccatagaaatctgaatccagcaagatatatcatcatttttactatagagtcttttagtattaagaaatactttaagaatgaaaaaagaagagagaattatttggaaga

SEQ ID NO: 192645 - DNA, 601 bp, Human
gagagtgactctataggttctaccagaaagttaaagcacctctgggtgatgctgggttcacagagacatagcactgtgagctcggcaggggtcttagagcttgaaatccaatgccttcatttttgacatcaggaattggagcagtggtgtgcttgtaaatgtttaacaacaggctccctagggaaaaaaagctctgttttgtagtgtctgctgattccatggtgtaaatactcccaccatgactgatttcaggttatcaatatgacgtcactgaatgcggtgttggaaagagattggtagyagcagaccattgtacagaatttccagcattccgctgacatgcatgtaaataaaacctcaagaacacatagataataatgagatacagtaaaacaattaggaagtgaagaatttttgattatatgtcaccttttgaaaacattttatttagtcgtaagtttttatgatttaacgttttataatggctgtgtttagcaaccatcttgctgaatttcttaaaatttaaagctggactcttatgagccagtttgagccagttccagtgcagaactgaactggaggcttacaaaggcatgggatg

SEQ ID NO: 192646 - DNA, 601 bp, Human
gggtgatgctgggttcacagagacatagcactgtgagctcggcaggggtcttagagcttgaaatccaatgccttcatttttgacatcaggaattggagcagtggtgtgcttgtaaatgtttaacaacaggctccctagggaaaaaaagctctgttttgtagtgtctgctgattccatggtgtaaatactcccaccatgactgatttcaggttatcaatatgacgtcactgaatgcggtgttggaaagagattggtagtagcagaccattgtacagaatttccagcattccgctgacatgcrtgtaaataaaacctcaagaacacatagataataatgagatacagtaaaacaattaggaagtgaagaatttttgattatatgtcaccttttgaaaacattttatttagtcgtaagtttttatgatttaacgttttataatggctgtgtttagcaaccatcttgctgaatttcttaaaatttaaagctggactcttatgagccagtttgagccagttccagtgcagaactgaactggaggcttacaaaggcatgggatggagccaggactagtaccaaggtcttttcgcatcacttgagata

SEQ ID NO: 192647 - DNA, 601 bp, Human
ctccctagggaaaaaaagctctgttttgtagtgtctgctgattccatggtgtaaatactcccaccatgactgatttcaggttatcaatatgacgtcactgaatgcggtgttggaaagagattggtagtagcagaccattgtacagaatttccagcattccgctgacatgcatgtaaataaaacctcaagaacacatagataataatgagatacagtaaaacaattaggaagtgaagaatttttgattatatgtcaccttttgaaaacattttatttagtcgtaagtttttatgatttaacrttttataatggctgtgtttagcaaccatcttgctgaatttcttaaaatttaaagctggactcttatgagccagtttgagccagttccagtgcagaactgaactggaggcttacaaaggcatgggatggagccaggactagtaccaaggtcttttcgcatcacttgagataacatatccagggaaaaatagttcacagtgtgattacaggatgatggatcctgaccttcagctgtcacccataaaaagggcctttaagtgattttggatgatattctgaaaacactggatcagtgtttgat

SEQ ID NO: 192648 - DNA, 601 bp, Human
tcaaaatggaaagaaaaagctaattatacaacagcatttgtagtgggagataaatgggcttttgaaaggcttaactatatttattaagtcccgatctctaatggattataagcttgttgaggccggggacctcctccttgttcctgactgtgagtagctcaatgtcatcaatcagtagtggtcagtataaccttggagagttttaagctggagaaggataggatctaattttcatagcagatcactctggcagatcactctggctgctatgcagagaagaggggcagggctagagggaagkccacgataaggaggttgttgtgaagctatcagggaaccatgatggtggctaggaccaggagaggtggggttggagtggacatgaggcccatcgcagggctgctagaattgcctgtgggctaggtgggggtgaaatggcagctgagggaatttcctccattgtttcttgttccttccttggttctagggtcagaagccaggacccagacacatgggaaactgctactcaggggaaaatgatcagctcactgtgcaggatatgagtgatgtagattacaaattttgttatttatttatttat

SEQ ID NO: 192649 - DNA, 601 bp, Human
gaaaggcttaactatatttattaagtcccgatctctaatggattataagcttgttgaggccggggacctcctccttgttcctgactgtgagtagctcaatgtcatcaatcagtagtggtcagtataaccttggagagttttaagctggagaaggataggatctaattttcatagcagatcactctggcagatcactctggctgctatgcagagaagaggggcagggctagagggaaggccacgataaggaggttgttgtgaagctatcagggaaccatgatggtggctaggaccaggagakgtggggttggagtggacatgaggcccatcgcagggctgctagaattgcctgtgggctaggtgggggtgaaatggcagctgagggaatttcctccattgtttcttgttccttccttggttctagggtcagaagccaggacccagacacatgggaaactgctactcaggggaaaatgatcagctcactgtgcaggatatgagtgatgtagattacaaattttgttatttatttatttatttatttacagtttagtggagtttattatattagagttgggcatccatcaccactatctaattt

SEQ ID NO: 192650 - DNA, 601 bp, Human
ttgggcatccatcaccactatctaattttagaagatttctcttgccccactaaaaaacccataccccttagccatcatcctccagcgcttcctccatgctccgcctgtggcactcactaatctactttctagctctatagatttgtctactctggacctttcatataaatggaatcatgtaatatgttgctatttgtgactgactttttcacttagaatatattttcaaagtttatctatgttgtagcatgtatcaatatttcattcttttttattggcaaataacattccattgtatgtrcatacaacattttgttttacattctatttgttatgtccataagcatttgggttgtttccattatttttattttttattaaaaaaatttttttttgagacagggtttctctcctgttgcccaggttggagtgcaatggtgtgttctcagctcactacagcctctgcctcccaggctcaagcgatcctcctgcctcagtctcccgagtagctgggactacaggcgcatgccaccacacctggctaatttttgtatttttagtagagatagggtttcaccacgttagccaggctggtctcgaa

SEQ ID NO: 192651 - DNA, 601 bp, Human
atagatttgtctactctggacctttcatataaatggaatcatgtaatatgttgctatttgtgactgactttttcacttagaatatattttcaaagtttatctatgttgtagcatgtatcaatatttcattcttttttattggcaaataacattccattgtatgtacatacaacattttgttttacattctatttgttatgtccataagcatttgggttgtttccattatttttattttttattaaaaaaatttttttttgagacagggtttctctcctgttgcccaggttggagtgcaatrgtgtgttctcagctcactacagcctctgcctcccaggctcaagcgatcctcctgcctcagtctcccgagtagctgggactacaggcgcatgccaccacacctggctaatttttgtatttttagtagagatagggtttcaccacgttagccaggctggtctcgaactcctgacctcaagtgatctgctggtctcggcctcccaaagtgctaggattacaggtgtgagccaccatgcccggccccatttttttgattattctaaataatgctattatgaacagttgtgtacaggtttttgtg

SEQ ID NO: 192652 - DNA, 601 bp, Human
taatagagacgggggtttcgccatgttggccaggctggtcttgaactcctgacctcagttgatgtgcccgcctcggcctcccaaagtgctggggttacaggcgtgaaccaccacgcccggccaacaatgtcttgaggggagaaaatggggaagcatcagtctctgttattccactgagcctttgttgtgacctgcctacttgaaaccctctgtcttcttagatgttaagttttaaaattatgccctggctgttctgactactctccaatggctttccagtggttggaagtgtgccagatgygacctgcgagaaaacctctggttgaatctgactgacggctctgtcctgtgtggaaagtggttctttgacagctctgggggcaacgggcatgcgctggagcattacagagacatgggctacccactagccgtgaaactgggaaccatcactcctgacggggcaggtgagtgcgcctttaccgactttgggaacatgcagtggcttcctcttagatttaaccaatccctgaatccaggtggttggaaggtgcaggctctggatgcagacagcccaggtttgaattctaattctgcctcttat

SEQ ID NO: 192653 - DNA, 601 bp, Human
gacatatctaaacatagaaaagatacagcaacaacatggtataaaagatagaaaatggtcacctgtacagggcacttaccgtgaatggaacacgcagggctggaggttgctctgggtgagtcagtgagtgagtggggagtgagtgtgaaggcctcggactttagtgttcactactgcagactataaacaccatacacttggctacactaaacttatgaaaacattgtccttttcaataataaattaacctcttactgtaatgtttttactttatgaacttaatttttttagcttttggacrtttttgtagtaacacttagcttaaaacacaaatacattatacagctgtacacttttttttgttttgttttgttttttgagacagagtctcactctgtcacccaggctggagtgcggtggcgtgatctcagctcactgcaacctccacctcccagattcaagtgattctcctgcctcagcctcctgagtagctgggaggtgccccaaccacgcccaggtaatttttgtatttttagtagagatggggtttcaccatgttggtcaggttggccttgaactcctgacctcaggtgatccaccc

SEQ ID NO: 192654 - DNA, 601 bp, Human
cacctgtacagggcacttaccgtgaatggaacacgcagggctggaggttgctctgggtgagtcagtgagtgagtggggagtgagtgtgaaggcctcggactttagtgttcactactgcagactataaacaccatacacttggctacactaaacttatgaaaacattgtccttttcaataataaattaacctcttactgtaatgtttttactttatgaacttaatttttttagcttttggacatttttgtagtaacacttagcttaaaacacaaatacattatacagctgtacacttttttwtgttttgttttgttttttgagacagagtctcactctgtcacccaggctggagtgcggtggcgtgatctcagctcactgcaacctccacctcccagattcaagtgattctcctgcctcagcctcctgagtagctgggaggtgccccaaccacgcccaggtaatttttgtatttttagtagagatggggtttcaccatgttggtcaggttggccttgaactcctgacctcaggtgatccacccacctcggcctctcaaagtgttgggattacaggcgagagccaccatgcccagccaaattt

SEQ ID NO: 192655 - DNA, 601 bp, Human
gccatatatgcagtccattgttgaccaaaatgttgttattcagtgagtgattgtaattagattctatttaaatgtatgctaataataaaggccaagaattaattctattctttgtgtatctttcgttttctagaagctttcttttctaatgggaaacttattttaaaattgctaaatagagtaactctagtttcttttctttcagttttaagaaagttttatattttcctcttgattttgcaacaaacagatattcagtgtaacatatgtagaaaacagagataaaagtttagataaatcratacaaaatactagtaataccaccctgtagactactcactgttaataatttaggtatttcattttagtcttttctcttttttttaaagggttaatcagttcatacacacacatgtacacacgcacacccacctcacatttttacaaaaatgtgatcatactgtataaagttttattccttatttttctctatttaacattatgtttttctatgctattaaatattcttcagtattttatgatggtttcataaatcatttcactattctgtaagtggttacaattttttttctattctgat

SEQ ID NO: 192656 - DNA, 601 bp, Human
ccttgaggtctcaacttagatttagtttttcaaagaagccctggtccctcagtccaggccagagtggtggcatgcatagcaagaacgggccccacatgaaattctactctgggtccccatgggtacagcaacaaacaaaccaagaagcagatcactacacaaacaaacaaaaagctttcctctgtgggaggacgcattgtttcggcgaggcagggatgaggttcttggtagaaagggagtagggcaggacggagacgggatagggtgtgtttttcttccatcacagaaactagtttacccragaagatgctttagtgtcttgggtgattgtaggagagtcttccagagatgcccaaggcagctgtgaaattgcctcttctattggctgtaccagctccatagcatctcaagctggtctttcttctttggtcatctttacccccgacctgggcataagctcccttgagtttctcccagccccagggtttggaatcagggcacggactacttcatgttagttttggcctggcctcggcccctgctgtgtgcctctgtggtacttcctgctgctctgtcatggtactttccacaagaccctgtt

SEQ ID NO: 192657 - DNA, 601 bp, Human
attttcaccttccagctagtatttaagtggaattttttgatcccttgtcatagattaaaaatactgttgatgtatttgtttcaatttattagttcaaaggtttttgcttattttattaatatttaaacttttggaaatgtttcttaattgggctgagattttgtcttttgtttcgcttttgagaatgctgaattatatttaaaaaatataaatgagggttgctatccacagttatcatgggcctctgggggaagaggaatagaaaagacaactacacaatgtttaacttattaataatagactgaatttctttggggagcagcgagtctccatatatctgggtatgggacagaaggtcacatagcttctatgcattactttttttcctcctggtgatgttccaaggagtagggagctccttggacagtctgtcttatactgtccctaagagtgatatcttcatattcattttccttgttacagattttgtttttcaaatataagagcaaagaaattgtgggttttgagtcttcattccttttaagggcttaggttggttcttcaccaagtctgttggtatcctgttctgatacatacattt

SEQ ID NO: 192658 - DNA, 601 bp, Human
gttggttcttcaccaagtctgttggtatcctgttctgatacatacatttttttcttttttttccttctttagaaactttttttttttttcctgttttttggagacagggtcctgctctgtcacccaggctagagtacagtgacattatcatagcttactgtagcctcaaactcctggcctcaagtgatcctcctgccttggtctcccggagtgctgggattacagatgtgagccatgtacctcgctggtgtcctgatataccttcataaatattctgttgtagagggaagaagattgggcyaggagttagactacctgggttctgggccacctgtggcctttatgagcttcttttccttatctgcaagatgggcttgaaaatgtctcttctgtcctcttcaccacactgtgtgtgaggatggatagggcagcggattggatagctttggaaaaccaaacagtcctccaacttcactgtgcacctgaagatctcgttaaaaatgcagattctcattcagtcggcctgaggcggggctcaagattctgcatttcttttcttttcttttttttttgagatagagtctctctctgtcgcccaggc

SEQ ID NO: 192659 - DNA, 601 bp, Human
atcctcctgccttggtctcccggagtgctgggattacagatgtgagccatgtacctcgctggtgtcctgatataccttcataaatattctgttgtagagggaagaagattgggccaggagttagactacctgggttctgggccacctgtggcctttatgagcttcttttccttatctgcaagatgggcttgaaaatgtctcttctgtcctcttcaccacactgtgtgtgaggatggatagggcagcggattggatagctttggaaaaccaaacagtcctccaacttcactgtgcacctgargatctcgttaaaaatgcagattctcattcagtcggcctgaggcggggctcaagattctgcatttcttttcttttcttttttttttgagatagagtctctctctgtcgcccaggccagtggcacgatcttgggtcactgcaagcttcgcctcctgggttcacgccattctcctgcctcagcctcccgagtagctgggactacaggcgcccgccaccacgcccggctaattttttgcatttttaatagagacgggtttcaccatgttagccaggatcatctggatctcctggtctcgtgatc

SEQ ID NO: 192660 - DNA, 601 bp, Human
atcttcattttataggttttagcttttaattgttgcatttacttcttgcatttaattagtagatgttttcttttggttgccagcttagattttttatgctgtaataaaaatggcacctcatcaagtactcttttggtttagttggagtttacttgcaaaattagtctcctttgatgggcagtcgtgtgaatcattctttgttcgcgaaacgcagatggtgtagggagatgacctttaaaattatctgtgaccaacatcactttcattaatttcagggagggaagcaaagctcctaggggayagaacgaataaaccaacacattactgttgatagagaagctctgcttcatttaatactgtgttttcaaattgatgtcatgactatataatatttttcctttaaggaactatttcaatgtgcatttcgttttagccctttccttccaggtcgcctccctctcttcatgttcctattctctttgtctcctctttgtcactcatttttacttttttgtttagttttttctgctcttctttacacctccctcctttttgtttgctgtgttgcattgaatattcccttgaatttagtctccttgct

SEQ ID NO: 192661 - DNA, 601 bp, Human
tcatgccactgcactccagcctgggtaacagagcgagaatctgtctcaaaaaaaaaaaaaaaaagagcttcgtaaactcaaaaacaccatacaagggtttgttattagtaatggtttctgctttttgaccatcaccctatgtaccaagaatatattaatcattaatcttcacagcacatctgccaattccctcctatagatgcgctaggagagatccggtggtaggtctggttagtgtctctcttgtgggggactggaatttcctgaaggatttagggctttcattttttgctacttacastgtggttcatagactagtgcagctccttatactgctggatgtgggccttcaatgagataagtttggaaatcgagagtgagcattgggaaattgtaacaatttgatgttgctgttgtgttttacaagtggcatttcatttttctaataatttcttggaattgtattttttaacttatttttaattattatgggtacataacaggtgtatatatttatggggtatatgtgatattctgatacaggtacgcaatgtgtaataatcacattggggtaattggggtattcatcacctcaagcatt

SEQ ID NO: 192662 - DNA, 601 bp, Human
cttatttttaattattatgggtacataacaggtgtatatatttatggggtatatgtgatattctgatacaggtacgcaatgtgtaataatcacattggggtaattggggtattcatcacctcaagcatttgtcatttctttgtattaggaatattccaatttcactcttttagttattttaaaatatacgacaagttattgttgactgtagtcaccctgttgtgctatcaaatactagatcttgttcattctacttatacttttttacccattaaccatcctaattgtatttttaaaaagyatcatctgtctgagttgaaataaacaaaaaaactgaccctttaccgcagataatttgagaggcactgatttaggtgctccctgactgtgcttgtacaagactgccttcctcctcctacaccgagggggacagcagctatgtctgtggctgttttcttccttgggtgtactgaggacagggagctatagagcccaggggctgtggctggtacactctcaggcagccactgcctacgtgtagagaatcatcctaatgtgttccagaggtaggtttccaccttagtttaagtgcggaagagga

SEQ ID NO: 192663 - DNA, 601 bp, Human
ttcttttctgctaagcagtgtgctgagtgtgtgggggtcagtggtgaacacaaggacatggtcctcacccccaggcatgaagtaagcaggagatacaggcattaagaaaataatcatagtaacaactgcatgcttataaacatggtacattccatgatggagaaaggagggaggtggtcagagaggagcctatgaagaagggacacacatcctgatgcatgtgcaggaggagtgaagacaggctttatgtttttgagaatttagtatttgaatctctccctagtcttgtttcaagagtctyagaattttatattactaatattttacattctcattctattttctaaacatttactagatatatgagaacatgagcaatgaactattcatacatgtcttcagtcttttcaccctttgaccaaatatcactggattgaaatacttgttcttctcacttctttttcaccagcaggtctaactcagtggagttagattcaggagcagtgtcttcattttgaaagtagaaaaagtgactcagggcctggcatggtggctcatacctgtaaacccagtactttgggaggctgaggcaggaggatta

SEQ ID NO: 192664 - DNA, 601 bp, Human
gagaacatgagcaatgaactattcatacatgtcttcagtcttttcaccctttgaccaaatatcactggattgaaatacttgttcttctcacttctttttcaccagcaggtctaactcagtggagttagattcaggagcagtgtcttcattttgaaagtagaaaaagtgactcagggcctggcatggtggctcatacctgtaaacccagtactttgggaggctgaggcaggaggattacttgaaaccaggagtttgaggccagcctaagcagcaaagttagatcccatccctacaaaaattwaaaaaaaaaaaaaatagccgggcgtggtggtgcacacctgtagtcccagctactcgggaggctgaggtgggaggattgcttgatcccaggagtctgaggttgcagtaagctgtggttgtgccaccgtactcaggctgggcaacagagtgagatcctgtctttaaaaaaataataagaaggccgggtgcagtggctcacgcctgtaatcctagcactttgggaggccgaggtggacagatcacctgagatcaggggtttgagaccagcctggccaacatggtgaaaccccgtctgtactaa

SEQ ID NO: 192665 - DNA, 601 bp, Human
ctcgggaggctgaggtgggaggattgcttgatcccaggagtctgaggttgcagtaagctgtggttgtgccaccgtactcaggctgggcaacagagtgagatcctgtctttaaaaaaataataagaaggccgggtgcagtggctcacgcctgtaatcctagcactttgggaggccgaggtggacagatcacctgagatcaggggtttgagaccagcctggccaacatggtgaaaccccgtctgtactaaaaatacacaaattagccgggcatggtggtgtgtgcctataatcccagctactyaggaggctgaggcaggagaattgcttgagcccaggaggcagaggttgcagtgagccgagattgctctactgcactccagcctgggcaaccgagtgagactctgtctcaagaaaaaaaaaaaaaaaagaaagaaataataataagaaaattaaagaaaggaaagaaaaaaagaaaaatgactcagaaagattaactggcttatgaacagccgtagcataattagggaacttggcctgattccttggtaccctgtctgccatttgaacctagtttacatttcaaaataatttttattgagga

SEQ ID NO: 192666 - DNA, 601 bp, Human
ggccgggtgcagtggctcacgcctgtaatcctagcactttgggaggccgaggtggacagatcacctgagatcaggggtttgagaccagcctggccaacatggtgaaaccccgtctgtactaaaaatacacaaattagccgggcatggtggtgtgtgcctataatcccagctactcaggaggctgaggcaggagaattgcttgagcccaggaggcagaggttgcagtgagccgagattgctctactgcactccagcctgggcaaccgagtgagactctgtctcaagaaaaaaaaaaaaaaaagaaagaaataataataagaaaattaaagaaaggaaagaaaaaaagaaaaatgactcagaaagattaactggcttatgaacagccgtagcataattagggaacttggcctgattccttggtaccctgtctgccatttgaacctagtttacatttcaaaataatttttattgaggattaaatctaaataaactggtatacaaatggaatgacaaccaaggtagattgctagatagcaaaactacatctttttaagaattgctagattacaaacaggaggtataacatctatgaaaattatct

SEQ ID NO: 192667 - DNA, 601 bp, Human
ctcacgcctgtaatcctagcactttgggaggccgaggtggacagatcacctgagatcaggggtttgagaccagcctggccaacatggtgaaaccccgtctgtactaaaaatacacaaattagccgggcatggtggtgtgtgcctataatcccagctactcaggaggctgaggcaggagaattgcttgagcccaggaggcagaggttgcagtgagccgagattgctctactgcactccagcctgggcaaccgagtgagactctgtctcaagaaaaaaaaaaaaaaaagaaagaaataataakaagaaaattaaagaaaggaaagaaaaaaagaaaaatgactcagaaagattaactggcttatgaacagccgtagcataattagggaacttggcctgattccttggtaccctgtctgccatttgaacctagtttacatttcaaaataatttttattgaggattaaatctaaataaactggtatacaaatggaatgacaaccaaggtagattgctagatagcaaaactacatctttttaagaattgctagattacaaacaggaggtataacatctatgaaaattatctagcgtttcttctgca

SEQ ID NO: 192668 - DNA, 601 bp, Human
ttgttttatctgagggtctcgggaggcgacttgtcaacaggcttgagaaggagctgccaagcaaggatctgtgaggcagcatcccaggaaaaagacagcagaaggcatgaccttgagacatgagcaagtctgtcatgccctggggcagcaagagggacaagtggggatgttgtgggctgggggaacacagtggcagatgaggtcagagaagtgggcagagtgggcacatgaagggctggagaaagggatctgcttttggattcttcttcctagagctttcaggcgagagtcaaagacaacrgggaaagaacaacacaaagtagagggtgtgaaataggaagtgaatttaagaagtgaaaggagtgattgtgcattatgattggagatcagtgttaaagctggctttgctctgttaggataagcttgccaggagggattatagagtgctccaggggcagtggatgggcagacacagccagcagagtggttccgaacttggcctggtgcctggctgcatgggtccattctgggcctcattactccctccctggtaggctttttttttttttgagatagggtcttgctgtgtcatccaggctga

SEQ ID NO: 192669 - DNA, 601 bp, Human
cctagagctttcaggcgagagtcaaagacaacggggaaagaacaacacaaagtagagggtgtgaaataggaagtgaatttaagaagtgaaaggagtgattgtgcattatgattggagatcagtgttaaagctggctttgctctgttaggataagcttgccaggagggattatagagtgctccaggggcagtggatgggcagacacagccagcagagtggttccgaacttggcctggtgcctggctgcatgggtccattctgggcctcattactccctccctggtaggctttttttttttttgagatagggtcttgctgtgtcatccaggctgaagtgcagtggtacaatcacggctcactgcagccttgacctcctgggctcaggcaatcctcccaccttagcctctcgagtagctgcaattataggtatgtaccactgcacccagctaatttttaatttttttttgtagagatagggtcttattttgttgtccaggctggtctcaactcttgggttcaagcaatcttcgcccctcggcttccaaaagtactgggattacaggtggcttggagacttttgaagctacctaatgaatttgca

SEQ ID NO: 192670 - DNA, 601 bp, Human
ggggcggccgggcagagacgctcctcacatcccggacggggcggcagggcagaggtgctccccacatctcagacgatgggcggccgggcagagacgctcctcacttcccagatgtgatggcggccgggaagaggcgctcctcacttcctagatgggatggcggccgggcagagacgctcctcactttccagactgggcagccaggcagaggggctcctcacatcccagacgatgggcggccaggcagagacactcctcacttcccagacggggtggcggccgggcagaggctgcaatctcrgcactttgggaggccaaggcaggctgctgagaggtggatgttgtagcgagccgagatcacgccactgcactccagcctgggcaccattgagcactgagtgaaggagactccgtctgcaatcccggcacctcgggaggccgaggctggcggatcactcgcggttaggggctggagaccggccgggccaacacagcgaaaccccgtctccaccaaaaaaatacgagaaccagtcaggcgtggcggcgcgcgcctacaatcgcaggcagtcggcaggctgaggcaggagaatcaggcagcagt

SEQ ID NO: 192671 - DNA, 601 bp, Human
gatgtgatggcggccgggaagaggcgctcctcacttcctagatgggatggcggccgggcagagacgctcctcactttccagactgggcagccaggcagaggggctcctcacatcccagacgatgggcggccaggcagagacactcctcacttcccagacggggtggcggccgggcagaggctgcaatctcagcactttgggaggccaaggcaggctgctgagaggtggatgttgtagcgagccgagatcacgccactgcactccagcctgggcaccattgagcactgagtgaaggagactmcgtctgcaatcccggcacctcgggaggccgaggctggcggatcactcgcggttaggggctggagaccggccgggccaacacagcgaaaccccgtctccaccaaaaaaatacgagaaccagtcaggcgtggcggcgcgcgcctacaatcgcaggcagtcggcaggctgaggcaggagaatcaggcagcagtaccgtccagcttcagctcggcatcagagggagaccgtggagagagggagagggagaccgtggggagacggagaggaagagggagagggagagggagagccaatttttaat

SEQ ID NO: 192672 - DNA, 601 bp, Human
actttccagactgggcagccaggcagaggggctcctcacatcccagacgatgggcggccaggcagagacactcctcacttcccagacggggtggcggccgggcagaggctgcaatctcagcactttgggaggccaaggcaggctgctgagaggtggatgttgtagcgagccgagatcacgccactgcactccagcctgggcaccattgagcactgagtgaaggagactccgtctgcaatcccggcacctcgggaggccgaggctggcggatcactcgcggttaggggctggagaccggccsggccaacacagcgaaaccccgtctccaccaaaaaaatacgagaaccagtcaggcgtggcggcgcgcgcctacaatcgcaggcagtcggcaggctgaggcaggagaatcaggcagcagtaccgtccagcttcagctcggcatcagagggagaccgtggagagagggagagggagaccgtggggagacggagaggaagagggagagggagagggagagccaatttttaatgttaaagagaaaaattacccaaacacttgttaaagatgataaggcagactttattcaagggggtccatggcc

SEQ ID NO: 192673 - DNA, 601 bp, Human
tcctcacttcccagacggggtggcggccgggcagaggctgcaatctcagcactttgggaggccaaggcaggctgctgagaggtggatgttgtagcgagccgagatcacgccactgcactccagcctgggcaccattgagcactgagtgaaggagactccgtctgcaatcccggcacctcgggaggccgaggctggcggatcactcgcggttaggggctggagaccggccgggccaacacagcgaaaccccgtctccaccaaaaaaatacgagaaccagtcaggcgtggcggcgcgcgcctrcaatcgcaggcagtcggcaggctgaggcaggagaatcaggcagcagtaccgtccagcttcagctcggcatcagagggagaccgtggagagagggagagggagaccgtggggagacggagaggaagagggagagggagagggagagccaatttttaatgttaaagagaaaaattacccaaacacttgttaaagatgataaggcagactttattcaagggggtccatggccataggtataggagcactgcaacagggcctggcaatgggggagacattggactcaactctgattccaacaag

SEQ ID NO: 192674 - DNA, 601 bp, Human
taggtataggagcactgcaacagggcctggcaatgggggagacattggactcaactctgattccaacaaggtcaagtggggatttataaacaaggagttgggtggggccaggggatggaaaatcacaaagaagaaacgtcaaggattagctgtttctggctacccagacttaatgggattactgctgaaggcaggccaggctggtcagacagcaaggatgggtgattttcactaaactgacttagcaggatgcttacttaaactggatctacaaggacagagagggaagcccaaggacggrcccagtcaagcagaggcttcagaggagcctgatgatgttttggttaagtcgagtcttgtccctaactgtactgttgtctttatttatttatttttttttgagacagagtcttgctctgtcatccaggctggagtctggtggcatgatcttggctcactgcaacctccacctccagggttcaagtaattctcctgcctcagcctcccaagtagctgggattccaggcacgtgccactgcacctggctattttttgcatttttagtagagatggggttttgctgtgttagctaggctggtct

SEQ ID NO: 192675 - DNA, 601 bp, Human
tagcaggatgcttacttaaactggatctacaaggacagagagggaagcccaaggacgggcccagtcaagcagaggcttcagaggagcctgatgatgttttggttaagtcgagtcttgtccctaactgtactgttgtctttatttatttatttttttttgagacagagtcttgctctgtcatccaggctggagtctggtggcatgatcttggctcactgcaacctccacctccagggttcaagtaattctcctgcctcagcctcccaagtagctgggattccaggcacgtgccactgcaccyggctattttttgcatttttagtagagatggggttttgctgtgttagctaggctggtcttgaactcctgacctccgatgatccacccgcctcagccttccaaagtgctgggattacaggtatgagccacagcacctggcctctgtaccactgtcatcgaggtggtgattattgtgatggcttagccagtggttcttaactctggttgcgtgttagaatcactcagggaacttttaaaagaaattccaaatcccaggcctcagtctcacgcaatgaaattggaacatttaggggtgcttctg

SEQ ID NO: 192676 - DNA, 601 bp, Human
aaaagcatccaataaaatgttcatagtggatatctctgggttgcaaaattaaaggcaattcttcatgtatttttaaaaaagtgttccaaaatgagaatgtgttacttttataagaagataaagttatctacaaaggactgaagaaaatttgaaactggtatcagtatgaagcagaatcaaataaataagttatttgtgtgtaacgcagatcaaatgctccacctaacagcagttgtacttattgatattcatagataaatttaatattactatggaaaaacaacaatgacctttttgtttytgtttctctgtcctggccaggactaagttaggacatggccttctctcaggccagtattcaaagcctccggtgaaatctgaactcattgaacaggtgatgaaggaggagcacaaggtatgtgtccgagcgtttgccatgttgacatgtaggtagggaggagctttagaatgtgggtttcctatgatttggcacatggtggccataaatttagcaagctgtcagaatagtaatgtcatttcagtgtctagggtgcctgtctgtatgctcttaaaaattgtgacaaggaatagccagggttgt

SEQ ID NO: 192677 - DNA, 601 bp, Human
cacatagattccttagtccctccgtaggactgaggaatcagaatttcaggggagggcttggcattcctcaggtttggtaagctgccgggtggttcttaagcaggctcaagtaggagaaactccgtgggccagtcgttactaattaatagaaccactgaaagataggcttgatgttttaatggccagacctgcatttccactggaccctccctatgctgcttgttgtacaactccagagggtactactcataacttggtctttttgagtggtgcccttggaattgtgtagtgcacagcttaygcatctgtgtttggcaccgtcctctcccgttgccacagatgccctgagtggaacgcgtgccccacttccccgccacctgctctggcttcctagtatcctgtcttgacttactgggcaggctcgttcagttctgtgtctcaagtgtttatcttaaggcagtccttcttagccaatacctgtagactgagagcaagaatcaacagtgaataaataccctcttgttcatcaggaagccagctagttgtggaaatggagcaagcaagagaagggagattgtggaaagaacatatagaggcagcc

SEQ ID NO: 192678 - DNA, 601 bp, Human
tggaattgtgtagtgcacagcttacgcatctgtgtttggcaccgtcctctcccgttgccacagatgccctgagtggaacgcgtgccccacttccccgccacctgctctggcttcctagtatcctgtcttgacttactgggcaggctcgttcagttctgtgtctcaagtgtttatcttaaggcagtccttcttagccaatacctgtagactgagagcaagaatcaacagtgaataaataccctcttgttcatcaggaagccagctagttgtggaaatggagcaagcaagagaagggagattrtggaaagaacatatagaggcagccttggggatggggagaaagaagtaggttgtaaagagggtggagagggaaacagacattctgaatggcaagcccaggagaccagaggggtatgggaataggaagaactgaagttctcaagttgcattgttacccagcattgtaagatagcaaggtccttatccaccagaggctggaaggctcccatctgagatacagttgaggaggtggcttgagggtagggctggagtatggggttatccaggcttcttctacttctgtgcttctgtgaaactttga

SEQ ID NO: 192679 - DNA, 601 bp, Human
actcaggagcctggctttcccttctggttctgcaaggagttgtgtgactatgggcaagtcatgccaccttccaatctcaccattcaagtggcagaattgatctaggtggtggtggtgaatgttttaggcccaggagtcccctttctaatgtaaataaaatcatggaccttgcgtgaccgtttctgtgctcttgggatctcctcatttgagaaaatgtgaaatgaaaaatcatcaatttagtgctgtttggaaataaaatttggttttgttaatattacagtgtccttttatgttaaaaaaagtagttcttatatgagcaaggcacactatctatgcagtctacaagtagtatctgtttggagcccttgtctctcttcccccactggattcggtggctgtagtgtagtagctccttacatctccagggtctgaggcttgtaggtgggagccactgctctggatcaaggtatgtgacctggaagcacttgggccatctctgggatgtgttttgcttggtccacacataaaatctaaatttccatcttctcttaaccattcagaacgtctgacagtcccaggcccgcaatgacagctggagcca

SEQ ID NO: 192680 - DNA, 601 bp, Human
agttcttatatgagcaaggcacactatctatgcagtctacaagtagtatctgtttggagcccttgtctctcttcccccactggattcggtggctgtagtgtagtagctccttacatctccagggtctgaggcttgtaggtgggagccactgctctggatcaaggtatgtgacctggaagcacttgggccatctctgggatgtgttttgcttggtccacacataaaatctaaatttccatcttctcttaaccattcagaacgtctgacagtcccaggcccgcaatgacagctggagccaagrggcagccctcccttcacacaggacacacagtccccagctggctccggtccctttgtgactcatgacctgactgggactctgggtatttggatttgtgacccttgatctagatgacttgtgaaatcctttccagccctcaggtgccacgatctagtggtcttgaagaaagaatcttgattatgagaagcatatatgtgcatctaggcaggggcagggagggcccatccagctgggtgggagacaagtcggtctttggtccagcatcggtaatatttctttaacactcaaatagagctcaca

SEQ ID NO: 192681 - DNA, 601 bp, Human
tttccagccctcaggtgccacgatctagtggtcttgaagaaagaatcttgattatgagaagcatatatgtgcatctaggcaggggcagggagggcccatccagctgggtgggagacaagtcggtctttggtccagcatcggtaatatttctttaacactcaaatagagctcacattgaccatgattttccttgtggccctgggggtgtccgtttcaagctgttccttgaatagacaaataatttacagcaaaaatctccactttccttgacagtagaaggaattagtttctcaggcatcasgattttcactggcagttggtttcaaaggaaccaatttgtgagactctttccttttctcagttatcagaagccctttggaaggatggtcctgtcccaggcctctggtgtttgtgacttatagatgagcctgaaatgccccaagagagggaaagaagattcactgaaacagagaaggggatagatgatgagaggaatgtatggtgtgggggagagagcatgaaggatgggtcagagccatgtggcagaaacgcctttttacggggccaccaccacgcatggtcttaataactagcatcacat

SEQ ID NO: 192682 - DNA, 601 bp, Human
ggacaggcagacatgtgtctatcttccttttatcctgtggtttaaaagtatctgtgcaagtattgctgtgatgtgataaaagcctcagtcttgctgcttgcttattaattaaagcattcggctcaggggaatatggtggactgtgtctggctgtctgtgtggtgcactctgttaaacagaaagtcctgtgtaagcatttgggagagattctgaacactgaaggcctccctctaattttagctgatctgttttgcaattgctgatggagaaagtaagtacagtatcttattaatatgacagrttccttagttggatgctattttggtgacttcctgggtctctgtgttataaagttagtggtcaggactagccattgcctcaggtgtctgagagccagctctcaagtgagagtgtgtgttccctgaaggcagggccgactcttggtcaagttgggtctctgcctctcatcttgtgaggtgttgggcccataggggacactcaggtgatgtcactggctcattgctaaatgggaaacatgctttctgtaatctaattctttggttcttattttggatttttggtttcttttagggaactgcct

SEQ ID NO: 192683 - DNA, 601 bp, Human
gtggagaaataactgttggactggcttgtgatgttggccctagagttgtgtaggcttgaagaagggttatgcagactcttgatgtgttgtcttctctttagcagctagtaggatggactcagggacctcagaaatgagatgttggcacatgtataccaaaaacagcataaggacactagagaaagggagtggagagattttttagctttgtgaccctggacttaataactctgtgcctcagtttccccatctgtcaagtggagaaaatcatcatcaccacctcatggggttgggtgagttmagaaaaatatatatgtaaagtgttaagaactgtgcctggcacgtagtcggtattcatccaagcacctgagattttatagctctcagtaaatatctgcttaatgagtacataaatgttagccattatatgaagctagggcattattattgcatgctcgtgtcagctgatactatgtgatatatatcagcactgtgaatgaagaaagtcacaatttttacataggtttcaggaggtgtatatacaggtagtaaaattaattgtcaggtagtaaaattaattgcgctttggctagcgctggaa

SEQ ID NO: 192684 - DNA, 601 bp, Human
agcactgtgaatgaagaaagtcacaatttttacataggtttcaggaggtgtatatacaggtagtaaaattaattgtcaggtagtaaaattaattgcgctttggctagcgctggaagcacaactgaagccgtgtatgtgtgtaagctggtcatttatatacaggttgttagtccttagatgcccaaatgctgccactttgaggaattctttgagagctaccagtggtgtttcaggtcctctgtggtgttccctaacatttgttatcgatgcgtgtgtatgtctctcatctcctctgttgtcygtaagctcctagaaggcagaatctccaatagtgctctgcatgaagcaggcagtcactaaatactaaatgcccagaccagattatgttttcagcaagacagggaaattcatcagatttttattagaaaacactgcatagaacatgtgtgttggagggatgttatatatggagctgcctctttgtcgcagggagatagataaaggagttttctcatcagctgttgcatatgactgtgattctgcaaacgtgtcatcgtccccagactataggcatggacctccatgagaattcgaggaggtg

SEQ ID NO: 192685 - DNA, 601 bp, Human
ttgggtgttaagaccactttgagttgaaaggcctatctggcacttctctgccagtctcagcttcccgagtgaagataagactagtgtccgctttctagggttactacaagtattaacgagacagtaggtatcaccattagtagatgggctgaacttggaggaaacatttgggaaacagctttatcaggtgcacatctttattgccaaaggtgatgtggaatcttcctacctgcctcttcagagcatcctgggcagatcccctagattccttgtgattttctgtaggttacccgtattaaaragccagttttagtcttcttcattctacctagctcaagagtttcagaaaacagcagtgctgaagcattagtgtcagcatctaattttgttttgttttgttttgtttttggttgtgggggcggtctttgctccacttatttgcctctttccacccgctgctggcccctccatagtcaagggtcaaggggattggagattagagaagtaggcagagtcttttcacttgccaagtgctggtgggctccctctgggctgccacatgtctcctgtcatggctggcttttttgtgggggaacattgg

SEQ ID NO: 192686 - DNA, 601 bp, Human
tgctgaagcattagtgtcagcatctaattttgttttgttttgttttgtttttggttgtgggggcggtctttgctccacttatttgcctctttccacccgctgctggcccctccatagtcaagggtcaaggggattggagattagagaagtaggcagagtcttttcacttgccaagtgctggtgggctccctctgggctgccacatgtctcctgtcatggctggcttttttgtgggggaacattggtggttctttagagctgcctccccgcaactgttataccaccctcagggaccttacarggacctttccctgatgctctgtccagctggcctcggcagccgtcacctcctcctgccctgagccttctccactggcagatagcctgcccacttctgtagggtcctgcatggggcatttggctgccttctgagctgtcctgctggtcccccacgaaatccagcatcctcgtcctgccagagttgccctgctgcctgttcttcccccgcagcctttctagcagctgcagccaggtgaggggcaagccctctacaagctcctggaactccctgtgctctggtccagaaacagtatggggtggg

SEQ ID NO: 192687 - DNA, 601 bp, Human
cacacgccaccatgcccagctaattttttgtatttttaatagagacagggtttcgccatgttggccgggctggtctcaaactcctgacctcaggtgatccacctgcctcggcctcccaaaatgctaggattacaggcatgagccaacacacctggcctctcttttaacttccatcggaaacctctcctcccaagcttgctttgaaatgggctgtgacatttggtcactgcgtagcaagtcctgtgagaatgagccgagtgcctgactttagaaagtgagtactttctaaagtgtgtgtcayctattgtcctagttttaagtaaacaggaagagtctcatcctgtgttcttcataaggttcatagtgcagggcctggcacatagtaaacacccagcgagtattggccactatcattatttaccttctttgggctgtagttttctcatctggaaagtggagtttatggtgggttctgctctgcttgccgcttagggctgttaatttgcatgaaagtatcataagtccatttcatttttatacattagccacagcagaacgggatctctccgcgcatgtttaaggcctttgtaagcaagagcca

SEQ ID NO: 192688 - DNA, 601 bp, Human
gcttgccagttattccattcacaatttatttttttctggtctttgtgacaaagttccttaagagccctgcgtggtatttggtgtcctcctgccactgctcaaagatgatgagtctgcttacatcagaatcgaatgccattaaaaactttttttttttttttgagactgagtctagctctgttgcccaggctagagtgcagtggcacaatcttggctcactgcaacctctgcctcctgggttcaagcaattctactgcctcagcctcctgagtagctgggattataggagcctgccaccacrcccggctaatttttgtatttttagtagagatggggtttcaccatgttggtcaggctggttttgaactcctgaccttgtgatccacccgcctcggcctcccaaagtgctgggattacaggtgtgagctggaaagccactgagaattcctgagtaaagccttttttttttttcctggttacaacagtgttctttgtggaaaatatagaaaacacaaaggagaacatcaaaatcccccttaatgccacgccctgcagccagccagtgttttttgtttgtttgtttgtttgtttgtttttgttt

SEQ ID NO: 192689 - DNA, 601 bp, Human
gtttgtttttgtttgtttgtttttgacagagtcttgctcttgtcgcccaggctggagtgcagtggcacgatcttggcccactgcaacctccgccttgcaggttcaagtgattcttctgttgtttgtttccttgttagaactaggctgcagtggtttctcttgtctgcctcagggttactgattcacatgtctgctcaggtccatgatcttttctaactctgtttatcatttattagtgataactttttttttttagaataaagcctcccgagtagctgggattataggcacccactaccaygcctggctaatttttttgtatttttagtagagacggggtttcaccatgttggccaggctggtctcgaactcctgacctcagatgatccacccgcctccgcctcccaaagtgctgggattacaggcatgagccactgtgcccggccaacagccagtgttcacaggttggcatctgcccctcccatcactttccaggtcttatgttaattctctacatgctcttctgtaagcagtgttttcacttaaatgtttgccacatcatcacatctgttaacagagcataatttctgttttatttgta

SEQ ID NO: 192690 - DNA, 601 bp, Human
tgtttttgacagagtcttgctcttgtcgcccaggctggagtgcagtggcacgatcttggcccactgcaacctccgccttgcaggttcaagtgattcttctgttgtttgtttccttgttagaactaggctgcagtggtttctcttgtctgcctcagggttactgattcacatgtctgctcaggtccatgatcttttctaactctgtttatcatttattagtgataactttttttttttagaataaagcctcccgagtagctgggattataggcacccactaccatgcctggctaatttttttgtatttttagtagagacggggtttcaccatgttggccaggctggtctcgaactcctgacctcagatgatccacccgcctccgcctcccaaagtgctgggattacaggcatgagccactgtgcccggccaacagccagtgttcacaggttggcatctgcccctcccatcactttccaggtcttatgttaattctctacatgctcttctgtaagcagtgttttcacttaaatgtttgccacatcatcacatctgttaacagagcataatttctgttttatttgtacctaatttacatgagtg

SEQ ID NO: 192691 - DNA, 601 bp, Human
ccgccttgcaggttcaagtgattcttctgttgtttgtttccttgttagaactaggctgcagtggtttctcttgtctgcctcagggttactgattcacatgtctgctcaggtccatgatcttttctaactctgtttatcatttattagtgataactttttttttttagaataaagcctcccgagtagctgggattataggcacccactaccatgcctggctaatttttttgtatttttagtagagacggggtttcaccatgttggccaggctggtctcgaactcctgacctcagatgatccrcccgcctccgcctcccaaagtgctgggattacaggcatgagccactgtgcccggccaacagccagtgttcacaggttggcatctgcccctcccatcactttccaggtcttatgttaattctctacatgctcttctgtaagcagtgttttcacttaaatgtttgccacatcatcacatctgttaacagagcataatttctgttttatttgtacctaatttacatgagtgtatttatataatcatattgtacatgtttttatgtttccagggcagccctttatttttttccctttctctttt

SEQ ID NO: 192692 - DNA, 601 bp, Human
cacatgtctgctcaggtccatgatcttttctaactctgtttatcatttattagtgataactttttttttttagaataaagcctcccgagtagctgggattataggcacccactaccatgcctggctaatttttttgtatttttagtagagacggggtttcaccatgttggccaggctggtctcgaactcctgacctcagatgatccacccgcctccgcctcccaaagtgctgggattacaggcatgagccactgtgcccggccaacagccagtgttcacaggttggcatctgcccctcccrtcactttccaggtcttatgttaattctctacatgctcttctgtaagcagtgttttcacttaaatgtttgccacatcatcacatctgttaacagagcataatttctgttttatttgtacctaatttacatgagtgtatttatataatcatattgtacatgtttttatgtttccagggcagccctttatttttttccctttctcttttgattggcttctcctcctcctttcttctcattccatgaatttctctcccatggtttttaatttaataatattgaaatagtaatccatgatgaact

SEQ ID NO: 192693 - DNA, 601 bp, Human
tagacattcgagcagaggtctcttgaaataatccagctttggcacatgagtatttgagccacctcttctgggagataaattgtgtcagggttctttgtagaagcaaagcccattagaagggtctctgggctttggaagagagaaggaggcagagatgtggcactcatgtttggtgccttctccttccatcagtctaagctggttcttcctaggcagaatagacaaatggcatttcttcgaattaacatcgtagaagcaaaaaagacaaaatagctgctggattgtgcatctcctgtgaacyagtcatttttgtaaagttcagcaattccactatgcagccatgaaaaggaatgagatcatgtcctttgcacatggatgaagctggaagccctcatcctcagcaaactaacacaggaacagaaaccaaacaccgcatattctcactcataagtgcgagttgaacattgagaacatatggacacagggaggggaacatcacacactgaggcctgttggtgggtggggggaaaggggagagaacttagaggacaggtcagtaggtgcagcaaaccgccacggcacacatatacttatgtaacag

SEQ ID NO: 192694 - DNA, 601 bp, Human
ttgtaaagttcagcaattccactatgcagccatgaaaaggaatgagatcatgtcctttgcacatggatgaagctggaagccctcatcctcagcaaactaacacaggaacagaaaccaaacaccgcatattctcactcataagtgcgagttgaacattgagaacatatggacacagggaggggaacatcacacactgaggcctgttggtgggtggggggaaaggggagagaacttagaggacaggtcagtaggtgcagcaaaccgccacggcacacatatacttatgtaacagacctgcacrttctacacatgtatcctggagtttttttgttttttgtttttttttttgagaataaagaaaaaaaaattcagcggttccctggatggccctttttgctctttcttgtgtgtggggggtggtgggtcagtttatgatgttagttggaaagtgatgattatgatgatttaagatgaaacgattttcattttctatatgctcatgcagtttttgatcagtttcaaaatccttttggtgtagaaacaagggaatgggagtctgctgtttgtttccttgttagaactaggctgcagtggtttctct

SEQ ID NO: 192695 - DNA, 601 bp, Human
gagatcatgtcctttgcacatggatgaagctggaagccctcatcctcagcaaactaacacaggaacagaaaccaaacaccgcatattctcactcataagtgcgagttgaacattgagaacatatggacacagggaggggaacatcacacactgaggcctgttggtgggtggggggaaaggggagagaacttagaggacaggtcagtaggtgcagcaaaccgccacggcacacatatacttatgtaacagacctgcacgttctacacatgtatcctggagtttttttgttttttgttttttkttttgagaataaagaaaaaaaaattcagcggttccctggatggccctttttgctctttcttgtgtgtggggggtggtgggtcagtttatgatgttagttggaaagtgatgattatgatgatttaagatgaaacgattttcattttctatatgctcatgcagtttttgatcagtttcaaaatccttttggtgtagaaacaagggaatgggagtctgctgtttgtttccttgttagaactaggctgcagtggtttctcttgtccgcctcagggttactgactcacgtgtctgctcatgtcca

SEQ ID NO: 192696 - DNA, 601 bp, Human
tcccttagtatttaatcatttgagtaggaatagcacagaggccttctgggttggtagccctgatgtctgaggtgttgggtaacctccacaggaagttgtctcggcagtgttggttactgtcatgggttgtttgatggtggctaactgcagtcctgtagttatcctcctccttggcctcacagggacccatgtgggacccatgacctctaatcatagttgctggtggaaccaaatcagaaaatgtgtaacactcgatctggctcttgccaggcgcttagtggtggttctgtttttttttttgttttgttttgtttttttctgcctttggttattttattttaaaacagcttaaagttaacaagaatgtttttgttacttttgtgtatgtgtgtgtgatcattggcaaaaattgatccccttacacaatgtaacatctctttctggccttatctgttgggttgtggagggagtgctgatcagagttttaagtccagctttgccaataattggctggttttgactttgggcctcagttcttcagcaaggcagtgaaggactgggaagacgtgagcccttggaccttttctggctgtgaaatact

SEQ ID NO: 192697 - DNA, 601 bp, Human
cactgcacttaattggaaaaagagtgcttgcagtggcataaaacaaagggaggtctgaaagtttggctccaggagttttgctacgttcagatattctttggccatttttctttgaggctaagattgagattttggctaacataaaggggattaaaggatggaacggctggtgtgggctgtttttaccatggcctcaatagcagttcaacctatatatatatatataaaattttatatataaaatgtatatatataaaattttatatatatacatataatatatataagtattatatatatwttttagagggagtctcgctctgtcacccaggctggagtgcagtggcatgatcttggctcactgcaacctctgcctcccaagttcaagcaattctcctgtttcagcctcctgagtagctgggaatgcaggcacatgccaccaagcccggctaatttttgtatatttttttttgtttttttttgagacggagttttgcttttgttgcccaggctggagtgcagtggcacaatctctgcttgccacaacctacgcctcccaggttcaagtgattctcctgcctcagcttcccgagtagctggg

SEQ ID NO: 192698 - DNA, 601 bp, Human
acaaagggaggtctgaaagtttggctccaggagttttgctacgttcagatattctttggccatttttctttgaggctaagattgagattttggctaacataaaggggattaaaggatggaacggctggtgtgggctgtttttaccatggcctcaatagcagttcaacctatatatatatatataaaattttatatataaaatgtatatatataaaattttatatatatacatataatatatataagtattatatatatattttagagggagtctcgctctgtcacccaggctggagtgcartggcatgatcttggctcactgcaacctctgcctcccaagttcaagcaattctcctgtttcagcctcctgagtagctgggaatgcaggcacatgccaccaagcccggctaatttttgtatatttttttttgtttttttttgagacggagttttgcttttgttgcccaggctggagtgcagtggcacaatctctgcttgccacaacctacgcctcccaggttcaagtgattctcctgcctcagcttcccgagtagctgggattacaggcctgtgccaccatgcccggctagttttgtatttt

SEQ ID NO: 192699 - DNA, 601 bp, Human
ggctggtgtgggctgtttttaccatggcctcaatagcagttcaacctatatatatatatataaaattttatatataaaatgtatatatataaaattttatatatatacatataatatatataagtattatatatatattttagagggagtctcgctctgtcacccaggctggagtgcagtggcatgatcttggctcactgcaacctctgcctcccaagttcaagcaattctcctgtttcagcctcctgagtagctgggaatgcaggcacatgccaccaagcccggctaatttttgtatatwtttttttgtttttttttgagacggagttttgcttttgttgcccaggctggagtgcagtggcacaatctctgcttgccacaacctacgcctcccaggttcaagtgattctcctgcctcagcttcccgagtagctgggattacaggcctgtgccaccatgcccggctagttttgtatttttagtagagatggggtttctccatgttggtcaggctggtctcgaactcccaacctcaggtgatcctccctccttggcctcccaaagtgctggattacaggcatgagccaccgcacccagccaa

SEQ ID NO: 192700 - DNA, 601 bp, Human
taaaatgtatatatataaaattttatatatatacatataatatatataagtattatatatatattttagagggagtctcgctctgtcacccaggctggagtgcagtggcatgatcttggctcactgcaacctctgcctcccaagttcaagcaattctcctgtttcagcctcctgagtagctgggaatgcaggcacatgccaccaagcccggctaatttttgtatatttttttttgtttttttttgagacggagttttgcttttgttgcccaggctggagtgcagtggcacaatctctgctygccacaacctacgcctcccaggttcaagtgattctcctgcctcagcttcccgagtagctgggattacaggcctgtgccaccatgcccggctagttttgtatttttagtagagatggggtttctccatgttggtcaggctggtctcgaactcccaacctcaggtgatcctccctccttggcctcccaaagtgctggattacaggcatgagccaccgcacccagccaatttttgtttttttagtggagacagggtttcactatttagccaggctgatctggaactcctgacctcaggtgatc

SEQ ID NO: 192701 - DNA, 601 bp, Human
gtgcagtggcatgatcttggctcactgcaacctctgcctcccaagttcaagcaattctcctgtttcagcctcctgagtagctgggaatgcaggcacatgccaccaagcccggctaatttttgtatatttttttttgtttttttttgagacggagttttgcttttgttgcccaggctggagtgcagtggcacaatctctgcttgccacaacctacgcctcccaggttcaagtgattctcctgcctcagcttcccgagtagctgggattacaggcctgtgccaccatgcccggctagttttgyatttttagtagagatggggtttctccatgttggtcaggctggtctcgaactcccaacctcaggtgatcctccctccttggcctcccaaagtgctggattacaggcatgagccaccgcacccagccaatttttgtttttttagtggagacagggtttcactatttagccaggctgatctggaactcctgacctcaggtgatctgccctcctcagcctcccaaagtgctgggattacaggcatgaaccaccatgtccggcctcaacctatattatttgttctctgtgaaacccctccctcag

SEQ ID NO: 192702 - DNA, 601 bp, Human
gcccggctaatttttgtatatttttttttgtttttttttgagacggagttttgcttttgttgcccaggctggagtgcagtggcacaatctctgcttgccacaacctacgcctcccaggttcaagtgattctcctgcctcagcttcccgagtagctgggattacaggcctgtgccaccatgcccggctagttttgtatttttagtagagatggggtttctccatgttggtcaggctggtctcgaactcccaacctcaggtgatcctccctccttggcctcccaaagtgctggattacaggcrtgagccaccgcacccagccaatttttgtttttttagtggagacagggtttcactatttagccaggctgatctggaactcctgacctcaggtgatctgccctcctcagcctcccaaagtgctgggattacaggcatgaaccaccatgtccggcctcaacctatattatttgttctctgtgaaacccctccctcaggcttctgctatgtttcagattgtagagttcatatgttaaaaacaggaaagcaaaaacaatttatttcaaaaaggaaaaacaagccatatttgttaaaattattttt

SEQ ID NO: 192703 - DNA, 601 bp, Human
gtgcagtggcacaatctctgcttgccacaacctacgcctcccaggttcaagtgattctcctgcctcagcttcccgagtagctgggattacaggcctgtgccaccatgcccggctagttttgtatttttagtagagatggggtttctccatgttggtcaggctggtctcgaactcccaacctcaggtgatcctccctccttggcctcccaaagtgctggattacaggcatgagccaccgcacccagccaatttttgtttttttagtggagacagggtttcactatttagccaggctgatctsgaactcctgacctcaggtgatctgccctcctcagcctcccaaagtgctgggattacaggcatgaaccaccatgtccggcctcaacctatattatttgttctctgtgaaacccctccctcaggcttctgctatgtttcagattgtagagttcatatgttaaaaacaggaaagcaaaaacaatttatttcaaaaaggaaaaacaagccatatttgttaaaattatttttaaaaagctccctatccaagggagattaatagtagttcattcaggtatcagttgcccatcactaagtgagtttt

SEQ ID NO: 192704 - DNA, 601 bp, Human
gtgcctgcctctccctagaagtgtcctgctaggaagcagccttttcaacacctggaaatggcccatctttaaaatggggactgagaggcattagctttccacagagaggcagattccctgagcccagggctagtggtcaggagacctggattcttctcctgtgtctaccttccacgttagcttctgtcctggggcaaagtcaccgcccagtgattccatctgtaatggagaaatgatgctctcctgaatttctcctcagatgctacaaaatattcagttgtaggcagtgctagcatatctrtctagaatcctggaggaggggtttctgcttcctatagttcttacaaggagcttttaccttttcctttttgtctgcatacacacatgctcttgcatgtgccttttatatacatgagaagaattagtactgggtgtatccagttgttagtaattgaaaactggtccttgtgggaaagaaaaagatgatgttaaaggtaataaagcaactatcatttattgcacatttgttattgccaggtcatgtgttaagcacttcccatcaattatcatatttcatcctcttagtagtctgaggtaggtc

SEQ ID NO: 192705 - DNA, 601 bp, Human
ccctagaagtgtcctgctaggaagcagccttttcaacacctggaaatggcccatctttaaaatggggactgagaggcattagctttccacagagaggcagattccctgagcccagggctagtggtcaggagacctggattcttctcctgtgtctaccttccacgttagcttctgtcctggggcaaagtcaccgcccagtgattccatctgtaatggagaaatgatgctctcctgaatttctcctcagatgctacaaaatattcagttgtaggcagtgctagcatatctatctagaatcctsgaggaggggtttctgcttcctatagttcttacaaggagcttttaccttttcctttttgtctgcatacacacatgctcttgcatgtgccttttatatacatgagaagaattagtactgggtgtatccagttgttagtaattgaaaactggtccttgtgggaaagaaaaagatgatgttaaaggtaataaagcaactatcatttattgcacatttgttattgccaggtcatgtgttaagcacttcccatcaattatcatatttcatcctcttagtagtctgaggtaggtcccattattttct

SEQ ID NO: 192706 - DNA, 601 bp, Human
gtggtcaggagacctggattcttctcctgtgtctaccttccacgttagcttctgtcctggggcaaagtcaccgcccagtgattccatctgtaatggagaaatgatgctctcctgaatttctcctcagatgctacaaaatattcagttgtaggcagtgctagcatatctatctagaatcctggaggaggggtttctgcttcctatagttcttacaaggagcttttaccttttcctttttgtctgcatacacacatgctcttgcatgtgccttttatatacatgagaagaattagtactgggygtatccagttgttagtaattgaaaactggtccttgtgggaaagaaaaagatgatgttaaaggtaataaagcaactatcatttattgcacatttgttattgccaggtcatgtgttaagcacttcccatcaattatcatatttcatcctcttagtagtctgaggtaggtcccattattttctcattttatgaaggaagaaataaaagaagtaattggccagtaagtggcaggcatgggattcattccagtctgattgagttcaaactctaaatgcctgctatcaagcacccccatattcctt

SEQ ID NO: 192707 - DNA, 601 bp, Human
catctcgctttgcttcattccctgaatacttggtagtgcagataaagaagttcacttttggtcttgactgggttcccaaaaaatttggtaggtatcttttgcgtgcttttgcttaaaacatcaaatgagccatttaaacaacatggcatgtgaaagagcccatgtagttggctgccacaaacagttccatttcattccatcattctcacctttctgttttgaatcagagtatatgataagaactgacaataaaaattgccatctgcttacccacccctccagttatggtttctggaatgaycaaattctaagagtgtaaacagaatcctcacattgtcaaataaacagtgctttccaaactttaatgtgcatatgaattatctgggatcttggttaaaatgcagatgcagattgggcaggtctggagtgggcctgtgattctgtgtttctaacaagctcccacgtgatgctgatgctgttggtgctgctggcccacaggccacactttgagcagccagtggttgaagatgcagtctcctcataggatctctcctctgcctctgagcaggcaggtgtggctaatgacattcacttaataaag

SEQ ID NO: 192708 - DNA, 601 bp, Human
ctgctggcccacaggccacactttgagcagccagtggttgaagatgcagtctcctcataggatctctcctctgcctctgagcaggcaggtgtggctaatgacattcacttaataaagtagaaaaaaagccagttgcattagacagtaaaacaaaaggatgtgattttggcttcatgaggctttcttcgtgctaatttttaaagttcctgaccattgttagaggttaattttccagacgatacataaaagcctttctccagcattaagatctaatacaaagggtgttactaggttgtcctcrgtggtgtggaagaatgtacagtttctcaagcaagaaccttggactatttgccagtcttttaaagtttttatgtttttaagtacttaagaaaaaacccaactcaatcttacgctggttaactaagcactcgtctgaaggggataggtaaaaaggatgtagaatcggctggagtgatttcctagagacctccggcactaacagttacgcagcacttgtttgccacgtgaaattgtgctgggctgttactgatcctgcaggagatcctcccttttcctggcagaatagttttgtgagcagggg

SEQ ID NO: 192709 - DNA, 601 bp, Human
ctgattttggggacagtattttcaggttgtttgctagcccaaaagatgtatcctgtaccaatatttgaacccatttttcattattatcatctgaatatgtgcagcactaaatcttgacagggtattagtctgacaaattttgtatttgaataagtcaacacaataacagagccaagaagttaaaaaaagtactgtaaagataatacacttgagattcaattaatttctttaaaacttcattatttattcaatatcttagttagaatatccacagtacccatcatgatctgagaacgggttrcatcatcaaatggggttgcaaactcaaatgcctaacaaggacagggtaatctaaatgaaagaactgggctgagtataggaggcttgtagctagctatcttggtcttgcttgggtgttcccactttgaataaaaagatgaactagaaaaactgccataagactcagagtagcacaaatatgatgctcagggagcaacaaggagcagtggggtctgtgtcagactaacattgcaccattgtctagggtagaaactgaagatcagctcccgatggttgttaccatatgagaatgtgctacagc

SEQ ID NO: 192710 - DNA, 601 bp, Human
tcttgacagggtattagtctgacaaattttgtatttgaataagtcaacacaataacagagccaagaagttaaaaaaagtactgtaaagataatacacttgagattcaattaatttctttaaaacttcattatttattcaatatcttagttagaatatccacagtacccatcatgatctgagaacgggttgcatcatcaaatggggttgcaaactcaaatgcctaacaaggacagggtaatctaaatgaaagaactgggctgagtataggaggcttgtagctagctatcttggtcttgcttsggtgttcccactttgaataaaaagatgaactagaaaaactgccataagactcagagtagcacaaatatgatgctcagggagcaacaaggagcagtggggtctgtgtcagactaacattgcaccattgtctagggtagaaactgaagatcagctcccgatggttgttaccatatgagaatgtgctacagctttatgcttttcaaaataagctggaaatctggattttaccttaaatcttctgatttaaacattggaatttgttgtccacacttttaaaatatcaaacagattgtgtctggg

SEQ ID NO: 192711 - DNA, 601 bp, Human
ccagggggttacagccaggagaggaagaacttccagacatcagcccccccatagtcattcctgatgactcaaaaggtaccatctcctgccaggagaatatgcgctaccctcccaccctgttctataggaacagtctctttcttccaccactgtgttgctgctaccaccaccacccattggtggtctagctgccttgctgtgatgtaacccaccaccgacacaggagggaggcatggctgcaatggtaaacataaaatagacattgtaagaggcacagacccatcatgtgtggttgaaatgracagtttttttttgtaggctcttagtctagggaagctgtgtcattcttgggagtacctttggacaacctaaaggggaaattgaacagcgtgagttggttttaaaactgtgatggcatctcacctccccagcttttttactgcatcatagaaaggaagagatttgagtttctctttgactctgtgaccccatcactggtcattgttcagaacacataacatttttttttttttgaggtggagccttgctctgttgcccaggctggagtgcagtggcacgatctcggctcactgcaacctcc

SEQ ID NO: 192712 - DNA, 601 bp, Human
ccaccactgtgttgctgctaccaccaccacccattggtggtctagctgccttgctgtgatgtaacccaccaccgacacaggagggaggcatggctgcaatggtaaacataaaatagacattgtaagaggcacagacccatcatgtgtggttgaaatggacagtttttttttgtaggctcttagtctagggaagctgtgtcattcttgggagtacctttggacaacctaaaggggaaattgaacagcgtgagttggttttaaaactgtgatggcatctcacctccccagcttttttactgcwtcatagaaaggaagagatttgagtttctctttgactctgtgaccccatcactggtcattgttcagaacacataacatttttttttttttgaggtggagccttgctctgttgcccaggctggagtgcagtggcacgatctcggctcactgcaacctccacctcctgggttcaagcaattctcctgcctcagcctcacgagtagctgggactacaggcgcgtgccaccatgcctgcttaattttttttttgtagtattagtagagatggggtttcaccttgtgagcgaggatggtctcgatc

SEQ ID NO: 192713 - DNA, 601 bp, Human
actcaggaggctgaggcaagagaatcgcttgaaccagggagtcgagccgagattgcgccactgcattccagcctggcggcagagcgagaccctgtctcaaaaaaacaaacaaacaaacaaacaaacaaacaaacaaaaaatacagagagaggctgggcgcagtggtgcatgcctgtaatcccagccctttgggaggctgaggtgggaggatcacttgagcccaggaatttgaaaccaacctggtcagcatagtgagacactgtctctacaaaaaataaaaaatttaaaagtttgccaggcrtggtgactggtgacatgtgcctgtagttccagctactcagtaggctaagccaggaggatcacctgagcccaggaggtcgaggctgcagtgagccatgattgctgtaccaccctctgggtctgggcaacagagtcagacactgtctccaaaaaaaagttttttttaaagaaaaaataatagagacataatagggaaatagtagtttgttaggataataatcaaagcatcatgttttaactaacctaaacgcctgaaagctattactttctcttattactgaggctggggtggtctgcgtgt

SEQ ID NO: 192714 - DNA, 601 bp, Human
cactgtctctacaaaaaataaaaaatttaaaagtttgccaggcgtggtgactggtgacatgtgcctgtagttccagctactcagtaggctaagccaggaggatcacctgagcccaggaggtcgaggctgcagtgagccatgattgctgtaccaccctctgggtctgggcaacagagtcagacactgtctccaaaaaaaagttttttttaaagaaaaaataatagagacataatagggaaatagtagtttgttaggataataatcaaagcatcatgttttaactaacctaaacgcctgaaarctattactttctcttattactgaggctggggtggtctgcgtgtggttgagggattgacaacagtgtgtggtccccaggagtggggagggcattggaaatgccctggatcaatgggttttcttttttctaaaactcctcaacatggtttggtctcattttctgtcctctcccttaatttccagatcgcctgatgaaccaattgatagaccgtatgtatctttaaaaatgtttctcaatgtcctactgttgttattaatctgatgaatttgtctgtgaaagttcagtaaagaggcattgttc

SEQ ID NO: 192715 - DNA, 601 bp, Human
ggcggaggctgcagtgagccaagattgcaccactgcactctggcctgagtgacagagcgagactctgtctcaaaaaaacaaacaaacaaaaaaacaacaaaaaaaaccccaaacagctttattgagatataattcatccctttaaagtgtataagtcagtggcaaaaagaccaatagaaagatacgggatatacttctaactaagcgatgatgaaaatttgaaatggaaacatgggcatgaagaaatggaggatgtttagttagctttttcttttatctactttattaagctataatgcayatattcatctgtttaaagtgtacatttcaatggtttttcataaattcacagttgtgtaaccattaccactatcaaattttagaacattttgtacccttcaaaagaaatctcatacataatagcagtcactccccattttcctgctcaccccagcccctggcaaccacgaatctgttttctggatcaagggatttgcctgttttggacatttcatataaatggagtcatataataaaaggtcgtttgtgtttggtttctatcacttagcatagtgctttcaagattcatctatgttgtagc

SEQ ID NO: 192716 - DNA, 601 bp, Human
gcggaggctgcagtgagccaagattgcaccactgcactctggcctgagtgacagagcgagactctgtctcaaaaaaacaaacaaacaaaaaaacaacaaaaaaaaccccaaacagctttattgagatataattcatccctttaaagtgtataagtcagtggcaaaaagaccaatagaaagatacgggatatacttctaactaagcgatgatgaaaatttgaaatggaaacatgggcatgaagaaatggaggatgtttagttagctttttcttttatctactttattaagctataatgcatrtattcatctgtttaaagtgtacatttcaatggtttttcataaattcacagttgtgtaaccattaccactatcaaattttagaacattttgtacccttcaaaagaaatctcatacataatagcagtcactccccattttcctgctcaccccagcccctggcaaccacgaatctgttttctggatcaagggatttgcctgttttggacatttcatataaatggagtcatataataaaaggtcgtttgtgtttggtttctatcacttagcatagtgctttcaagattcatctatgttgtagca

SEQ ID NO: 192717 - DNA, 601 bp, Human
taaagtgtataagtcagtggcaaaaagaccaatagaaagatacgggatatacttctaactaagcgatgatgaaaatttgaaatggaaacatgggcatgaagaaatggaggatgtttagttagctttttcttttatctactttattaagctataatgcatatattcatctgtttaaagtgtacatttcaatggtttttcataaattcacagttgtgtaaccattaccactatcaaattttagaacattttgtacccttcaaaagaaatctcatacataatagcagtcactccccattttccygctcaccccagcccctggcaaccacgaatctgttttctggatcaagggatttgcctgttttggacatttcatataaatggagtcatataataaaaggtcgtttgtgtttggtttctatcacttagcatagtgctttcaagattcatctatgttgtagcatgtgtcagtacttcattcctttttacggtaaaataatagtctgttgggtcgggtttggtggcttacgcctgtaatcccagcactttggaaggccaaggcaggaggatcatttgaggtcaagagttcaagaccagcctggcc

SEQ ID NO: 192718 - DNA, 601 bp, Human
actccccattttcctgctcaccccagcccctggcaaccacgaatctgttttctggatcaagggatttgcctgttttggacatttcatataaatggagtcatataataaaaggtcgtttgtgtttggtttctatcacttagcatagtgctttcaagattcatctatgttgtagcatgtgtcagtacttcattcctttttacggtaaaataatagtctgttgggtcgggtttggtggcttacgcctgtaatcccagcactttggaaggccaaggcaggaggatcatttgaggtcaagagttcragaccagcctggccaacatggtgaaaccccatctctattaaaaatgcaaaaattgtctgggcatggtggcgggcacctggagtctcagctacttgggagactgaggcaggagaattgcttgagcccaggagacggaggttgcagtgagctgagatcacgccactgccctccagcctgggcaacagagtgagactccatctaaaataataataataataacaataataatagtctattttatgggtatactatattttattaatctttatcagttcatggacatttgggttatttacattt

SEQ ID NO: 192719 - DNA, 601 bp, Human
ctccgcctcttgggttcaagcgattcttgtgcctcagcctcccaagtagctggattacaggtgtgcaccaccatgccctgctaatttttgtatttttagtagagacaggattttgccatgttggccaggctggccacgaactcctgacctcaggcgatccactcgccttggcctcccaaagtgctgggattacaggcatgagccactgcgcctggcccagactgtcttgattattataactttgtagaatcatgtttttccttgttagtgttgtttcaggacaaaaaaaaaaaaaaaaaaaggaaaagacttgggtgtggttatttttctcagattttgctgagccgctgaccatgcctggttatggaggggcagcttctgctggagcctctgtttttggtgcttctggactggataaccaacctccagaggaaatcgtagctatcatcacctccatgggatttcagcgaaatcaggctattcaggcactacgagcaacggtgagcatgagagactgtgtgtgtgtgtgtgtgtgtgtgtgtgtgtgaatttatttctgtagcagttgagactttccaatgtactttgatcattttgattc

SEQ ID NO: 192720 - DNA, 601 bp, Human
tttaagatgattaaaatatctcaaccagagtttgttttacttggggtactttcttgtgctccactcattttatttgcctgactgtttcattagaggttttatatctatacaaattctttaacctgccagaaatatcacaagctgagaaagatggaaatatttttatggtcaattagtttgaagtacatggagttcagtttaaacaattatacttaactaatcagtgttgttgtcattaatcaagatattaatcttgtctttactggaattcaaacattttaccaacattccaggagagaasgctctaacataataccacactggcatccctctattgttcagttatctgcagaaaatacagttggtagagaaggtagtgtgtgcaattaaagtggctttagaaagagctgcacttaaacaaatgccatacccttggttattccacacctattattatcagcatcttcctgcagaaaagctgagctaacattgatataaactttggaatgctgatctgctgcttagaactcttttccagtgaatccaattacagatgtcagctgggagacttgcagaatgccatgccaactgaacgtgcctg

SEQ ID NO: 192721 - DNA, 601 bp, Human
cagaactatacgttcagctcatgcccttccctcccaccacaacatagtcaagcctttgccatcattcaaaagttagcacagatcccatcttcttcgttttttttttttttcttttttgagacagagtctcacactgttgccaggctggtgtgctgtggcgcgatctcggctcactgcaacctccgcctcccaggttcaagccattctcctgcttcagcctcccgagtagctgggattacaggcatgtgccaccacacccagctaatttttgtatttttagtagagacggggattcaccatkttggcctggctggtcttgatctcctgacctcgtgatatgcctgtctcggcctcccaaagtgctgggattacaggcatgagccaccatgcctggccagatcccatcttcttagaaatggtgcagtttgccactttgcataggccccggtgatctgataaagtcatgtcagaatcatgttgcttggtcatgtttgtgcccaagtttagggccaactttgattttgtctgttcctttgaggtaaaatttcttcatggaccatgggagcttttgtcaaaaagagaacatttgttttcatggtag

SEQ ID NO: 192722 - DNA, 601 bp, Human
tggactgccttcctagatccttgtcataatcagctcatgcttacctcatatgctagcaataattataccagtatgaaaaatactcccatttgtgccatctttaatcctcacagtaaccttatgaggtacataccattattatccccattttacaggtgaagaacctgagatagagaaggctaagtaatagcttgtcaaggtctcatagctagtgatggatagaaccacaattccagtgcaggcagtctgcctccagagcctgtgcctgtagccactgtaatgcattgttagttttttttgkttttttttttttttgagacagagtctcactccatcacccaggctggagtgcagtggcacgatcttggctcactgcaacctccacctcccaggttcaagcgattctcctgcttcagcctcccgagtagctggaattacaggtttgggccaccacgctcccttgttagttcttctgttgttggaggtatcaagttgatcttgcaataaaattacttctgtaggtatttgtgtctcccatttgactaggagcttgcccagggcagaggccatttggcttttataaaactcatggtgtctagca

SEQ ID NO: 192723 - DNA, 601 bp, Human
agggaggggaaaacatgacttcctgtactttactatattagcacacaaactcatattgtgagttgttgctttctttttcctttgtaaaaaaattaacacttatattgaaggatatatattaattttagcaacttaaggaaatatagatatatgaaaagacaaaattaaaaattacaatcttactccccggcaataatgacaaaataatgttttgtttatattctctagacctttttagacaaatgtataaaaatgaatataaatctaaggttgtttaaatataacattctattctatatayacattgctattttgtgacttgcttttcctttaatgtaattaacatgtgattaacatgtgatgaggctatgattagcctgtgagttatgtaggtgtacatgtatatacatctatattgttgaacatatattaacaatattctattataaacatgtaccatagtttatatacctaattctaggttaattaggtatcatttaaataaaagaccacattattacagaaagagtttcaaataatgaagatatttccacattcagaagatgaccactatgatttttaaataatgaggtttttttga

SEQ ID NO: 192724 - DNA, 601 bp, Human
ctgaggtatatgacttgagaattttttttttttttgagatggagtctcgctctgtcgccaggctggagtgcagtggcgccatctcagcaaactgcaacctccaactccctggttcaagctattctcctgcctcagcctctggagtagctaggattacaggcacgcgccaccacacccagctaatttttatactgtttttagtacagatggggtttcaccatgttggccaggatggtctccatttcccgaccttgtgatctgcctgccttggcctcccaaagtgctgggattacaggtgtgmgccactgcacccagctgagaatattgaatacaattaaagagtaggggtaattggtgtttgaggaaccaaaacaaacaaaataaaaacaacttcagttttcagggttttaagtggcaagaagtccaagacaaatctgtctaagcaaaaagggaaatattttctcatgaaagctggcaagtcctgggggcactgggctgcaggcctgccgtgattcaggactcaaatccttttagctggatgggccccttggctctgcttcctctaggttggttccagtcccagacaggctctccctaatgg

SEQ ID NO: 192725 - DNA, 601 bp, Human
ttttttgagatggagtctcgctctgtcgccaggctggagtgcagtggcgccatctcagcaaactgcaacctccaactccctggttcaagctattctcctgcctcagcctctggagtagctaggattacaggcacgcgccaccacacccagctaatttttatactgtttttagtacagatggggtttcaccatgttggccaggatggtctccatttcccgaccttgtgatctgcctgccttggcctcccaaagtgctgggattacaggtgtgagccactgcacccagctgagaatattgaakacaattaaagagtaggggtaattggtgtttgaggaaccaaaacaaacaaaataaaaacaacttcagttttcagggttttaagtggcaagaagtccaagacaaatctgtctaagcaaaaagggaaatattttctcatgaaagctggcaagtcctgggggcactgggctgcaggcctgccgtgattcaggactcaaatccttttagctggatgggccccttggctctgcttcctctaggttggttccagtcccagacaggctctccctaatggcacaagatggctgcagcgcctcccacaac

SEQ ID NO: 192726 - DNA, 601 bp, Human
gttattttagggagtgttttgatgtctctgtgttctgagcactctctgtagactaactaaataatgcgtcatgccctgatgagatactgctgctttgtaaatattttagatgctataatggcttataaaattaaattcatttaaagacacttctgaatccagagttgcttttggtcattacacttgttaaagcataattttccaaaaggcaagatcatgactttcaggtaaatgtaaaatgaacacatatcacagattttaaaaaactcattaattaatgagagaatcagtcagatgttaytactggtttaaaaacatttgtggaactaggatatttaaagacaatttcaaaaagaaatgttaggatgagattgccaggttaggttaaaaattagtcagtgtctgtcaggaccataaatccttgaaataattatattaccagtttataccccaatttataaatctatacatccttgaggatatgtgttctactggacagaatttttttgtatctttactagataaaaatctacaagttagcaggtaacatcactaaatatgagatctttaatcagtagtgtgttagtagttttatagtcat

SEQ ID NO: 192727 - DNA, 601 bp, Human
ccaaggtattcatgagggatccacctccatgtcccaaatacctcccactatgtccggaattggtgggttcttggtctcactgacttcgagaatgaagccgcggaccctccctgtgagtgttacagttcttaaagatggtgtgtccgcagtttgttccttctgatgttcggacatgttcaaagtttctttcttctgctgggttcctggtctcgctggcttcaggagtgaagctgcagaccttcacggcaagtgctacagctcttaaggcagcacgtctggagttgttcgttcctcctgtccrgagttgctcattcctccctgtgggtttgtggtctcgctggcctcaggagtgaagctgcagacctttgcagtgattacagctcataaaggtagtggagacccaaagggtgagcagcagcaagatttattgcaaagagcaaaagaacaaaccttccacagtttggaaggggacccaagcaggttgccactgctggctcgggcagcccgcttttattcccttatctgaccccacccacatcctgctgattggcccattttacagagagctgattggtccattttacagagagctgattggtcc

SEQ ID NO: 192728 - DNA, 601 bp, Human
ggtctcgctggcttcaggagtgaagctgcagaccttcacggcaagtgctacagctcttaaggcagcacgtctggagttgttcgttcctcctgtccggagttgctcattcctccctgtgggtttgtggtctcgctggcctcaggagtgaagctgcagacctttgcagtgattacagctcataaaggtagtggagacccaaagggtgagcagcagcaagatttattgcaaagagcaaaagaacaaaccttccacagtttggaaggggacccaagcaggttgccactgctggctcgggcagccygcttttattcccttatctgaccccacccacatcctgctgattggcccattttacagagagctgattggtccattttacagagagctgattggtccattttgacagggtgctgattggtgcatttacaatccctgagctagacacagagtgctgattggtgtatttacaatcctctagctagacataaaagttctccaagttcccactagattaactagacacagagcactgattggtgcgtttacaaaccttgagctagacacagagtgctgattggtgcctttacaaaccttgagctag

SEQ ID NO: 192729 - DNA, 601 bp, Human
gacataaaagttctccaagtccccacccgactcaggagcccaactggctttgcctagtggatcctgtgccagggccgtgggtggagctgcccgccagttccgcgccacgcgcctgcactcctcagcccttgggcggtcgatgggactgggcactgcggagcagggggcggtgcccctcggggaggcttgggccatgcaggagcccaccacggtgggggctcaggcatggcaggctgcaggtcccaaggcctgccctgtggggaggcagctgaggcctggcgagaattcgagtgcagtgccrgcaggctggcactgctggcggacctggcaccccctccacagatgctggcctgggtgcaaagcccctgactgctgagcccatgctcacccagaactcagtgctggctcgcgagcattgtgcgcagccccggttcctgcctgcgcctctccctccacctgcgcctctccctccacaccttgcaagcagagggagctggctccactctcagccagcccagagaggggctcccacagtgcagcggtgggctgaagggctcctcaagcgtggccagagcagatgtcacggtcgaggaggtgctga

SEQ ID NO: 192730 - DNA, 601 bp, Human
ggactgggcactgcggagcagggggcggtgcccctcggggaggcttgggccatgcaggagcccaccacggtgggggctcaggcatggcaggctgcaggtcccaaggcctgccctgtggggaggcagctgaggcctggcgagaattcgagtgcagtgccagcaggctggcactgctggcggacctggcaccccctccacagatgctggcctgggtgcaaagcccctgactgctgagcccatgctcacccagaactcagtgctggctcgcgagcattgtgcgcagccccggttcctgcctgcscctctccctccacctgcgcctctccctccacaccttgcaagcagagggagctggctccactctcagccagcccagagaggggctcccacagtgcagcggtgggctgaagggctcctcaagcgtggccagagcagatgtcacggtcgaggaggtgctgagagcgagcaagggctgccagcacgttgtcacctctcaccaccaggtcccacctccaacattgggggtcacatttcaacatgagatttggaggggacaaacatccaaactatatcaagtagtaaatagtgagatgaactaagt

SEQ ID NO: 192731 - DNA, 601 bp, Human
gtcccaaggcctgccctgtggggaggcagctgaggcctggcgagaattcgagtgcagtgccagcaggctggcactgctggcggacctggcaccccctccacagatgctggcctgggtgcaaagcccctgactgctgagcccatgctcacccagaactcagtgctggctcgcgagcattgtgcgcagccccggttcctgcctgcgcctctccctccacctgcgcctctccctccacaccttgcaagcagagggagctggctccactctcagccagcccagagaggggctcccacagtgcagyggtgggctgaagggctcctcaagcgtggccagagcagatgtcacggtcgaggaggtgctgagagcgagcaagggctgccagcacgttgtcacctctcaccaccaggtcccacctccaacattgggggtcacatttcaacatgagatttggaggggacaaacatccaaactatatcaagtagtaaatagtgagatgaactaagttcatccccctagatcaggagccagcaacttttttctctaatgaaccagataatacatgtttcaggttttgtgggccatatacatgtctgtctcatat

SEQ ID NO: 192732 - DNA, 601 bp, Human
atttttgtggttctgagtatgtacatgagttgtttttaaacaaagagaggaaaatgcttttgggggggctttagtgacatgtttggatatagtgggatgtatggatttgtcctttctctgtgtctgttttgtcaacccattggctgtgttggtatctgtgctttgtttcactgatgtgaccctgtcttatggtgggaagtgctcagtaaacactctgttgaattgctgaagccattgttttgcaggacatccttgtggggaaaagccttgattggggtattgtatcctctctctctctctyttttttttttttttttttcttttttgagacagagtctcattctgtcgcccaggctggagtacagtggtgcgatctcggctcactgcagcctcaatcccctgggctccagcaattctcccacctccgtctcccgagtagctgcgactacaggtgcacgccaccatgcctggctaatttttttgtatttgtagagacagggttttgccatgttgcccaggctggtctcaaactcctgagcacaagcaatccatccaccttgcctcccaaagtgctgagattacaggcgtttgccaccatgcc

SEQ ID NO: 192733 - DNA, 601 bp, Human
atgtacatgagttgtttttaaacaaagagaggaaaatgcttttgggggggctttagtgacatgtttggatatagtgggatgtatggatttgtcctttctctgtgtctgttttgtcaacccattggctgtgttggtatctgtgctttgtttcactgatgtgaccctgtcttatggtgggaagtgctcagtaaacactctgttgaattgctgaagccattgttttgcaggacatccttgtggggaaaagccttgattggggtattgtatcctctctctctctcttttttttttttttttttttcttttttgagacagagtctcattctgtcgcccaggctggagtacagtggtgcgatctcggctcactgcagcctcaatcccctgggctccagcaattctcccacctccgtctcccgagtagctgcgactacaggtgcacgccaccatgcctggctaatttttttgtatttgtagagacagggttttgccatgttgcccaggctggtctcaaactcctgagcacaagcaatccatccaccttgcctcccaaagtgctgagattacaggcgtttgccaccatgcctggcctgtatcctctctt

SEQ ID NO: 192734 - DNA, 601 bp, Human
tgcagcctcaatcccctgggctccagcaattctcccacctccgtctcccgagtagctgcgactacaggtgcacgccaccatgcctggctaatttttttgtatttgtagagacagggttttgccatgttgcccaggctggtctcaaactcctgagcacaagcaatccatccaccttgcctcccaaagtgctgagattacaggcgtttgccaccatgcctggcctgtatcctctcttcatttcatgaaaattcttagagagcagccacatttttgggagagcagtactgtctcttaaatttargattaggaatttgatatagaattaatccaaaagggcttaaaaagccaacaggggccaagaaacacaaggatctcagctcactccctttcttgcttacatagggaggtaaaggtgggttcttagtgtgggagacagaactggagggcagacaagggtaaggtgcctggatcactgtttcaaaaataaataccaggcaaaatgattatcatttacaactttttttgcctggcttctgatttcaaacctgggatttttttcttttctttttttttcagttgatgtgatagctagcaacagaaa

SEQ ID NO: 192735 - DNA, 601 bp, Human
ccgtctcccgagtagctgcgactacaggtgcacgccaccatgcctggctaatttttttgtatttgtagagacagggttttgccatgttgcccaggctggtctcaaactcctgagcacaagcaatccatccaccttgcctcccaaagtgctgagattacaggcgtttgccaccatgcctggcctgtatcctctcttcatttcatgaaaattcttagagagcagccacatttttgggagagcagtactgtctcttaaatttaagattaggaatttgatatagaattaatccaaaagggcttaraaagccaacaggggccaagaaacacaaggatctcagctcactccctttcttgcttacatagggaggtaaaggtgggttcttagtgtgggagacagaactggagggcagacaagggtaaggtgcctggatcactgtttcaaaaataaataccaggcaaaatgattatcatttacaactttttttgcctggcttctgatttcaaacctgggatttttttcttttctttttttttcagttgatgtgatagctagcaacagaaatttagttaattatgggaaaggcaatcttctcggattcatt

SEQ ID NO: 192736 - DNA, 601 bp, Human
tactcagtaaacaaaacaaactccctgtccttatggagcctattctagcctggggtaaaagctgatagacaataaatacgtgcacaagtaagaatgtgacatggtggctgggcatggtggctcatacctgtaatcccagcactttgggaggccgaagtgggtggattacctgaggtcaggcgttcgagaccggcctggccagcatggcgaaaccccgtctctactaaaaatgcaaaaaaattagccgggcatagtggcgtgtgcctgtagtcccagctacttgggaggttgaggcaggagmattgcttgaatcccggaggcggaggttgcagtgagccgagatcacgccattgcattccagcctgggtaacaagggcaaaactccgtctcaaagaaaaaaaaaaaaacgaatgcgacatggcaggtgttactttctgctgtatggacaggaaagcaggataagggaaacgggagcaacaggagtgagggcgggtgtggaaggagggttactatttataaggaaggttcaggaaggcctctctgatgaggtgacatttggacctgagatctcaatgaagtgatgagtgagtcacatgacatc

SEQ ID NO: 192737 - DNA, 601 bp, Human
aggaggttctagccattgcagttaggcaagaaaaagaagtaaaagttatttggattatcaaggaagaagtaaaactgtctctatttgcagatgacataatctcatatatagaaagtccagaggaatcgactaaaaaatgattagaactaacaaatgagttcagcaaggttgcaggaaacaagatcaatatacaaaattaaattatatttctatacactaacaatgaacattccagaaatgaaattaagaaaacaatatcatttactgccatagactaacatgatatcagccagagagagaragaaagagagtctggatagggggggaagaagaaggtttgaaccccagatcaccaaaattcaaaggtcggggagatgaagggaagcagtaaggcagtaaggcagctgtacaaccaagagagtcatgtcctggaggcaagtatttgagaacggaggtcatcaacagaatgtgatgctgctgaagagtgagtaagatgaggactagggattgacagctgagtaagttgaatgagcctgagtgaaaagcaggagagaaagaatgagagacagaggggtaagagaaaaactctgtccagaaccaa

SEQ ID NO: 192738 - DNA, 601 bp, Human
aagcagtaaggcagtaaggcagctgtacaaccaagagagtcatgtcctggaggcaagtatttgagaacggaggtcatcaacagaatgtgatgctgctgaagagtgagtaagatgaggactagggattgacagctgagtaagttgaatgagcctgagtgaaaagcaggagagaaagaatgagagacagaggggtaagagaaaaactctgtccagaaccaatacttcttttggaaaatgtagtaaaagtggagcactagcaaaatcaatatgcaagcccatttttttccttattaaattcaayagacatacattttactctcatttactctaaagtcttgtaaatgtgttctctcagtttccatactacctcattgtagtctgtaacggtttgctgagtggactggtacttgtccatggaagccactttggcaacatgaactaaaatggattcaacatggatatcatagagtactgggtatgatgcaagaggtacctgttagagaataaacattggtctcatcctctcagaggccatatatctctttgttcagaaaacatgaagcctgaagtttggtcccacctacgttataatcatgagcaa

SEQ ID NO: 192739 - DNA, 601 bp, Human
tttttccttattaaattcaacagacatacattttactctcatttactctaaagtcttgtaaatgtgttctctcagtttccatactacctcattgtagtctgtaacggtttgctgagtggactggtacttgtccatggaagccactttggcaacatgaactaaaatggattcaacatggatatcatagagtactgggtatgatgcaagaggtacctgttagagaataaacattggtctcatcctctcagaggccatatatctctttgttcagaaaacatgaagcctgaagtttggtcccacmtacgttataatcatgagcaagtgaaaaatcttgcacaaagcattatccttttctacaaatgataacagttatctgctctcttccttataattttgacatttgtttggtatttcagtctgaattgctcatttaagttttatacaaccctgcgaagtgggtggatttttttttttaatccccacaaagaaacaggctcagaaagaggaaacaacttgtccaccctcgtgctatttggaagtgatagagccaggactacccttttagatccataagcttgccaccagaccgggctgtgggatt

SEQ ID NO: 192740 - DNA, 601 bp, Human
cattttactctcatttactctaaagtcttgtaaatgtgttctctcagtttccatactacctcattgtagtctgtaacggtttgctgagtggactggtacttgtccatggaagccactttggcaacatgaactaaaatggattcaacatggatatcatagagtactgggtatgatgcaagaggtacctgttagagaataaacattggtctcatcctctcagaggccatatatctctttgttcagaaaacatgaagcctgaagtttggtcccacctacgttataatcatgagcaagtgaaaamtcttgcacaaagcattatccttttctacaaatgataacagttatctgctctcttccttataattttgacatttgtttggtatttcagtctgaattgctcatttaagttttatacaaccctgcgaagtgggtggatttttttttttaatccccacaaagaaacaggctcagaaagaggaaacaacttgtccaccctcgtgctatttggaagtgatagagccaggactacccttttagatccataagcttgccaccagaccgggctgtgggattttttaaatccctttccacatttgaattt

SEQ ID NO: 192741 - DNA, 601 bp, Human
atttactctaaagtcttgtaaatgtgttctctcagtttccatactacctcattgtagtctgtaacggtttgctgagtggactggtacttgtccatggaagccactttggcaacatgaactaaaatggattcaacatggatatcatagagtactgggtatgatgcaagaggtacctgttagagaataaacattggtctcatcctctcagaggccatatatctctttgttcagaaaacatgaagcctgaagtttggtcccacctacgttataatcatgagcaagtgaaaaatcttgcacaaarcattatccttttctacaaatgataacagttatctgctctcttccttataattttgacatttgtttggtatttcagtctgaattgctcatttaagttttatacaaccctgcgaagtgggtggatttttttttttaatccccacaaagaaacaggctcagaaagaggaaacaacttgtccaccctcgtgctatttggaagtgatagagccaggactacccttttagatccataagcttgccaccagaccgggctgtgggattttttaaatccctttccacatttgaatttaacatcagctgt

SEQ ID NO: 192742 - DNA, 601 bp, Human
gccatatatctctttgttcagaaaacatgaagcctgaagtttggtcccacctacgttataatcatgagcaagtgaaaaatcttgcacaaagcattatccttttctacaaatgataacagttatctgctctcttccttataattttgacatttgtttggtatttcagtctgaattgctcatttaagttttatacaaccctgcgaagtgggtggatttttttttttaatccccacaaagaaacaggctcagaaagaggaaacaacttgtccaccctcgtgctatttggaagtgatagagccakgactacccttttagatccataagcttgccaccagaccgggctgtgggattttttaaatccctttccacatttgaatttaacatcagctgtgctttgataatttatgtcctattttttgatcacaaatttgcaggttgagtttagtgtccctctgagtatgtgtgtgttgtcaacatagcaaggtaaatagaccttgtctttcaaatctaaacagttgctggattatactatggttggttttaaattctaaccagaagtgctcttcattctggaaatgctgccttgtaactgagttgtttc

SEQ ID NO: 192743 - DNA, 601 bp, Human
cagttatctgctctcttccttataattttgacatttgtttggtatttcagtctgaattgctcatttaagttttatacaaccctgcgaagtgggtggatttttttttttaatccccacaaagaaacaggctcagaaagaggaaacaacttgtccaccctcgtgctatttggaagtgatagagccaggactacccttttagatccataagcttgccaccagaccgggctgtgggattttttaaatccctttccacatttgaatttaacatcagctgtgctttgataatttatgtcctattttgtgatcacaaatttgcaggttgagtttagtgtccctctgagtatgtgtgtgttgtcaacatagcaaggtaaatagaccttgtctttcaaatctaaacagttgctggattatactatggttggttttaaattctaaccagaagtgctcttcattctggaaatgctgccttgtaactgagttgtttcctctttcacagcatatgagctatttgcattcatcagtcacatgggaacatccacaatgagtggtcattacatttgccatatcaaaaaggaaggaaggtgagtcatttttagaaggt

SEQ ID NO: 192744 - DNA, 601 bp, Human
tactatatgccaggcactctcctaggtacattgtatgttatcttatttggttctcacattggtcttgtaaagggtatactgttaacgcccttttgcacatcaagacaccgagactcagggaggctgaatagcttgaccttagctagtaagtagctgtgtgagagctgatattcaaagccactttcaactatcataccaaggtgacctcccaaaataaagatgcatcctgcagcagaatgtatgctgtaattggaacctccctaggattgccatatttagccaacaaaaggaaacaagacargaaaaaccaggatgccctattaaatttgaatttcagataaataatgaataattttttagtataaataaatttcaaatattctatgtcccaaatattatatggggcatgcttctactgaaatttcttattgcttacctgatactcagatgtaactgggtaacctgtgttttatctggcagctctaaaccttcagtgctttgccttactacagccttgcagttggcttctcagccttcttaagtagaattgttaagtgtgtagtgaaccggaaatgagacagttgtggaatgaaaggctgct

SEQ ID NO: 192745 - DNA, 601 bp, Human
ttgagcacaggaatttatctcttttttttgagatggagtttcactcttattgcccaggctggagtgcaatggcacaatctcagctcattacaacctccgcctcccaaattcaagcaattctcctgcctcagtctcccaagtagctgggattacaggcatgtgctatcatgactggctagttttgtatttttagtagagatggggtttcactatgttggtcaggctggtcccaaactcctgacctcaagtgatccacccgccttggcctcccaaagtgctgagattacaggtgtgagtcacygcacccggctgggacttaatctttgtggtgaattgtttttattacaaacacgatagcgctttaaaaaacactttatggaatgaagtcaaagaaaataaaataaaaatgctttttaaaagaaaaatagcttaattataattttaaaagcaataaaattcatagtaaataatttataaatataaaaatatacaaagaatatgtaccctggaagcctaacaataaccattgtctacattttgatatacttttctttgttttattgtctcactggaagaaagtatatatatgtctatatgcaca

SEQ ID NO: 192746 - DNA, 601 bp, Human
tcagctcattacaacctccgcctcccaaattcaagcaattctcctgcctcagtctcccaagtagctgggattacaggcatgtgctatcatgactggctagttttgtatttttagtagagatggggtttcactatgttggtcaggctggtcccaaactcctgacctcaagtgatccacccgccttggcctcccaaagtgctgagattacaggtgtgagtcaccgcacccggctgggacttaatctttgtggtgaattgtttttattacaaacacgatagcgctttaaaaaacactttatggmatgaagtcaaagaaaataaaataaaaatgctttttaaaagaaaaatagcttaattataattttaaaagcaataaaattcatagtaaataatttataaatataaaaatatacaaagaatatgtaccctggaagcctaacaataaccattgtctacattttgatatacttttctttgttttattgtctcactggaagaaagtatatatatgtctatatgcacacatactacatataaataaacacacgtatttacaacttaactaaaagcttaaagtatgtgcagagtgcatacaatttttt

SEQ ID NO: 192747 - DNA, 601 bp, Human
acataattctttgactcaatttctcaggctatctatggatttctataaagggagttatgggatcaaaggttaaaatgtttggaggttcctgatacattttagtaactactttttgatggagcttaagaatcaaaaagcagttgtagctgggtatgatggcatgtgcctgtgttcccagctactccagaggctgaagcgagaggatcccttgagcccaggagttcgaagcttcagattgtgctaccttactccagcctggggaatagaatgaggccttgtctcttaaaaaaaaaaaaaaaaagcagttgtgattccctaccagcattctgtccctttttatacaacgaacttgagtatagtaccttaaaacatcatggttaagtgttgtgcgccatatgatttagtgacttctttgtgtaaagtttcctggaactgacttaaatccatcaaatgcttctgtcttattttcagatgggtgatttacaatgaccacaaagtttgtgcctcagaaaggccccctaaagacctgggctacatgtacttttaccgcaggataccaagctaaacctcaaatataaaaattggcgaaaagaagccatac

SEQ ID NO: 192748 - DNA, 601 bp, Human
tagcccccagctgggacagcacagttctagccagccaagcaaggtgggatgatggggcacgtgttgggaccctcagcatgatgaggctggagagctccaggactcacagctccaggcccttgttggcccagtcagtgtgctcaggggctaaaaaggcaaataggatgctttggcctccaggcccttgtagtcagtgctattccctcattctggatcctttatcccgtgcgttcacttggaggcttccttctccccacccagatctcatgttacacgtcaccttctcagaaggcccttccayttgaatcagccctctttccagccccatcactctctagccatcatagtttgccttttctttgcagctctcatgactatctgaattgtttccttatatgtgtaacatccactagaagctgagctccataagcccttgcctggcggattcagcaccatgtcaccagtgtgcagaatggtgctgacatcacggcaggtggcaggcccacaactcccagcagcaaacagagctgggcctgcgtcccaccatccaggtctccagtttgggcttgggtttcccaccatcctggctgcagcctccccc

SEQ ID NO: 192749 - DNA, 601 bp, Human
cccccattctattctcgtggtagtgaataattctcacaagatccgatggttttgtaaggggaaacccctttcccttgaccctctctcttctcttgtctgtcaccatgtgagatttgcctttcaccttccgccatgattgtgagacctccccagccacgtggaactgtgagtccattaaacctctttcttttgtaaattgcccagtcttgggtatgtctttatcagcagcatgaaaatggactaatacaccagggaatccctaaataatcctattcctgagaggtgacactgatccctggtyttcaggccttcactactcagactcagagatgttactctctacccattctctccaagccacactgtgccattggaacagcatgcttctctcttagtatccttatccttcaaggtcaaaggccacaccgtgattacagtcagcagacacacatggcaagccagaggctgacaaggcagtgcttgaccaatcattctttcttccctgagaagactctcgttgatccacagctgctgtctccagggccctaaccagaattttctgcacataaagacatcccatttctggttgctgactctgagg

SEQ ID NO: 192750 - DNA, 601 bp, Human
ggatggggcttgacacagagggacagcactcaccaagatgtctcccttcaagagcagtcctggctcgatggtgatgcagacgctagtctggctgtctcctgggatgttgctaagggagagaggtgggcagaaaaagagtgggctgctggaggggagatgagggaggggcattttctccctgctgcccctacgccacagggttagtgggaaacctctctgactctgtcctttcagccctcttgagaatattctctcctctccccaaccttctgacctggtccttagccctgggccttgggcwtctctggcctctcacgcccatgtaatacttactagatgccagatgtgtacacaggttgcatggcctggtagatgcggagaaatggccgacatcctgtaaaagtggggtgggtgttagctaagacagcagaaactggcaggcaggaggggcagaggagacagtgaagggagaaagagagaaaggaaggaagaaatgggggaagacggggtaggaaggggaaggaggaaaagaggaaagagtaaaagaggaagcagaaaggggaagaaataccaacttttcacttgtaaggcaaattaaatt

SEQ ID NO: 192751 - DNA, 601 bp, Human
caaggatggggcttgacacagagggacagcactcaccaagatgtctcccttcaagagcagtcctggctcgatggtgatgcagacgctagtctggctgtctcctgggatgttgctaagggagagaggtgggcagaaaaagagtgggctgctggaggggagatgagggaggggcattttctccctgctgcccctacgccacagggttagtgggaaacctctctgactctgtcctttcagccctcttgagaatattctctcctctccccaaccttctgacctggtccttagccctgggccttgsgcttctctggcctctcacgcccatgtaatacttactagatgccagatgtgtacacaggttgcatggcctggtagatgcggagaaatggccgacatcctgtaaaagtggggtgggtgttagctaagacagcagaaactggcaggcaggaggggcagaggagacagtgaagggagaaagagagaaaggaaggaagaaatgggggaagacggggtaggaaggggaaggaggaaaagaggaaagagtaaaagaggaagcagaaaggggaagaaataccaacttttcacttgtaaggcaaattaa

SEQ ID NO: 192752 - DNA, 601 bp, Human
ggccagtcttggcctctggggacaaaaatgtcctcccaagaagtttctacatacaagtcagagtgcaaaaagtaagatggatttaaatggcagcaggaagaactgaagctagaattcagagagtccttgtcaccaataagaagccaggaggtaacagctcacgctgagtgatatttccctggagatgctccagaacaacagctaagcccagggtgagagacacagactgtgtgagactggaaggtcttccaagagccctgagagcctatggttccaagcctggcagcccaggaggagtacytgtcttgtcccaagaggcaggaaaggagtaagaaaagaagggagagaaaataaacaaggatggggcttgacacagagggacagcactcaccaagatgtctcccttcaagagcagtcctggctcgatggtgatgcagacgctagtctggctgtctcctgggatgttgctaagggagagaggtgggcagaaaaagagtgggctgctggaggggagatgagggaggggcattttctccctgctgcccctacgccacagggttagtgggaaacctctctgactctgtcctttcagccctcttga

SEQ ID NO: 192753 - DNA, 601 bp, Human
gaacagcagagaattggaggccagtcttggcctctggggacaaaaatgtcctcccaagaagtttctacatacaagtcagagtgcaaaaagtaagatggatttaaatggcagcaggaagaactgaagctagaattcagagagtccttgtcaccaataagaagccaggaggtaacagctcacgctgagtgatatttccctggagatgctccagaacaacagctaagcccagggtgagagacacagactgtgtgagactggaaggtcttccaagagccctgagagcctatggttccaagcctgrcagcccaggaggagtacctgtcttgtcccaagaggcaggaaaggagtaagaaaagaagggagagaaaataaacaaggatggggcttgacacagagggacagcactcaccaagatgtctcccttcaagagcagtcctggctcgatggtgatgcagacgctagtctggctgtctcctgggatgttgctaagggagagaggtgggcagaaaaagagtgggctgctggaggggagatgagggaggggcattttctccctgctgcccctacgccacagggttagtgggaaacctctctgactctg

SEQ ID NO: 192754 - DNA, 601 bp, Human
ggtcccagggagcctccttatcagctccgctgactgagcccccaaggctcaccccaaacccggtgagggagagctcatcaacaccaaacaggatctcagagttctgtggggaaacttctagaacagcagagaattggaggccagtcttggcctctggggacaaaaatgtcctcccaagaagtttctacatacaagtcagagtgcaaaaagtaagatggatttaaatggcagcaggaagaactgaagctagaattcagagagtccttgtcaccaataagaagccaggaggtaacagctcacrctgagtgatatttccctggagatgctccagaacaacagctaagcccagggtgagagacacagactgtgtgagactggaaggtcttccaagagccctgagagcctatggttccaagcctggcagcccaggaggagtacctgtcttgtcccaagaggcaggaaaggagtaagaaaagaagggagagaaaataaacaaggatggggcttgacacagagggacagcactcaccaagatgtctcccttcaagagcagtcctggctcgatggtgatgcagacgctagtctggctgtctcctgggat

SEQ ID NO: 192755 - DNA, 601 bp, Human
ctgggcttcggaacttcttgtggtagcacttcagctgggtgggaagacgggcagaaccagtcaggggcctgaggctgggaggtcaggtcccagggagcctccttatcagctccgctgactgagcccccaaggctcaccccaaacccggtgagggagagctcatcaacaccaaacaggatctcagagttctgtggggaaacttctagaacagcagagaattggaggccagtcttggcctctggggacaaaaatgtcctcccaagaagtttctacatacaagtcagagtgcaaaaagtaagawggatttaaatggcagcaggaagaactgaagctagaattcagagagtccttgtcaccaataagaagccaggaggtaacagctcacgctgagtgatatttccctggagatgctccagaacaacagctaagcccagggtgagagacacagactgtgtgagactggaaggtcttccaagagccctgagagcctatggttccaagcctggcagcccaggaggagtacctgtcttgtcccaagaggcaggaaaggagtaagaaaagaagggagagaaaataaacaaggatggggcttgacacagag

SEQ ID NO: 192756 - DNA, 601 bp, Human
ggaagatgacgtctcgggctgggcttcggaacttcttgtggtagcacttcagctgggtgggaagacgggcagaaccagtcaggggcctgaggctgggaggtcaggtcccagggagcctccttatcagctccgctgactgagcccccaaggctcaccccaaacccggtgagggagagctcatcaacaccaaacaggatctcagagttctgtggggaaacttctagaacagcagagaattggaggccagtcttggcctctggggacaaaaatgtcctcccaagaagtttctacatacaagtcrgagtgcaaaaagtaagatggatttaaatggcagcaggaagaactgaagctagaattcagagagtccttgtcaccaataagaagccaggaggtaacagctcacgctgagtgatatttccctggagatgctccagaacaacagctaagcccagggtgagagacacagactgtgtgagactggaaggtcttccaagagccctgagagcctatggttccaagcctggcagcccaggaggagtacctgtcttgtcccaagaggcaggaaaggagtaagaaaagaagggagagaaaataaacaagg

SEQ ID NO: 192757 - DNA, 601 bp, Human
tggattggtggatggagagagagatgggtaaataaatgtgtatttatatgtcccaggcattaatgtgatatagataaaacttccaatggataaaagaaagaagcaaaagcaaacaccaaacctttcccaaccacctcttctcctctcagaaaatggttcccccttgctgctgccacacccctccactactgctcttctgccctgcagggtaattatcccctgctagtctgcctcccaactcaacaagatttttgagctccaccaaggcagagaccatgccatgttttactttgtatccccrgcacttggtacagatcctagcccaaagcagatgcccagtgaatgttgaaaaaaaaaatgattgtcagtaggacacatgtgacaaactgggaggacaagatgaaggagagacagggaaagtcatagaaggctgcaagatataaaacagcccaaggactgggaggagtttatctccacttctactaacaactggaattcccagaccatccaatctcaactctctcccaagtctctctcaactctctcctaccatcaccctgagactagacagaccacatggtccagaaaagatggtccccat

SEQ ID NO: 192758 - DNA, 601 bp, Human
taagcctctatttctttttctctttttagagaccaggtctcactctgttgcccaggccaaagtgcagcggtgcaatcatagctcactgcagccttgaactcctgggctcaagtgatcctcctgcctcagcccctggaatagctgtgctaacaggcacatgccaccatgcccggctaatttttttattttttgtagagatggggtctcactatatttaccaggctagtcttaaactcctggcctcaagcaatcctcccgccttggcctcccaaagtgctgggattacaggcatgagccaccrtgcctggccatgcctctatttattgatatgtcaattttcgatggtatctcctgactcccactacgtaagaggaggaaatctgtgacccttccttctctcaacttctgcccaatcccttatttatttgatcagctatgcctttatttttccttgttaagactgttatcatttacattctgtactgtaattatgatggcatcttctggctccagtgcaaggagagctcattaaagaaacacccttctacatgagccagaccacactaaggagatctggaccctcctccaagccccaggtcca

SEQ ID NO: 192759 - DNA, 601 bp, Human
tatatttttgagacagaatcttgctctgtcaccctagatggagtacagtggtgcgatcacagctcactgcaacctcaatctcccaagccaaagtggtcctcctacctctgcctccagagtaactgggactacaggtgcaagccaccacgcccggctcatttttgtattttttatagcgacggagttttgctgtgttgctgaggctggtctcaaactcctgggctcaagcaatccaccggcctcagcatcccaaagtgctgggtctacaggcgtgagccaccatacccagccagacatgaaytttaaataacctctatggattgaccactattaatatgaataatttggttcacttatactactacccctacttcctgtcttcttaaatctgattagattattgtttttatttatgctattgattatctttgaaactttaaataagatagttaagcctctatttctttttctctttttagagaccaggtctcactctgttgcccaggccaaagtgcagcggtgcaatcatagctcactgcagccttgaactcctgggctcaagtgatcctcctgcctcagcccctggaatagctgtgctaac

SEQ ID NO: 192760 - DNA, 601 bp, Human
ggagtgcatatttatatttttgagacagaatcttgctctgtcaccctagatggagtacagtggtgcgatcacagctcactgcaacctcaatctcccaagccaaagtggtcctcctacctctgcctccagagtaactgggactacaggtgcaagccaccacgcccggctcatttttgtattttttatagcgacggagttttgctgtgttgctgaggctggtctcaaactcctgggctcaagcaatccaccggcctcagcatcccaaagtgctgggtctacaggcgtgagccaccatacccakccagacatgaattttaaataacctctatggattgaccactattaatatgaataatttggttcacttatactactacccctacttcctgtcttcttaaatctgattagattattgtttttatttatgctattgattatctttgaaactttaaataagatagttaagcctctatttctttttctctttttagagaccaggtctcactctgttgcccaggccaaagtgcagcggtgcaatcatagctcactgcagccttgaactcctgggctcaagtgatcctcctgcctcagcccctggaat

SEQ ID NO: 192761 - DNA, 601 bp, Human
ggatagggtcaggataaaaggaaggagtgagagaatgaattctaactcggcttataccttgaattttctctggcccataagaaaatacaaactccactttgccatactctggaaatcgatcatctggaaaaagagaaggaaaaataaaaataggcaaaaagtcccaaaaaggattccataaaaagttttcttctagaaaaaattaaaataccatatatgtacatggttaataatataataataatcaatgtatatttatacatatatacatgaaattatatctatacaatgaaattaaatytcctgcccactctagcccctgtcctacttgcctgaggtaatgaggtcactgattctaactatttctattgcttttctactagcaatttacctctaagactctaaataatagccactatttttatgccactatttctagatcccaattttattttattttattttatttattttgagatggagtctcgctctgtcgcccagcctggagtgcatatttatatttttgagacagaatcttgctctgtcaccctagatggagtacagtggtgcgatcacagctcactgcaacctcaatctccca

SEQ ID NO: 192762 - DNA, 601 bp, Human
attaagtcactggttcatgtttagctaggggtccactctgaaacccagatcctttactgatggcctgcctctcaaaaataacttgatcactgtggaacagaccaggggtggaagggtgctggggatagggtcaggataaaaggaaggagtgagagaatgaattctaactcggcttataccttgaattttctctggcccataagaaaatacaaactccactttgccatactctggaaatcgatcatctggaaaaagagaaggaaaaataaaaataggcaaaaagtcccaaaaaggattccayaaaaagttttcttctagaaaaaattaaaataccatatatgtacatggttaataatataataataatcaatgtatatttatacatatatacatgaaattatatctatacaatgaaattaaatttcctgcccactctagcccctgtcctacttgcctgaggtaatgaggtcactgattctaactatttctattgcttttctactagcaatttacctctaagactctaaataatagccactatttttatgccactatttctagatcccaattttattttattttattttatttattttgagat

SEQ ID NO: 192763 - DNA, 601 bp, Human
ctccatctaccaaggacctcagtctctgaatataacaggctgatgacctaatgggaccagaacagtttatccaacccagtgcctctctgtctgcttttttatttttattatccagagattaagtcactggttcatgtttagctaggggtccactctgaaacccagatcctttactgatggcctgcctctcaaaaataacttgatcactgtggaacagaccaggggtggaagggtgctggggatagggtcaggataaaaggaaggagtgagagaatgaattctaactcggcttataccttgmattttctctggcccataagaaaatacaaactccactttgccatactctggaaatcgatcatctggaaaaagagaaggaaaaataaaaataggcaaaaagtcccaaaaaggattccataaaaagttttcttctagaaaaaattaaaataccatatatgtacatggttaataatataataataatcaatgtatatttatacatatatacatgaaattatatctatacaatgaaattaaatttcctgcccactctagcccctgtcctacttgcctgaggtaatgaggtcactgattctaacta

SEQ ID NO: 192764 - DNA, 601 bp, Human
ctgcttatgagctacgtgggatcagggacagcagggaaatcacagccccgacattgaaaggacataaagcctccaaagggtcatcccaggcatggccctgccccctcttaaaacgctctccgctccagacagaaacctagggggcacggcagaatctcccagccatccacagaaaacccagctcagcattgggacaaatacctaatgcatgcagagcttaaaagtagacgatgggttgacaggtgcagcaaaccaccatggcacatatatgcctatgtaacaaatctgcacattcagcacrtgtatcccagaacttaaggtaaaataaaaataaataagtaaatttttaaaaacctggctcaaagacagcatagctcctagtcaagtctgtcagggtgagttaccttcctggcttggcagtcctttctttagtctatccagagtccctctgcccataacctaacttcatctcctttcattccattctcgaataagatggtgaacaactggtctccacttataaccagtatagaggcttcaaggttattattaaaccagccttcaggttgaatcacctcagttctcataaatacacatcttc

SEQ ID NO: 192765 - DNA, 601 bp, Human
gatggcacagccccacccaggactggcttcagctgggaggagaagccagacgctgggtgctggcatccttgaaagggccatcctgggtcatgggggtaaatcaggaggttctgcctctgggaagggtctcagtcaccccaactgaacacagatgggtgatgggctggaccatcctgaaggtcctcccagctccaacattctgcagtcctacgaccaactcaagaaaagaagcttgtggccaaaccccaggcagggcatctcaagagttcctgggctctgggcatgctcactttcggagccygccccacgtctccttacacatatgcagatagaccacataaataaatagaatgcatgtagaactctcaagagacgacctgagttgcagtggaccatttgacataatgttaggtttgtagctaaattaaacatgtattaatttcaattctgctgctttcttttcaaatttcagagcctatcagtttgttcccagctctcaaacatttttgttggctgttgatgaaagcttgtaggccctagatcctgtgcctctgttcctagtactctgaccccagagaactcaggcagcaagcctgaagaa

SEQ ID NO: 192766 - DNA, 601 bp, Human
cgtgtagaggaaagagggcacagggaggcccccaggcctacctatctctaacctagctctgccatgggacccaggggccccaggatggcacagccccacccaggactggcttcagctgggaggagaagccagacgctgggtgctggcatccttgaaagggccatcctgggtcatgggggtaaatcaggaggttctgcctctgggaagggtctcagtcaccccaactgaacacagatgggtgatgggctggaccatcctgaaggtcctcccagctccaacattctgcagtcctacgaccaaytcaagaaaagaagcttgtggccaaaccccaggcagggcatctcaagagttcctgggctctgggcatgctcactttcggagcctgccccacgtctccttacacatatgcagatagaccacataaataaatagaatgcatgtagaactctcaagagacgacctgagttgcagtggaccatttgacataatgttaggtttgtagctaaattaaacatgtattaatttcaattctgctgctttcttttcaaatttcagagcctatcagtttgttcccagctctcaaacatttttgttggctgtt

SEQ ID NO: 192767 - DNA, 601 bp, Human
gaaaccttgtgctcattctggtgaccccaaggtcagaggagaaatctttattcaaggaaaggcccaaagattttcagagaggagtcatcaaatccaaaaccttggggagggagacagaagacagcgccgtgtagaggaaagagggcacagggaggcccccaggcctacctatctctaacctagctctgccatgggacccaggggccccaggatggcacagccccacccaggactggcttcagctgggaggagaagccagacgctgggtgctggcatccttgaaagggccatcctgggtcaygggggtaaatcaggaggttctgcctctgggaagggtctcagtcaccccaactgaacacagatgggtgatgggctggaccatcctgaaggtcctcccagctccaacattctgcagtcctacgaccaactcaagaaaagaagcttgtggccaaaccccaggcagggcatctcaagagttcctgggctctgggcatgctcactttcggagcctgccccacgtctccttacacatatgcagatagaccacataaataaatagaatgcatgtagaactctcaagagacgacctgagttgcagtgg

SEQ ID NO: 192768 - DNA, 601 bp, Human
aaccagacctctccccaccacctgtccttgacctttccttcctcccactcaggatcaaaggcctggggcatccaaatacatgtgacccagaaaactccttctcaggtgtgacgagctgaactgttcccccattcagattcctgttttgcaaccctaacccccagcagctcagtatgccactgtatttggagatacagcctttaaagaggcaattaaggtgaaaagagatcattagggtgagcactactccaatacgtctggtgtctttataagaagagatgagggtaagaatacaagcagrgggaagatgatgtgaagatacagggagaaaacagcatctccaagccaaggagagaggtctcaggagaaaccaaccctgctgaaatctggatctcagacttgtagcctccagaactatgagaaaattcatttctgttgaacaagcccctgggtctgtggtgctttgctgtggctgccagagcagattaataatacttcaggcatgggattcaccagaaggcactgctctgggagtaaagggtccccaagatggcaggcactgtcctcccagccactgtcccacaacagagaacttcgtcca

SEQ ID NO: 192769 - DNA, 601 bp, Human
ttataagatttctttgggtgggggtgataaaactgttctaaaatgagattacggtgatggttgtacaagcctaaatatactaaaacccattgaattgtatactttaaagaggtgaagttgtggtattaaattatatctatacagctattaagtttttaaaaagagagtgatggctgaaaactgctttgtggctccaaactataccgccatacacaccatgcacacacatacatatcaaaggtgtaaaaagattagaaagtggaagattgtaagaggaattgtggagagcacggtgtttggyggcaggtcccacctttctagaggcttctccctcatctcagtgagtctgctcagagactcagcaggtacctgcgggcgcatggaggatgtgaaagacaggggcctaactgtgctgtgggaacaggggtgggggcgcactggccacctcaacccgggtctttgcgggggccaggagtgctgactttttactttggaccaaggtgagagagagccagcccctgggctgcctcaaatgctgtccatgagggccacctgcaggggtgagagatttcagcaggaggaggctggagggagcgaagga

SEQ ID NO: 192770 - DNA, 601 bp, Human
gaatggagccccaggactctggtgagggcttctgggccagctcagctcagctcctgggagcagcagggacccccggggaacaccagcccctcccttggccccacactgcaactgttctcacctccctggcctcctgcaagggtgccctggccctcagctcacctccaccacctccaacatcccgctaaggtcccacccaccccaccgcagtgaccagagcaattgtgtgaggaagccagtcagatttgattgtttctcgttccttttactttccagactttgaacaacgttgttatgccactttttaatctgaaaaacaattctgccttcaatgccatttatcctcccaggggcccttcaaatgcagaccctctgcaaagccagcccctctgatcataatcatccccagaagacagggcacttgcccgagccccttacccacgggctgcagggcagagtggatacagcactgggctgacacccctaccccgtctccagacaaccccagggcacagctttctatatccccagggcttacacagtgcccaccacctagcaggggatcagttaagtaactggaaacagaaaggaaggaaggaaa

SEQ ID NO: 192771 - DNA, 601 bp, Human
ctaggttctcaaaccccaactgcatggggcagcagggcagggctcctcaggactcctacccttgtcagaaatggtgagaaatgttatgctgagaaatggtgggtgtcagaatccaagctctacccctacctggctgtgtaagcatcagtaagttacttaacctctctgtgcttgtttcttcatctgtgaaataggaacaagagaactcaggtcacaggagagtcatgaggagtacaagaaattatgggtacctaacagtatctcacatattggggggtgcatattaaaggaggtgggcggrtagattctcctcctcatccctagccaaatcactgtctgggagcatcaattaatacagtccttatgaaggccaatctggccctgtctataaaaattatctcttcatatattcttctacccagcaattccacttccagaaatttgtcctatagatagacttacccaaatgaaaatggtatatgtgcaacgccattcactgcagcatttttttggaaacagcaaaagattggaaacagcttaaatgtttctatgatttaaaggcagtttttaaaaacctagttattaaaacatagtgcacaca

SEQ ID NO: 192772 - DNA, 601 bp, Human
gttgggttatcaaactggctgggcagttttataattacagctcccaatactgtacgcagtggggcagagttggggtacgcagtggggcagagatccatgtggttccatgcagagaggtgggtgtgtgcagaggagcccatgtggttccatgcatgagaggtggctatgactacaggggtccatgtgcttccatgcatgagaggtggctatgactagagggatccatgtggttccatgcatgagaggtggttgtgagcagaggggtccatgtggttccatgtgtgagaggtgactatgagtmaaggggtccctgtggctccatgcatgagaggtggctatgagtacaggagtccatgtggttacatgcatgagtaggtgcagaggtgggtggaggatctgggtgggtatctgcttccttccccaaataagcccatctagggctaggctgaaagtgactcacttatgcagaggccaccaaaccatgaagcacaggcctgcatggcagacagaagccagggcaccacccttgggcctttctgcctttgcatcacatgaggagcgcccatctgcttctcgaaggttctcaagcaatgtgcagaca

SEQ ID NO: 192773 - DNA, 601 bp, Human
cccaactactccctgtgtttcccctcagacacctgagccctcagcccctcgccattttcagcacccctctctggctgctgttctttgagggtaaagaaagaaaataaggggaagaacaaaaatggtacccagtgccctgtaccctggccactgacctatcttcactgatgagataaaatgggacagctcggtgtcacagacttcaaagagaccactaaaaataaggagaccaggggaggggaagcagaggggttctatgcctcaggctccacctggggaagaccacagtttggacaaactrttgcaattatcctcctacctccatagagtcttctagaactaaccaacaaacctcgggctcttgaaaggtttaaggcaccccagttcacccacttgtccccaccccaaccaacccacaacagtattagcagagattttgtttgcacgcaaccttcatgtttatttgtccatctgaatatcatctacattattattttgtaagttataaaaataaacttcatttaacttaaactagttctaagcacaatatccatgatgtcccagattgaatgtgcaaaatacatacctttttttccaatac

SEQ ID NO: 192774 - DNA, 601 bp, Human
tgaacggccctcaagttcccaccattatcctgatgtgccctggaaagtgccaggagtccctaactgataataagacaccaaatccccactcttattaacatgttgtttgtgacttatttgcatatcaattgaatctcccaacccaattctcagagtggacaggaggtgatctgggctttgcggccaggccagtgggagcttcagcgactggtgtctccatgcagagggccccagttagtttgcaaccccaaaatgcttccacagacacaggcttgccctgagctatggctaccccatcctygtgcccagaccttcccagctaagtttggtacagcgagattgggagggaaagccctgccaggcacagcccaactactccctgtgtttcccctcagacacctgagccctcagcccctcgccattttcagcacccctctctggctgctgttctttgagggtaaagaaagaaaataaggggaagaacaaaaatggtacccagtgccctgtaccctggccactgacctatcttcactgatgagataaaatgggacagctcggtgtcacagacttcaaagagaccactaaaaataaggagaccagg

SEQ ID NO: 192775 - DNA, 601 bp, Human
ctttccatttaatagcacacaccttcagaaagtgaacaggagagaacaagatttttctcagggctgtgctgtcagtcttgtcgcaggtggctttgtcctctaagcaagtgacctcaccagtgtcacctacaagcttgcctctggacccagggagggtggaccagctgggcttctcctggccaccttcccattctgctgagtccaagaaaaaaagagggaggctcaaggtccaagacccacacggagcccaaatctcaatgtcagcctgtggccttgaagatggagaaagtcagcttcagamtgaaataaaaaatagagcccctcccacccacggctgcctctgctgctccaggccctctgggggacagcagaactgggatctccagggcccgggaggttggctcagccaagagagctttttaaaagccctggggcttttagagctgaagggccttaggggagtagttaatccccctgcccacccctcactttataggctgacaatgaagctcagcaggctcaggaccacccaaggtcacccggcaaggaagtacaaaaccaactcctggctccctattcagtgctcttgtccctaatgctg

SEQ ID NO: 192776 - DNA, 601 bp, Human
caatgtggtctgtgtgaatgatgcctcttgaagttcaatatgtaacctgcatggctgtacagaatggccctagagaagagtgcttgttccataaatgcttcttgccttacaccgagtagccgagaaagctttatgtagttctgtcagccattgagatactcttctttcaccaccacccagtgaaaaatcaggggttctaggtggaccccgagtttctccccaaaggtgagggaagagagtcagtgcagccgaaacatgaagacatgtattcctcatattctgcagcaaaggctgagcatgrtggaggtccctgagccagagcctaccccatggcatcccctacagacctctccagctacactccagcccagtggacattaacttccctagacccaggacccctgggagatctggtgaaataagggagttgatgaacaccccaaaaaccatctgtggatcccaagatacaacatatgcatcgaaaagttagggtgctgtctctggggatcctctctgtcacccatgacttgcatggagaatgccaggctccatccaggggaaatggggcggcacactgagtggaagctttgcggctgcggga

SEQ ID NO: 192777 - DNA, 601 bp, Human
catgctgttccttccgtgcaatgcccttcctcatcctgcccgtgaaactcccaacctcctgggcaaatgctttcagactcagttcaaacttccctgggaaatttcccttaatctaacttcttccctactgtcctccagactcaggtaaacctctacggtgctcctgttgtcccttgtagacatctctactgtgacaacagtcacccacagaatggtcattactgatgtccatgtctgtcttcccactttgctgagagcttgttgaggaagagcctttatctctctctctctctctctctccccctctccctagggccggttcccagacggtgccatccacaatgtggtctgtgtgaatgatgcctcttgaagttcaatatgtaacctgcatggctgtacagaatggccctagagaagagtgcttgttccataaatgcttcttgccttacaccgagtagccgagaaagctttatgtagttctgtcagccattgagatactcttctttcaccaccacccagtgaaaaatcaggggttctaggtggaccccgagtttctccccaaaggtgagggaagagagtcagtgcagccgaaacatgaaga

SEQ ID NO: 192778 - DNA, 601 bp, Human
atttttgccagctctccaggggtcctggcacacacatggctggaggacatctagagaaacccgccccagctgatcagcactttgggctctgagatcaagaaaccccacttctcttcctcatgaaaagtagggaggttttgcttatttagatgttaggacagacggcccaaccatgaagaataaaaggtgccagccatattgactgcaagaaaggagtcaccttcattggcaatgactcagtgaagacagacccttccctgtcggaccagcaggtaggttttgaatagcgaatgagttactraggttttcaggatgagtcccttcatgataaaaagtcctttgggtccaagtccagcaaataacaattcattaaaatgcattacccagagccgtgatgaccacccaacgtgggggaaaatcagtgccatgacaataggaagaagcaccgtgcctaccccagacataggctgtttggaggcagactgggcaaaactccttaaaaggaggagtggggaatccaaggccacgtgcatctgagaggtaggtgagctttgatgagaagtgaagcttggccaagagcctgcccagagagcaagttctg

SEQ ID NO: 192779 - DNA, 601 bp, Human
acaggcaggaatacccccaaataaatacttaaagccacaaatatttcagaaaatacaaatgttcctaccatgcccaaggatcagcccttaggccagaagtggcagcctctaaaaataaacactctgacagaagcccatggccaaaaacaagtgatcagacaaccacaaaacaggaacatcccaatcaacatacacacacacagaccacaggccagccatgttacaacacagagaactggcacaaagatgctccaccaggcacttgcatccctctacacacacacacacacacacacacacrcacacaccccagggactggatgccctcctcatttactgacctctccagatccacccctctgcccccagttttccccaaggctttgggacctcagccaacaccagccccagacaacacaggaccaaagtattgcagcagcccagggcccagggcccagggctggtctgaactgaaaaggggttttggctaaaatacattctgaatctccaccaacctggccctgtgcctagacccctaaaggctgctaagatgcaggaccaggcacagctgcctcttccaaccccctattatcatcgtaaa

SEQ ID NO: 192780 - DNA, 601 bp, Human
gcttcctgaccagaggcatgaataactctctgagccagcctcctggtccataaaatggggataataatagaatctggttgaaccatctgaaattgccaatattcattaaatacactgtgctttgagtttaaatgagttgacacatgacatgctgagaccagttcctggcacgtgatgggagttcaacagctgggagccctaaccatcaccattatgagtatcattaattcctgaatgaccatttccaaagcatcctcagtcccctccgccaccccatctcaaaaagtctcacccctgcttygatgtctggagttcccactctggattagaggcagaatgccaggagagtagccattgccttgaatgcccatagaggtatcagcatggacggccagtcgccccgaggatagcctttgcccacggaagcagggggagaacccaggagggcagtagggtgcagcaaagggccccaccatgcccaaggtggtggtggcagggaggctgaaggcagagctgggactctctaagacaagcttgccctcagctagatttgtctccagctcaatgcaaaggatgtgatagaaccattcagagatacaat

SEQ ID NO: 192781 - DNA, 601 bp, Human
catcctaaaacctcctctcaccaccctgaggtggggaaaaggggagctgacagaaagacctctaccccaggctttggggcagagcctcaccaacactcagcttcagggccgggcagtggagcccaacactgagcaggaagtgctgggggcaaatcgctccagtcccaagcctagctctggcatttcaccagcttcctgaccagaggcatgaataactctctgagccagcctcctggtccataaaatggggataataatagaatctggttgaaccatctgaaattgccaatattcattaaayacactgtgctttgagtttaaatgagttgacacatgacatgctgagaccagttcctggcacgtgatgggagttcaacagctgggagccctaaccatcaccattatgagtatcattaattcctgaatgaccatttccaaagcatcctcagtcccctccgccaccccatctcaaaaagtctcacccctgcttcgatgtctggagttcccactctggattagaggcagaatgccaggagagtagccattgccttgaatgcccatagaggtatcagcatggacggccagtcgccccgaggatagc

SEQ ID NO: 192782 - DNA, 601 bp, Human
ttggtggaggctgtggagttgcccgagtcgctgctcacagaaagcgtgtgttccacgtggttgggggtggccgacagtgtaggacgtgtggcattaacagccccggtgctgccgtgcagggagtctttcttcttcaccttagcatacaggctcccatctagtggcccctgcgtgtgtcccaccacctctgcaagggacagagccggaggggagacaacagacaacagacattagcgggaggcaggggtatcatccactctgccagagaaagaagctaagagctcccatgccctgcatcctraaacctcctctcaccaccctgaggtggggaaaaggggagctgacagaaagacctctaccccaggctttggggcagagcctcaccaacactcagcttcagggccgggcagtggagcccaacactgagcaggaagtgctgggggcaaatcgctccagtcccaagcctagctctggcatttcaccagcttcctgaccagaggcatgaataactctctgagccagcctcctggtccataaaatggggataataatagaatctggttgaaccatctgaaattgccaatattcattaaatacactg

SEQ ID NO: 192783 - DNA, 601 bp, Human
ttcttttttccccctattaaactctagactccttaaggataagatccatatctgatttccaacatgtattgaaatctccacctctagagacatctgagatcagtccagccacagaatcagggacataagataactcagttggactctccaactctgactcttatttctttttcttgtcttattgcactggctaggacatccaatacaatgttagatgcaagtggtgataacagacatccttattttgtccctggctctaataggaacgcttccaatgctccacaggaaagtgtgatgtatrctataaatttctggtccctaccctttatcaaattagaaaactgcccctaccttctcctctacaacttaagctggaataaggcacaagggtgattggatcaaagtggaataaaccagggacttgagactgaggtatggaggacagccaatggggaaaaggcagacctgggggaggaaagccaggagaaaccagatcaagttcatggccatgaagaggttctcccacagatctgagcttcctaggttactcatgtcaaagtgtatgttccagcttcttacggcagagatgtagacagagcag

SEQ ID NO: 192784 - DNA, 601 bp, Human
ttgcccagtgctatgcttaatctggtatgtacacgtcaacaattcccatatctctaagttccagcctcttctccttaaactcctgactcatttatccaaccactgcagatgtttcatggtcatctcaaacttaatgtgtccaaaagtcatgtttctagtgttcccctgaaactgctcttcataaattgttacccatctcaataaagagcaactccattctttagttgctcaggccccagacctaagcgttgtctctgacttttctctttctctctcattccatgtgtaatctatcagtaaycttgttggctctacctccaaaatatgtctaaaatccgagcacttctcccctttccatggccactgcccagatcaatagcagcagccacctaactgctctccctccttccatcctgcccaccctggtcaattcagaacaagtcagatgatgtcactcttgggcccaaatccttcctaaggcttctcatgccacacggagtaaaagccaccattcttacaatcacctcaaagaccctctgtaagctgtccctgttcccatttcctctctgaacttgtgtcctgctatgcctcccttgatcac

SEQ ID NO: 192785 - DNA, 601 bp, Human
ccttcacaagctgctccatgccagttcctatgctggttccctcctcctgtctgtagccttggaatgtgggaggttccaggactccatccttgggacctctccttacctgtcctcaacccctcggtgacattgcccagtgctatgcttaatctggtatgtacacgtcaacaattcccatatctctaagttccagcctcttctccttaaactcctgactcatttatccaaccactgcagatgtttcatggtcatctcaaacttaatgtgtccaaaagtcatgtttctagtgttcccctgaaactgctcttcataaattgttacccatctcaataaagagcaactccattctttagttgctcaggccccagacctaagcgttgtctctgacttttctctttctctctcattccatgtgtaatctatcagtaatcttgttggctctacctccaaaatatgtctaaaatccgagcacttctcccctttccatggccactgcccagatcaatagcagcagccacctaactgctctccctccttccatcctgcccaccctggtcaattcagaacaagtcagatgatgtcactcttgggcccaaatcct

SEQ ID NO: 192786 - DNA, 601 bp, Human
ctcaaaagtgggccaaagagctggaaagggagaagggggaaggagagccacccaccagagagggaggaagattggagccggtggagaggagggggcgggaagctgccactgtgtccgatgccctgcagcctggcgttgtacgctgcccaccccccaccccaggggagccagcagggagtgggaggcaggaaggaagggaggatatggggcaaggcaggcaccccaccaacagcacagggaacagatggacatgggaaacacagagagtgcaggggacggggcattaaacaggacaaaacamaacaaaaacaaagagaaaatcaagattagttggtgttctgactctggtatctgggcacacactggagggaggtggggaaggtatcagacaggaagagagggggatccaaggtcctgcttctccaagaggcagatggacctcctgctggccagcaccacagcgtttccctctcttctaaccccagggtggaagcagaggtgccatcgtgggaccaggagaattcacgcatccctcacctgctcccataggcagcaggcctgtccctggaccacccatcttttcctgggcacctgcctctcc

SEQ ID NO: 192787 - DNA, 601 bp, Human
atggagaagtaagtgaggagacagaagagaggatagtgagaaatggggaaggagaaggagaaacagatggaaaccagagaacaacagaagagggagaggaaaagacagaggagagaaggaagaaggtgggaaagatttggaaggaatagcacatgaagaaggagtgaaaagaaactgatgctcaaaagtgggccaaagagctggaaagggagaagggggaaggagagccacccaccagagagggaggaagattggagccggtggagaggagggggcgggaagctgccactgtgtccgatgycctgcagcctggcgttgtacgctgcccaccccccaccccaggggagccagcagggagtgggaggcaggaaggaagggaggatatggggcaaggcaggcaccccaccaacagcacagggaacagatggacatgggaaacacagagagtgcaggggacggggcattaaacaggacaaaacacaacaaaaacaaagagaaaatcaagattagttggtgttctgactctggtatctgggcacacactggagggaggtggggaaggtatcagacaggaagagagggggatccaaggtcctgcttc

SEQ ID NO: 192788 - DNA, 601 bp, Human
catgcagacaggagggagagagggctggagagaggagggatggagaagtaagtgaggagacagaagagaggatagtgagaaatggggaaggagaaggagaaacagatggaaaccagagaacaacagaagagggagaggaaaagacagaggagagaaggaagaaggtgggaaagatttggaaggaatagcacatgaagaaggagtgaaaagaaactgatgctcaaaagtgggccaaagagctggaaagggagaagggggaaggagagccacccaccagagagggaggaagattggagccggyggagaggagggggcgggaagctgccactgtgtccgatgccctgcagcctggcgttgtacgctgcccaccccccaccccaggggagccagcagggagtgggaggcaggaaggaagggaggatatggggcaaggcaggcaccccaccaacagcacagggaacagatggacatgggaaacacagagagtgcaggggacggggcattaaacaggacaaaacacaacaaaaacaaagagaaaatcaagattagttggtgttctgactctggtatctgggcacacactggagggaggtggggaagg

SEQ ID NO: 192789 - DNA, 601 bp, Human
ccacctgctgggccagggtgccagaaagccacacggcgatcacactagcagccctagggcaagccatgccagctccccttgaggcaggcccaccatcccagaacctgcccctacccaggcccagctgaacactacactccccaccactgggctgagagaagggcagaggaagaagaaaggagggaggggcggttgaagggagcagtctgctagagccatctcctgatcatccctggactgggagaagaagggaccatggaggcaccagataactgacattgggaatcaacagttcccattkcccctaggccttttcctggagctgctcaggggcatggtgtagggcaggcctgagcatggcatcttccctgacccagcctccagtgtcagaggagcaggggaaggaagaggtgattccctggccagggctcaacgcctaagggcctgcgtgtcccagaggccaggggtagatgttagtggacggcatcattctcaaatgaattactgtgaccccagtgaagcatccacaaggtccagggcatgtcaaaccaccgtgcaaaatacacaacaggacaggactatcatctgtccacttctcaga

SEQ ID NO: 192790 - DNA, 601 bp, Human
ctgctgcccaccacccctggatcacgtgacgagtaccctggtgtcaggcttcatgatgtgcctcctctgcaccccccagactggccactgccaccctcacagacccagctcttctttccagtcttccgatttccaaaagactggattcctcaggtccaggtagcagggctgggtgtccgacagcatgcctggggctccagaagcgaggggatccgggaggccacctgctgggccagggtgccagaaagccacacggcgatcacactagcagccctagggcaagccatgccagctccccttraggcaggcccaccatcccagaacctgcccctacccaggcccagctgaacactacactccccaccactgggctgagagaagggcagaggaagaagaaaggagggaggggcggttgaagggagcagtctgctagagccatctcctgatcatccctggactgggagaagaagggaccatggaggcaccagataactgacattgggaatcaacagttcccattgcccctaggccttttcctggagctgctcaggggcatggtgtagggcaggcctgagcatggcatcttccctgacccagcctc

SEQ ID NO: 192791 - DNA, 601 bp, Human
cgtcactcttctgccaggacagtgctgtgctggacaacagctcactccaaggctcccctagcatgagccagactggaggcaattaatccccttcatctgacacacacacgcacacacactcacacgcacactcgcacaccctgcaattctgggagctgtagccctgacacagaccgatacatgtactttggcaaagcactgctgcccaccacccctggatcacgtgacgagtaccctggtgtcaggcttcatgatgtgcctcctctgcaccccccagactggccactgccaccctcacagmcccagctcttctttccagtcttccgatttccaaaagactggattcctcaggtccaggtagcagggctgggtgtccgacagcatgcctggggctccagaagcgaggggatccgggaggccacctgctgggccagggtgccagaaagccacacggcgatcacactagcagccctagggcaagccatgccagctccccttgaggcaggcccaccatcccagaacctgcccctacccaggcccagctgaacactacactccccaccactgggctgagagaagggcagaggaagaagaaaggagg

SEQ ID NO: 192792 - DNA, 601 bp, Human
tgctcaagggagagccacggcttcctggggccaccaatcagtcacagcttcagcctcctcatgcccaagatggcagccaacacaagttctgttggcacaggggccacgtacattgccacattcctctccagtacaggacagccagcccctaggggaatgcacagccagctccagttctccctcctctcaccagggccagtggatagcttgagccaggcccagccaacctgatccctgaacagcaccagtgtctcctttttgtgctgacccaggcctctcctgagtacactgagtccctcgyggcctggtattaatccatcacttccttccccacaaccacctcctccagttcctcttcatgtctcttcttctataaaaaggaacactgccccatgccttggctcatttgggtcttggccttaggtggatgtgtctctgtcctttggggatctgcctccccagtaagtgtataggggctgggggctaaatgcctctgcctggaggccaaggatggatgagctgggggctctgtcagcctgagggtcctgggtccctctctccttggtagaagctaaataggttgcctggaatggaagaggtg

SEQ ID NO: 192793 - DNA, 601 bp, Human
ttcctgggcaattgggcccttctgctgaggcagatgagtgggcgacgctaaagccaggcaagtcttttgcttcctgagagaaaaattccacacgtttctccaccttctgtcttctctccctaaccctgtgtgtctatggaacctctgacttctcaccgaggtacccatggctggccaagaggagggagagaagaaggcaaaacccagttctagcacagcccaggtggcttccacccaaggcaaggtgatgtcctttccctggccatttacagctaacagtgaatggaagcagatgtcaccrtggaaagtgagagaggttccccgcagtcacaagaggctgcagagctggctctcacgtaacctgctctaggctcaccctgtccagcacagcagtcacgagccacacatggccgcagagccgttgcagggtgaccagtgtgaacagagacatgccataagtgtgaaacacacacagggttttaaagtatgaaaaagaacacaaaacatcccgttcttttttacattgattatacgttgaaatgctaatattttagactggggttaaataaaacatattaaaatgaatttcaccagtttcttc

SEQ ID NO: 192794 - DNA, 601 bp, Human
cctcacccaacacacacacacacacacacacacacacacacacacagacacacacagtccatttaaaacatgtacttggatggattcagaagagaacagaagaaaattgggcctcaggatggcacaccctgcaaaggacagagacagaaggagataatgggccagagccacgccaaccctgagacctcaggccagccctcggccaagcatgtcccttgaaaagcccaggaggagagaacttctcaatgtggggctctgtccccccaaacctcagtgtcctggaaggaggagaagcctatartctgtggccaagagcacccactccctatgcgaagcctgggctcctcccaggccgcccatctgggttacaagtgtcatgtaacacacaaggtcagaaagggctgctggctttttcccattagccaagaacctggccagattcagagctgatctgcagggtggctgttatgcccagtcacgagatacctgggtggcagctgccatgtctcctgacacagctctgagaagaagttaaaaaatgaactctgtgtctcctatcaacgacattgggagcctgcagagaccacagccccaaggatac

SEQ ID NO: 192795 - DNA, 601 bp, Human
gaagacctgggctgagggcaaggggatcgaggaaacggcaggcaatgatggccactgctagtcatgggtttctctggtagggttctctgggcctgaagaggcagacctagagaccactctgaatgccaggtgatgcctcgtggatgccaggtgaatgcctgtgatgcttcgtggatgctcagagcagagccagctgggctgccagcagaggccctggcacacagcagcaggggcatgcttctctgactctgtgtgtgtgtgtgtacatgtgtgtgtacccatgtgtgcatgtatgtgcgcmcatgtacgtgtacccgagggcctgaacacctagaatgtgtggcttccagcagagatctcaacaccaccaaggaaactgagaccaggcctccaaagcctcaagctagaggaggctgggagttgtgcaaactccacaagtcaacagacaggaaggctgcaaggaaatctgtcacccccaacccctacacagagagccccaacccaggcctgacctcagtgtgggcacaaagctggctgctgaccagattctgagacccgggtttctgtccagaaccacaggagtcctcctccccctggcccc

SEQ ID NO: 192796 - DNA, 601 bp, Human
gagaagacctgggctgagggcaaggggatcgaggaaacggcaggcaatgatggccactgctagtcatgggtttctctggtagggttctctgggcctgaagaggcagacctagagaccactctgaatgccaggtgatgcctcgtggatgccaggtgaatgcctgtgatgcttcgtggatgctcagagcagagccagctgggctgccagcagaggccctggcacacagcagcaggggcatgcttctctgactctgtgtgtgtgtgtgtacatgtgtgtgtacccatgtgtgcatgtatgtgcrcccatgtacgtgtacccgagggcctgaacacctagaatgtgtggcttccagcagagatctcaacaccaccaaggaaactgagaccaggcctccaaagcctcaagctagaggaggctgggagttgtgcaaactccacaagtcaacagacaggaaggctgcaaggaaatctgtcacccccaacccctacacagagagccccaacccaggcctgacctcagtgtgggcacaaagctggctgctgaccagattctgagacccgggtttctgtccagaaccacaggagtcctcctccccctggcc

SEQ ID NO: 192797 - DNA, 601 bp, Human
gccagggagagtcagaagcccggaggtggcaggtcctttgacagtcaggagaagacctgggctgagggcaaggggatcgaggaaacggcaggcaatgatggccactgctagtcatgggtttctctggtagggttctctgggcctgaagaggcagacctagagaccactctgaatgccaggtgatgcctcgtggatgccaggtgaatgcctgtgatgcttcgtggatgctcagagcagagccagctgggctgccagcagaggccctggcacacagcagcaggggcatgcttctctgactctrtgtgtgtgtgtgtacatgtgtgtgtacccatgtgtgcatgtatgtgcgcccatgtacgtgtacccgagggcctgaacacctagaatgtgtggcttccagcagagatctcaacaccaccaaggaaactgagaccaggcctccaaagcctcaagctagaggaggctgggagttgtgcaaactccacaagtcaacagacaggaaggctgcaaggaaatctgtcacccccaacccctacacagagagccccaacccaggcctgacctcagtgtgggcacaaagctggctgctgaccagattctg

SEQ ID NO: 192798 - DNA, 601 bp, Human
ccagggaggccgagcagccatcctccttccttcctcagagcttgggctgctctcctcagcagcagagtaagatgcagccagcatcgggagtagggatgggggatgagcacaggccagggagagtcagaagcccggaggtggcaggtcctttgacagtcaggagaagacctgggctgagggcaaggggatcgaggaaacggcaggcaatgatggccactgctagtcatgggtttctctggtagggttctctgggcctgaagaggcagacctagagaccactctgaatgccaggtgatgcctygtggatgccaggtgaatgcctgtgatgcttcgtggatgctcagagcagagccagctgggctgccagcagaggccctggcacacagcagcaggggcatgcttctctgactctgtgtgtgtgtgtgtacatgtgtgtgtacccatgtgtgcatgtatgtgcgcccatgtacgtgtacccgagggcctgaacacctagaatgtgtggcttccagcagagatctcaacaccaccaaggaaactgagaccaggcctccaaagcctcaagctagaggaggctgggagttgtgcaaactccacaagt

SEQ ID NO: 192799 - DNA, 601 bp, Human
tggtgaagatgaggaagagcaaaaaaggaaaaagagagaaagagattaacagggattatttcttgagaaagagaatctgtggagaaaacggagatgggaaagctggggtgaggccagggccgatttgcgctgtccacagaaggactccaaggggaaggccgaggcccaccctgcaaaggaccccaaggctccgaggcatagttgagtccccggctctcaggagcctgagcccctcgcagcccctgtgcccagggctctgtgggccaagtgtcaagcaggagtgtgctggctggtgagaggsagcccccagcccccttctactgatcccccgtggctcagtgtccctggccatgccgacactctgagtgggaggctatgcccagctgcgtggcttcatgggtcacaaatgcatgccactgcccacctacctggctggatccgtcttctggtaactaaggaaaaaagtaaagttgaccccaatagcccccacccagccctaaaaccagagtccagggagcagctttctgagttcagtggccccacatggccaccaagggcccagggagccctgtctccctccaccataagaaggagaggagct

SEQ ID NO: 192800 - DNA, 601 bp, Human
aggaggtgtccagggtggtatctcatcaccaagcgttgggggacaggaaggccatgtgcctggtcgcctgagtcccagtgaggaaagagagctgcctccagccagcctcttcaagccctgcgtgaaaagccatttccagacccagagagcaggaagtcacagcaaatgctacttaccttctgacagcctgaccaccaccttcccctcatcttcctctgagggaagacgagaagagaggtgggaggaaggagaggcaggaaagaagggcaggtggtgaagatgaggaagagcaaaaaaggaraaagagagaaagagattaacagggattatttcttgagaaagagaatctgtggagaaaacggagatgggaaagctggggtgaggccagggccgatttgcgctgtccacagaaggactccaaggggaaggccgaggcccaccctgcaaaggaccccaaggctccgaggcatagttgagtccccggctctcaggagcctgagcccctcgcagcccctgtgcccagggctctgtgggccaagtgtcaagcaggagtgtgctggctggtgagaggcagcccccagcccccttctactgatccccc

SEQ ID NO: 192801 - DNA, 601 bp, Human
ggcaggctggtgcaaatggcgctgggagaggaaggtgcaagaggagcgttttggtcaacaaggtgacactgcaggagcccccagacactggctgtgcctgagccagcgcctggcagctacaagctcccccatcaggactcaggaggtgtccagggtggtatctcatcaccaagcgttgggggacaggaaggccatgtgcctggtcgcctgagtcccagtgaggaaagagagctgcctccagccagcctcttcaagccctgcgtgaaaagccatttccagacccagagagcaggaagtcacrgcaaatgctacttaccttctgacagcctgaccaccaccttcccctcatcttcctctgagggaagacgagaagagaggtgggaggaaggagaggcaggaaagaagggcaggtggtgaagatgaggaagagcaaaaaaggaaaaagagagaaagagattaacagggattatttcttgagaaagagaatctgtggagaaaacggagatgggaaagctggggtgaggccagggccgatttgcgctgtccacagaaggactccaaggggaaggccgaggcccaccctgcaaaggaccccaaggct

SEQ ID NO: 192802 - DNA, 601 bp, Human
gtccctccctgtctacctctatgagctgctgcacaccaggcaggctggtgcaaatggcgctgggagaggaaggtgcaagaggagcgttttggtcaacaaggtgacactgcaggagcccccagacactggctgtgcctgagccagcgcctggcagctacaagctcccccatcaggactcaggaggtgtccagggtggtatctcatcaccaagcgttgggggacaggaaggccatgtgcctggtcgcctgagtcccagtgaggaaagagagctgcctccagccagcctcttcaagccctgcgtgaaaagccatttccagacccagagagcaggaagtcacagcaaatgctacttaccttctgacagcctgaccaccaccttcccctcatcttcctctgagggaagacgagaagagaggtgggaggaaggagaggcaggaaagaagggcaggtggtgaagatgaggaagagcaaaaaaggaaaaagagagaaagagattaacagggattatttcttgagaaagagaatctgtggagaaaacggagatgggaaagctggggtgaggccagggccgatttgcgctgtccacagaaggactccaagg

SEQ ID NO: 192803 - DNA, 601 bp, Human
agtccctccctgtctacctctatgagctgctgcacaccaggcaggctggtgcaaatggcgctgggagaggaaggtgcaagaggagcgttttggtcaacaaggtgacactgcaggagcccccagacactggctgtgcctgagccagcgcctggcagctacaagctcccccatcaggactcaggaggtgtccagggtggtatctcatcaccaagcgttgggggacaggaaggccatgtgcctggtcgcctgagtcccagtgaggaaagagagctgcctccagccagcctcttcaagccctgcktgaaaagccatttccagacccagagagcaggaagtcacagcaaatgctacttaccttctgacagcctgaccaccaccttcccctcatcttcctctgagggaagacgagaagagaggtgggaggaaggagaggcaggaaagaagggcaggtggtgaagatgaggaagagcaaaaaaggaaaaagagagaaagagattaacagggattatttcttgagaaagagaatctgtggagaaaacggagatgggaaagctggggtgaggccagggccgatttgcgctgtccacagaaggactccaag

SEQ ID NO: 192804 - DNA, 601 bp, Human
gagatcgtgccactgcactccagcctggacaacaagagcaaaactccatctcaaaaaaaaaggcgtcattcaggccaaaacgtcagtggtgccaacgtggagaatctcttctctgagaaatgcctgtggagcacgtcccgggaaaggggatctgagtccctccctgtctacctctatgagctgctgcacaccaggcaggctggtgcaaatggcgctgggagaggaaggtgcaagaggagcgttttggtcaacaaggtgacactgcaggagcccccagacactggctgtgcctgagccagcrcctggcagctacaagctcccccatcaggactcaggaggtgtccagggtggtatctcatcaccaagcgttgggggacaggaaggccatgtgcctggtcgcctgagtcccagtgaggaaagagagctgcctccagccagcctcttcaagccctgcgtgaaaagccatttccagacccagagagcaggaagtcacagcaaatgctacttaccttctgacagcctgaccaccaccttcccctcatcttcctctgagggaagacgagaagagaggtgggaggaaggagaggcaggaaagaagggc

SEQ ID NO: 192805 - DNA, 601 bp, Human
tactcagggggctgaggcaggagaattgcttgaacctgggaggcagaggttgcagtgagccgagatcgtgccactgcactccagcctggacaacaagagcaaaactccatctcaaaaaaaaaggcgtcattcaggccaaaacgtcagtggtgccaacgtggagaatctcttctctgagaaatgcctgtggagcacgtcccgggaaaggggatctgagtccctccctgtctacctctatgagctgctgcacaccaggcaggctggtgcaaatggcgctgggagaggaaggtgcaagaggagygttttggtcaacaaggtgacactgcaggagcccccagacactggctgtgcctgagccagcgcctggcagctacaagctcccccatcaggactcaggaggtgtccagggtggtatctcatcaccaagcgttgggggacaggaaggccatgtgcctggtcgcctgagtcccagtgaggaaagagagctgcctccagccagcctcttcaagccctgcgtgaaaagccatttccagacccagagagcaggaagtcacagcaaatgctacttaccttctgacagcctgaccaccaccttcccctc

SEQ ID NO: 192806 - DNA, 601 bp, Human
gccaggagaattatccccccaggggacactggcaatgttggagacattttcgattgtcatgactgagtgagagctactggcatctagcaggtagaatccagggacactgctaatcctcctacagtgcacagggcagcacccacaacaaagagtcattcagggccaggcacagtggctcacacctgtaatcccagcactttgggaggccaaggtgggtggatcgcctaaggtcaggagctcaagaccagcctggccaacatggtgaaaccccatctctactaaaaatacaaaaaaaaaaaaattgctgggcgtggtggtgcatgcctgtaatcccagctactcagggggctgaggcaggagaattgcttgaacctgggaggcagaggttgcagtgagccgagatcgtgccactgcactccagcctggacaacaagagcaaaactccatctcaaaaaaaaaggcgtcattcaggccaaaacgtcagtggtgccaacgtggagaatctcttctctgagaaatgcctgtggagcacgtcccgggaaaggggatctgagtccctccctgtctacctctatgagctgctgcacaccaggcaggctgg

SEQ ID NO: 192807 - DNA, 601 bp, Human
tgggaatcccaatgcattattgtatacacggtgagtccatagatttcctgaaacacgcgaagttgtctgagatccccgaaagacagacttagtactttctgtgttgataggaaaccaggcagggcttccagagggcaaatcgtggctgtaagatgggggctctgcgccaggagaattatccccccaggggacactggcaatgttggagacattttcgattgtcatgactgagtgagagctactggcatctagcaggtagaatccagggacactgctaatcctcctacagtgcacagggcakcacccacaacaaagagtcattcagggccaggcacagtggctcacacctgtaatcccagcactttgggaggccaaggtgggtggatcgcctaaggtcaggagctcaagaccagcctggccaacatggtgaaaccccatctctactaaaaatacaaaaaaaaaaaaattgctgggcgtggtggtgcatgcctgtaatcccagctactcagggggctgaggcaggagaattgcttgaacctgggaggcagaggttgcagtgagccgagatcgtgccactgcactccagcctggacaacaagag

SEQ ID NO: 192808 - DNA, 601 bp, Human
gccccctctctgcttccctggtgcccagtgcagggctcatctaaatcaggggttcctctgggacccatagacatgccaactccttgaaactgcttttcagaattacgtgcatgggaatcccaatgcattattgtatacacggtgagtccatagatttcctgaaacacgcgaagttgtctgagatccccgaaagacagacttagtactttctgtgttgataggaaaccaggcagggcttccagagggcaaatcgtggctgtaagatgggggctctgcgccaggagaattatccccccagggracactggcaatgttggagacattttcgattgtcatgactgagtgagagctactggcatctagcaggtagaatccagggacactgctaatcctcctacagtgcacagggcagcacccacaacaaagagtcattcagggccaggcacagtggctcacacctgtaatcccagcactttgggaggccaaggtgggtggatcgcctaaggtcaggagctcaagaccagcctggccaacatggtgaaaccccatctctactaaaaatacaaaaaaaaaaaaattgctgggcgtggtggtgcatgcc

SEQ ID NO: 192809 - DNA, 601 bp, Human
ggggggatgccagtgcccagaaccacaccctggcctcccgcccaggctggcacccactttgtttcacctgctggtttgagtcctcactcgagttctgctcctggtgtgtccaaggcctcccacctgattatgccccctctctgcttccctggtgcccagtgcagggctcatctaaatcaggggttcctctgggacccatagacatgccaactccttgaaactgcttttcagaattacgtgcatgggaatcccaatgcattattgtatacacggtgagtccatagatttcctgaaacacgcraagttgtctgagatccccgaaagacagacttagtactttctgtgttgataggaaaccaggcagggcttccagagggcaaatcgtggctgtaagatgggggctctgcgccaggagaattatccccccaggggacactggcaatgttggagacattttcgattgtcatgactgagtgagagctactggcatctagcaggtagaatccagggacactgctaatcctcctacagtgcacagggcagcacccacaacaaagagtcattcagggccaggcacagtggctcacacctgtaatcccag

SEQ ID NO: 192810 - DNA, 601 bp, Human
gaggtggggacagggagggtgcttcatgtagaacattccaggagcccaaaccctgccaagtggctgctggcggtgaagagcagctgcagcacagggtgacttgggctcctccggtctggcactgtcagctccttgtccacaccctgaagtgcattttctgtctcccaaagaggctctttgcttggagagaaggggcacacccaccctaactaaaatcaagacatgtgggtgggaaagaaagaagggaatatggaaacccccaggtcccagatctagaagctcaaaagttagaattccaaayattttagattgagccacatgccccctcctcccagcccccatgacatcctattcctacctcagctcagcacttttgcctaatattgaaatgtctgttggcatcactctcctcaccagctgccttaacacatccttatattcccaaagcctggcaaacagtcagcgcacaaagtattatgaataaatgaatcaatgcatgaaagaatgaatgaatgtaaagtgtttcgcacagcgcctgggacatagcagacatccctcaaattattcttttccccaagccgaataatcctgcctctggcca

SEQ ID NO: 192811 - DNA, 601 bp, Human
agtccatcaactgtcctaggttgctccattggaatgaaccatcagtttcccaccaggcccctgacccacacattaggtaagcaattcacattgccctacgccccacccttttaaagaagtacaggtacccctgctagcaacagtaaaactgagataaagtgggccacaccaccccgtcctgtggtcaggacacagccaagcctgtggcttgcgggtgcttacttgccattaggcaaggctgggtctactaactgcttctggcctaaacacaggcacctgagctgcagcctgggagtctgayggcaagattgcatggagggcccatgggacagtgtattagaaaccctgagatggctcgatagcatggccaagttcttaaggcaacagtcccattggccccttcagctcctaaactgcagaacaccagaggagttctcaagacactgggagtctgaacttggggaacaggatggctcgcccagggagaagcagcagcatccattctgaccacaatgttggaaacagcccttgtgcattgggtggccaacctagccaaggccactcagacccagccccacctggccctgccctcaccgggccc

SEQ ID NO: 192812 - DNA, 601 bp, Human
ggcctcctcgaaagcctccctcaaccagcccaggccacccacctcctcgcagaaggcccaggccaaattcataccaaaggcatggattctgtgccacccaagcacgaggctctgctggaactagaagacaatgcagatatcccctgaccaggcccagtacacttttttgtaaagacttaatagtaaatatcttaggctggtgggtaaggctgtcactgttgcaactacacaactctgctgttgtggtgtgacagcttacatagacaacaggacagtgaatgggcatggttgggttgcaatsaaactttctttaccaaaatagtcagtggacaggatctgaccagctgccacagtgtgctgacccctgatctaacctatctcctcagcccagagaggtggagccgtgcgccaggacacatggataattagtggcagtgaacactagcaccaaagtctccagactcacaagctggctctgggtgacctagacagggcccataggctcacaggacacccagagctggctctatccagcacttcagcccatcaggcagagaaaagccaactccatagggctattcctagtgataaaaagagcaaa

SEQ ID NO: 192813 - DNA, 601 bp, Human
aaggatggatgctgaggcccgacaagggaaatgactaggtccccagatggcccgactcccagaccggcacctgcccaactcctctacggcctctgaggccagctcccaaacgaactccgcttgaaagaggaagaagcaacagaacgctcttgtttaccccgggccatgatccgggaggaatgtcattcctaccacctccaaatcccaccctgtccctgtcttacccaggaggaacctggcctgagtacagagccatactgcccacaactaaggcatccactgaaatcagcctgagaaactraagaaccagagtctgtgcatccctcaggaggccaggcccctgcagcccctgctggccaagactgcaatggtcagagttggagaagagccccctcctccaggtctcctccagaagacaatgcagagatcccctaaccagggccagtacacttttttgtaaagacttaatagtaaatatcttaggctgttgggtcaggctgtcactgttgcaactatacaactctgctgttgtggtgtgagagcttacatagacaataggacagtgtatgggcatggctgggttgccatcaaactttcttta

SEQ ID NO: 192814 - DNA, 601 bp, Human
gggggtgggggacacacgctagaaaaggccattttacagataaggatggatgctgaggcccgacaagggaaatgactaggtccccagatggcccgactcccagaccggcacctgcccaactcctctacggcctctgaggccagctcccaaacgaactccgcttgaaagaggaagaagcaacagaacgctcttgtttaccccgggccatgatccgggaggaatgtcattcctaccacctccaaatcccaccctgtccctgtcttacccaggaggaacctggcctgagtacagagccatactrcccacaactaaggcatccactgaaatcagcctgagaaactgaagaaccagagtctgtgcatccctcaggaggccaggcccctgcagcccctgctggccaagactgcaatggtcagagttggagaagagccccctcctccaggtctcctccagaagacaatgcagagatcccctaaccagggccagtacacttttttgtaaagacttaatagtaaatatcttaggctgttgggtcaggctgtcactgttgcaactatacaactctgctgttgtggtgtgagagcttacatagacaatagga

SEQ ID NO: 192815 - DNA, 601 bp, Human
atcccaggatagtgccagagttcatgtgagctccaccccctgcccagaatccagaaacagccttggccacctagcaacaggcctgcactggtgagtcttgccctgtggggctgctgtagactcaccagcccctttgatgccaagacacacccacccctctctgcctgacacactcagcattcctctagagactggcatcagggaaccccattcccaggcggaactcaacattccatcgcccacctctggcattcctgtagcactgagcagtttagtttacagaggacctcattatacacgrcactacctggtgttcaaaacagcctaagagggggtgggggacacacgctagaaaaggccattttacagataaggatggatgctgaggcccgacaagggaaatgactaggtccccagatggcccgactcccagaccggcacctgcccaactcctctacggcctctgaggccagctcccaaacgaactccgcttgaaagaggaagaagcaacagaacgctcttgtttaccccgggccatgatccgggaggaatgtcattcctaccacctccaaatcccaccctgtccctgtcttacccagga

SEQ ID NO: 192816 - DNA, 601 bp, Human
gaaataatggccccttgttctgagctccaagcccttcactcatgtgtgggctttgggcccatctgactctcatcctgtgcagggagggcgccatgatgcaggtctggggcagaggatagagatgcgggctctggaatcacacgcttccacctgaatctgatttctgccactgcttagctgtggcacctttatgcctcaggttcctcttctgaaaagtgggaacaataatagtgctcacctcctaggattgctgcgaggattaaataactgcataaagcacttagcaaagtgccaggtaccwaggatgagcccactacataagtcattactgttggtagattttcaacttggggaaggactttgccacattcaccgtggtacccttcactccttccagcacagttttggatgggcggaattgaatgcggcctgggaattataggtcactgggctccccacaggattcagcgcgcaggacatgtgccctcaatgcaccttgatgaactggtttgcaaggtaccgccatctgggtatgctttctgcctgtccacgccataggcaacagatccaggaggcctcacccatcccgtcccagtcccag

SEQ ID NO: 192817 - DNA, 601 bp, Human
ccctcctgggggcgacacctcctaggtcctcctcctttgcctggcactcgatgccttgcctgagctgattgcaaccctcctttcctatgccgtcatcccatctctttgtcccctccaccttcacccccactaccccagtcaagcagctccttgctgcacccctccactaagcctgtcagcagggactgtcacccacctctgggctttcatctctgtgtgatgcactcagaaatatggatgccagccatccatccacccaggcaccccctaatggcaggccacatgccctcagcctcacacycccaacatggccacagcccagtcctctgtccctgctgggctgtccttctggaatgccctgtctctctttcttcatctttcaacatcctgctacttcctctacacccttcacaaatgcctccagccctcagaaatcctcgctgcatccctagccagaaataatggccccttgttctgagctccaagcccttcactcatgtgtgggctttgggcccatctgactctcatcctgtgcagggagggcgccatgatgcaggtctggggcagaggatagagatgcgggctctggaatcacacgctt

SEQ ID NO: 192818 - DNA, 601 bp, Human
aaggacatcagggttttatacgttaccttacagaaccatcagaagaagaaactgaggctcagggaggttaagcagtaggcttagtaccacactgcttataaaagaccagggtttcaacttagctgtgtctgattccaaagcccacgtcttccccactgcaccatgctcactcctgagccatgtcaaagtgaagagccctctcctatcgaaactggaggtggctgtcatgttatagcctccagcatcacagaaattcctaatggagtttcctggctcctgttcctactgggagtagccctgycttgactcagtttcctcaagtgtgatatcatcatccttaaacattgacagagagtgctagaattgggctttcactcctagatggctccaaaaaagcaaagacaaggaatcacaggggaaggtttcacatcaggggatttgaggtcattgtaaggtctgctctccagccactggggatgtggccaccaatggagaaagctgtcttgcatggtaatgaggctcctgtcattaggagcatttaagcagaggctgacagacctattggcctgaatgctgtagagggaatttcctgcattgggag

SEQ ID NO: 192819 - DNA, 601 bp, Human
tttgttgtggaggccagaaacctggtagacccctgctgggtgccgacacaggctggggctccccggggtggtcgctgcactgctctgggggctggagacagtgctaccatggaagccagtgcctggtggacccatcatctggtgatggctcaaactgggactgctgggggcagccatgctgggattgatggcccgccggccgaagccaggactagggggagtgttggtgcccactgttctgtggcgcgcctgagggctcccaggcaccgtgtggacgccagccacactgaactgagctcgrgcctggctttccggagaggagctgaaatgctgaagtgagtagtcggggctgctgtagctactgcccacagtcgggagaggagaagagctctggtagtttctctgggcagacgggctgggctgtcccaggctgcctgagcggaagccagactccaacagaggctgggtgggcgtccggggaccctggtcactgctctctcccgacgggaaactccccactgaagtgctgcagagagatggcaggttgcgatgtcagtggacagaactgaatgaagggtggatttacagcaggctgtctgcc

SEQ ID NO: 192820 - DNA, 601 bp, Human
ggcccaggctggggcttccagggctggctattgcattgctatgaagaccggaggccaggttgccttggtgagccccagggtgccggcccaggctgggactccccggggtggtggccactttgttgtggaggccagaaacctggtagacccctgctgggtgccgacacaggctggggctccccggggtggtcgctgcactgctctgggggctggagacagtgctaccatggaagccagtgcctggtggacccatcatctggtgatggctcaaactgggactgctgggggcagccatgctggrattgatggcccgccggccgaagccaggactagggggagtgttggtgcccactgttctgtggcgcgcctgagggctcccaggcaccgtgtggacgccagccacactgaactgagctcgagcctggctttccggagaggagctgaaatgctgaagtgagtagtcggggctgctgtagctactgcccacagtcgggagaggagaagagctctggtagtttctctgggcagacgggctgggctgtcccaggctgcctgagcggaagccagactccaacagaggctgggtgggcgtccggggacc

SEQ ID NO: 192821 - DNA, 601 bp, Human
cccgctgggactggacatgccgctggcgacaggcgaagacaccttcccattgatggtggcatagttggggaggctgcctgcccggtctcccactgacatccttcgcttctctggcaaggctggtgttgggctcccttgccggaaggctgcggagtctggtgacggggaggtggcagggctgctcaggccagggtagtaggcaggggagacagggaaggagggcgtggaaggagcctggtagccagaggcactgctctgccgggacagtgtgggtctccgatcctccggggtagaatagccrccataggccacatgccggtccaagcaggggctgccgggaaccacagatccagaccctccgaggtgacggcccaggctggggcttccagggctggctattgcattgctatgaagaccggaggccaggttgccttggtgagccccagggtgccggcccaggctgggactccccggggtggtggccactttgttgtggaggccagaaacctggtagacccctgctgggtgccgacacaggctggggctccccggggtggtcgctgcactgctctgggggctggagacagtgctaccatggaag

SEQ ID NO: 192822 - DNA, 601 bp, Human
atttttatcatcctcatctgtatccacatcctcatctcagcatccacaaccacagcacacgtatcgtaaggatacctccaactctctttatacggataaagaaactaagtcccagaagtcagtgattcacccagggtcgtctgccaagagaatgtcagaatagacactgggatagatatttcactcttctacttacttcatcagcaggagaggtgaaaatggaagggggagaggcccacctggcatggagtacttggagaagtcgggcagagtgtgggagaaggagacggtgctgcccccrctgggactggacatgccgctggcgacaggcgaagacaccttcccattgatggtggcatagttggggaggctgcctgcccggtctcccactgacatccttcgcttctctggcaaggctggtgttgggctcccttgccggaaggctgcggagtctggtgacggggaggtggcagggctgctcaggccagggtagtaggcaggggagacagggaaggagggcgtggaaggagcctggtagccagaggcactgctctgccgggacagtgtgggtctccgatcctccggggtagaatagccacca

SEQ ID NO: 192823 - DNA, 601 bp, Human
gccttggctctgccatttcttgactgtatgatactagacaagtgacagagcctctaagcctcagtttgtaaactggggttaataatattaatacctactttactaagtggccaagaagcttaaatgacacagtactcagctcagagcctggcacacagcatgtgctcaatgagtggtaatggctatgaggacgatgataatcataacagtaatactattcattatgatttttatcatcctcatctgtatccacatcctcatctcagcatccacaaccacagcacacgtatcgtaaggatamctccaactctctttatacggataaagaaactaagtcccagaagtcagtgattcacccagggtcgtctgccaagagaatgtcagaatagacactgggatagatatttcactcttctacttacttcatcagcaggagaggtgaaaatggaagggggagaggcccacctggcatggagtacttggagaagtcgggcagagtgtgggagaaggagacggtgctgcccccgctgggactggacatgccgctggcgacaggcgaagacaccttcccattgatggtggcatagttggggaggctgcc

SEQ ID NO: 192824 - DNA, 601 bp, Human
acccccaagatatggacacatgataaagacaactccagtgatgcttgaagaccattagttttggggtggcgtggcctggattggaagccttggctctgccatttcttgactgtatgatactagacaagtgacagagcctctaagcctcagtttgtaaactggggttaataatattaatacctactttactaagtggccaagaagcttaaatgacacagtactcagctcagagcctggcacacagcatgtgctcaatgagtggtaatggctatgaggacgatgataatcataacagtaatastattcattatgatttttatcatcctcatctgtatccacatcctcatctcagcatccacaaccacagcacacgtatcgtaaggatacctccaactctctttatacggataaagaaactaagtcccagaagtcagtgattcacccagggtcgtctgccaagagaatgtcagaatagacactgggatagatatttcactcttctacttacttcatcagcaggagaggtgaaaatggaagggggagaggcccacctggcatggagtacttggagaagtcgggcagagtgtgggagaaggagacg

SEQ ID NO: 192825 - DNA, 601 bp, Human
ctcaacttcagcatacccaccatgaagatgagggcagaaagatccatttctgcccccttttccccaggcctctcctcactttccacagggaaggcctatgttctgcatcacatagaacaaaaaaaaaatcacttctctttggatcaaacaggtgatggctggcctagaatctagaggccatctactgcatgtcaggcaccccacttctcaggcagacagcacccccacacacacccatgcccagactctgcagaccttgggaatttgtcatagaacattagattctggagggagctcagayaggacacagtccaactgcctaattttacataaaaggaggaattcagggatgagaagtgacttgcccaagtcacacagatggtgaccttggtaagaggccctagcagtcagtttaggaccagctaaactgtatcttcctgtctaagcatcaggatgtgcggccctcactctcaacctcttccttcagcttttggcaccaaagaaaacacaaaaagggagggagaacagaaaaagatgaggattccacatttttcctctcctgtcttcagagacagaagttggcatgaaagacactgcaaag

SEQ ID NO: 192826 - DNA, 601 bp, Human
gccatctgggtggctgagccacctcctggtggagggcctggcactgcattcccacagagcccactgaaagccttcctccaccccgtgtccccctttccctagaagactgtgactaaagccttcctacagcttttctcccatggcctaaaacacttgcttctagaacctttctccacaggttcagtttctcaacttcagcatacccaccatgaagatgagggcagaaagatccatttctgcccccttttccccaggcctctcctcactttccacagggaaggcctatgttctgcatcacatrgaacaaaaaaaaaatcacttctctttggatcaaacaggtgatggctggcctagaatctagaggccatctactgcatgtcaggcaccccacttctcaggcagacagcacccccacacacacccatgcccagactctgcagaccttgggaatttgtcatagaacattagattctggagggagctcagacaggacacagtccaactgcctaattttacataaaaggaggaattcagggatgagaagtgacttgcccaagtcacacagatggtgaccttggtaagaggccctagcagtcagttt

SEQ ID NO: 192827 - DNA, 601 bp, Human
tccatcccctatcccctgcccgccatctgggtggctgagccacctcctggtggagggcctggcactgcattcccacagagcccactgaaagccttcctccaccccgtgtccccctttccctagaagactgtgactaaagccttcctacagcttttctcccatggcctaaaacacttgcttctagaacctttctccacaggttcagtttctcaacttcagcatacccaccatgaagatgagggcagaaagatccatttctgcccccttttccccaggcctctcctcactttccacagggaargcctatgttctgcatcacatagaacaaaaaaaaaatcacttctctttggatcaaacaggtgatggctggcctagaatctagaggccatctactgcatgtcaggcaccccacttctcaggcagacagcacccccacacacacccatgcccagactctgcagaccttgggaatttgtcatagaacattagattctggagggagctcagacaggacacagtccaactgcctaattttacataaaaggaggaattcagggatgagaagtgacttgcccaagtcacacagatggtgaccttggta

SEQ ID NO: 192828 - DNA, 601 bp, Human
gtggaagggaccttcggcctcctcatccatcccctatcccctgcccgccatctgggtggctgagccacctcctggtggagggcctggcactgcattcccacagagcccactgaaagccttcctccaccccgtgtccccctttccctagaagactgtgactaaagccttcctacagcttttctcccatggcctaaaacacttgcttctagaacctttctccacaggttcagtttctcaacttcagcatacccaccatgaagatgagggcagaaagatccatttctgcccccttttccccagrcctctcctcactttccacagggaaggcctatgttctgcatcacatagaacaaaaaaaaaatcacttctctttggatcaaacaggtgatggctggcctagaatctagaggccatctactgcatgtcaggcaccccacttctcaggcagacagcacccccacacacacccatgcccagactctgcagaccttgggaatttgtcatagaacattagattctggagggagctcagacaggacacagtccaactgcctaattttacataaaaggaggaattcagggatgagaagtgacttgccca

SEQ ID NO: 192829 - DNA, 601 bp, Human
acaccatgcgaacacagtggaagggaccttcggcctcctcatccatcccctatcccctgcccgccatctgggtggctgagccacctcctggtggagggcctggcactgcattcccacagagcccactgaaagccttcctccaccccgtgtccccctttccctagaagactgtgactaaagccttcctacagcttttctcccatggcctaaaacacttgcttctagaacctttctccacaggttcagtttctcaacttcagcatacccaccatgaagatgagggcagaaagatccatttctkcccccttttccccaggcctctcctcactttccacagggaaggcctatgttctgcatcacatagaacaaaaaaaaaatcacttctctttggatcaaacaggtgatggctggcctagaatctagaggccatctactgcatgtcaggcaccccacttctcaggcagacagcacccccacacacacccatgcccagactctgcagaccttgggaatttgtcatagaacattagattctggagggagctcagacaggacacagtccaactgcctaattttacataaaaggaggaattcagggatg

SEQ ID NO: 192830 - DNA, 601 bp, Human
ggtggcgctagttttacttaagtctcattgagcctaccgaccttcgttctttcttaggtgagacaaattttctttaaagttaaaatttaactactcctacgggtcttcctgtactcaggttggcaaacttattctgttgggtttttatgtttgtttttgtgagaccgggcctcactctgtcactcaggctggcatgcagtggcacaatcatggctcactgcagcctcaacctcctgggctcaagtgatcctcccacctcagcctctccagtagctgggaccacaggccactattcagtgtrtgccattttgcctggctcattttctttttgttttttgtagattcaggatctcactatgttgccctggctggtctcgaactcctggccccaagtgatccccctgccttggcctcctgaagtgctgggattataggtgtgcaccaccacacctggctggcaaacttactctgtaaatggccggagagtaaatatttcaggcttcgcaggccatgcagcctctgctacaactactccactctgccactgcagcaggacagcagcacagggaggatgcaagccagcaggtgtgggggcgcccca

SEQ ID NO: 192831 - DNA, 601 bp, Human
accttcatggccagcccgtacgcgcctcggaaggagtgactgtcgcggatgatgaaggcccccggctcctggtccttgaggagcgcgatggctgcatggggaagggacaaggagagaggaggaagcaagacctcggtggcgctagttttacttaagtctcattgagcctaccgaccttcgttctttcttaggtgagacaaattttctttaaagttaaaatttaactactcctacgggtcttcctgtactcaggttggcaaacttattctgttgggtttttatgtttgtttttgtgagaccrggcctcactctgtcactcaggctggcatgcagtggcacaatcatggctcactgcagcctcaacctcctgggctcaagtgatcctcccacctcagcctctccagtagctgggaccacaggccactattcagtgtatgccattttgcctggctcattttctttttgttttttgtagattcaggatctcactatgttgccctggctggtctcgaactcctggccccaagtgatccccctgccttggcctcctgaagtgctgggattataggtgtgcaccaccacacctggctggcaaacttac

SEQ ID NO: 192832 - DNA, 601 bp, Human
cagcatccccttagtcagggaacaccctcccagcacacagattagaaagtctggcgacatttaggcaccgccttctctttcctgaggctgctctctcctctccatccagaccaacccctcaacacctcagtctgcctccccactctcttccccagatgcccatctcatcctccaggacatgtctcctgtcccctacttctgtctcctgtcatccctgggacgacgtggtctgaggattccatatgaatttcttcatacggagagttttcctgaacaatctggcaagtccatttatgtatgytcctggagtcaagctttttcataaattttttcttcttttttaataggaagaaaaggagagtagttttgagtttctccagactggcaaaatgacatgtgtcctccagccctggcccatgtccggagtggctggcaggatcaagacatgacaagggccagctcaagggtgtgggtggtgagccaggagtctcacgttcctacctcggtttggaatgaccagcttgcaaggcagggccaatgggatgatggagtgctggtagaccagggcagacagcgatcctgtagggaggcagacggcatg

SEQ ID NO: 192833 - DNA, 601 bp, Human
tgctgggaggagttctaggtgcccacctgccacgctccagggctgatgcgcctccatgagagaagctaaacactccttccctagccctgccgtctcactcaaattctcatcctgcatgtcctcatgctcttggagtccattccaacttcccacaatcaaaacaggacttgctcttccctaacagctcagcatccccttagtcagggaacaccctcccagcacacagattagaaagtctggcgacatttaggcaccgccttctctttcctgaggctgctctctcctctccatccagaccaayccctcaacacctcagtctgcctccccactctcttccccagatgcccatctcatcctccaggacatgtctcctgtcccctacttctgtctcctgtcatccctgggacgacgtggtctgaggattccatatgaatttcttcatacggagagttttcctgaacaatctggcaagtccatttatgtatgttcctggagtcaagctttttcataaattttttcttcttttttaataggaagaaaaggagagtagttttgagtttctccagactggcaaaatgacatgtgtcctccagccctggcc

SEQ ID NO: 192834 - DNA, 601 bp, Human
ttgtgagctctggagtccagcagaactgggctcaaaccctcaccccagcacttactaagtatctataaaacaaagacgatgatcatggtacccacgtcactgggtttttgagcgactccatgtacagcttagccagtgcttaacataaagcaagccttcaagtgacaattggcattgctgttattgttttgcattgatatatctttgtgtaggtcaataaatcccctaattcccctaattcattaaaccattgatccagcataactctaatttcaatattaataagaattgagtgatggayatattagcatattgatgtaacccacaatgtatgcatttatcaaaacatcacattgtacatggtacataattttttttttttttttgaaacagaatcctgctctgtcacccaggctggagtgcagtggcatgatcacagctcactgcagcctcaaactcccatgctctagcagattatcccacattagcctccagcgtagctgggactacaggcatgagccaccatgcctggataatttttttactgttttgtaaaaacagggtcttctgatattctacaggctggtcttgaatgcctcac

SEQ ID NO: 192835 - DNA, 601 bp, Human
tgcaggaggggtcagggcaggaaggcagaaagagaggcctgggcatgggtacagtttcaggtgaccactcacctgccccttgtttcagcaggtctgcagttgagttggcagggccggagctatctttcgattcatctgtggggtctaagacaaaaattcagtaggaattaaaaccctagagctggaaagaagcacaagtttggctgggctgaaggtgagctctgcaactctttggcagaaggaacgctgcttttcataccagaccctggcagtcagccctgagttaggctcagtctgaacrtttgatgattgctctaagcagccagcacactggttgtgagctctggagtccagcagaactgggctcaaaccctcaccccagcacttactaagtatctataaaacaaagacgatgatcatggtacccacgtcactgggtttttgagcgactccatgtacagcttagccagtgcttaacataaagcaagccttcaagtgacaattggcattgctgttattgttttgcattgatatatctttgtgtaggtcaataaatcccctaattcccctaattcattaaaccattgatccagcataactc

SEQ ID NO: 192836 - DNA, 601 bp, Human
agaaatgtgatcttcccagagacatttgggcctggagagacctccagcctgcacgtgcaggaggggtcagggcaggaaggcagaaagagaggcctgggcatgggtacagtttcaggtgaccactcacctgccccttgtttcagcaggtctgcagttgagttggcagggccggagctatctttcgattcatctgtggggtctaagacaaaaattcagtaggaattaaaaccctagagctggaaagaagcacaagtttggctgggctgaaggtgagctctgcaactctttggcagaaggaacrctgcttttcataccagaccctggcagtcagccctgagttaggctcagtctgaacgtttgatgattgctctaagcagccagcacactggttgtgagctctggagtccagcagaactgggctcaaaccctcaccccagcacttactaagtatctataaaacaaagacgatgatcatggtacccacgtcactgggtttttgagcgactccatgtacagcttagccagtgcttaacataaagcaagccttcaagtgacaattggcattgctgttattgttttgcattgatatatctttgtgtag

SEQ ID NO: 192837 - DNA, 601 bp, Human
tgggaggtagatgcaagatagatggatgagaaggtagatgagcagttgggtgcaaggaatcaatcaagtggtaaatgtgtgggtacacggatgaatagatgagtcacaggaaggagaaccccaccgaggagcaggcaggggagtcttactttctctggttgtcagtcagagtgattccctgggcagagactttgaagtgaacgatggtggcagctggcgtggggtctgcagccaacgtctcagatgtggctttagagatggcctgtggcccagtgagtgactccatgtccacagagttgaygaagagcacattgcaggctggaagaaaccaacccaagggggagtcatgggagctggcgtgggtgaggacattaacccagatccattcttcagggagaaggtagcagataaatttcaggctagccttgagccaaggcatctgcacatagaaatgtgatcttcccagagacatttgggcctggagagacctccagcctgcacgtgcaggaggggtcagggcaggaaggcagaaagagaggcctgggcatgggtacagtttcaggtgaccactcacctgccccttgtttcagcaggtctgcag

SEQ ID NO: 192838 - DNA, 601 bp, Human
ggatggatggatggatggatgggtgcatggatgggtgcatggatgggtgcatggatggatggatggataagtagctgggtagatgggaggtagatgcaagatagatggatgagaaggtagatgagcagttgggtgcaaggaatcaatcaagtggtaaatgtgtgggtacacggatgaatagatgagtcacaggaaggagaaccccaccgaggagcaggcaggggagtcttactttctctggttgtcagtcagagtgattccctgggcagagactttgaagtgaacgatggtggcagctggygtggggtctgcagccaacgtctcagatgtggctttagagatggcctgtggcccagtgagtgactccatgtccacagagttgacgaagagcacattgcaggctggaagaaaccaacccaagggggagtcatgggagctggcgtgggtgaggacattaacccagatccattcttcagggagaaggtagcagataaatttcaggctagccttgagccaaggcatctgcacatagaaatgtgatcttcccagagacatttgggcctggagagacctccagcctgcacgtgcaggaggggtcagg

SEQ ID NO: 192839 - DNA, 601 bp, Human
aggtcaggccacctttccaccatctgtggctatcgcaggtccacacaacttctctcttatgagcaagatggcctgagctgttgacactggtgacccaagcaatgtacagagacagatgtgccatagaatcatcccaaatgctaggggctggggaaggaagaaactggcactgaggaataggaaatgtggggaggggctggaagaagaagcaaagaggccagggacactgttaggagagagtccaagtggacgggctctgctcctagaaagcaggtcctttttatcagttgtatttacagcygtatacccaatgctggcaaattctcatagaaggatggatgaatgggtggatggatagatgaatggagatacagatggatgaagggaaaaacaggtggtaagggatagatgagggatgaataaatgcagggaggcatggatggatggatggatggatggatggatggatggatggatggatggatggatgcatggatggatggatggatggatggatggatggatggatgcatggatggatggatggatggatggatggatggatggatggatgcatggatggatggatggatggatggat

SEQ ID NO: 192840 - DNA, 601 bp, Human
ggctcagggtaaatcatcgtactttctccctagagcccagccccacccatgcccagaccctctgcaggaaggtctggggagaggagctgccccccattcccccctcattcccccattcccccattccccagggacaggagctgcccaagatcacacagatgcattcaaggtcgagagaacactgcagcctgcctcctgaggggctctccccatcatggagaggagaagcagattcaaggtcagggcatggcagagggggtagcagtgggcactgagtccctgggagggtctccatatctayagtgggaaagactcaaaagatgcccaacacgattactcacacatgggcagaccttccagctgaatggagaatgtatgcacatgcacacacacacacacacacatgcacatgcatgcacccacacagacgtcagtgttagaaagctgtgtgggagagaagctgtgtacaagagacttactttctttcctgtggatccaggtcacagaaggtgacagtgttgagagggtagtggcgtctgaaaaagagcctgcagcacagacatcagataaacagagaatgagtgctgaaggggctgctttt

SEQ ID NO: 192841 - DNA, 601 bp, Human
tgtaagcaatctctgacccatttccattgcttctaataagactgttttctgtccacttcctgccatccctgctgcttctaaccctgggagagtgaaggcagctggaccagacgctgggcctctggcctcgaggcaggacaaggcaaaaggcctggaagcctggtcaagcttcactcggaagctgagtgaccttggcacaaaggtttttgctgctctttccctacccccagccctggtttctaaatgtgccccgtgcttccctcactgtgaagtacaaaggccagcctgctgggcaggggtragaagtcacacttacttagcaggggcaccaccctctgttttcatccacctgtggagagaaagtgggctcagggtaaatcatcgtactttctccctagagcccagccccacccatgcccagaccctctgcaggaaggtctggggagaggagctgccccccattcccccctcattcccccattcccccattccccagggacaggagctgcccaagatcacacagatgcattcaaggtcgagagaacactgcagcctgcctcctgaggggctctccccatcatggagaggagaagcagattca

SEQ ID NO: 192842 - DNA, 601 bp, Human
tattctttttttaaccttttcttacattttattagcttacagattctgtcagtatgtctcatgtatatattatataatatttatatatcagtacaatgcctctctctaggggactcgcataggcttaagaatggagtcctggtgaattttccattctggcttagagtccttaaatggtggtcaggtgttttcccaactgtccagtggaccttaggccctttggcccaagtgcaagccttctgccctctgctgcatgggcagcgtggctcagctagggaaaccaaggcagaaagggtgacastgaggctttggcattgtaggtaggcgatgtggtgtacaggcagcaggcccaggagctctgctgaggtcagagggtgcctgcaaaagccagaccctaaaacacttacagaggggaggataaggactccaggtttctggccggagcctcactgagcagaaagtaggttccccagggagaattccaacacagggaccctgcagaatagaacagggctgggcagagcagcaagactcaatccccagcccccaaaaaggcatcatgcaggtaagcaggtctgagataaggctggtccaggggcat

SEQ ID NO: 192843 - DNA, 601 bp, Human
agttaccagctttctggcatgaatgggtcctcccgcaggggcacacatggctcaggctggagtggaggggctggccatgcatgcaaggtgggctgtggtgggtggtgaggaagggaaaagcgaccgtgaaagctgaccccagactcagtcctgggccccagccaggctgcttgaagggtctgatacaccgcccagcctcaagtgtggacagaacatccatgccaggaataggctcctgggctctccagtgggagatgagatatttacaaaggaaggggatgggaaatatctcctatcttgraagataattggggtttgctagggaatgaggagagggggaaacccagatatttggcttgaataacccagaaggaagagcactttggagggactttggtcaccaggcacaaggtttcactctgggaagcagggggtggccagtggggcctctgcccctgctctccaccttctgcagacaccctcctttccaactccctgaaacagaacgtccacactgacacagctccttggaggagaaaaaatacaaaagacacacacgcacctatgtgtgccatacacacccatgtccccgcatgctcac

SEQ ID NO: 192844 - DNA, 601 bp, Human
aggctcatcagaacaaggcagaatctcctactcactaacctcctgagagccgtttatagggggatcacacttgtccaggagggctgcccctcctgctttcacacaaccactggccccaccatccctctcctggccagtctcagaagacccagggatcctcaaaaaccaggggagaaggaatcctggccattggtgtccacagctttcagagctactggaggagacgctcagatgacatgggtcaaaggcctttcccaaacttaggatgtgatgtatctgtcccttaagcgcctggctaaayaagagagccagaacaccgtgatagcaggctgatcaaaccgctcacttcctccctgttttccttcgcaggtcccctctccattgttttctcgcccaatccttccctcttgctccctttgggaaaaagccacgtggagctcactgggcccctcccccagctgaagggacatgaccctcctctgccctcttccctccagacacccagctggacagctggtggcagcacgggactgaacctgctggggtctgcgtcgctgcgatgtccatgactccctggctctttgttgcccatcttctccca

SEQ ID NO: 192845 - DNA, 601 bp, Human; identical to SEQ ID NO: 188614

SEQ ID NO: 192846 - DNA, 601 bp, Human; identical to SEQ ID NO: 188615

SEQ ID NO: 192847 - DNA, 601 bp, Human; identical to SEQ ID NO: 188616

SEQ ID NO: 192848 - DNA, 601 bp, Human; identical to SEQ ID NO: 188617

SEQ ID NO: 192849 - DNA, 601 bp, Human; identical to SEQ ID NO: 188618

SEQ ID NO: 192850 - DNA, 601 bp, Human; identical to SEQ ID NO: 188619

SEQ ID NO: 192851 - DNA, 601 bp, Human; identical to SEQ ID NO: 188620

SEQ ID NO: 192852 - DNA, 601 bp, Human; identical to SEQ ID NO: 188621

SEQ ID NO: 192853 - DNA, 601 bp, Human; identical to SEQ ID NO: 188622

SEQ ID NO: 192854 - DNA, 601 bp, Human; identical to SEQ ID NO: 188623

SEQ ID NO: 192855 - DNA, 601 bp, Human; identical to SEQ ID NO: 188624

SEQ ID NO: 192856 - DNA, 601 bp, Human; identical to SEQ ID NO: 188625

SEQ ID NO: 192857 - DNA, 601 bp, Human; identical to SEQ ID NO: 188626

SEQ ID NO: 192858 - DNA, 601 bp, Human; identical to SEQ ID NO: 188627

SEQ ID NO: 192859 - DNA, 601 bp, Human; identical to SEQ ID NO: 188628

SEQ ID NO: 192860 - DNA, 601 bp, Human; identical to SEQ ID NO: 188629

SEQ ID NO: 192861 - DNA, 601 bp, Human; identical to SEQ ID NO: 188630

SEQ ID NO: 192862 - DNA, 601 bp, Human; identical to SEQ ID NO: 188631

SEQ ID NO: 192863 - DNA, 601 bp, Human; identical to SEQ ID NO: 188632

SEQ ID NO: 192864 - DNA, 601 bp, Human; identical to SEQ ID NO: 188633

SEQ ID NO: 192865 - DNA, 601 bp, Human; identical to SEQ ID NO: 188634

SEQ ID NO: 192866 - DNA, 601 bp, Human; identical to SEQ ID NO: 188635

SEQ ID NO: 192867 - DNA, 601 bp, Human; identical to SEQ ID NO: 188636

SEQ ID NO: 192868 - DNA, 601 bp, Human; identical to SEQ ID NO: 188637

SEQ ID NO: 192869 - DNA, 601 bp, Human; identical to SEQ ID NO: 188638

SEQ ID NO: 192870 - DNA, 601 bp, Human; identical to SEQ ID NO: 188639

SEQ ID NO: 192871 - DNA, 601 bp, Human; identical to SEQ ID NO: 188640

SEQ ID NO: 192872 - DNA, 601 bp, Human; identical to SEQ ID NO: 188641

SEQ ID NO: 192873 - DNA, 601 bp, Human; identical to SEQ ID NO: 188642

SEQ ID NO: 192874 - DNA, 601 bp, Human; identical to SEQ ID NO: 188643

SEQ ID NO: 192875 - DNA, 601 bp, Human; identical to SEQ ID NO: 188644

SEQ ID NO: 192876 - DNA, 601 bp, Human; identical to SEQ ID NO: 188645

SEQ ID NO: 192877 - DNA, 601 bp, Human; identical to SEQ ID NO: 188646

SEQ ID NO: 192878 - DNA, 601 bp, Human; identical to SEQ ID NO: 188647

SEQ ID NO: 192879 - DNA, 601 bp, Human; identical to SEQ ID NO: 188648

SEQ ID NO: 192880 - DNA, 601 bp, Human; identical to SEQ ID NO: 188649

SEQ ID NO: 192881 - DNA, 601 bp, Human; identical to SEQ ID NO: 188650

SEQ ID NO: 192882 - DNA, 601 bp, Human; identical to SEQ ID NO: 188651

SEQ ID NO: 192883 - DNA, 601 bp, Human; identical to SEQ ID NO: 188652

SEQ ID NO: 192884 - DNA, 601 bp, Human; identical to SEQ ID NO: 188653

SEQ ID NO: 192885 - DNA, 601 bp, Human; identical to SEQ ID NO: 188654

SEQ ID NO: 192886 - DNA, 601 bp, Human; identical to SEQ ID NO: 188655

SEQ ID NO: 192887 - DNA, 601 bp, Human; identical to SEQ ID NO: 188656

SEQ ID NO: 192888 - DNA, 601 bp, Human; identical to SEQ ID NO: 188657

SEQ ID NO: 192889 - DNA, 601 bp, Human; identical to SEQ ID NO: 188658

SEQ ID NO: 192890 - DNA, 601 bp, Human; identical to SEQ ID NO: 188659

SEQ ID NO: 192891 - DNA, 601 bp, Human; identical to SEQ ID NO: 188614

SEQ ID NO: 192892 - DNA, 601 bp, Human; identical to SEQ ID NO: 188615

SEQ ID NO: 192893 - DNA, 601 bp, Human; identical to SEQ ID NO: 188616

SEQ ID NO: 192894 - DNA, 601 bp, Human; identical to SEQ ID NO: 188617

SEQ ID NO: 192895 - DNA, 601 bp, Human; identical to SEQ ID NO: 188618

SEQ ID NO: 192896 - DNA, 601 bp, Human; identical to SEQ ID NO: 188619

SEQ ID NO: 192897 - DNA, 601 bp, Human; identical to SEQ ID NO: 188620

SEQ ID NO: 192898 - DNA, 601 bp, Human; identical to SEQ ID NO: 188621

SEQ ID NO: 192899 - DNA, 601 bp, Human; identical to SEQ ID NO: 188622

SEQ ID NO: 192900 - DNA, 601 bp, Human; identical to SEQ ID NO: 188623

SEQ ID NO: 192901 - DNA, 601 bp, Human; identical to SEQ ID NO: 188624

SEQ ID NO: 192902 - DNA, 601 bp, Human; identical to SEQ ID NO: 188625

SEQ ID NO: 192903 - DNA, 601 bp, Human; identical to SEQ ID NO: 188626

SEQ ID NO: 192904 - DNA, 601 bp, Human; identical to SEQ ID NO: 188627

SEQ ID NO: 192905 - DNA, 601 bp, Human; identical to SEQ ID NO: 188628

SEQ ID NO: 192906 - DNA, 601 bp, Human; identical to SEQ ID NO: 188629

SEQ ID NO: 192907 - DNA, 601 bp, Human; identical to SEQ ID NO: 188630

SEQ ID NO: 192908 - DNA, 601 bp, Human; identical to SEQ ID NO: 188631

SEQ ID NO: 192909 - DNA, 601 bp, Human; identical to SEQ ID NO: 188632

SEQ ID NO: 192910 - DNA, 601 bp, Human; identical to SEQ ID NO: 188633

SEQ ID NO: 192911 - DNA, 601 bp, Human; identical to SEQ ID NO: 188634

SEQ ID NO: 192912 - DNA, 601 bp, Human; identical to SEQ ID NO: 188635

SEQ ID NO: 192913 - DNA, 601 bp, Human; identical to SEQ ID NO: 188636

SEQ ID NO: 192914 - DNA, 601 bp, Human; identical to SEQ ID NO: 188637

SEQ ID NO: 192915 - DNA, 601 bp, Human; identical to SEQ ID NO: 188638

SEQ ID NO: 192916 - DNA, 601 bp, Human; identical to SEQ ID NO: 188639

SEQ ID NO: 192917 - DNA, 601 bp, Human; identical to SEQ ID NO: 188640

SEQ ID NO: 192918 - DNA, 601 bp, Human; identical to SEQ ID NO: 188641

SEQ ID NO: 192919 - DNA, 601 bp, Human; identical to SEQ ID NO: 188642

SEQ ID NO: 192920 - DNA, 601 bp, Human; identical to SEQ ID NO: 188643

SEQ ID NO: 192921 - DNA, 601 bp, Human; identical to SEQ ID NO: 188644

SEQ ID NO: 192922 - DNA, 601 bp, Human; identical to SEQ ID NO: 188645

SEQ ID NO: 192923 - DNA, 601 bp, Human; identical to SEQ ID NO: 188646

SEQ ID NO: 192924 - DNA, 601 bp, Human; identical to SEQ ID NO: 188647

SEQ ID NO: 192925 - DNA, 601 bp, Human; identical to SEQ ID NO: 188648

SEQ ID NO: 192926 - DNA, 601 bp, Human; identical to SEQ ID NO: 188649

SEQ ID NO: 192927 - DNA, 601 bp, Human; identical to SEQ ID NO: 188650

SEQ ID NO: 192928 - DNA, 601 bp, Human; identical to SEQ ID NO: 188651

SEQ ID NO: 192929 - DNA, 601 bp, Human; identical to SEQ ID NO: 188652

SEQ ID NO: 192930 - DNA, 601 bp, Human; identical to SEQ ID NO: 188653

SEQ ID NO: 192931 - DNA, 601 bp, Human; identical to SEQ ID NO: 188654

SEQ ID NO: 192932 - DNA, 601 bp, Human; identical to SEQ ID NO: 188655

SEQ ID NO: 192933 - DNA, 601 bp, Human; identical to SEQ ID NO: 188656

SEQ ID NO: 192934 - DNA, 601 bp, Human; identical to SEQ ID NO: 188657

SEQ ID NO: 192935 - DNA, 601 bp, Human; identical to SEQ ID NO: 188658

SEQ ID NO: 192936 - DNA, 601 bp, Human; identical to SEQ ID NO: 188659

SEQ ID NO: 192937 - DNA, 601 bp, Human; identical to SEQ ID NO: 188614

SEQ ID NO: 192938 - DNA, 601 bp, Human; identical to SEQ ID NO: 188615

SEQ ID NO: 192939 - DNA, 601 bp, Human; identical to SEQ ID NO: 188616

SEQ ID NO: 192940 - DNA, 601 bp, Human; identical to SEQ ID NO: 188617

SEQ ID NO: 192941 - DNA, 601 bp, Human; identical to SEQ ID NO: 188618

SEQ ID NO: 192942 - DNA, 601 bp, Human; identical to SEQ ID NO: 188619

SEQ ID NO: 192943 - DNA, 601 bp, Human; identical to SEQ ID NO: 188620

SEQ ID NO: 192944 - DNA, 601 bp, Human; identical to SEQ ID NO: 188621

SEQ ID NO: 192945 - DNA, 601 bp, Human; identical to SEQ ID NO: 188622

SEQ ID NO: 192946 - DNA, 601 bp, Human; identical to SEQ ID NO: 188623

SEQ ID NO: 192947 - DNA, 601 bp, Human; identical to SEQ ID NO: 188624

SEQ ID NO: 192948 - DNA, 601 bp, Human; identical to SEQ ID NO: 188625

SEQ ID NO: 192949 - DNA, 601 bp, Human; identical to SEQ ID NO: 188626

SEQ ID NO: 192950 - DNA, 601 bp, Human; identical to SEQ ID NO: 188627

SEQ ID NO: 192951 - DNA, 601 bp, Human; identical to SEQ ID NO: 188628

SEQ ID NO: 192952 - DNA, 601 bp, Human; identical to SEQ ID NO: 188629

SEQ ID NO: 192953 - DNA, 601 bp, Human; identical to SEQ ID NO: 188630

SEQ ID NO: 192954 - DNA, 601 bp, Human; identical to SEQ ID NO: 188631

SEQ ID NO: 192955 - DNA, 601 bp, Human; identical to SEQ ID NO: 188632

SEQ ID NO: 192956 - DNA, 601 bp, Human; identical to SEQ ID NO: 188633

SEQ ID NO: 192957 - DNA, 601 bp, Human; identical to SEQ ID NO: 188634

SEQ ID NO: 192958 - DNA, 601 bp, Human; identical to SEQ ID NO: 188635

SEQ ID NO: 192959 - DNA, 601 bp, Human; identical to SEQ ID NO: 188636

SEQ ID NO: 192960 - DNA, 601 bp, Human; identical to SEQ ID NO: 188637

SEQ ID NO: 192961 - DNA, 601 bp, Human; identical to SEQ ID NO: 188638

SEQ ID NO: 192962 - DNA, 601 bp, Human; identical to SEQ ID NO: 188639

SEQ ID NO: 192963 - DNA, 601 bp, Human; identical to SEQ ID NO: 188640

SEQ ID NO: 192964 - DNA, 601 bp, Human; identical to SEQ ID NO: 188641

SEQ ID NO: 192965 - DNA, 601 bp, Human; identical to SEQ ID NO: 188642

SEQ ID NO: 192966 - DNA, 601 bp, Human; identical to SEQ ID NO: 188643

SEQ ID NO: 192967 - DNA, 601 bp, Human; identical to SEQ ID NO: 188644

SEQ ID NO: 192968 - DNA, 601 bp, Human; identical to SEQ ID NO: 188645

SEQ ID NO: 192969 - DNA, 601 bp, Human; identical to SEQ ID NO: 188646

SEQ ID NO: 192970 - DNA, 601 bp, Human; identical to SEQ ID NO: 188647

SEQ ID NO: 192971 - DNA, 601 bp, Human; identical to SEQ ID NO: 188648

SEQ ID NO: 192972 - DNA, 601 bp, Human; identical to SEQ ID NO: 188649

SEQ ID NO: 192973 - DNA, 601 bp, Human; identical to SEQ ID NO: 188650

SEQ ID NO: 192974 - DNA, 601 bp, Human; identical to SEQ ID NO: 188651

SEQ ID NO: 192975 - DNA, 601 bp, Human; identical to SEQ ID NO: 188652

SEQ ID NO: 192976 - DNA, 601 bp, Human; identical to SEQ ID NO: 188653

SEQ ID NO: 192977 - DNA, 601 bp, Human; identical to SEQ ID NO: 188654

SEQ ID NO: 192978 - DNA, 601 bp, Human; identical to SEQ ID NO: 188655

SEQ ID NO: 192979 - DNA, 601 bp, Human; identical to SEQ ID NO: 188656

SEQ ID NO: 192980 - DNA, 601 bp, Human; identical to SEQ ID NO: 188657

SEQ ID NO: 192981 - DNA, 601 bp, Human; identical to SEQ ID NO: 188658

SEQ ID NO: 192982 - DNA, 601 bp, Human; identical to SEQ ID NO: 188659

SEQ ID NO: 192983 - DNA, 601 bp, Human; identical to SEQ ID NO: 188614

SEQ ID NO: 192984 - DNA, 601 bp, Human; identical to SEQ ID NO: 188615

SEQ ID NO: 192985 - DNA, 601 bp, Human; identical to SEQ ID NO: 188616

SEQ ID NO: 192986 - DNA, 601 bp, Human; identical to SEQ ID NO: 188617

SEQ ID NO: 192987 - DNA, 601 bp, Human; identical to SEQ ID NO: 188618

SEQ ID NO: 192988 - DNA, 601 bp, Human; identical to SEQ ID NO: 188619

SEQ ID NO: 192989 - DNA, 601 bp, Human; identical to SEQ ID NO: 188620

SEQ ID NO: 192990 - DNA, 601 bp, Human; identical to SEQ ID NO: 188621

SEQ ID NO: 192991 - DNA, 601 bp, Human; identical to SEQ ID NO: 188622

SEQ ID NO: 192992 - DNA, 601 bp, Human; identical to SEQ ID NO: 188623

SEQ ID NO: 192993 - DNA, 601 bp, Human; identical to SEQ ID NO: 188624

SEQ ID NO: 192994 - DNA, 601 bp, Human; identical to SEQ ID NO: 188625

SEQ ID NO: 192995 - DNA, 601 bp, Human; identical to SEQ ID NO: 188626

SEQ ID NO: 192996 - DNA, 601 bp, Human; identical to SEQ ID NO: 188627

SEQ ID NO: 192997 - DNA, 601 bp, Human; identical to SEQ ID NO: 188628

SEQ ID NO: 192998 - DNA, 601 bp, Human; identical to SEQ ID NO: 188629

SEQ ID NO: 192999 - DNA, 601 bp, Human; identical to SEQ ID NO: 188630

SEQ ID NO: 193000 - DNA, 601 bp, Human; identical to SEQ ID NO: 188631

SEQ ID NO: 193001 - DNA, 601 bp, Human; identical to SEQ ID NO: 188632

SEQ ID NO: 193002 - DNA, 601 bp, Human; identical to SEQ ID NO: 188633

SEQ ID NO: 193003 - DNA, 601 bp, Human; identical to SEQ ID NO: 188634

SEQ ID NO: 193004 - DNA, 601 bp, Human; identical to SEQ ID NO: 188635

SEQ ID NO: 193005 - DNA, 601 bp, Human; identical to SEQ ID NO: 188636

SEQ ID NO: 193006 - DNA, 601 bp, Human; identical to SEQ ID NO: 188637

SEQ ID NO: 193007 - DNA, 601 bp, Human; identical to SEQ ID NO: 188638

SEQ ID NO: 193008 - DNA, 601 bp, Human; identical to SEQ ID NO: 188639

SEQ ID NO: 193009 - DNA, 601 bp, Human; identical to SEQ ID NO: 188640

SEQ ID NO: 193010 - DNA, 601 bp, Human; identical to SEQ ID NO: 188641

SEQ ID NO: 193011 - DNA, 601 bp, Human; identical to SEQ ID NO: 188642

SEQ ID NO: 193012 - DNA, 601 bp, Human; identical to SEQ ID NO: 188643

SEQ ID NO: 193013 - DNA, 601 bp, Human; identical to SEQ ID NO: 188644

SEQ ID NO: 193014 - DNA, 601 bp, Human; identical to SEQ ID NO: 188645

SEQ ID NO: 193015 - DNA, 601 bp, Human; identical to SEQ ID NO: 188646

SEQ ID NO: 193016 - DNA, 601 bp, Human; identical to SEQ ID NO: 188647

SEQ ID NO: 193017 - DNA, 601 bp, Human; identical to SEQ ID NO: 188648

SEQ ID NO: 193018 - DNA, 601 bp, Human; identical to SEQ ID NO: 188649

SEQ ID NO: 193019 - DNA, 601 bp, Human; identical to SEQ ID NO: 188650

SEQ ID NO: 193020 - DNA, 601 bp, Human; identical to SEQ ID NO: 188651

SEQ ID NO: 193021 - DNA, 601 bp, Human; identical to SEQ ID NO: 188652

SEQ ID NO: 193022 - DNA, 601 bp, Human; identical to SEQ ID NO: 188653

SEQ ID NO: 193023 - DNA, 601 bp, Human; identical to SEQ ID NO: 188654

SEQ ID NO: 193024 - DNA, 601 bp, Human; identical to SEQ ID NO: 188655

SEQ ID NO: 193025 - DNA, 601 bp, Human; identical to SEQ ID NO: 188656

SEQ ID NO: 193026 - DNA, 601 bp, Human; identical to SEQ ID NO: 188657

SEQ ID NO: 193027 - DNA, 601 bp, Human; identical to SEQ ID NO: 188658

SEQ ID NO: 193028 - DNA, 601 bp, Human; identical to SEQ ID NO: 188659

SEQ ID NO: 193029 - DNA, 601 bp, Human; identical to SEQ ID NO: 188614

SEQ ID NO: 193030 - DNA, 601 bp, Human; identical to SEQ ID NO: 188615

SEQ ID NO: 193031 - DNA, 601 bp, Human; identical to SEQ ID NO: 188616

SEQ ID NO: 193032 - DNA, 601 bp, Human; identical to SEQ ID NO: 188617

SEQ ID NO: 193033 - DNA, 601 bp, Human; identical to SEQ ID NO: 188618

SEQ ID NO: 193034 - DNA, 601 bp, Human; identical to SEQ ID NO: 188619

SEQ ID NO: 193035 - DNA, 601 bp, Human; identical to SEQ ID NO: 188620

SEQ ID NO: 193036 - DNA, 601 bp, Human; identical to SEQ ID NO: 188621

SEQ ID NO: 193037 - DNA, 601 bp, Human; identical to SEQ ID NO: 188622

SEQ ID NO: 193038 - DNA, 601 bp, Human; identical to SEQ ID NO: 188623

SEQ ID NO: 193039 - DNA, 601 bp, Human; identical to SEQ ID NO: 188624

SEQ ID NO: 193040 - DNA, 601 bp, Human; identical to SEQ ID NO: 188625

SEQ ID NO: 193041 - DNA, 601 bp, Human; identical to SEQ ID NO: 188626

SEQ ID NO: 193042 - DNA, 601 bp, Human; identical to SEQ ID NO: 188627

SEQ ID NO: 193043 - DNA, 601 bp, Human; identical to SEQ ID NO: 188628

SEQ ID NO: 193044 - DNA, 601 bp, Human; identical to SEQ ID NO: 188629

SEQ ID NO: 193045 - DNA, 601 bp, Human; identical to SEQ ID NO: 188630

SEQ ID NO: 193046 - DNA, 601 bp, Human; identical to SEQ ID NO: 188631

SEQ ID NO: 193047 - DNA, 601 bp, Human; identical to SEQ ID NO: 188632

SEQ ID NO: 193048 - DNA, 601 bp, Human; identical to SEQ ID NO: 188633

SEQ ID NO: 193049 - DNA, 601 bp, Human; identical to SEQ ID NO: 188634

SEQ ID NO: 193050 - DNA, 601 bp, Human; identical to SEQ ID NO: 188635

SEQ ID NO: 193051 - DNA, 601 bp, Human; identical to SEQ ID NO: 188636

SEQ ID NO: 193052 - DNA, 601 bp, Human; identical to SEQ ID NO: 188637

SEQ ID NO: 193053 - DNA, 601 bp, Human; identical to SEQ ID NO: 188638

SEQ ID NO: 193054 - DNA, 601 bp, Human; identical to SEQ ID NO: 188639

SEQ ID NO: 193055 - DNA, 601 bp, Human; identical to SEQ ID NO: 188640

SEQ ID NO: 193056 - DNA, 601 bp, Human; identical to SEQ ID NO: 188641

SEQ ID NO: 193057 - DNA, 601 bp, Human; identical to SEQ ID NO: 188642

SEQ ID NO: 193058 - DNA, 601 bp, Human; identical to SEQ ID NO: 188643

SEQ ID NO: 193059 - DNA, 601 bp, Human; identical to SEQ ID NO: 188644

SEQ ID NO: 193060 - DNA, 601 bp, Human; identical to SEQ ID NO: 188645

SEQ ID NO: 193061 - DNA, 601 bp, Human; identical to SEQ ID NO: 188646

SEQ ID NO: 193062 - DNA, 601 bp, Human; identical to SEQ ID NO: 188647

SEQ ID NO: 193063 - DNA, 601 bp, Human; identical to SEQ ID NO: 188648

SEQ ID NO: 193064 - DNA, 601 bp, Human; identical to SEQ ID NO: 188649

SEQ ID NO: 193065 - DNA, 601 bp, Human; identical to SEQ ID NO: 188650

SEQ ID NO: 193066 - DNA, 601 bp, Human; identical to SEQ ID NO: 188651

SEQ ID NO: 193067 - DNA, 601 bp, Human; identical to SEQ ID NO: 188652

SEQ ID NO: 193068 - DNA, 601 bp, Human; identical to SEQ ID NO: 188653

SEQ ID NO: 193069 - DNA, 601 bp, Human; identical to SEQ ID NO: 188654

SEQ ID NO: 193070 - DNA, 601 bp, Human; identical to SEQ ID NO: 188655

SEQ ID NO: 193071 - DNA, 601 bp, Human; identical to SEQ ID NO: 188656

SEQ ID NO: 193072 - DNA, 601 bp, Human; identical to SEQ ID NO: 188657

SEQ ID NO: 193073 - DNA, 601 bp, Human; identical to SEQ ID NO: 188658

SEQ ID NO: 193074 - DNA, 601 bp, Human; identical to SEQ ID NO: 188659

SEQ ID NO: 193075 - DNA, 601 bp, Human; identical to SEQ ID NO: 188660

SEQ ID NO: 193076 - DNA, 601 bp, Human; identical to SEQ ID NO: 188661

SEQ ID NO: 193077 - DNA, 601 bp, Human; identical to SEQ ID NO: 188662

SEQ ID NO: 193078 - DNA, 601 bp, Human
agtaaatcaagctcccaaggagaaaagacagcaataagggtgatttttattgtaatgataataataacaactccaacagctaacacatagagtgctgaccatgagacaggcgctgttccaagcatgtaattcgtttactcttcacagcagcctagggaagcaagcagtgctaatatccccattccacagtgaggacagggaggcacagaaaggtgaaggaacttgcccaaagttccacagctggtttccagtggcactgggattcagacgcaggcagcctgggctgggatctgtgctctgrtcccctgtcctccactgcagcaaatacgggggagaggcagcatccctgggatgaatgagactgttgctccagccccatctcacagagcccgctctgccattcccaaactcaaaacaggatatcttattagctaaaggaggaggcagtgtggtaaggaggaaagggctatgaggctggaatgaaataagatatgcaaaatgggccaggtgcggtggctcatgcctgtaatcccagcactttgggaggccaaggcaggcagaccactgaaggtcgggagttcaagaccagcctggccaacat

SEQ ID NO: 193079 - DNA, 601 bp, Human
cggtggctcatgcctgtaatcccagcactttgggaggccaaggcaggcagaccactgaaggtcgggagttcaagaccagcctggccaacatgatgaaaccccgtctttaccaaaaatacaacaattagctggtcgtggtggtacacacctgtaatctcagctgctcaggaggctgaggcaggagaactgcttgaacctggaatacagagattccagtgagccaagattgtgccaccacactccagcctgggcgatagagtgagactttgtctcagaaaaaagatatgcaaaacgtgtagcrtagagactggaaaggcagatgcattatttctgaagctctctagatcccaaccaaaaaacacccagacaactagataggaaaaaaaatgtttccatggaaaacatttacaaacgaaacaaggtatggttgtctgcagttcaggcccacctgcatgactttggcatctgtgcaggaaaaaacagtggcagaaccccaaaataatcaacaggtatccccagaaagtgtactaggtgctttgggggaacagcagctgaaactgggaggcgttttgctcactccaggggccagagtgtgcacaga

SEQ ID NO: 193080 - DNA, 601 bp, Human
tcagaaaaaagatatgcaaaacgtgtagcgtagagactggaaaggcagatgcattatttctgaagctctctagatcccaaccaaaaaacacccagacaactagataggaaaaaaaatgtttccatggaaaacatttacaaacgaaacaaggtatggttgtctgcagttcaggcccacctgcatgactttggcatctgtgcaggaaaaaacagtggcagaaccccaaaataatcaacaggtatccccagaaagtgtactaggtgctttgggggaacagcagctgaaactgggaggcgttttsctcactccaggggccagagtgtgcacagagccagtgggagggaggaaggggctggcgcaggcttgctcttgggagcttttgaaacttagccaccacagctctccctaaggtcagagtctcacacgagggagagactgctggaaatggaacagaaattgtgtagaaaagagaccatagagactgtgggaagagaaggtccgggtaaatgtggaagaatgtcaggaggtgagctctgcaaagtcaggaagataactgtgaatgatactctttctcaaattccaggaaaactagtttccttta

SEQ ID NO: 193081 - DNA, 601 bp, Human
ccatagactgggtggcttaaaataatagaaatgtattacttcatggttctggaggccagaagtccaaaatcaaggtgtcagcagggctgcacttcctctgaaacctctaggggaatgcctcttctgtaggggagtgctctttctgtaggggagtgctccttctgtaggggagtgctccttctgtaggggagtgctccttctgtaggggaatgcctcttctgtaggggagtgctccttctgtaggggaatgcctcttctgtaggggaatgctccttctgtagggcatgctccttctgtaggrgaatgctcctgtaggggaatgctccttctgtaggggagtgctccttctgtaggggaatgcctcttctgtaggggagtgctccttctgtaggggagtgctccttctgtaggggaatgcctcttctgtaggggagtgctccttctgtaggggaatgctccttctgtagggcatgctccttctgtaggggaatgcctcttctgtaggggaatgctccttctgtaggggagtgctccttctgtaggggagtgctccttctgtagggcatgctccttctgtaggggagtgctccttctgtagggg

SEQ ID NO: 193082 - DNA, 601 bp, Human
ttgtcatcacatgatcttgtgtgtctttgtcgtcacatagccctcttcttataaggataacggtcatcttggatcagggcccaccctactccagtgtgacctcatcttaactgattacatctgcaatgaccgtagtttccagtgacgtcacattctgaggtactggggatggaactttgacatctttcttggaaggatgtaatgcaaaccatgacacccatagaaagtgttaggggctgaattgtgtccccccccaaattcatatgttgaattcctaatccctaatacctctaaagtcccyatctccaaatgcagtcacattcaacgaggtaattaaggtaaaagtgagatcatatgaatgggccctaatccaatacagcaggagttcttataagaagggattagggaccaggtgtggtggctcacgcctgtaatcccagcactttgggaggccaaggtgggcagatcacaaggtcaagagttcgagaccagcctggtccacatggtgaaaccacacctctactaagaatacaaaaattagccgggtgtggtggcatgtgcctgtaatctcagcgacttgggaggctgaggcaggagaatc

SEQ ID NO: 193083 - DNA, 601 bp, Human
ttgtgtgtctttgtcgtcacatagccctcttcttataaggataacggtcatcttggatcagggcccaccctactccagtgtgacctcatcttaactgattacatctgcaatgaccgtagtttccagtgacgtcacattctgaggtactggggatggaactttgacatctttcttggaaggatgtaatgcaaaccatgacacccatagaaagtgttaggggctgaattgtgtccccccccaaattcatatgttgaattcctaatccctaatacctctaaagtccctatctccaaatgcagtyacattcaacgaggtaattaaggtaaaagtgagatcatatgaatgggccctaatccaatacagcaggagttcttataagaagggattagggaccaggtgtggtggctcacgcctgtaatcccagcactttgggaggccaaggtgggcagatcacaaggtcaagagttcgagaccagcctggtccacatggtgaaaccacacctctactaagaatacaaaaattagccgggtgtggtggcatgtgcctgtaatctcagcgacttgggaggctgaggcaggagaatcgcttgaacccaggagg

SEQ ID NO: 193084 - DNA, 601 bp, Human
aattcatatgttgaattcctaatccctaatacctctaaagtccctatctccaaatgcagtcacattcaacgaggtaattaaggtaaaagtgagatcatatgaatgggccctaatccaatacagcaggagttcttataagaagggattagggaccaggtgtggtggctcacgcctgtaatcccagcactttgggaggccaaggtgggcagatcacaaggtcaagagttcgagaccagcctggtccacatggtgaaaccacacctctactaagaatacaaaaattagccgggtgtggtggcakgtgcctgtaatctcagcgacttgggaggctgaggcaggagaatcgcttgaacccaggaggcggaggttgcagtgagccgagatcatgccactgtactccagcctgggtgacagggcaagactctgtctcaaaaaagaagaagaagaagaagaagaagaagaagaagaagaagagattaggaaacagacatgcacagagggaagaccatgtgaggaggacacagggagaagtcagacttctacaagccaaagagagaggcctcagaaagaaccaaacctgccaacaccttgatcttggact

SEQ ID NO: 193085 - DNA, 601 bp, Human
ctaatccctaatacctctaaagtccctatctccaaatgcagtcacattcaacgaggtaattaaggtaaaagtgagatcatatgaatgggccctaatccaatacagcaggagttcttataagaagggattagggaccaggtgtggtggctcacgcctgtaatcccagcactttgggaggccaaggtgggcagatcacaaggtcaagagttcgagaccagcctggtccacatggtgaaaccacacctctactaagaatacaaaaattagccgggtgtggtggcatgtgcctgtaatctcagckacttgggaggctgaggcaggagaatcgcttgaacccaggaggcggaggttgcagtgagccgagatcatgccactgtactccagcctgggtgacagggcaagactctgtctcaaaaaagaagaagaagaagaagaagaagaagaagaagaagaagagattaggaaacagacatgcacagagggaagaccatgtgaggaggacacagggagaagtcagacttctacaagccaaagagagaggcctcagaaagaaccaaacctgccaacaccttgatcttggactttcagccttcagaaccat

SEQ ID NO: 193086 - DNA, 601 bp, Human
aatctcagcgacttgggaggctgaggcaggagaatcgcttgaacccaggaggcggaggttgcagtgagccgagatcatgccactgtactccagcctgggtgacagggcaagactctgtctcaaaaaagaagaagaagaagaagaagaagaagaagaagaagaagagattaggaaacagacatgcacagagggaagaccatgtgaggaggacacagggagaagtcagacttctacaagccaaagagagaggcctcagaaagaaccaaacctgccaacaccttgatcttggactttcagcctycagaaccatgagacaatccatttctcttggttaggccacccagtctgttgtatagcaaacaaatgcacagctattataagcaaaaaagagaataagagacagaatgatatccctctgggtaatgaaagcacaccagaaagacgtgcccagactaaatgaaaattctaatattctatcttgaaagaaaccaaaagtgttaagaaaataaacaaaacatagaagaaaaatggggccgggtgccctgtaatcccagcattttgggaggctgaggcaggtggatcacctgaggtcaggagttcg

SEQ ID NO: 193087 - DNA, 601 bp, Human
aatcccagcattttgggaggctgaggcaggtggatcacctgaggtcaggagttcgagaccaccctggccaacatggtgaaaccccatctctactaaaaatacaaaaattagccaggcatggtggcaggtgcctgtaatcccagctactcaggaggctgaggcaggagaatcacttgaaccagggaggcaaaggttgcagtgagccaagattgtgccattgccctctggcctgggtgacagagcgagactctgtctcaaaaaaaaaaaaaaaaaaaagaaaagaaaagaaaagaaaaaaaaagaaaaagaaaaaaagaaagaaagaaaggaaaatagaaaaatcgagtcagaattagaagaaaactgagaaatgaagtaatagaccaaagaaacaaaaagttaaaaatttcagatgtaaatactaaactagatggaacacaaaagtgaataaacagataaatagaagttgaaaagaacaacaagttttaaaaatcaagaaagaaataacaagagatgaaaggcttgaagaaaaagtgacaaatattcaaaatctgtaagaagatctgacatttagataataggactccctgcagaagaagcc

SEQ ID NO: 193088 - DNA, 601 bp, Human
ccattgccctctggcctgggtgacagagcgagactctgtctcaaaaaaaaaaaaaaaaaaaagaaaagaaaagaaaagaaaaaaaaagaaaaagaaaaaaagaaagaaagaaaggaaaatagaaaaatcgagtcagaattagaagaaaactgagaaatgaagtaatagaccaaagaaacaaaaagttaaaaatttcagatgtaaatactaaactagatggaacacaaaagtgaataaacagataaatagaagttgaaaagaacaacaagttttaaaaatcaagaaagaaataacaagagatgaaaggcttgaagaaaaagtgacaaatattcaaaatctgtaagaagatctgacatttagataataggactccctgcagaagaagccgaatacatgggggaaagtactatacatgatctcaagaaaactttccataaattaaaaaagagatttgaaattccacattgaaataacacatagcgtacctgagaatatcaacaagaacaaccaacaccaagacacataacacattcttgtgaaattattgtactttaaagaaaaggaggaaggccgggtgtggtggctcatacctgtaatcaca

SEQ ID NO: 193089 - DNA, 601 bp, Human
ctcaagaaaagttaagcccagaattttatacctagcaaaactgactttcatgtgcaaaaagcataaactattatgaccatgcaagcattaaacattcagttacttctaaaactacaactaaatgagtgttataaggaaaagagtatagtatgaattactggataggtcagacaatgtagacatagcacatttatttttaaactctgagccgaatagggagagcatatcaaaaattattttcaataattatgttagtcatggtaactttagaattgttatcctgaggctactgtgtaggtaatgtgggataatgatgggatactgcatgtccttgaggaccaggattctgatgtggaagaaagaatgtgcctttgtaatacagaagagattaattaaaaaaccatatggtccttcttttgaattggatatcagtatgaactcttggtgtatattagtttttaaatgttcactgaagaggcctagaaacaatgaccaaccccctagcactgagcctccctagtatccagactggtcttgataagccatttctcactaaaaaacaaaaacaggccaggcgcggtggctcacacctataatccca

SEQ ID NO: 193090 - DNA, 601 bp, Human
aactattatgaccatgcaagcattaaacattcagttacttctaaaactacaactaaatgagtgttataaggaaaagagtatagtatgaattactggataggtcagacaatgtagacatagcacatttatttttaaactctgagccgaatagggagagcatatcaaaaattattttcaataattatgttagtcatggtaactttagaattgttatcctgaggctactgtgtaggtaatgtgggataatgatgggatactgcatgtccttgaggaccaggattctgatgtggaagaaagaatrtgcctttgtaatacagaagagattaattaaaaaaccatatggtccttcttttgaattggatatcagtatgaactcttggtgtatattagtttttaaatgttcactgaagaggcctagaaacaatgaccaaccccctagcactgagcctccctagtatccagactggtcttgataagccatttctcactaaaaaacaaaaacaggccaggcgcggtggctcacacctataatcccagcactatgggaggccaaggcaggcagatcacaatgtcaggagttcgagactagcctgaccaacat

SEQ ID NO: 193091 - DNA, 601 bp, Human
ccccctagcactgagcctccctagtatccagactggtcttgataagccatttctcactaaaaaacaaaaacaggccaggcgcggtggctcacacctataatcccagcactatgggaggccaaggcaggcagatcacaatgtcaggagttcgagactagcctgaccaacatgatgaaaccccatctctactaaaaatacaaaaattagctggtcgtggtggtgcccgcctgtaatcccagctactcaggaggctgaggcaggagaatcacttgaacccgggaggtggaggttgcagtgagcygatatcgcaccacagcactccagcctgggtgacagagcgagactcatctcaaaaaatatataaaaataaaaataaatgaaaaacaaaaacagaaatacaaatccaagacttcttggagaaatggttgattccaggtcttgggcagtaaaagtgtaaaatgaggctggatcatctcgtcacatcagatagcaagaaagctgtgaaagacgacaagggctgggccaaaaggacccaggagccaacttcattttccctctggcaagagatgggaaaatttgagtttcaacaaaggataaaaat

SEQ ID NO: 193092 - DNA, 601 bp, Human
aaaagaaaataaaggaacagagaagaaacctgtagcttaaaatggacttaaaaggcagagcaaaaacttgttgatggacaagtctgaatgattgtgtctagagacgcacactgatgtgagaaaactatgaagaaacccaagtaggccgggctcggtggctcaggcctgtaatcccagcactttgggaggctgaggtgggcggatcacaaggtcagaagttcaagaccagcctgaccaacatggtaaaaccctgtctctactaaaaaaaaatacaaaaaaaattagccgggcatggtggcaygcgcctgtaatcccagctactcaggaggctgaggcaggagaatcgcttgaacctgggaggcggaggttgcagtgagctgagactgtgccactgtactccagtctgggtgacagagcgagactctgtctcaaaaaaaaaaaaaaaaaaaaacccaagtagagcactgccgtgggactcaggctaggggtcactgttgggttgcaggaggggttgagttctgtctggcagttgcggggcgtttggtggctggccaagttctctttcttgacctgggtggtgattataaaggcatttgccttg

SEQ ID NO: 193093 - DNA, 601 bp, Human
atggtggcatgcgcctgtaatcccagctactcaggaggctgaggcaggagaatcgcttgaacctgggaggcggaggttgcagtgagctgagactgtgccactgtactccagtctgggtgacagagcgagactctgtctcaaaaaaaaaaaaaaaaaaaaacccaagtagagcactgccgtgggactcaggctaggggtcactgttgggttgcaggaggggttgagttctgtctggcagttgcggggcgtttggtggctggccaagttctctttcttgacctgggtggtgattataaaggcrtttgccttgtaataactcgttaaactatactttcattttgtgtaattttgtatccgtgttttattttatgatcaagaggttgtaaaaatctgtctagcacagtacctggaacccagacctctgagagactgtagcctcttctgcctccccgtcacctggtgatgtggaattgactgccctgtgctgggcaccgagcttggcgctttctatctgctccttcgtttattaccctgctgcccagcctcactgtgggctctgagaaggcgggaccatgtgtcccttgttcactttgctgtccct

SEQ ID NO: 193094 - DNA, 601 bp, Human
aaaaaaaaaaaaaaaaaacccaagtagagcactgccgtgggactcaggctaggggtcactgttgggttgcaggaggggttgagttctgtctggcagttgcggggcgtttggtggctggccaagttctctttcttgacctgggtggtgattataaaggcatttgccttgtaataactcgttaaactatactttcattttgtgtaattttgtatccgtgttttattttatgatcaagaggttgtaaaaatctgtctagcacagtacctggaacccagacctctgagagactgtagcctcttccgcctccccgtcacctggtgatgtggaattgactgccctgtgctgggcaccgagcttggcgctttctatctgctccttcgtttattaccctgctgcccagcctcactgtgggctctgagaaggcgggaccatgtgtcccttgttcactttgctgtccctagcagccggcgcctggcactcaaaacatatttgttgggcaagtgaacctgtgactctattttgccattgtagctattgatgctcaattcgtgcagttgacaaatgtccaagctgtgcttatccgccagggcacatggaagct

SEQ ID NO: 193095 - DNA, 601 bp, Human
ttgtaataactcgttaaactatactttcattttgtgtaattttgtatccgtgttttattttatgatcaagaggttgtaaaaatctgtctagcacagtacctggaacccagacctctgagagactgtagcctcttctgcctccccgtcacctggtgatgtggaattgactgccctgtgctgggcaccgagcttggcgctttctatctgctccttcgtttattaccctgctgcccagcctcactgtgggctctgagaaggcgggaccatgtgtcccttgttcactttgctgtccctagcagcyggcgcctggcactcaaaacatatttgttgggcaagtgaacctgtgactctattttgccattgtagctattgatgctcaattcgtgcagttgacaaatgtccaagctgtgcttatccgccagggcacatggaagctggagggtgttgctggcatttaggtcccggtccagtttgcaggaagggccatgaagcctccccacagagcagccaggctgcagagaccactgtcgttctctgatggagctgtctctgggacagatgcccctgccctggccacctgctcctcctccctagacctcgg

SEQ ID NO: 193096 - DNA, 601 bp, Human
ctgccatcactgcaccgtttctctggagcagggcctgggctgcgtgctcccaagcctggcagagggctatggatggagcattgtcctgttcacctcgcttcctggctgtgctgcccgtgtgcccggtccccaaccacccccgccctctagggagtccctatccctggcctgcggagaagcatgccatgatgagttcattcagcagccgtggacggagcccctctgtgtcaggctctagggacatggtgataagaaggggtcctcccaccctctcaggggaggcatgcaacggagccagccrcgaggacaccagtgtttacaccatgacacaaccatgcgggggggtggggggaggagaggctccctcagcacgtggttgcccaaggagccgtccccagtcccagtccccctaggtttgctcctcccgaaaaggaataacgctgaatcgtcacagggtggcacagacttgggtcagagaaaataactaactggtatttgccttttgcaaaatgatggggtttcaccaaaccacatacaaatccttcccaaatccccagtggctggttttgtggcctctccggccagccccgatctgagtgtt

SEQ ID NO: 193097 - DNA, 601 bp, Human
gggtccttcaggcccctgtgcaggagggcaggcagggagggggttgggtcagggctttgtcctgtcccactgggtgggtggggtatgcaccctgacactggcccacagccgccccccgccccaaaggggccagccctgtgcttgatgctgggcctgcagttgtggctgggacatggccctcaggtgatttctagatcttggaacatgggagtttggaatcctaggaccttctagttcactcactcattctttccgtttctgaacccttcttgagcctctacctgtgcctgaccctgggctragccttgcagatacagagatggataaatgccacatagcccctgaggactttgcatctcagcagcagggagaagccaccccgtatcagatcatcaaaatatgatgccgaaataggcatgcacagagacaggccttgatggcctgtggaggctctcttaggggaagtctcctggcaggttttacgtctttagttcccacctacatccttcctggggtgacccaagccaagaggttgggcagctgctgggcctagaaccagcacccaccagcgcctttctctggctgcatctgctccagacag

SEQ ID NO: 193098 - DNA, 601 bp, Human
cacctgtgatgaccaggagccagggtttcatcatcgccaggaccctgtgacacggtgggattatctcctctaacaaaggagagagcgagagccagagagggcaagagatttgcccgaggccactcagagctggggccagagcgggcctggagcccggtcttccccagacaccacacccgcccagagccggagcccagggttgactgctgctgtggtgggctaagttgctgtgagtttggatgtcccagaaaaacaatcagcgcacaggccccggggctcgccgtgttcagtcctcccagastaacagaagaagagggagaaatgccccgagtccactaagaacctgcaagggccgggtcgtcctctaatgtagccttgaaagacccgttcttagcggggatcgaggagcccgcagcagggcccgcgccgtcgtctttgtaaagcccccttgcattcctctttaaccggctgtcaaagaaaaatgaagaatgcgttttcgccctgtgcaaaaatgctccattaatgcccgagggattctcaggccactacaaagctttccttatctggctctggattcattctcagctctgcagcctgtaat

SEQ ID NO: 193099 - DNA, 601 bp, Human
gcccgcagcagggcccgcgccgtcgtctttgtaaagcccccttgcattcctctttaaccggctgtcaaagaaaaatgaagaatgcgttttcgccctgtgcaaaaatgctccattaatgcccgagggattctcaggccactacaaagctttccttatctggctctggattcattctcagctctgcagcctgtaatccggggtgctctgggaagagatctttcaggtagtatatcctgagtgatgactaatgggggagccctggctgcagcaggggcgggctgtgtatcatcagcgtgcggawgagagagacagaaaggcaactcgaggccacccgggctccccgggcccctgggctatggctgctgtctgagcctcagacttcccctccagcctccagatcaccacttccttttaactctcaggccagccacatctgtgtctgtctggctccctccactcagcctcaagacccagcatgtgtgtgaccacttccaagaagcctcccctgactgctccagggtcatggctgtgtgataggagggcctggcctgcaaaaacgccctccctatttctccagggagggaaatctgtgtgctatgag

SEQ ID NO: 193100 - DNA, 601 bp, Human
ctcttgagagtggctataccttctaggcctgatcaggaaggaagctgggttttggtgtgccagtcaggtgagacgcagagaagacagcacaatcaacacaggaagtaacagaagcagctagttactcacaggtcctagagaggtggggagcaccccttgcagggccaatgggaaggggaagcgcctgcagcatgagagagagagagaatgagagagagagacagagagagacctgtgggaccaaagcctttactggggtccagggtgttatccaggcaggtttcccgtgaggaattctaaytggggggcttggagcaggcaggagttccctgaggtcatgcggtggcggatgggggtcacttctgcataggcctgcactatcgatgtaggtgtgagggtctttgggttgtatccagctgtcccataaggcaggggcccccaggaggtggtggtataaggcagtcctctgggtcaaccgccttaaggaactgggaggaggtggagaactggaacccgcagcaagggtgactgagccctgctctggtgtgggagttaaacgcacattcagaatgcgtgccgaggcaacataggatgagaagcc

SEQ ID NO: 193101 - DNA, 601 bp, Human
ggtgactgagccctgctctggtgtgggagttaaacgcacattcagaatgcgtgccgaggcaacataggatgagaagccggcacaacacccaggcttttccatgaaagtgaacttgacagccgctttcccacattgtctgtgctgagtcgtgggagcctctgagttttgccagtgtgtcaacgcgctcctgcagcactctcacccccacttaaagggaactaccacagtttatgttttgaaatcgcattttaaattccatctgtgggtgtataaggattattacccaatttcaagtttaccrtttgaaaaatagcaatggcgtgagtggccccttttaggcaaagtgtgattgggtctgtgtggccgcggcaaactgctctgggcttgcggctttgttctctgtttccagctgtgtgactttaggcaaatttcataacctgtctgagcctcagctttcttctcagtaaaattgccataataatatttgccctgcagggtaatagggactgaggtgtgtgcctgttttaacataagagtggtctagtctggaggataaatgagccgctgggaggaagaagtttggaaatggagggctggtggg

SEQ ID NO: 193102 - DNA, 601 bp, Human
tcagcccgagggcccaggcagggtggggtcctagtgatgcctgtcggtgggtgacatcaggccatccacagcaccgggagccagcagaaagggctgggccaggccatgtggacagggtctacggacagtacagggccagaggtccctattctgggaccttgacatgctgccgttctcgtgagcttctgggggactcctgcgaggcatgtgggctgcttctcagacctgcgggtaccccacctcccagatgttgtcaatgggatgtgaggttcacgagcacgtcacggagcctctcccctcrtcatgtacgtgcgcatcatggcaaaatgtgcctggccactggttcctgacgctggaaggcacgaacccactccccacacccacagccggcgttgctgtgactgcagtgtctgtgttctaagccccacttttcacatccatccccgctgcccggccagagagacgtcctcagcccagagccccacttttcacatccatccccgctgcccggccagagacacgtcctcagcccagagccccacttttcacatccatccccgctgcccggccagagacacgtcctcagcccagagccccactt

SEQ ID NO: 193103 - DNA, 601 bp, Human
agcccgagggcccaggcagggtggggtcctagtgatgcctgtcggtgggtgacatcaggccatccacagcaccgggagccagcagaaagggctgggccaggccatgtggacagggtctacggacagtacagggccagaggtccctattctgggaccttgacatgctgccgttctcgtgagcttctgggggactcctgcgaggcatgtgggctgcttctcagacctgcgggtaccccacctcccagatgttgtcaatgggatgtgaggttcacgagcacgtcacggagcctctcccctcgtmatgtacgtgcgcatcatggcaaaatgtgcctggccactggttcctgacgctggaaggcacgaacccactccccacacccacagccggcgttgctgtgactgcagtgtctgtgttctaagccccacttttcacatccatccccgctgcccggccagagagacgtcctcagcccagagccccacttttcacatccatccccgctgcccggccagagacacgtcctcagcccagagccccacttttcacatccatccccgctgcccggccagagacacgtcctcagcccagagccccactttt

SEQ ID NO: 193104 - DNA, 601 bp, Human
ccatgcctcagaccccaaatattccatggcctctctcctctcctggactgtagccgtgacattcacttccttctccttttggtgaactcctattcatccctccaagccgatgtcagctgtcacctcctcttggatgccgtccacacgctccacatgcagagtgtgcagctccttcttttgtgctccagtggccccagatgagccccttttgcaactctcctcatactcattctcccaacgagtaatgtgtgtatccctgggggcaggtcctgctctgaggaatgcagcagtgactaaggcrgacatgaacgcctctctcatacactttttatcccagagggtaggagtacacgagaaacaagcataatatatacacggtcagatggtagtgagggctgtgcagagcaggggaggggagtgggaggcggggtgcagcatggcggtacagctttaaatctggtggtcagtgacatttgtcaaagactcaggagctgaggaagtgacccacacagagatctggaggaagagggctccaggcagagggaatggcagagtgctggagtggccatgcctggggaactccttctggaaagtctgtcgt

SEQ ID NO: 193105 - DNA, 601 bp, Human
tgggggcaggtcctgctctgaggaatgcagcagtgactaaggcagacatgaacgcctctctcatacactttttatcccagagggtaggagtacacgagaaacaagcataatatatacacggtcagatggtagtgagggctgtgcagagcaggggaggggagtgggaggcggggtgcagcatggcggtacagctttaaatctggtggtcagtgacatttgtcaaagactcaggagctgaggaagtgacccacacagagatctggaggaagagggctccaggcagagggaatggcagagtgcyggagtggccatgcctggggaactccttctggaaagtctgtcgtgaaccagagcagataaatgcttgtgctggggggaggggtgtcgtgaaaagggaaacaccaggagttgtggcattgggagtttcttcgcttgactttcaattccaccaaacaattcctagacagaagagcctccaggggtttattcgtgcaaggctaccctctgtcaccctgtttgtccttgcttcttatacacacacagaacagatgcacccactggggtcaccccaacccagcccccagcagttgcccataactgg

SEQ ID NO: 193106 - DNA, 601 bp, Human
ctctcatacactttttatcccagagggtaggagtacacgagaaacaagcataatatatacacggtcagatggtagtgagggctgtgcagagcaggggaggggagtgggaggcggggtgcagcatggcggtacagctttaaatctggtggtcagtgacatttgtcaaagactcaggagctgaggaagtgacccacacagagatctggaggaagagggctccaggcagagggaatggcagagtgctggagtggccatgcctggggaactccttctggaaagtctgtcgtgaaccagagcagakaaatgcttgtgctggggggaggggtgtcgtgaaaagggaaacaccaggagttgtggcattgggagtttcttcgcttgactttcaattccaccaaacaattcctagacagaagagcctccaggggtttattcgtgcaaggctaccctctgtcaccctgtttgtccttgcttcttatacacacacagaacagatgcacccactggggtcaccccaacccagcccccagcagttgcccataactggccgcaggatcccacacacctgctgacttccagagtcaccaaggggttaaaaggggct

SEQ ID NO: 193107 - DNA, 601 bp, Human
gtgtcctgcgcgccattttgcagacaggagggaggaagtgtcctgcgcgccattttgcagacaggaggaaggaagtgtcctgcacgccattttgcagacaggagggaggaagtgtcctgcgcgccattttgcagacaggagggaggaagtgtcctgcgcgccattttgcagacaggagggaggaagtgtcctgcgcgccattttgcagacaggagggaggaagtgtcctgcgcgccattttgcagacaggaggaaggagatgtagtgggatgggaagatctgggctctgaggtcagtcccmgctggacggaaacctgcggccctgttagctccgtgatctggaaggtgctactagtagcgcctcatttttctccccaggagaaggagggcgaccgtgtctcatccctaactgcgatgggggctgaatgcggctgtgggcacatagggtctctctgtctccacccatgtctcctgctgtgtggcctctttccagcccatccacactctagttggtggctttgtgagtgctgacaatacttccatgtgcttttttgttttttcttttttgagacagagtctcgctcagtcacccaggctggag

SEQ ID NO: 193108 - DNA, 601 bp, Human
cgcgccattttgcagacaggaggaaggaagtgtcctgcacgccattttgcagacaggagggaggaagtgtcctgcgcgccattttgcagacaggagggaggaagtgtcctgcgcgccattttgcagacaggagggaggaagtgtcctgcgcgccattttgcagacaggagggaggaagtgtcctgcgcgccattttgcagacaggaggaaggagatgtagtgggatgggaagatctgggctctgaggtcagtccccgctggacggaaacctgcggccctgttagctccgtgatctggaagrtgctactagtagcgcctcatttttctccccaggagaaggagggcgaccgtgtctcatccctaactgcgatgggggctgaatgcggctgtgggcacatagggtctctctgtctccacccatgtctcctgctgtgtggcctctttccagcccatccacactctagttggtggctttgtgagtgctgacaatacttccatgtgcttttttgttttttcttttttgagacagagtctcgctcagtcacccaggctggagtgtggtggcgtgatctcggctcactgcaacctctgcctcccatgt

SEQ ID NO: 193109 - DNA, 601 bp, Human
ttccactggtatgagatattgtgcagtctcttgattcatcatctggtttgctaaaatgctctttgacagccctgcacactccattacacgttgtcagctagaatcacaagcctcacgttggaggctgcactttagaagggaagatgacgtgcccaaggtcacacagctggtcgatgcagagccacctaggaactcgaggctgtaactctaggtctctttataaaccagtgtctagagtcagagacatgagactcaggcagagagaccccccccaccccccgccactgactttcatcatttsaaacaatggagagacaatcaagtgcaacatcaaatagcaggagctgaaagatggcttcgagatggggccgagaatgtggaccacagagcccaagaggcagcgaaggtctccccactgcacccgagcacttcgtgttcaggatcctggatccccagcacatcagctgcaacttacagagcagagccaagacatgaaagtgaagcgcccgaggggacctacatttttcaacagggagaaaaaaagtgcttaattatatctttaagaggcacagacacgccaagggataccagcagcgtctga

SEQ ID NO: 193110 - DNA, 601 bp, Human
tcatggcagaaggcctgccatgggcctgccagggcctgggttggggatggtggggcagaaatgagctgacactgtccctgaacaaggaggccgactgtgagcgtcccctgcaatgagcaggtgcagtgttgcagtggaaagagaccaggtgccaggtgacatagggggtccagggaagacttctgtgaagacttctatgaagcattccagctggtcccagtgtctggcacatgagacatggcaaatcagagtctgtaggatcaagtggatggatggaaccaggcccctggtggcagctcttatgtttgcgatgctgcatgtgggcagcgagtgttccttgctacttcttcctccttcccttgcctccctgtgttagagaagttggtggtggttctgaaagaacagtggtgtagaattcgtgatggggaggcagccaggaaatgacccagcttcttggttctctgagactgacgaagtgaggtcctggggcagtccccaccagatgaggcacgtggctcagcctcatctgcctgcctctccccaagattgacaccgttcccagaaccggcctgaaacttcatatttttgggctttgcacttg

SEQ ID NO: 193111 - DNA, 601 bp, Human
aatacacttatgtgtaaatataattatataataattatataaatttatatgtaaatttataaaatacactttaaactatttaaaatacagttatataaatttgacatactttataacatatatttttaatatattgttttatatgtataatagttatatatcatatatgaaactatataatatacagaaatataataataacagaaatagatctctttttttttgggacaggatcttgctctgtcacccaggctagaatgcagtggcacaatcttggctcattgcaaccttgaccttcccrggctcaaacaattctgccacctcagcctcctgagtagctgggactataagcacacaccaccatgcctggctaatttttgtattttttgtagagacagggttttgccacgttgcccacgctggtctcgaactcatgggcttgtgatctgcccgcctaagcctcccaaagtgctgggattacaagcgtgagccactgcacccagctgaaacaaagacatatctgactgttgcttgtggaggtgcctgccattcctccctacagtgattcacaggctcacccagcctctccttctccttcaag

SEQ ID NO: 193112 - DNA, 601 bp, Human
aaatttgacatactttataacatatatttttaatatattgttttatatgtataatagttatatatcatatatgaaactatataatatacagaaatataataataacagaaatagatctctttttttttgggacaggatcttgctctgtcacccaggctagaatgcagtggcacaatcttggctcattgcaaccttgaccttcccgggctcaaacaattctgccacctcagcctcctgagtagctgggactataagcacacaccaccatgcctggctaatttttgtattttttgtagagacrgggttttgccacgttgcccacgctggtctcgaactcatgggcttgtgatctgcccgcctaagcctcccaaagtgctgggattacaagcgtgagccactgcacccagctgaaacaaagacatatctgactgttgcttgtggaggtgcctgccattcctccctacagtgattcacaggctcacccagcctctccttctccttcaagccccaaacctctgaatgccaggaagggtggtaagaagtgtctctgcgcctagtaccagtaaagttggcaggtcactgtggctagcgggggcaccat

SEQ ID NO: 193113 - DNA, 601 bp, Human
ctcacccagcctctccttctccttcaagccccaaacctctgaatgccaggaagggtggtaagaagtgtctctgcgcctagtaccagtaaagttggcaggtcactgtggctagcgggggcaccattgttggcctcgggcctggggagagaaaaatatgacatacagggggcccacgggggtacgttaggttcagccctgtaagcccacactgaccctggtgggcagacccagcccagggaggggcaggcaggagtgaccccgtcatcaggttctgctggcgagcccagggtggtgacaggcscacgtcttttgccgggagctgaagacgttcatgggctttcaagcaggacaaagcttcaatgtcatcaccaggtagcaggcagagcaagggtgctgacagcctgcagaagcctgtgcttatctctccatcggagctaaagcccatgtttgcttagggaacagcctgaaattccaccccagctgctgggcctttcacttttgaaacataagcccagagagcgaaaggggggaacgttgtgcccagattctctttctgagcgtgaacttgatgttcctgaccaggaaccagccactcgtaccg

SEQ ID NO: 193114 - DNA, 601 bp, Human
ttgccgggagctgaagacgttcatgggctttcaagcaggacaaagcttcaatgtcatcaccaggtagcaggcagagcaagggtgctgacagcctgcagaagcctgtgcttatctctccatcggagctaaagcccatgtttgcttagggaacagcctgaaattccaccccagctgctgggcctttcacttttgaaacataagcccagagagcgaaaggggggaacgttgtgcccagattctctttctgagcgtgaacttgatgttcctgaccaggaaccagccactcgtaccgaaggccttyctgacccctcagttctcccctgagcctttgctgtgtcctgggcaccaagaggtggagataggctgtcaccgtgcacgtttcctaagcctgcagaggaactgttcacagaatccagcctggaatcagccgtttgtggcaaacagtcagtagctatttctcaacgtgtggttgtgaagctgcaggctccatattcgctcttcacagagcatccaagcaggtgtctcagtgccagctcacaccgttcacactgctcacaccagctctggagagctgcttgtacacatctctccacaagtccac

SEQ ID NO: 193115 - DNA, 601 bp, Human
tcagttctcccctgagcctttgctgtgtcctgggcaccaagaggtggagataggctgtcaccgtgcacgtttcctaagcctgcagaggaactgttcacagaatccagcctggaatcagccgtttgtggcaaacagtcagtagctatttctcaacgtgtggttgtgaagctgcaggctccatattcgctcttcacagagcatccaagcaggtgtctcagtgccagctcacaccgttcacactgctcacaccagctctggagagctgcttgtacacatctctccacaagtccactttcagtgwtgccacgtggtaccggaaatttgccatagaaattggccgatggtacgaccagagagccacctgttagatagttaccccacatccccaccctcaacaccaccttagacaaatcctactgtcagaacatgtggaacggagaagggaccttggcggttcattcataaatgtcagcacccataggtctgtgcctgtttggccgcagacactggggagcagcctgtagccttggcttgtgcagcttcctctgcaggaggggtgcctcttccaagaaacctgtcctgactccccagccctccccac

SEQ ID NO: 193116 - DNA, 601 bp, Human
ctgtgtcctgggcaccaagaggtggagataggctgtcaccgtgcacgtttcctaagcctgcagaggaactgttcacagaatccagcctggaatcagccgtttgtggcaaacagtcagtagctatttctcaacgtgtggttgtgaagctgcaggctccatattcgctcttcacagagcatccaagcaggtgtctcagtgccagctcacaccgttcacactgctcacaccagctctggagagctgcttgtacacatctctccacaagtccactttcagtgttgccacgtggtaccggaaattkgccatagaaattggccgatggtacgaccagagagccacctgttagatagttaccccacatccccaccctcaacaccaccttagacaaatcctactgtcagaacatgtggaacggagaagggaccttggcggttcattcataaatgtcagcacccataggtctgtgcctgtttggccgcagacactggggagcagcctgtagccttggcttgtgcagcttcctctgcaggaggggtgcctcttccaagaaacctgtcctgactccccagccctccccacctccattctcgcccccgctgga

SEQ ID NO: 193117 - DNA, 601 bp, Human
cagctcacaccgttcacactgctcacaccagctctggagagctgcttgtacacatctctccacaagtccactttcagtgttgccacgtggtaccggaaatttgccatagaaattggccgatggtacgaccagagagccacctgttagatagttaccccacatccccaccctcaacaccaccttagacaaatcctactgtcagaacatgtggaacggagaagggaccttggcggttcattcataaatgtcagcacccataggtctgtgcctgtttggccgcagacactggggagcagcctgyagccttggcttgtgcagcttcctctgcaggaggggtgcctcttccaagaaacctgtcctgactccccagccctccccacctccattctcgcccccgctggacaatgcacaccctccatcagagcgtggtgcatacctttcatcctagatctcccaccagctttgaaaccagcatcctgttcatgatgtctggaaccctgggaactgtcccagcacctgtttagcacatgtgtgcatgcgaaggggatctgctgagtgctctgctctggtgggaaggccgctctgcacagctggagctgat

SEQ ID NO: 193118 - DNA, 601 bp, Human
gccgatggtacgaccagagagccacctgttagatagttaccccacatccccaccctcaacaccaccttagacaaatcctactgtcagaacatgtggaacggagaagggaccttggcggttcattcataaatgtcagcacccataggtctgtgcctgtttggccgcagacactggggagcagcctgtagccttggcttgtgcagcttcctctgcaggaggggtgcctcttccaagaaacctgtcctgactccccagccctccccacctccattctcgcccccgctggacaatgcacaccctycatcagagcgtggtgcatacctttcatcctagatctcccaccagctttgaaaccagcatcctgttcatgatgtctggaaccctgggaactgtcccagcacctgtttagcacatgtgtgcatgcgaaggggatctgctgagtgctctgctctggtgggaaggccgctctgcacagctggagctgatgccttggcagatgctgggcatctgaatcgtgcagtgcaggagcacaggggcatggcaccgtttgttgctggggaacctaggcctcaaaagggcctcagcctctccgcagtgcagt

SEQ ID NO: 193119 - DNA, 601 bp, Human
gctctgcacagctggagctgatgccttggcagatgctgggcatctgaatcgtgcagtgcaggagcacaggggcatggcaccgtttgttgctggggaacctaggcctcaaaagggcctcagcctctccgcagtgcagtgaggactgtcccatactctcactgcgtacagagtatgggagagtctctgtgaggctttgggtgccctgcagagggaaggcagtgccagctgggcctggtcgggggccatggagatggcgggcccaggctggggaggacttgtggcacccactcccttacccgcyaacccggatcccctggaatctgcagaatgcctggggttgctcctcttctaccctgccgtggctgagctttgtctgtgccctgtcctctggccacggtctttgcctgatccctaccctggtacaggcagagctccctgcaacccccagctgtttccccagaactgacaccagtctccctgcaccacccatcctccttttgactgccctggggacgccactgctgctctgatcctctgtcactccagccacctcttgcttccctgttatcacaaacactgaacagtgagctcaggtgtcagc

SEQ ID NO: 193120 - DNA, 601 bp, Human
ggccacggtctttgcctgatccctaccctggtacaggcagagctccctgcaacccccagctgtttccccagaactgacaccagtctccctgcaccacccatcctccttttgactgccctggggacgccactgctgctctgatcctctgtcactccagccacctcttgcttccctgttatcacaaacactgaacagtgagctcaggtgtcagcctccacagaggcatgcacagcaaggggtccggaggcatgccccatggagaactgggggtgctctgcttgcaggaggatccagggcccaytgcagtcctcagatgttctgggggagaggatacgcctgcttcatttcttctcaggggtcagaactgggcacagggggttggaaggagggagaaagatgtctatcaggtacccactgcatgccaggccctcttctaggctcccttaaaacctttcaggtaggccagtcacggtcgctcatgcctgtaatcccagcactttgggaggccaaagcgggtggatcacctgaggtcaggagtttgagactagcctgatcaacatggagaaaccccgtctctactaaaaatataaaatgagccagg

SEQ ID NO: 193121 - DNA, 601 bp, Human
ggctcccttaaaacctttcaggtaggccagtcacggtcgctcatgcctgtaatcccagcactttgggaggccaaagcgggtggatcacctgaggtcaggagtttgagactagcctgatcaacatggagaaaccccgtctctactaaaaatataaaatgagccaggcatggtggcacatgcctgtaatcccagctactcgggaggctgaggcaggagaatggcttgaacccgggaggtggacgttgcaatgagccgagatcacgccattgcactccagcctgggcaacaagagtgaaactcygtcgcaaaaacaaaagacaaacaaaaaacacctgtcaggtaaatggtggtagagcagaaaacctgggctcagaagctggcattgatcccagagccatccagtttcaaagcccacacccacaactttcctccaggttgggcagtgcatgatggaaaggctgtcccagcaagtagtgagttcactttcaccagtccctggaggcaggagcagagcctgagctgaccacttggaaggagatgttattcaggggactcgagcatctggcgtaggatgggactccatgaggtctatgcctccttc

SEQ ID NO: 193122 - DNA, 601 bp, Human; identical to SEQ ID NO: 188614

SEQ ID NO: 193123 - DNA, 601 bp, Human; identical to SEQ ID NO: 188615

SEQ ID NO: 193124 - DNA, 601 bp, Human; identical to SEQ ID NO: 188616

SEQ ID NO: 193125 - DNA, 601 bp, Human; identical to SEQ ID NO: 188617

SEQ ID NO: 193126 - DNA, 601 bp, Human; identical to SEQ ID NO: 188618

SEQ ID NO: 193127 - DNA, 601 bp, Human; identical to SEQ ID NO: 188619

SEQ ID NO: 193128 - DNA, 601 bp, Human; identical to SEQ ID NO: 188620

SEQ ID NO: 193129 - DNA, 601 bp, Human; identical to SEQ ID NO: 188621

SEQ ID NO: 193130 - DNA, 601 bp, Human; identical to SEQ ID NO: 188622

SEQ ID NO: 193131 - DNA, 601 bp, Human; identical to SEQ ID NO: 188623

SEQ ID NO: 193132 - DNA, 601 bp, Human; identical to SEQ ID NO: 188624

SEQ ID NO: 193133 - DNA, 601 bp, Human; identical to SEQ ID NO: 188625

SEQ ID NO: 193134 - DNA, 601 bp, Human; identical to SEQ ID NO: 188626

SEQ ID NO: 193135 - DNA, 601 bp, Human; identical to SEQ ID NO: 188627

SEQ ID NO: 193136 - DNA, 601 bp, Human; identical to SEQ ID NO: 188628

SEQ ID NO: 193137 - DNA, 601 bp, Human; identical to SEQ ID NO: 188629

SEQ ID NO: 193138 - DNA, 601 bp, Human; identical to SEQ ID NO: 188630

SEQ ID NO: 193139 - DNA, 601 bp, Human; identical to SEQ ID NO: 188631

SEQ ID NO: 193140 - DNA, 601 bp, Human; identical to SEQ ID NO: 188632

SEQ ID NO: 193141 - DNA, 601 bp, Human; identical to SEQ ID NO: 188633

SEQ ID NO: 193142 - DNA, 601 bp, Human; identical to SEQ ID NO: 188634

SEQ ID NO: 193143 - DNA, 601 bp, Human; identical to SEQ ID NO: 188635

SEQ ID NO: 193144 - DNA, 601 bp, Human; identical to SEQ ID NO: 188636

SEQ ID NO: 193145 - DNA, 601 bp, Human; identical to SEQ ID NO: 188637

SEQ ID NO: 193146 - DNA, 601 bp, Human; identical to SEQ ID NO: 188638

SEQ ID NO: 193147 - DNA, 601 bp, Human; identical to SEQ ID NO: 188639

SEQ ID NO: 193148 - DNA, 601 bp, Human; identical to SEQ ID NO: 188640

SEQ ID NO: 193149 - DNA, 601 bp, Human; identical to SEQ ID NO: 188641

SEQ ID NO: 193150 - DNA, 601 bp, Human; identical to SEQ ID NO: 188642

SEQ ID NO: 193151 - DNA, 601 bp, Human; identical to SEQ ID NO: 188643

SEQ ID NO: 193152 - DNA, 601 bp, Human; identical to SEQ ID NO: 188644

SEQ ID NO: 193153 - DNA, 601 bp, Human; identical to SEQ ID NO: 188645

SEQ ID NO: 193154 - DNA, 601 bp, Human; identical to SEQ ID NO: 188646

SEQ ID NO: 193155 - DNA, 601 bp, Human; identical to SEQ ID NO: 188647

SEQ ID NO: 193156 - DNA, 601 bp, Human; identical to SEQ ID NO: 188648

SEQ ID NO: 193157 - DNA, 601 bp, Human; identical to SEQ ID NO: 188649

SEQ ID NO: 193158 - DNA, 601 bp, Human; identical to SEQ ID NO: 188650

SEQ ID NO: 193159 - DNA, 601 bp, Human; identical to SEQ ID NO: 188651

SEQ ID NO: 193160 - DNA, 601 bp, Human; identical to SEQ ID NO: 188652

SEQ ID NO: 193161 - DNA, 601 bp, Human; identical to SEQ ID NO: 188653

SEQ ID NO: 193162 - DNA, 601 bp, Human; identical to SEQ ID NO: 188654

SEQ ID NO: 193163 - DNA, 601 bp, Human; identical to SEQ ID NO: 188655

SEQ ID NO: 193164 - DNA, 601 bp, Human; identical to SEQ ID NO: 188656

SEQ ID NO: 193165 - DNA, 601 bp, Human; identical to SEQ ID NO: 188657

SEQ ID NO: 193166 - DNA, 601 bp, Human; identical to SEQ ID NO: 188658

SEQ ID NO: 193167 - DNA, 601 bp, Human; identical to SEQ ID NO: 188659

SEQ ID NO: 193168 - DNA, 601 bp, Human; identical to SEQ ID NO: 188660

SEQ ID NO: 193169 - DNA, 601 bp, Human; identical to SEQ ID NO: 188661

SEQ ID NO: 193170 - DNA, 601 bp, Human; identical to SEQ ID NO: 188662

SEQ ID NO: 193171 - DNA, 601 bp, Human; identical to SEQ ID NO: 193078

SEQ ID NO: 193172 - DNA, 601 bp, Human; identical to SEQ ID NO: 193079

SEQ ID NO: 193173 - DNA, 601 bp, Human; identical to SEQ ID NO: 193080

SEQ ID NO: 193174 - DNA, 601 bp, Human; identical to SEQ ID NO: 193081

SEQ ID NO: 193175 - DNA, 601 bp, Human; identical to SEQ ID NO: 193082

SEQ ID NO: 193176 - DNA, 601 bp, Human; identical to SEQ ID NO: 193083

SEQ ID NO: 193177 - DNA, 601 bp, Human; identical to SEQ ID NO: 193084

SEQ ID NO: 193178 - DNA, 601 bp, Human; identical to SEQ ID NO: 193085

SEQ ID NO: 193179 - DNA, 601 bp, Human; identical to SEQ ID NO: 193086

SEQ ID NO: 193180 - DNA, 601 bp, Human; identical to SEQ ID NO: 193087

SEQ ID NO: 193181 - DNA, 601 bp, Human; identical to SEQ ID NO: 193088

SEQ ID NO: 193182 - DNA, 601 bp, Human; identical to SEQ ID NO: 193089

SEQ ID NO: 193183 - DNA, 601 bp, Human; identical to SEQ ID NO: 193090

SEQ ID NO: 193184 - DNA, 601 bp, Human; identical to SEQ ID NO: 193091

SEQ ID NO: 193185 - DNA, 601 bp, Human; identical to SEQ ID NO: 193092

SEQ ID NO: 193186 - DNA, 601 bp, Human; identical to SEQ ID NO: 193093

SEQ ID NO: 193187 - DNA, 601 bp, Human; identical to SEQ ID NO: 193094

SEQ ID NO: 193188 - DNA, 601 bp, Human; identical to SEQ ID NO: 193095

SEQ ID NO: 193189 - DNA, 601 bp, Human; identical to SEQ ID NO: 193096

SEQ ID NO: 193190 - DNA, 601 bp, Human; identical to SEQ ID NO: 193097

SEQ ID NO: 193191 - DNA, 601 bp, Human; identical to SEQ ID NO: 193098

SEQ ID NO: 193192 - DNA, 601 bp, Human; identical to SEQ ID NO: 193099

SEQ ID NO: 193193 - DNA, 601 bp, Human; identical to SEQ ID NO: 193100

SEQ ID NO: 193194 - DNA, 601 bp, Human; identical to SEQ ID NO: 193101

SEQ ID NO: 193195 - DNA, 601 bp, Human; identical to SEQ ID NO: 193102

SEQ ID NO: 193196 - DNA, 601 bp, Human; identical to SEQ ID NO: 193103

SEQ ID NO: 193197 - DNA, 601 bp, Human; identical to SEQ ID NO: 193104

SEQ ID NO: 193198 - DNA, 601 bp, Human; identical to SEQ ID NO: 193105

SEQ ID NO: 193199 - DNA, 601 bp, Human; identical to SEQ ID NO: 193106

SEQ ID NO: 193200 - DNA, 601 bp, Human; identical to SEQ ID NO: 193107

SEQ ID NO: 193201 - DNA, 601 bp, Human; identical to SEQ ID NO: 193108

SEQ ID NO: 193202 - DNA, 601 bp, Human; identical to SEQ ID NO: 193109

SEQ ID NO: 193203 - DNA, 601 bp, Human; identical to SEQ ID NO: 193110

SEQ ID NO: 193204 - DNA, 601 bp, Human; identical to SEQ ID NO: 193111

SEQ ID NO: 193205 - DNA, 601 bp, Human; identical to SEQ ID NO: 193112

SEQ ID NO: 193206 - DNA, 601 bp, Human; identical to SEQ ID NO: 193113

SEQ ID NO: 193207 - DNA, 601 bp, Human; identical to SEQ ID NO: 193114

SEQ ID NO: 193208 - DNA, 601 bp, Human; identical to SEQ ID NO: 193115

SEQ ID NO: 193209 - DNA, 601 bp, Human; identical to SEQ ID NO: 193116

SEQ ID NO: 193210 - DNA, 601 bp, Human; identical to SEQ ID NO: 193117

SEQ ID NO: 193211 - DNA, 601 bp, Human; identical to SEQ ID NO: 193118

SEQ ID NO: 193212 - DNA, 601 bp, Human; identical to SEQ ID NO: 193119

SEQ ID NO: 193213 - DNA, 601 bp, Human; identical to SEQ ID NO: 193120

SEQ ID NO: 193214 - DNA, 601 bp, Human; identical to SEQ ID NO: 193121

SEQ ID NO: 193215 - DNA, 601 bp, Human; identical to SEQ ID NO: 188614

SEQ ID NO: 193216 - DNA, 601 bp, Human; identical to SEQ ID NO: 188615

SEQ ID NO: 193217 - DNA, 601 bp, Human; identical to SEQ ID NO: 188616

SEQ ID NO: 193218 - DNA, 601 bp, Human; identical to SEQ ID NO: 188617

SEQ ID NO: 193219 - DNA, 601 bp, Human; identical to SEQ ID NO: 188618

SEQ ID NO: 193220 - DNA, 601 bp, Human; identical to SEQ ID NO: 188619

SEQ ID NO: 193221 - DNA, 601 bp, Human; identical to SEQ ID NO: 188620

SEQ ID NO: 193222 - DNA, 601 bp, Human; identical to SEQ ID NO: 188621

SEQ ID NO: 193223 - DNA, 601 bp, Human; identical to SEQ ID NO: 188622

SEQ ID NO: 193224 - DNA, 601 bp, Human; identical to SEQ ID NO: 188623

SEQ ID NO: 193225 - DNA, 601 bp, Human; identical to SEQ ID NO: 188624

SEQ ID NO: 193226 - DNA, 601 bp, Human; identical to SEQ ID NO: 188625

SEQ ID NO: 193227 - DNA, 601 bp, Human; identical to SEQ ID NO: 188626

SEQ ID NO: 193228 - DNA, 601 bp, Human; identical to SEQ ID NO: 188627

SEQ ID NO: 193229 - DNA, 601 bp, Human; identical to SEQ ID NO: 188628

SEQ ID NO: 193230 - DNA, 601 bp, Human; identical to SEQ ID NO: 188629

SEQ ID NO: 193231 - DNA, 601 bp, Human; identical to SEQ ID NO: 188630

SEQ ID NO: 193232 - DNA, 601 bp, Human; identical to SEQ ID NO: 188631

SEQ ID NO: 193233 - DNA, 601 bp, Human; identical to SEQ ID NO: 188632

SEQ ID NO: 193234 - DNA, 601 bp, Human; identical to SEQ ID NO: 188633

SEQ ID NO: 193235 - DNA, 601 bp, Human; identical to SEQ ID NO: 188634

SEQ ID NO: 193236 - DNA, 601 bp, Human; identical to SEQ ID NO: 188635

SEQ ID NO: 193237 - DNA, 601 bp, Human; identical to SEQ ID NO: 188636

SEQ ID NO: 193238 - DNA, 601 bp, Human; identical to SEQ ID NO: 188637

SEQ ID NO: 193239 - DNA, 601 bp, Human; identical to SEQ ID NO: 188638

SEQ ID NO: 193240 - DNA, 601 bp, Human; identical to SEQ ID NO: 188639

SEQ ID NO: 193241 - DNA, 601 bp, Human; identical to SEQ ID NO: 188640

SEQ ID NO: 193242 - DNA, 601 bp, Human; identical to SEQ ID NO: 188641

SEQ ID NO: 193243 - DNA, 601 bp, Human; identical to SEQ ID NO: 188642

SEQ ID NO: 193244 - DNA, 601 bp, Human; identical to SEQ ID NO: 188643

SEQ ID NO: 193245 - DNA, 601 bp, Human; identical to SEQ ID NO: 188644

SEQ ID NO: 193246 - DNA, 601 bp, Human; identical to SEQ ID NO: 188645

SEQ ID NO: 193247 - DNA, 601 bp, Human; identical to SEQ ID NO: 188646

SEQ ID NO: 193248 - DNA, 601 bp, Human; identical to SEQ ID NO: 188647

SEQ ID NO: 193249 - DNA, 601 bp, Human; identical to SEQ ID NO: 188648

SEQ ID NO: 193250 - DNA, 601 bp, Human; identical to SEQ ID NO: 188649

SEQ ID NO: 193251 - DNA, 601 bp, Human; identical to SEQ ID NO: 188650

SEQ ID NO: 193252 - DNA, 601 bp, Human; identical to SEQ ID NO: 188651

SEQ ID NO: 193253 - DNA, 601 bp, Human; identical to SEQ ID NO: 188652

SEQ ID NO: 193254 - DNA, 601 bp, Human; identical to SEQ ID NO: 188653

SEQ ID NO: 193255 - DNA, 601 bp, Human; identical to SEQ ID NO: 188654

SEQ ID NO: 193256 - DNA, 601 bp, Human; identical to SEQ ID NO: 188655

SEQ ID NO: 193257 - DNA, 601 bp, Human; identical to SEQ ID NO: 188656

SEQ ID NO: 193258 - DNA, 601 bp, Human; identical to SEQ ID NO: 188657

SEQ ID NO: 193259 - DNA, 601 bp, Human; identical to SEQ ID NO: 188658

SEQ ID NO: 193260 - DNA, 601 bp, Human; identical to SEQ ID NO: 188659

SEQ ID NO: 193261 - DNA, 601 bp, Human; identical to SEQ ID NO: 188660

SEQ ID NO: 193262 - DNA, 601 bp, Human; identical to SEQ ID NO: 188661

SEQ ID NO: 193263 - DNA, 601 bp, Human; identical to SEQ ID NO: 188662

SEQ ID NO: 193264 - DNA, 601 bp, Human; identical to SEQ ID NO: 193078

SEQ ID NO: 193265 - DNA, 601 bp, Human; identical to SEQ ID NO: 193079

SEQ ID NO: 193266 - DNA, 601 bp, Human; identical to SEQ ID NO: 193080

SEQ ID NO: 193267 - DNA, 601 bp, Human; identical to SEQ ID NO: 193081

SEQ ID NO: 193268 - DNA, 601 bp, Human; identical to SEQ ID NO: 193082

SEQ ID NO: 193269 - DNA, 601 bp, Human; identical to SEQ ID NO: 193083

SEQ ID NO: 193270 - DNA, 601 bp, Human; identical to SEQ ID NO: 193084

SEQ ID NO: 193271 - DNA, 601 bp, Human; identical to SEQ ID NO: 193085

SEQ ID NO: 193272 - DNA, 601 bp, Human; identical to SEQ ID NO: 193086

SEQ ID NO: 193273 - DNA, 601 bp, Human; identical to SEQ ID NO: 193087

SEQ ID NO: 193274 - DNA, 601 bp, Human; identical to SEQ ID NO: 193088

SEQ ID NO: 193275 - DNA, 601 bp, Human; identical to SEQ ID NO: 193089

SEQ ID NO: 193276 - DNA, 601 bp, Human; identical to SEQ ID NO: 193090

SEQ ID NO: 193277 - DNA, 601 bp, Human; identical to SEQ ID NO: 193091

SEQ ID NO: 193278 - DNA, 601 bp, Human; identical to SEQ ID NO: 193092

SEQ ID NO: 193279 - DNA, 601 bp, Human; identical to SEQ ID NO: 193093

SEQ ID NO: 193280 - DNA, 601 bp, Human; identical to SEQ ID NO: 193094

SEQ ID NO: 193281 - DNA, 601 bp, Human; identical to SEQ ID NO: 193095

SEQ ID NO: 193282 - DNA, 601 bp, Human; identical to SEQ ID NO: 193096

SEQ ID NO: 193283 - DNA, 601 bp, Human; identical to SEQ ID NO: 193097

SEQ ID NO: 193284 - DNA, 601 bp, Human; identical to SEQ ID NO: 193098

SEQ ID NO: 193285 - DNA, 601 bp, Human; identical to SEQ ID NO: 193099

SEQ ID NO: 193286 - DNA, 601 bp, Human; identical to SEQ ID NO: 193100

SEQ ID NO: 193287 - DNA, 601 bp, Human; identical to SEQ ID NO: 193101

SEQ ID NO: 193288 - DNA, 601 bp, Human; identical to SEQ ID NO: 193102

SEQ ID NO: 193289 - DNA, 601 bp, Human; identical to SEQ ID NO: 193103

SEQ ID NO: 193290 - DNA, 601 bp, Human; identical to SEQ ID NO: 193104

SEQ ID NO: 193291 - DNA, 601 bp, Human; identical to SEQ ID NO: 193105

SEQ ID NO: 193292 - DNA, 601 bp, Human; identical to SEQ ID NO: 193106

SEQ ID NO: 193293 - DNA, 601 bp, Human; identical to SEQ ID NO: 193107

SEQ ID NO: 193294 - DNA, 601 bp, Human; identical to SEQ ID NO: 193108

SEQ ID NO: 193295 - DNA, 601 bp, Human; identical to SEQ ID NO: 193109

SEQ ID NO: 193296 - DNA, 601 bp, Human; identical to SEQ ID NO: 193110

SEQ ID NO: 193297 - DNA, 601 bp, Human; identical to SEQ ID NO: 193111

SEQ ID NO: 193298 - DNA, 601 bp, Human; identical to SEQ ID NO: 193112

SEQ ID NO: 193299 - DNA, 601 bp, Human; identical to SEQ ID NO: 193113

SEQ ID NO: 193300 - DNA, 601 bp, Human; identical to SEQ ID NO: 193114

SEQ ID NO: 193301 - DNA, 601 bp, Human; identical to SEQ ID NO: 193115

SEQ ID NO: 193302 - DNA, 601 bp, Human; identical to SEQ ID NO: 193116

SEQ ID NO: 193303 - DNA, 601 bp, Human; identical to SEQ ID NO: 193117

SEQ ID NO: 193304 - DNA, 601 bp, Human; identical to SEQ ID NO: 193118

SEQ ID NO: 193305 - DNA, 601 bp, Human; identical to SEQ ID NO: 193119

SEQ ID NO: 193306 - DNA, 601 bp, Human; identical to SEQ ID NO: 193120

SEQ ID NO: 193307 - DNA, 601 bp, Human; identical to SEQ ID NO: 193121

SEQ ID NO: 193308 - DNA, 601 bp, Human; identical to SEQ ID NO: 188614

SEQ ID NO: 193309 - DNA, 601 bp, Human; identical to SEQ ID NO: 188615

SEQ ID NO: 193310 - DNA, 601 bp, Human; identical to SEQ ID NO: 188616

SEQ ID NO: 193311 - DNA, 601 bp, Human; identical to SEQ ID NO: 188617

SEQ ID NO: 193312 - DNA, 601 bp, Human; identical to SEQ ID NO: 188618

SEQ ID NO: 193313 - DNA, 601 bp, Human; identical to SEQ ID NO: 188619

SEQ ID NO: 193314 - DNA, 601 bp, Human; identical to SEQ ID NO: 188620

SEQ ID NO: 193315 - DNA, 601 bp, Human; identical to SEQ ID NO: 188621

SEQ ID NO: 193316 - DNA, 601 bp, Human; identical to SEQ ID NO: 188622

SEQ ID NO: 193317 - DNA, 601 bp, Human; identical to SEQ ID NO: 188623

SEQ ID NO: 193318 - DNA, 601 bp, Human; identical to SEQ ID NO: 188624

SEQ ID NO: 193319 - DNA, 601 bp, Human; identical to SEQ ID NO: 188625

SEQ ID NO: 193320 - DNA, 601 bp, Human; identical to SEQ ID NO: 188626

SEQ ID NO: 193321 - DNA, 601 bp, Human; identical to SEQ ID NO: 188627

SEQ ID NO: 193322 - DNA, 601 bp, Human; identical to SEQ ID NO: 188628

SEQ ID NO: 193323 - DNA, 601 bp, Human; identical to SEQ ID NO: 188629

SEQ ID NO: 193324 - DNA, 601 bp, Human; identical to SEQ ID NO: 188630

SEQ ID NO: 193325 - DNA, 601 bp, Human; identical to SEQ ID NO: 188631

SEQ ID NO: 193326 - DNA, 601 bp, Human; identical to SEQ ID NO: 188632

SEQ ID NO: 193327 - DNA, 601 bp, Human; identical to SEQ ID NO: 188633

SEQ ID NO: 193328 - DNA, 601 bp, Human; identical to SEQ ID NO: 188634

SEQ ID NO: 193329 - DNA, 601 bp, Human; identical to SEQ ID NO: 188635

SEQ ID NO: 193330 - DNA, 601 bp, Human; identical to SEQ ID NO: 188636

SEQ ID NO: 193331 - DNA, 601 bp, Human; identical to SEQ ID NO: 188637

SEQ ID NO: 193332 - DNA, 601 bp, Human; identical to SEQ ID NO: 188638

SEQ ID NO: 193333 - DNA, 601 bp, Human; identical to SEQ ID NO: 188639

SEQ ID NO: 193334 - DNA, 601 bp, Human; identical to SEQ ID NO: 188640

SEQ ID NO: 193335 - DNA, 601 bp, Human; identical to SEQ ID NO: 188641

SEQ ID NO: 193336 - DNA, 601 bp, Human; identical to SEQ ID NO: 188642

SEQ ID NO: 193337 - DNA, 601 bp, Human; identical to SEQ ID NO: 188643

SEQ ID NO: 193338 - DNA, 601 bp, Human; identical to SEQ ID NO: 188644

SEQ ID NO: 193339 - DNA, 601 bp, Human; identical to SEQ ID NO: 188645

SEQ ID NO: 193340 - DNA, 601 bp, Human; identical to SEQ ID NO: 188646

SEQ ID NO: 193341 - DNA, 601 bp, Human; identical to SEQ ID NO: 188647

SEQ ID NO: 193342 - DNA, 601 bp, Human; identical to SEQ ID NO: 188648

SEQ ID NO: 193343 - DNA, 601 bp, Human; identical to SEQ ID NO: 188649

SEQ ID NO: 193344 - DNA, 601 bp, Human; identical to SEQ ID NO: 188650

SEQ ID NO: 193345 - DNA, 601 bp, Human; identical to SEQ ID NO: 188651

SEQ ID NO: 193346 - DNA, 601 bp, Human; identical to SEQ ID NO: 188652

SEQ ID NO: 193347 - DNA, 601 bp, Human; identical to SEQ ID NO: 188653

SEQ ID NO: 193348 - DNA, 601 bp, Human; identical to SEQ ID NO: 188654

SEQ ID NO: 193349 - DNA, 601 bp, Human; identical to SEQ ID NO: 188655

SEQ ID NO: 193350 - DNA, 601 bp, Human; identical to SEQ ID NO: 188656

SEQ ID NO: 193351 - DNA, 601 bp, Human; identical to SEQ ID NO: 188657

SEQ ID NO: 193352 - DNA, 601 bp, Human; identical to SEQ ID NO: 188658

SEQ ID NO: 193353 - DNA, 601 bp, Human; identical to SEQ ID NO: 188659

SEQ ID NO: 193354 - DNA, 601 bp, Human; identical to SEQ ID NO: 188660

SEQ ID NO: 193355 - DNA, 601 bp, Human; identical to SEQ ID NO: 188661

SEQ ID NO: 193356 - DNA, 601 bp, Human; identical to SEQ ID NO: 188662

SEQ ID NO: 193357 - DNA, 601 bp, Human; identical to SEQ ID NO: 193078

SEQ ID NO: 193358 - DNA, 601 bp, Human; identical to SEQ ID NO: 193079

SEQ ID NO: 193359 - DNA, 601 bp, Human; identical to SEQ ID NO: 193080

SEQ ID NO: 193360 - DNA, 601 bp, Human; identical to SEQ ID NO: 193081

SEQ ID NO: 193361 - DNA, 601 bp, Human; identical to SEQ ID NO: 193082

SEQ ID NO: 193362 - DNA, 601 bp, Human; identical to SEQ ID NO: 193083

SEQ ID NO: 193363 - DNA, 601 bp, Human; identical to SEQ ID NO: 193084

SEQ ID NO: 193364 - DNA, 601 bp, Human; identical to SEQ ID NO: 193085

SEQ ID NO: 193365 - DNA, 601 bp, Human; identical to SEQ ID NO: 193086

SEQ ID NO: 193366 - DNA, 601 bp, Human; identical to SEQ ID NO: 193087

SEQ ID NO: 193367 - DNA, 601 bp, Human; identical to SEQ ID NO: 193088

SEQ ID NO: 193368 - DNA, 601 bp, Human; identical to SEQ ID NO: 193089

SEQ ID NO: 193369 - DNA, 601 bp, Human; identical to SEQ ID NO: 193090

SEQ ID NO: 193370 - DNA, 601 bp, Human; identical to SEQ ID NO: 193091

SEQ ID NO: 193371 - DNA, 601 bp, Human; identical to SEQ ID NO: 193092

SEQ ID NO: 193372 - DNA, 601 bp, Human; identical to SEQ ID NO: 193093

SEQ ID NO: 193373 - DNA, 601 bp, Human; identical to SEQ ID NO: 193094

SEQ ID NO: 193374 - DNA, 601 bp, Human; identical to SEQ ID NO: 193095

SEQ ID NO: 193375 - DNA, 601 bp, Human; identical to SEQ ID NO: 193096

SEQ ID NO: 193376 - DNA, 601 bp, Human; identical to SEQ ID NO: 193097

SEQ ID NO: 193377 - DNA, 601 bp, Human; identical to SEQ ID NO: 193098

SEQ ID NO: 193378 - DNA, 601 bp, Human; identical to SEQ ID NO: 193099

SEQ ID NO: 193379 - DNA, 601 bp, Human; identical to SEQ ID NO: 193100

SEQ ID NO: 193380 - DNA, 601 bp, Human; identical to SEQ ID NO: 193101

SEQ ID NO: 193381 - DNA, 601 bp, Human; identical to SEQ ID NO: 193102

SEQ ID NO: 193382 - DNA, 601 bp, Human; identical to SEQ ID NO: 193103

SEQ ID NO: 193383 - DNA, 601 bp, Human; identical to SEQ ID NO: 193104

SEQ ID NO: 193384 - DNA, 601 bp, Human; identical to SEQ ID NO: 193105

SEQ ID NO: 193385 - DNA, 601 bp, Human; identical to SEQ ID NO: 193106

SEQ ID NO: 193386 - DNA, 601 bp, Human; identical to SEQ ID NO: 193107

SEQ ID NO: 193387 - DNA, 601 bp, Human; identical to SEQ ID NO: 193108

SEQ ID NO: 193388 - DNA, 601 bp, Human; identical to SEQ ID NO: 193109

SEQ ID NO: 193389 - DNA, 601 bp, Human; identical to SEQ ID NO: 193110

SEQ ID NO: 193390 - DNA, 601 bp, Human; identical to SEQ ID NO: 193111

SEQ ID NO: 193391 - DNA, 601 bp, Human; identical to SEQ ID NO: 193112

SEQ ID NO: 193392 - DNA, 601 bp, Human; identical to SEQ ID NO: 193113

SEQ ID NO: 193393 - DNA, 601 bp, Human; identical to SEQ ID NO: 193114

SEQ ID NO: 193394 - DNA, 601 bp, Human; identical to SEQ ID NO: 193115

SEQ ID NO: 193395 - DNA, 601 bp, Human; identical to SEQ ID NO: 193116

SEQ ID NO: 193396 - DNA, 601 bp, Human; identical to SEQ ID NO: 193117

SEQ ID NO: 193397 - DNA, 601 bp, Human; identical to SEQ ID NO: 193118

SEQ ID NO: 193398 - DNA, 601 bp, Human; identical to SEQ ID NO: 193119

SEQ ID NO: 193399 - DNA, 601 bp, Human; identical to SEQ ID NO: 193120

SEQ ID NO: 193400 - DNA, 601 bp, Human; identical to SEQ ID NO: 193121

SEQ ID NO: 193401 - DNA, 601 bp, Human
gggagagagagagaagagatgaatgaatgaatgaatgaatgaatgaatgaatgaagtggtcactcccctcaaggactctacaggctcttttggaataagtgcatctatacatgtaattcttctcctggtcaaaccccggactgatcaaagtagagtgtttttgctgaatatggggcaagaagctattaactgacagagtggttgaaagaagtctggaaatgagagaagaggggtcagaatgtaaaagaggaatcctggttcccttccacgggggtcccgaggtgctttgaggagggagaargagggcgtcccctctggggagcccactctccgggcttctactgacctggtctccgcctcaccggcctcttgcggccgctgcagaagcgcactttgctgaacaccccgaggacgtgcctctcgcacagggagcgcccgtctttgctggggctggagcggcgcttggaggccgacactcggtcgctgttggactccctcgcctgccgcttctgccggatcaaggagctggctatcgccgcagccatagctgctcagcgagggcctcaggccccagcctctactgcgccctccggcttgcgct

SEQ ID NO: 193402 - DNA, 601 bp, Human
catgagggaaaaatgaagaggtgagaaattgacaagggcgtctgaaagatgcaatgccaagtgttgctggaggaagagttggaaaaataataaatttaagttcatctggtgtctactaggtgtctatcatggattatgagggataagggaagggctgtattaatctttaggtcctcagtgggcagcgtaagtactgtactctacagacggatggatgcatggacggatagatgcatggatggatggatgggagagcgggagagagagagaagagatgaatgaatgaatgaatgaatgaatgaatgaatgaagtggtcactcccctcaaggactctacaggctcttttggaataagtgcatctatacatgtaattcttctcctggtcaaaccccggactgatcaaagtagagtgtttttgctgaatatggggcaagaagctattaactgacagagtggttgaaagaagtctggaaatgagagaagaggggtcagaatgtaaaagaggaatcctggttcccttccacgggggtcccgaggtgctttgaggagggagaaggagggcgtcccctctggggagcccactctccgggcttctactga

SEQ ID NO: 193403 - DNA, 601 bp, Human
tgtaaaggaagtgaaagagcatgagggaaaaatgaagaggtgagaaattgacaagggcgtctgaaagatgcaatgccaagtgttgctggaggaagagttggaaaaataataaatttaagttcatctggtgtctactaggtgtctatcatggattatgagggataagggaagggctgtattaatctttaggtcctcagtgggcagcgtaagtactgtactctacagacggatggatgcatggacggatagatgcatggatggatggatgggagagcgggagagagagagaagagatgaatgaatgaatgaatgaatgaatgaatgaatgaagtggtcactcccctcaaggactctacaggctcttttggaataagtgcatctatacatgtaattcttctcctggtcaaaccccggactgatcaaagtagagtgtttttgctgaatatggggcaagaagctattaactgacagagtggttgaaagaagtctggaaatgagagaagaggggtcagaatgtaaaagaggaatcctggttcccttccacgggggtcccgaggtgctttgaggagggagaaggagggcgtcccctctggggagccca

SEQ ID NO: 193404 - DNA, 601 bp, Human
agactgtgtaaaggaagtgaaagagcatgagggaaaaatgaagaggtgagaaattgacaagggcgtctgaaagatgcaatgccaagtgttgctggaggaagagttggaaaaataataaatttaagttcatctggtgtctactaggtgtctatcatggattatgagggataagggaagggctgtattaatctttaggtcctcagtgggcagcgtaagtactgtactctacagacggatggatgcatggacggatagatgcatggatggatggatgggagagcgggagagagagagaagagatgaatgaatgaatgaatgaatgaatgaatgaatgaagtggtcactcccctcaaggactctacaggctcttttggaataagtgcatctatacatgtaattcttctcctggtcaaaccccggactgatcaaagtagagtgtttttgctgaatatggggcaagaagctattaactgacagagtggttgaaagaagtctggaaatgagagaagaggggtcagaatgtaaaagaggaatcctggttcccttccacgggggtcccgaggtgctttgaggagggagaaggagggcgtcccctctgggg

SEQ ID NO: 193405 - DNA, 601 bp, Human
gaagactgtgtaaaggaagtgaaagagcatgagggaaaaatgaagaggtgagaaattgacaagggcgtctgaaagatgcaatgccaagtgttgctggaggaagagttggaaaaataataaatttaagttcatctggtgtctactaggtgtctatcatggattatgagggataagggaagggctgtattaatctttaggtcctcagtgggcagcgtaagtactgtactctacagacggatggatgcatggacggatagatgcatggatggatggatgggagagcgggagagagagagaagagatgaatgaatgaatgaatgaatgaatgaatgaatgaagtggtcactcccctcaaggactctacaggctcttttggaataagtgcatctatacatgtaattcttctcctggtcaaaccccggactgatcaaagtagagtgtttttgctgaatatggggcaagaagctattaactgacagagtggttgaaagaagtctggaaatgagagaagaggggtcagaatgtaaaagaggaatcctggttcccttccacgggggtcccgaggtgctttgaggagggagaaggagggcgtcccctctgg

SEQ ID NO: 193406 - DNA, 601 bp, Human
aatgaagactgtgtaaaggaagtgaaagagcatgagggaaaaatgaagaggtgagaaattgacaagggcgtctgaaagatgcaatgccaagtgttgctggaggaagagttggaaaaataataaatttaagttcatctggtgtctactaggtgtctatcatggattatgagggataagggaagggctgtattaatctttaggtcctcagtgggcagcgtaagtactgtactctacagacggatggatgcatggacggatagatgcatggatggatggatgggagagcgggagagagagagaagagatgaatgaatgaatgaatgaatgaatgaatgaatgaagtggtcactcccctcaaggactctacaggctcttttggaataagtgcatctatacatgtaattcttctcctggtcaaaccccggactgatcaaagtagagtgtttttgctgaatatggggcaagaagctattaactgacagagtggttgaaagaagtctggaaatgagagaagaggggtcagaatgtaaaagaggaatcctggttcccttccacgggggtcccgaggtgctttgaggagggagaaggagggcgtcccctc

SEQ ID NO: 193407 - DNA, 601 bp, Human
tcaactcaaaaacgtcatataattttcccaactagagtgcaagcacgtacttcagagattgagatataaaagtcacattgagttcagaaccttgaagtcctctgtagaccacataagccctaagaaaagaaggcctccaaattatccctccacaacagaacaggttattttattttccactaggtgagttactttgtagaggtaattcaaactattgcataaatcttcactttataaaatgaacatgctatactaattggacataaaataatagagactaatagctcctgtcttgggatcrtaattatttttgtatactcctgaaatttaccactttatcatcatcacaaaataagaaaatgagcctagtatggagtggacaatgtcatgaaaacccaacggaaaatgaaacagggtcgcttcttcacaaggcttaaccccaaatttctgagctaattctgagcccgacttgtccagacttcccaagtgtcgcccttcatccaatggacccaaccatgtacttcattgctggaaaccaacagcacgccacagtcagagttgcaaagagacaaactagccaacagattacagggcaggctcc

SEQ ID NO: 193408 - DNA, 601 bp, Human
ttgcttcctcaaatgcagagactgcctcacttcctataaattgtttttctacttctgttcaagaaaaacaaattcattaaaactttaaagacttaatctcgagttacgtcttgatgagatctctgtgggatgaaagaaatcaagagatcacaataactgctattttaaaatgttcctacaatggaaacataatttgttgttgagaatgcactgctgtagagagaaccgaattttaaaaacatgttcaaaatatcagtttaaaccctaaggtgggtttctgaaaagttaggggtcttactgtttttttttttttaacaaaaatcaagccaaatatcatttaattaggctgactttgtagttcagatatgagtcatactttcaaaagagaaaatgtaatcaaagtacttcctataaatgtaaaatatcacctgtcatataaatctattcttgacccatatattggccaaaactatttcaatttataaaaatctaactcatattccataaatcacatgattaaacattatttcacctttactgtcaactttcttcttgaagtttctatttcctacgatattttcttcctctatgcaaaaggata

SEQ ID NO: 193409 - DNA, 601 bp, Human
gccctttagatgtggtgcacctttctttagaaaataggaaaagttctgtaattccatgagtaagccagaagataaaattgaaaatatagcatatcaagcgtgtcctctatgtctaacaaggctgttttgtggaatcatcatacaatctataataattctatacatcaaaagcaaatatacatgatgatcatgcattcaaagaagagacaagaaaaaattgatcactattaacatatttccaaagcaaatctacaaaatttccagagcaaatttattctctcaccaagaataaaagcaatgwgtttccatatgagtaagcccaggactttttaaaatacaattttatgagacaaagcttacatttctaaagatcttccaaaatattcctattgcttcctcaaatgcagagactgcctcacttcctataaattgtttttctacttctgttcaagaaaaacaaattcattaaaactttaaagacttaatctcgagttacgtcttgatgagatctctgtgggatgaaagaaatcaagagatcacaataactgctattttaaaatgttcctacaatggaaacataatttgttgttgagaatgcact

SEQ ID NO: 193410 - DNA, 601 bp, Human
ttttttatgaaaatcgttttgaccttctggatccactaaaagattttcaggaagcttctagggcctctgtactgtatggtactttgagaactgctggtccagactgatgccctagcctccttactgttcccttgcttctactctgcttccattgctatccattctcttctccaaaggcaaagtgcccaattaaaaatacaagtcgcatgatatcaccccatactgctgatctttctttggaccctagattaaaatacaaaattcatcttaggcttctcaaggccctgcggttcttgccaarctttccaacatcatctgtacccctctccccttgttcttattgcttcagctatacttcaatttcttcagaagcaccgagctccctctcacatcaatcttcatgcaagttgttctcttctgccttgaaggttcttccattcctgtctgcctgtttcatcttttggagctcagcttaaatgatttttcctcaaagaagcatttcttgaccaaaagctagaggtaatatcttcattttacaaatcagcaaactgaggtgcaaagatattaagaaacttgcctaatgttcttacaaataataaga

SEQ ID NO: 193411 - DNA, 601 bp, Human
ggcatagtatttgcatagcatggttgtactatggttttcttcttgaatatttccatccatggttggtgaatcttcaaatgcaaaaccatcagtccaagtttcaattatgaggcattaacataagtgtggttacaagcatggagtctgggaggcctataaatactacaaacgaatcaaataactaacaataggcagaaaaatagaactttataaaatttgtgtttgtaaaatcacttgacgattcgaaggccaatgagtgtttcttgagagttcaagaataaagtaaacagccttatatatrtgggtattgtaaaaccattaaacaataaataaaacccaatcttccaccttcacattcttttctttttttttttttttttgagactgagtctcgccatgtggcccgggctggagtgcaatgacacgaccttggctcattgcaacttccgcctcccgggttcaaatgattctcctgcctcagcctcctaagtagctgggattacaggcacccaccaccacactgagctaatttttgtatttttaatagagatggggtttcaccatgttggccaggctggtctcgaactcctgacgttgtgat

SEQ ID NO: 193412 - DNA, 601 bp, Human
agggccacaatttatgaaataaaggaattggaacaggttggggactctcaatatatgatgcatattagcatagactttctaggtgtttggcattagtacgtttaaaaactctcaggtgatttcattttgcagctagggctgagaaccagtggcttatataagctctaagtgctaacattttgtgattcagcatacagatcctatttgacccatgtcattctttacttctagggaaccaagtttggtcttaggccttagggccctctctactgactcctgaaaagtaacgaagaaaagactstatagagtacagtcatccctccctatgttcagggtgaggagtggtggttacaagaccgccaccctcaggatacccaaccggaggatcctcaagtcctttacataaaatggcatagtatttgcatagcatggttgtactatggttttcttcttgaatatttccatccatggttggtgaatcttcaaatgcaaaaccatcagtccaagtttcaattatgaggcattaacataagtgtggttacaagcatggagtctgggaggcctataaatactacaaacgaatcaaataactaacaatagg

SEQ ID NO: 193413 - DNA, 601 bp, Human
cccaggctttgcaggacctcagcatccttaggtgggaaggagagatgctaccttcagaatccttcttcctctgaggcttgctcagtgagtcaggatgtcatttcctcattgatttaacagcaactgaagaactgcagtgacacaggcagtatactaagttctgagaaatctagtgctgaccaggtcctgtgcttaggaactgaagttttcatcaagaagacgaggcatgcaagcattccatatgatgatgcagctcagttttgggatatcattaaacacaggaaagattcaaatataagcaaaaaaaaaaaaagtggtgccttggacagaacgtttatgtgtccctccccctgcccaatgttgaaatcctaacctccaagatgatgttaggaagtggaagactttgagaagtgattaggtcatgaagcctctctcctcatgaatgggattagtggtcttacaaaagagaccccagggagctcccttgccccttctgccatttgaaaaagcagcaaagactgccatctatgacttaggaagcaggccctcacagacaccgaatcttccggcaccttgatcttgggaatgccagcctctcgaa

SEQ ID NO: 193414 - DNA, 601 bp, Human
ctccatcttcaccagatcaaaacttaccctgaaggggcaggctcccaaccaagatggtagttccattagcaaaattataatgaatggaactctaaatcataaagccatgtggtaacccagaaaatgcactcgggaacatttcaaagaagggagttttgtggcaataccaggaaaagcataatttcaaagcaagtttccttcttggtcctgcttttctcatgacctgtaggtggagagggaggagtagatagaatgcctgggaaaccagagctgcagaatgtggaggcggcctggccacaawgctgccaactcctttcctgagcaaagctgcagaggataatggcccagggattgtcagggaaagacaggtgaggcaaggaggcaatgaggaatcctctctactttcccgaaaagaaaatagatctccagtttctcagagaaatatcctataagaagactacagaggatgtctgggtttctatcattgtgacttcctttcctagaattctgagcttctgaactatcacctcatatgccatctcttcttctcctagctagagtcgagttgcaaaaacccactgcaatatcctttgaagcaaca

SEQ ID NO: 193415 - DNA, 601 bp, Human
acccactatgagtcttatttctttcttccatgaggtgggcaggtgtattgtaatgagctctgttttccaattcaaacccaccaacacttttcatatataccttaccaggtggacatctcaaggctaatgtcacagttagtcaaccccaagtgcaagatatataatggcctgggacgaaagtcttaatcaaggtgccagttcaaccagactttgaattcaaataatgaacccagctgcataaagcttgctgctcttcagccctaacaggtgtctgcataatcacaaagaaaaccagcttcaractgaatgtaattgctgagcatgaaaaagacaacaggcaggccagcagtttcagtgaaaataacaagagtcaggaccaaggaacctccatcttcaccagatcaaaacttaccctgaaggggcaggctcccaaccaagatggtagttccattagcaaaattataatgaatggaactctaaatcataaagccatgtggtaacccagaaaatgcactcgggaacatttcaaagaagggagttttgtggcaataccaggaaaagcataatttcaaagcaagtttccttcttggtcctgcttttc

SEQ ID NO: 193416 - DNA, 601 bp, Human
atttttaaaagacagattgtggctaagttttttaaattaagaaattactgtttttcttgaaatatagacattaaaggagaaacagtccaaaataatacagcaaaactataacttggaacacagtaacacaaatccagcaagagttaataaatcttaattatatactgccttacacaaaagaaggcaaggattttctcagtatttctatattccattcccaagcacatgatatacaaatactcaatgggtgtctagcaatataacttgactgtagatatttaaacgcatctacccaacattyatattgctccagacacagaacaggcagatagctcttgctaccagcattgggcaatgggccctaaaaggaggcagctgtggtgtagcagtaaggcataggcttatcgcaaatttcagtccttgctctgcctttcatagttgtatgacctaacacccactatgagtcttatttctttcttccatgaggtgggcaggtgtattgtaatgagctctgttttccaattcaaacccaccaacacttttcatatataccttaccaggtggacatctcaaggctaatgtcacagttagtcaaccccaa

SEQ ID NO: 193417 - DNA, 601 bp, Human
caagggtatttaacactaagatgacttgttggtctcagctgtaaatataaggaccagacatgactaaatctgaaatcaatggcaaaggttattcctcattaacctaacgttaagaaacctaaaccagtcaaaatagaaatgggcccttttccatattggctgcaccacccactccctctaggtttctggggcaaagacataaatgaatataaagatgctccttctttcagcattcccatagaaactgccccctgcatcagtgggtgctctgataagaaagaggtaaagtttgaaggtgttmggcaaagtaaatactaagtataagaagggatggccattaggagttgggttggggaataagtaaagacatgaagttctaagtatttatcaaacaactacatatcaaattaaactggagtaacaatatttttggaatttaatatcaaatgaagagatatttgtattagccaaaaatactgatttattttctttcccaacattttcatatatatgcagaaattccctcagagcctgactatactgatgccataagcacattagtcaccaatggaattaatttcgttttgatgaattatttctg

SEQ ID NO: 193418 - DNA, 601 bp, Human
ttgtgtccagttgaatgaatctaagaacaaataaagaatatacaacagagaagctaataaaaatatatttgttaaatttgtgatattccatttaatatacatgtcaaaccttctagaacttcatatcaaacatatcattaagccattttcttatatctgacatacagatatcttggaatacatacacctgtcctccatgagtattagcaccataaatatacatcaagaataataaagctgaaaggaatttcggaaatcattgatagtaaccctttcatgctgaaaataaggaaactaagcygaagagaagaaaaatgacttccccaaggtcaccaggactctgactcctagtccagtattttttctatcacatcattttaccttagactgaatcaaaaacctcttttatttatatcttccttttaaaaaggttgggtttcaaaccaagcaaaagaataaatacagagaactgtagcatacacagaagacttatttaatgctgctatcaataactttaaaagtaagagaaaagaagaaaaacaaatgaggtaatcaagagttgacagaaagaaccttttccattaaacccaatcgatactgt

SEQ ID NO: 193419 - DNA, 601 bp, Human
aaaggaagatgaactacacatgtaatttttggtgttctgtatctcctctaacccacgacctttttaagataaaggcctttgtttttttctctattgacccatacttcagttctagacagattataagtagacaatggatgtctgtcaaataattgaagatgtaaatgaatgtacagtggtgttggagtcagtgggttcaaatatgaaggtaaatgacctttaaagttttctacaatatgaagactctgtgattacaatgttaatggggtataggtttgctttttaattctacctatatgcrggatagagcagaatcaaaaactttcacccaacaaactcaaatttcccaaaggttcatagtgtatgtgaagatggctctatttatgagtattcatagaacattgctgaggtctttcactctccctctccaccaggagtaataatttgcattcaccttgttttgttaggcctatgtcattggtaaggtgactcatccaacaaatatattttatgtgacatctacgtgtcaagcaatatgctaggctttgttctttaccgtgttctacgtaagggactaacctcaagaaatgactttattagc

SEQ ID NO: 193420 - DNA, 601 bp, Human
aggttggaacaacaagccccttaattatggcagaagggatgaagaaaaggttatatgaaacagaagctgatagctatgtgatgaccatgaccatgctaattcatcttactgtcccttatagttcccagaaagtcctcagttagtacctgatgaataaacaatagagtaaaacgttacagagatacagtcaacgaggcgtgtgactgatatgaagagatgagtcaaagataagtggggtccccaacgtggcaaacaagatggtcagtatcagaaaactaccaatatttgctaagtgtctacwaggtatcattagtagtgctgttgactaaaggggaaactcaagacacaaagcagattgggttctggaggaagataatacattcaaattaaggcaaattgcatttgcgttcccagtggaacaactaccaggaggtatctagcacgtagttgaaaatttggatgaggagctcagatgttaatctgtggctcaaaaatatagaggagacaagtgaagtcaataaaaatgagtttatccaaggagaaaccatagccgagcaaagagaaaagcatgagccgaaggaggacaaaaagatgcaccgct

SEQ ID NO: 193421 - DNA, 601 bp, Human
tgactcatagtcgctgacttagttcacttagtttatgaaaaacattcaaatgtccatgggttttccttccttagaacatacaaaatggctgcttagattctagcacactatgtgaaaaatatcaaaatggagggatgtgggaaagcccttttgtgtcatatatttctgagtttcagtaactgctgagacatgcagccatacagtttcccatctctattcatttatttgttgatgtgtttaccgcctacacttactgcctattgaaattcttctcatcttctccggcctggctcaaatgccrtactcagagtgtgggggctgtggatacagctaagagagaggatggagagattggaagagataagatctcaccaaagtacagtcattttaaagccatttaaaggtgctcttgtaaggaactgggaacctttgcaaaggtttctataggaaagtaatgtgacattaaatatgttttgaaaaattatgtgtgaagaataatcagggattcaagaaaagggaggttgaaacaccaggtaggagattctacaacatttcaggttggaacaacaagccccttaattatggcagaagggatgaagaa

SEQ ID NO: 193422 - DNA, 601 bp, Human
cctgtagtcccagatacttgggaggttgaggcaggaggatcacttgagccctggaggtcaaggctgaagtgagctgcgatcggactgttgttgcacaccagcctgggcgacaaagcaagaccctatctaaaaaaataacaataatacataaaacataagtgtctataaaaataagcaaagacaaagacaatccaaatcgttataatacaatgtaatatcagctacagtaaatgagtcattatattgaaggtatcataatttatattgcattttatttaaaatttctgaagttatagaggtygacatatgttaggtgctttttatttattttttgtctacagaaatataattatttgctagatattttctcagatgttgtagagatcacaattagaaatcatatatgtatcatgccctaaaagaattcagactattaagaaagatatataacttataatcacataaattcaatacagtaatacatggaataaaagttgaagatagaatatagaaggtaaaattaaaatttaaaaattaatgtcattttcttaaaattaaagtcatcataaattatattttaaaaacatttcacatttttgaa

SEQ ID NO: 193423 - DNA, 601 bp, Human
cactcttagttattttatataattgaacatacataaggccggaggggtgtctcacacctgaatcccaacactctgggaggtcaaggtaggaggattgctagagaccaagagttcaagaccagtataggcaacataaagacacccccatctgtacagaaaattaaaccaaatagccaggcatggtggcatgtgcctgtagtcccagatacttgggaggttgaggcaggaggatcacttgagccctggaggtcaaggctgaagtgagctgcgatcggactgttgttgcacaccagcctgggcracaaagcaagaccctatctaaaaaaataacaataatacataaaacataagtgtctataaaaataagcaaagacaaagacaatccaaatcgttataatacaatgtaatatcagctacagtaaatgagtcattatattgaaggtatcataatttatattgcattttatttaaaatttctgaagttatagaggttgacatatgttaggtgctttttatttattttttgtctacagaaatataattatttgctagatattttctcagatgttgtagagatcacaattagaaatcatatatgtat

SEQ ID NO: 193424 - DNA, 601 bp, Human
agtaatttatataatatttatttttctatttttccttctacatacaaggcaatgcatgaatagaaacagagacgtgtctgaagaacacaaattgaaaatgatgaattgagtaggtgaagaaatcaaactatttctgacctacctaataaaaaggcaattgggagaggtaacctctggtaatataaagaacactggaattagagtcaaaagctggggaggcaaaaaagaaactaaaattcattgaacacttacaatgtttcaggtacagggctagtgcctttatatactttattgttaaaartgtcaaaccttcgataaggttgacattcacctgtctgttgctcccttacctagaatatgaatatctctatacattgtacaatataaataacagtaatatgaacaaaaaaaggggcaattgctagcatggctgtgcactgtatttgagaaagaatatagagaaataaccatggtattcctgtctcactgcactgcaaatcctgggatcgtaatcagatcccgttactatcagtgaatcacaatgttccctggcatgcctgcatctgggaacaccctactgaggagctggttaatattctat

SEQ ID NO: 193425 - DNA, 601 bp, Human
aactctcttcttgatagctcattcactcatacatttatatctatgttggtgtgtaattatacatgtgtatgcacacatacacacactgtatgctagctgcagcttatcttgggaacaaatcttaaatatggcttgcagaaattattaagtctcatttcattatttgatttcccctacacaaatttcatctgtcataagttctggctgatttatgactcaggaatgcaatacttataaacctcaccatccaaaacagcattcaaattccatcaaaaattacttttctcactttaaaaaaaaktattataatttaaagttctgtctcccagctggaatccagaagaataaatatgagtatgaaagttaaaggaaggctctgataaaataattagagtaatttatataatatttatttttctatttttccttctacatacaaggcaatgcatgaatagaaacagagacgtgtctgaagaacacaaattgaaaatgatgaattgagtaggtgaagaaatcaaactatttctgacctacctaataaaaaggcaattgggagaggtaacctctggtaatataaagaacactggaattagagtcaaaa

SEQ ID NO: 193426 - DNA, 601 bp, Human
ccacagttccacgctgacttcaatacatactgctatgctagtttttcatggtcttgaactctcttcttgatagctcattcactcatacatttatatctatgttggtgtgtaattatacatgtgtatgcacacatacacacactgtatgctagctgcagcttatcttgggaacaaatcttaaatatggcttgcagaaattattaagtctcatttcattatttgatttcccctacacaaatttcatctgtcataagttctggctgatttatgactcaggaatgcaatacttataaacctcacyatccaaaacagcattcaaattccatcaaaaattacttttctcactttaaaaaaaagtattataatttaaagttctgtctcccagctggaatccagaagaataaatatgagtatgaaagttaaaggaaggctctgataaaataattagagtaatttatataatatttatttttctatttttccttctacatacaaggcaatgcatgaatagaaacagagacgtgtctgaagaacacaaattgaaaatgatgaattgagtaggtgaagaaatcaaactatttctgacctacctaataaaaag

SEQ ID NO: 193427 - DNA, 601 bp, Human
tgtagattttttctaatttaaatgaaattttaacatatatatgttgtttgttccacagcacacacttttaaggtaggtagtattcaaactcagccctaatatttgtagggcttaaagcaagagaacaaatggagactcccatatcatatgtttaatatttaaatttataaatcaaggtaactgtcaaatattggatatttagttctgctacttgaaaattatgttttcctaattcaaacagatctcctgggctcctcagatctgatctttcacaaaacaaagcaggactgagagaattcaccccccccagctcatagttcagacctcttctcttcccactctgggctccagccaactgacactgccagggacccatagggattcacatataaaccatatgtccaagcaacatccacctccgtctaacagccttggtgaaccttcaggccaggggcgaatactctctgccatgcaatttgcccttggaagtacagccaaggaagacgagcacacagctcctggaagcaacctcagtaatgtctgggtaggaacttctgggatgccagagtgtggtacagaatagggaagcccaggctccagg

SEQ ID NO: 193428 - DNA, 601 bp, Human
ttatatataaaaataataatatgttacaacatatcctaaatttatgtagattttttctaatttaaatgaaattttaacatatatatgttgtttgttccacagcacacacttttaaggtaggtagtattcaaactcagccctaatatttgtagggcttaaagcaagagaacaaatggagactcccatatcatatgtttaatatttaaatttataaatcaaggtaactgtcaaatattggatatttagttctgctacttgaaaattatgttttcctaattcaaacagatctcctgggctcctsagatctgatctttcacaaaacaaagcaggactgagagaattcaccccccccagctcatagttcagacctcttctcttcccactctgggctccagccaactgacactgccagggacccatagggattcacatataaaccatatgtccaagcaacatccacctccgtctaacagccttggtgaaccttcaggccaggggcgaatactctctgccatgcaatttgcccttggaagtacagccaaggaagacgagcacacagctcctggaagcaacctcagtaatgtctgggtaggaacttctg

SEQ ID NO: 193429 - DNA, 601 bp, Human
tgttagtgttagtgttgagtgtaaatgccagattagaaaaagatgaggtagaagtgagaggtaaagaaaagccaacagtgaatatacagaatttgttaaaaggttaaaaatcaaaaagaagaaatgtaggcactctttcagtcctgaaaaaggattggggactattgatatttcataaagatttaagcatattaaattgaaaacagcaagaagctagagaagaggggatgaaaggtgatgtatcttccctaagaaggtgagagaggatgagatttagaacacaggagattggtcttagctsgaagaaataacatcttcattctaacagaaggaaagaaggatagaacagatgttaatttgcttattcagatgcaaaagtgttgaggagctcccaaatgtgatgacttctctttataacaggtaattctcactcaagatttttaatacatatatgaaaattcttaaagagaaaaaaatacttatacacatacacacgcacatatacaatctctctaagactacactgaatatctgctgaggatgacttttttcctgagccaccacaggtttcccactttcaggctccgggggtgacattcac

SEQ ID NO: 193430 - DNA, 601 bp, Human
ttagatttggtaaattagacatcattagtaatggtggcaagaacaggattgttagtgttagtgttgagtgtaaatgccagattagaaaaagatgaggtagaagtgagaggtaaagaaaagccaacagtgaatatacagaatttgttaaaaggttaaaaatcaaaaagaagaaatgtaggcactctttcagtcctgaaaaaggattggggactattgatatttcataaagatttaagcatattaaattgaaaacagcaagaagctagagaagaggggatgaaaggtgatgtatcttccctamgaaggtgagagaggatgagatttagaacacaggagattggtcttagctggaagaaataacatcttcattctaacagaaggaaagaaggatagaacagatgttaatttgcttattcagatgcaaaagtgttgaggagctcccaaatgtgatgacttctctttataacaggtaattctcactcaagatttttaatacatatatgaaaattcttaaagagaaaaaaatacttatacacatacacacgcacatatacaatctctctaagactacactgaatatctgctgaggatgacttttttc

SEQ ID NO: 193431 - DNA, 601 bp, Human
aaaacaggaattaaccagcaatgttgagtgctatcaagaagtcacataaatgagggctgaaaagtatccattagatttggtaaattagacatcattagtaatggtggcaagaacaggattgttagtgttagtgttgagtgtaaatgccagattagaaaaagatgaggtagaagtgagaggtaaagaaaagccaacagtgaatatacagaatttgttaaaaggttaaaaatcaaaaagaagaaatgtaggcactctttcagtcctgaaaaaggattggggactattgatatttcataaagayttaagcatattaaattgaaaacagcaagaagctagagaagaggggatgaaaggtgatgtatcttccctaagaaggtgagagaggatgagatttagaacacaggagattggtcttagctggaagaaataacatcttcattctaacagaaggaaagaaggatagaacagatgttaatttgcttattcagatgcaaaagtgttgaggagctcccaaatgtgatgacttctctttataacaggtaattctcactcaagatttttaatacatatatgaaaattcttaaagagaaaaaaatactta

SEQ ID NO: 193432 - DNA, 601 bp, Human
ctgtttcaaaaacaggaattaaccagcaatgttgagtgctatcaagaagtcacataaatgagggctgaaaagtatccattagatttggtaaattagacatcattagtaatggtggcaagaacaggattgttagtgttagtgttgagtgtaaatgccagattagaaaaagatgaggtagaagtgagaggtaaagaaaagccaacagtgaatatacagaatttgttaaaaggttaaaaatcaaaaagaagaaatgtaggcactctttcagtcctgaaaaaggattggggactattgatatttyataaagatttaagcatattaaattgaaaacagcaagaagctagagaagaggggatgaaaggtgatgtatcttccctaagaaggtgagagaggatgagatttagaacacaggagattggtcttagctggaagaaataacatcttcattctaacagaaggaaagaaggatagaacagatgttaatttgcttattcagatgcaaaagtgttgaggagctcccaaatgtgatgacttctctttataacaggtaattctcactcaagatttttaatacatatatgaaaattcttaaagagaaaaa

SEQ ID NO: 193433 - DNA, 601 bp, Human
ctccttgtgagctttattgactactgagctcagcatgcctctgtgagatattatggagccaatggggaggctgcacatgctataataaagtccattgtatccttgctgttgtgtgtaccctttataatattcatgtgctggtgtgacagtaaatcagagggggaaaaggcagtcaaggtggtcttaaataaaacaagttattctcataagtctttgaacccagataaacctttgaggtcagaactcccttaaaatgacatggttccaaggattctgatttaaaaaaaaaaaaatctgattaaaaaaaaaaaacctattgctataagtaatagagaagaccacactaataattggaaaagaaagaaaggacattattcttggacaaaggtagatgaaatcaaaggctaaatttgtgcaaaggtgtttaggttttatggctatatatttgaggttctacaccattggcaaagtgggtacatgcttgtttaaacatgataaccacattatttgaggagggaaatattagaagaggaacagatttagaaagaaacctacaaattaggtttaggatattttcagttggaggcaccaagtggaagtc

SEQ ID NO: 193434 - DNA, 601 bp, Human
aatgaacatacttctctccttgtgagctttattgactactgagctcagcatgcctctgtgagatattatggagccaatggggaggctgcacatgctataataaagtccattgtatccttgctgttgtgtgtaccctttataatattcatgtgctggtgtgacagtaaatcagagggggaaaaggcagtcaaggtggtcttaaataaaacaagttattctcataagtctttgaacccagataaacctttgaggtcagaactcccttaaaatgacatggttccaaggattctgatttaaaaacaaaaaaatctgattaaaaaaaaaaaacctattgctataagtaatagagaagaccacactaataattggaaaagaaagaaaggacattattcttggacaaaggtagatgaaatcaaaggctaaatttgtgcaaaggtgtttaggttttatggctatatatttgaggttctacaccattggcaaagtgggtacatgcttgtttaaacatgataaccacattatttgaggagggaaatattagaagaggaacagatttagaaagaaacctacaaattaggtttaggatattttcagttggagg

SEQ ID NO: 193435 - DNA, 601 bp, Human
tctaatctgtattttaaaagctcagtagagactgataacgagagaacagataggaggatgagcagggagacaagtgagaaagtaacaacacggccagtcaagagatgccagtgactagtttgtgaagatgtaaaattgtcttgacttagttattaattgcatgtgggcagaaagggaaatgtgtgggagcacagtaaaaatagaaagtggaagtatgtaatcatggcacagacagaatttccttagaagacagcaaagtagatccttcactgatctatttcccccaaactaacatatacamcccagcatggcatggaagacaaaacccagagtttatacttttctgagctaatgaacatacttctctccttgtgagctttattgactactgagctcagcatgcctctgtgagatattatggagccaatggggaggctgcacatgctataataaagtccattgtatccttgctgttgtgtgtaccctttataatattcatgtgctggtgtgacagtaaatcagagggggaaaaggcagtcaaggtggtcttaaataaaacaagttattctcataagtctttgaacccagataaacctttgag

SEQ ID NO: 193436 - DNA, 601 bp, Human
agtgtttatgtacagaaattctaatttctgatagcaagatagtaaggcaaaatcagaaaaacctgcccctgattgtccaataaaaagtagagtacaacttgttagatttcatagcacattgttgacaatagtcacctcatttcaccagaatggctttctctcccttggatctaatagcaagggaaagaatgctgagtttcatgcctaggccagtactatccaacagtaatataatgcaaaccccacgtaagtattttaaaacatttctagtactcatttttaaacaagcacaatatacagktgaaagtgtatattctatttatatagagtatatatttatatacagtattctatttatatatagtatatatttaatgacttgttctatttaacataatgtatcccaaattagtagtgaatatagaaattattgcaatatcatacattcattttcttcatgctaagtcttcaaaacacactgtgtattttgcaatcacagtatatctcagttcaactagccactttcaagtgctcaaaagccacatgttgctagtggctaccatattatacagcacagacctaggtggttggacatcttgac

SEQ ID NO: 193437 - DNA, 601 bp, Human
aattagacgagatccctttcttctgactctttctttctctctctttctttctttctttctttctttctttctttctttctttctttctttctttctttctgtctttctttctttcttctttctttccttctttctctgtttttttttctcagtgtctcactctgtcggccaggctggagtgtagtggtgagatcacagctcactgcagcttcgaactcctgagctcaggagattctcccgccttagcctcctgagtagctgggactacaggcgtgtgctatcatgcctagctaatttttgyatttttgtagagacagggtttttgccatgttgcccaggctggtcttgaactcctgggctcatgccatccacccacctcagcctcccaaagtgctgggattacaggtgtgagccactgtgcctggtctcctctaactattaaaatagctttcccaaaaatgcaaagatatagacacaactacttttgtaactggaaatttaaataggtaaaccttagattattcataaacataattttagtaaacttaaatttaagatttccaaaagtaacggaacagggattcattttcgtcattttagc

SEQ ID NO: 193438 - DNA, 601 bp, Human
ccagacactatgcaaggagcttgggatacaataggcagcttattagtttatgttcccaaattttaaatcttaaaggaaaaataatttttaaatagttcattctattgctttaaggagaataatatatctgaacagatgttttccctagagaattgaaaaccaccagtgaggaaagctgttcttattaccactccttacaagagaaaaatagaaccctagtgcaggaaaaaatgtcttttctggtattacgcattgatcaaaattagacgagatccctttcttctgactctttctttctctytctttctttctttctttctttctttctttctttctttctttctttctttctttctttctgtctttctttctttcttctttctttccttctttctctgtttttttttctcagtgtctcactctgtcggccaggctggagtgtagtggtgagatcacagctcactgcagcttcgaactcctgagctcaggagattctcccgccttagcctcctgagtagctgggactacaggcgtgtgctatcatgcctagctaatttttgcatttttgtagagacagggtttttgccatgttgcccaggct

SEQ ID NO: 193439 - DNA, 601 bp, Human
tccttttagttttccttggcagatagaaaatttttctagatcaccatctctcagaaggagcactgtctctgtacaggcccctgcctgcctcacacgggtctgacacccagtctcctgtgcccacataaaggttaagcctgatgctcacctgttgatgcctatgccattctagtaatcgccacctgaagtacagaaactcagttcctgctcatctcgataaatataaattccctcttcttttctggcacatagagatttcccctttttggttttgagcgcaactatgcattttaatttttgytgttatattttctccagcagattcacctattttaagtgggaggcagagtcatttcgtaacagctcagattacaatagtcaaagtcttattttagcgtcaatgtttattatgcctctaacaagtagaacattatggggggtaacattaaaactataatattcaaaattatcattgtggttagaactgtgcaattaggacataaaaacactctgaatgactgagtcacgaacacatctgcctgatcccttccaagtgtcaggtatttagtaggtgagagtctcccagggccagacactatgc

SEQ ID NO: 193440 - DNA, 601 bp, Human
cctgaccgctatataatcattttcttcaaaattcaccttttttcctatactgcccttttcctgtcttgtgatttctgcttcatttaattaataaacttttaaaacattatttttaaaatttattttagattcatcttaatatctacaacttgggggtatgaattattcaacttgttgagctttactcttctttttgatggtttatatccttgtatggtttcaattatcagactgagattttcctcagagaaagttgttttgtgtttccctggactgtgaaacacatggaaagcttttgtaytggcctcttgtagtatttcacggatttccccagctagagagaagttcttacgttaacttctcagactggaattccaacttaacaaggagagtttgatattgaacctcacccaggaagtggtccccgtttgggtttctaattcctcatagacaacactttccacccattgccctaggtggacacatcaagttccttttagttttccttggcagatagaaaatttttctagatcaccatctctcagaaggagcactgtctctgtacaggcccctgcctgcctcacacgggtctgacacccag

SEQ ID NO: 193441 - DNA, 601 bp, Human
ctattgtcactgctatataattattaatttaattttatttatttatttatttatttttatttttatttttttgagactgagtttcactcttgttgcccaggctagagtgcaatggcgtgatcttggctgaccgcaacctctgcctcccaggttcaaacaattctcctgcctcagcctcccgagtagctgggattacaggcatgtgtcaccacgcccggctaattttgtatttttagtagagacggggttgctccatgttggtcaggctggtctcaaactcccggcctcaggtgatctgccygccttggcctcccaaagtgctgggattacaggcgtgagccaccgcgcctgaccgctatataatcattttcttcaaaattcaccttttttcctatactgcccttttcctgtcttgtgatttctgcttcatttaattaataaacttttaaaacattatttttaaaatttattttagattcatcttaatatctacaacttgggggtatgaattattcaacttgttgagctttactcttctttttgatggtttatatccttgtatggtttcaattatcagactgagattttcctcagagaaagt

SEQ ID NO: 193442 - DNA, 601 bp, Human
tgtctgctttcatctccaattcaatcattttctcttctattatttagagcttatttttgaacacacacataaactttctttcttactattgtcactgctatataattattaatttaattttatttatttatttatttatttttatttttatttttttgagactgagtttcactcttgttgcccaggctagagtgcaatggcgtgatcttggctgaccgcaacctctgcctcccaggttcaaacaattctcctgcctcagcctcccgagtagctgggattacaggcatgtgtcaccacgccyggctaattttgtatttttagtagagacggggttgctccatgttggtcaggctggtctcaaactcccggcctcaggtgatctgcctgccttggcctcccaaagtgctgggattacaggcgtgagccaccgcgcctgaccgctatataatcattttcttcaaaattcaccttttttcctatactgcccttttcctgtcttgtgatttctgcttcatttaattaataaacttttaaaacattatttttaaaatttattttagattcatcttaatatctacaacttgggggtatgaattattca

SEQ ID NO: 193443 - DNA, 601 bp, Human
ttgatttgtctgctttcatctccaattcaatcattttctcttctattatttagagcttatttttgaacacacacataaactttctttcttactattgtcactgctatataattattaatttaattttatttatttatttatttatttttatttttatttttttgagactgagtttcactcttgttgcccaggctagagtgcaatggcgtgatcttggctgaccgcaacctctgcctcccaggttcaaacaattctcctgcctcagcctcccgagtagctgggattacaggcatgtgtcacyacgcccggctaattttgtatttttagtagagacggggttgctccatgttggtcaggctggtctcaaactcccggcctcaggtgatctgcctgccttggcctcccaaagtgctgggattacaggcgtgagccaccgcgcctgaccgctatataatcattttcttcaaaattcaccttttttcctatactgcccttttcctgtcttgtgatttctgcttcatttaattaataaacttttaaaacattatttttaaaatttattttagattcatcttaatatctacaacttgggggtatgaat

SEQ ID NO: 193444 - DNA, 601 bp, Human
acatgatgggaaaagcccatatgaattttggggttctgcaaattctctatcttaatctctttgattatagatgatctgacattgtatcttttcttctttcccaggactccattgaaatgcatgttggagcttctttatatatatttcctatctcttaaaatctcactcagtgttttccatctattaatctctcagaagaattgatttgtctgctttcatctccaattcaatcattttctcttctattatttagagcttatttttgaacacacacataaactttctttcttactattgtcaytgctatataattattaatttaattttatttatttatttatttatttttatttttatttttttgagactgagtttcactcttgttgcccaggctagagtgcaatggcgtgatcttggctgaccgcaacctctgcctcccaggttcaaacaattctcctgcctcagcctcccgagtagctgggattacaggcatgtgtcaccacgcccggctaattttgtatttttagtagagacggggttgctccatgttggtcaggctggtctcaaactcccggcctcaggtgatctgcctgccttggcc

SEQ ID NO: 193445 - DNA, 601 bp, Human
tattttagttctggtttctttttaaacccaagaaatgctcgtcataagatttttttcgtttattatgatagatttacaaacatgtttaccatcttttttgctcatcattataacccctctttccccccagactcaaccccctctttgtgaaccaataaggaaccaatctattaaagtgtaaaaatgtctcagtgtttggcattacatttgtttatttatttctctctctttcttattgtaattaactggacacataacatcaaaaagatgcttattttccctcagcattctggaaaaaaawttcatcatcttctagcaactattattgctgacaggtctgcaatctatctttcatttgtagttaatctgtcttttctctctgacttcttttaaaatattgtatcttcatcataatgtgattttataacattactataatattcccaggtgtggattgttttaagaatccacatgatgggaaaagcccatatgaattttggggttctgcaaattctctatcttaatctctttgattatagatgatctgacattgtatcttttcttctttcccaggactccattgaaatgcatgttggagctt

SEQ ID NO: 193446 - DNA, 601 bp, Human
atccacatattcctattactggctagtattttagttctggtttctttttaaacccaagaaatgctcgtcataagatttttttcgtttattatgatagatttacaaacatgtttaccatcttttttgctcatcattataacccctctttccccccagactcaaccccctctttgtgaaccaataaggaaccaatctattaaagtgtaaaaatgtctcagtgtttggcattacatttgtttatttatttctctctctttcttattgtaattaactggacacataacatcaaaaagatgcttaytttccctcagcattctggaaaaaaaattcatcatcttctagcaactattattgctgacaggtctgcaatctatctttcatttgtagttaatctgtcttttctctctgacttcttttaaaatattgtatcttcatcataatgtgattttataacattactataatattcccaggtgtggattgttttaagaatccacatgatgggaaaagcccatatgaattttggggttctgcaaattctctatcttaatctctttgattatagatgatctgacattgtatcttttcttctttcccagga

SEQ ID NO: 193447 - DNA, 601 bp, Human
ctcattcaacattgtattaacaccaaatatttggattttgaatcttcatctgatttgaaattcccataatagatggctataatcattttgctttaactttaattttctgatttagctgtttttatttctatcatcttcgtttgtggtttttatttattatgcatttctttgcttcattattttatccttatgttccttcaattagattgatttagtctcccttatactctctccaatttttccctttatcttgaattggaaattacagttctgtctctattattttagtagtaatccttayatatctaacataaaggtgtagtttaacaaaatccaagtctaactgttaattactaagcttttatcaaataatgcaaacggctaaaaactcaaatccacatattcctattactggctagtattttagttctggtttctttttaaacccaagaaatgctcgtcataagatttttttcgtttattatgatagatttacaaacatgtttaccatcttttttgctcatcattataacccctctttccccccagactcaaccccctctttgtgaaccaataaggaaccaatctattaaagtgtaaa

SEQ ID NO: 193448 - DNA, 601 bp, Human
aaatatttcaaacatgcagaaaacagaaaactaataataacctttttaacagtgcttaccatgagccagggactcaaatgatttctatgtctagtacttactcattccatctttgcattagctctatgaagttagtattttttttctcattttatagatgttaatactaaggtgcaagtgaagtgactgcccaatggctcacccaaatttcataagcagaagggctgtaaagatttgagcgcaggcagcctggctccagaacccatagaacagattatcattctcactgcctctcaaccakgtactcatcacccatatttaacaaatactagcattttccataattgcttcaaatcgttttatagaatcaaaccattacagtcatctctttaattccattccattactttgctaacgagatgcagacatatttctgaatttgggaggtagccttcctattcatatttttgtgcctgtactccctctgtaaatatccacaaaaagtacctactgccctttgtgtgttgtgcattttaacataaaaatatgccatgtatattatcaagcaatttgattatctcattcaacattgtattaacac

SEQ ID NO: 193449 - DNA, 601 bp, Human
tgaaccagtgttttcagacaaagtgccaggacaatactttcaagggtggctgatctgactgtagacatgatcaaaagcctacttctctcatggccgactccaagaagcatatttcaggattcaatacagcaaggattgatctacccctagctaaggaatctctcaaacttatggagacggtcagcttgactttaacacctataacctattttaaaaattgaaaacagtttcccatttacatgtgacacattgtattaagaaaaggcatgatttgtcaacaaataatttttaaagggcacaygtttgggagaacaattaacattaaaatgtatgttgcattttgtttaggtgttacagaatcaaaaatacaaaaacattgggttttttatttgatgcttcaaaatcttgcactttgttttataaaaactggtttaattttagaatctctgtgttttctttctagtgaccacataagatgaaaaaattgaaactcttcccaagtgtgtatccacacataatccattctttccatggatcacctgtgtagtcataaatgggaaaacaaattagatacaatggtcataagattttcttctttaac

SEQ ID NO: 193450 - DNA, 601 bp, Human
accactgtaaatcaatgaagattattaaaatttcagttaaattataatctagacaaactatattaatacaattaatttattacttgatattacatcacacaaaagagcactgaaaatatttatcaaatgtggataacacatacactgtaaatatgtaaacatgggttgggtgctataacttagattcattttgggaggctcttagggacaagtgaaacacagatacagggaactgccactgtgactgataatgatggactgtgacatagaggctaagatctcatgaataaagaaatgaacyagtgttttcagacaaagtgccaggacaatactttcaagggtggctgatctgactgtagacatgatcaaaagcctacttctctcatggccgactccaagaagcatatttcaggattcaatacagcaaggattgatctacccctagctaaggaatctctcaaacttatggagacggtcagcttgactttaacacctataacctattttaaaaattgaaaacagtttcccatttacatgtgacacattgtattaagaaaaggcatgatttgtcaacaaataatttttaaagggcacacgtttg

SEQ ID NO: 193451 - DNA, 601 bp, Human
cttctgcttaaactctttaacagcttcccatttcatttacaagaaaacgtcagacccttagcatggccgggagtgctttgcaccatctggctcctgcccacagtttcatcatcatcttaattgactctctccctggctcactaagctctaggcacatgtgccctctttctattcagacctagggatttttgcacctgcatttccctctgcctggattgattttcttcctgaaataaattcaagtcactgcataaatacaatttcatagaggtcttgtctaggcctccaacctaaatctgcygccacgtttgtacagatattatctggcagcacactgttttttttttcacctcccttcattgcacgtagtcgaatttgtaactagatagctatttctctttgttgtttattatctatttcccactctagactgtagcatccctgagggtgaggccatgtaacttttatttattacagaatatctagttcttagcatagtgcccattaacatacaggaagcaaacattttttttttttttttcagtgacctagtttcttctctctgggcttcaggtttcatctataaaacgactgtattgga

SEQ ID NO: 193452 - DNA, 601 bp, Human
ttaactttcagacagaattaatgtagataggaaaatccacggttagttaaacagtagcaatgggcaaattctcctgaggttcattcacagaaaggaaatgccaagcagttaacaaatgccaggcactttatgtggattatctctgaattttcactgaaataatttaaggcaggtactatcattgggctttttttttacatctatattagggaactgaggcttacagaggtgaaatcactagtgctaaattacagagttaatccatgccagagccagggtggaaggtttttgctttacaccwcattgttaatcatcagttgtcttttgaagaactctaacatgctaatacatctctctacttctttaactgtgatcagcccacaaaccctgtggaaatctataaagccaggggccaggaataaaaagcaaacactaaactggagttgcagacatagcttttggcctcctgtcacaaaaaaaagtggcggggctgtagacacttctatgcacacagaaagtgttctgtaataaaagcatcctcatttggcatagaaaaatcttctcagtgagtctcttttctcacagacacatcttttggcac

SEQ ID NO: 193453 - DNA, 601 bp, Human
ttgtttagataactaagacccactgaactaaagcttgttctaagaaattaggaagacacattatagtgtgctctatgactaggaagccacgcttatatggtagatttaactttcagacagaattaatgtagataggaaaatccacggttagttaaacagtagcaatgggcaaattctcctgaggttcattcacagaaaggaaatgccaagcagttaacaaatgccaggcactttatgtggattatctctgaattttcactgaaataatttaaggcaggtactatcattgggctttttttttacatctatattagggaactgaggcttacagaggtgaaatcactagtgctaaattacagagttaatccatgccagagccagggtggaaggtttttgctttacaccacattgttaatcatcagttgtcttttgaagaactctaacatgctaatacatctctctacttctttaactgtgatcagcccacaaaccctgtggaaatctataaagccaggggccaggaataaaaagcaaacactaaactggagttgcagacatagcttttggcctcctgtcacaaaaaaaagtggcggggctgtag

SEQ ID NO: 193454 - DNA, 601 bp, Human
tgccaatggctgtcatgccccacatgcttcagaggccaatgcattaagcaatgggaaaatttggaaggattttaagtctggggctaaaattatgagggtagtattttacaaagtcaaaggatactgtggttatgggagccagttagggagctattccatataagaaggaccttagataggcagtggcaatggggatggaaaaagctgtcagccagaggactgactgtgcttggtgtgctaacgtttcagccaccttaagaatgaaagtctcatttcagttgtaaatccaaatcccaaatcygaatccgaatcaatcgtcatcttcctaagggagcactatttaaatgtagaatattaatgaaagtgtgggtgaagaaagcttaacgcaggcattcccatgaagccaaataccttcttgccttttaagaatctctgttcatggaggggagtttgacactggtcaacctcactgggttacaactccctggtctttctcaaatgatcacccagagaagtagacctggaatgaacatggctttccaggcagctcaaaaatgattgctggagaatgccgaccacaagacacttcaaacatgaagat

SEQ ID NO: 193455 - DNA, 601 bp, Human
ccttcatatatgtacatgtataatttatgccacgtgtatgtgccactctgtaaattttgtgtataatataacacaaaataggaattttaaaatgagatcaatgaaaaacacaaacaaaagttgtaattgccaggcatggtggtgcacacccgcagtcctagctgctggggaggctgaggtgggaggattgcttgatcccagaagttcaaggctgcagtgagctatgattgcatcactatactccagcctgggagacagagtgagaacctgtatctaaaaaaaagttgtaatagttttttttcatatgccaatggctgtcatgccccacatgcttcagaggccaatgcattaagcaatgggaaaatttggaaggattttaagtctggggctaaaattatgagggtagtattttacaaagtcaaaggatactgtggttatgggagccagttagggagctattccatataagaaggaccttagataggcagtggcaatggggatggaaaaagctgtcagccagaggactgactgtgcttggtgtgctaacgtttcagccaccttaagaatgaaagtctcatttcagttgtaaatccaaatccca

SEQ ID NO: 193456 - DNA, 601 bp, Human
tccttccaaaacatacagtatgcaaagggaaggagagagtaatattatggtggagaaacctaacaaacaaagcactacctcagtcaggcaatcaaggttaatatcatcaattataaaacatgctgatagtatgttctcttgagattatgtgatgagaatagcactttacctctgtgatcttcctccaaaaaacccacaaccccagtctattcatgagaaaaaaaaattagacaaatgcccgttaaataatgttctacaaaatacttgaccagtactcctcaaaatggattgttcatcacayaaagaagggataaatgcttgaggtgagagataacctatttgccttgatgtgattactatgcatcataggcctgtttcgaaatatcacttgtaccctacaaatatatacacccaccatgtacccatacaagttaaaagtaaaaaattaaaaaaaaaaaaactatcaatgtcattgaagaaaacgaatgtctaggaaaaagtcatagataaaaggagtctaaaaagacataacaactaaatgtaatggggtattctgaatgagatcctagagctgaaaaagaacattatgtaaaaatgaagg

SEQ ID NO: 193457 - DNA, 601 bp, Human
gcctacaccctataacaagtgtctgcagttgggacttttgcacatgtgacttgatcacattcacattatttgggaatatggggcaatgcctctatcaacacatctttttcaaagcagtcctacaaagcaaaagagatgtcaagaaaattgggaatgaggaagcagactaatgagcaaagaactgaactggaaattaggtattctaattaatagatatgtattatctttatgagttaaataaattccgttttttaaatttgtgaacctcaatgtcctcatcaataaaaatctggaagttaarctgaatggttgtttgttccttcatatgagtctctattcactttgagcacattagaatcctctgccttgaatggtgtcagaaatagaagaatggatttgtcttcaatgcatttcctccataggctcatctaatcccacaactatggacaagtcagggacacacttggctagctaacgtcactgcaaacaactctctcttttttttaaaattatacttttagttctagggtacatgagcacaacgtgcaagtttgttacatatgtatacatgtgccatgctggttggctgcacccattaact

SEQ ID NO: 193458 - DNA, 601 bp, Human
tgtttcagtaacatatctatgcttttttttttccatttagaggtagagctttaacacttttagcagtaaactaaatgcaaataaataaaagctaattatgattgggaaaatacagagacatgctaaaaagtgagttattttcctcctttgtgcatctggtgtctgactgcaagatttcaccaactttatagtcccattccagaattattgtttaggccaaaatgcctctgtaatttctaagtttctagtagccataaccaggtccataagacttctatctctgcaggatgtcagctctccmtcagaagttcctgggttttgaatttgtgatcaagttcagccagaaagaatagtttggagaagaaccacaggcaacagcaaaaacttccacggccatgagatgtcactggcaaatatgtggaaatgcaaatttcaccttcactaaatacttcatcagagaggagcctcagtgttccaaagttcatttctccagtacaaaaaaaaaaaaaaaaaaaaaaaatcaagtcatacatatttatctaagtatttcaaaccagaattgctcaacttttaaaaaccctctaaacacaaatactttcaa

SEQ ID NO: 193459 - DNA, 601 bp, Human
acaatgcaaaccaaaatcagccaatcaacaacttagcaaaaaatctgagaacaagaaaactgaaatgaaattctttataataagatcttttatttattgtaaattatattttaaatgtgtaatattaactgaacaaagaataacttagaaagggtggacaagggcattttcattcattagggattttaaatttttcctcaaatagttcttaataatttaaaagacgtttcactacaaaatatctagcttcctaaattactttatgcagtttggtagattatcagcctgatcacaaaattayatccatcagaatcacaacttgttgggacagatatcagtgagcatttattgtgtgctcaacactaaagatctagcagtgaagacagacaaacattaggaaacaatatggcaccatacataattttagaatgacatgaatttgccctcaggtatctgtatatgattatgcagaatttgaaagatatgacagctatcaatcttgcctctggagcttgtatttgacatttttctagactgcaaattcattttgtcataccgtgatgattgcatttaattttttaacttgtcaactctaaagtta

SEQ ID NO: 193460 - DNA, 601 bp, Human
caatttattaaatttatcttaataaaatattaagatagtttatcttaataaaatattagtttaaatttgggagttcagagaatttttaaaagtacttatttgacacaatgtgtgccctatggtgtgtgtgtgtgtatgtgggtttgtgtgtggtatgcagaatgacattatgctaagatatatatatgcatggaggaaggtacaaatgtacacgtgggtgtagatttacactagcagttcacccagcgtcagcagagcaagcgttgtcaattattttcctagaaagagtgaaggaaggatytgtcctagcttgaccccacacttgcacttctacccttctgtctctgccccatgataaatgtcatgcatttgcaagatagttggctgggtaaaggtagcattttgtagattgaatatggctaatcgtcttacttggggattgattctatcttcatcaatttataatttttcaattttttttaaagttagatggacgatgctgacagggatgttgatatatcatcaccatctccagccattagattttatagaaataaaacctgagaactagtaatatcttggagttagtgcagataagtga

SEQ ID NO: 193461 - DNA, 601 bp, Human
tttttgtttgcttgtttgtttgtttttagttttcgagacagagtctcactgtgtcacccaggctggaatacagtggcacaatctctgctcactgcaacctccacctcccctggttcaagcaattcacgtgcctcaggcttccgagtagctggaattacaggcatgcaccaccgtgcctggctaatttttcttgtatttttagtagagacgggttttcaccatgctggccatagctggtctagagctcccagtgtcaggtgatccacccacctctgcctcccaaagtgctgggattacaggygtcagccactgcaaccaactaaaaccaaaagtttgataacacattttgttgactagatgataaggaaacacaattttagagtaaatttgcataatggagagcaattaggtgacatctttcagaatgaagaaagcacatacccttgacccagcaattctacttctaggtaactatcctataaatacatttgcatatatgaaaaatgacttatataggaggatattctttataggattgtttgtattagcaaaatacctaataggaaattaagtatttaaattatccatttaaatatgtatt

SEQ ID NO: 193462 - DNA, 601 bp, Human
ttaaaatttacattttaaggtaacaaagaaccaagttttttgtttgcttgtttgtttgtttttagttttcgagacagagtctcactgtgtcacccaggctggaatacagtggcacaatctctgctcactgcaacctccacctcccctggttcaagcaattcacgtgcctcaggcttccgagtagctggaattacaggcatgcaccaccgtgcctggctaatttttcttgtatttttagtagagacgggttttcaccatgctggccatagctggtctagagctcccagtgtcaggtgatccrcccacctctgcctcccaaagtgctgggattacaggcgtcagccactgcaaccaactaaaaccaaaagtttgataacacattttgttgactagatgataaggaaacacaattttagagtaaatttgcataatggagagcaattaggtgacatctttcagaatgaagaaagcacatacccttgacccagcaattctacttctaggtaactatcctataaatacatttgcatatatgaaaaatgacttatataggaggatattctttataggattgtttgtattagcaaaatacctaatagga

SEQ ID NO: 193463 - DNA, 601 bp, Human
gacagcagatgacatttattaagaattactgtgttctaggtacttttaaggaatcaaaccatttaaactacacaacagccctatgatctaaatattattattattgtcatttaacaaatgaggaaatttaacagagaggggttaaataactaattcaagggcaaagaatctcaagtcagattacttggacccaaattctggttttagcatttatgtatttaactctctagatctttaaacacactttgagactatcacacagggatttgcaaactgatgatttcctgcctgctggtaacayatctttcagaacaaagggtatttagggaaatggaggctgtcaatcagtttttctgagcatacctttacttctatatcagaagtaaataaaagactatcaaaatcttagtgattcttggctcctctaatgttgtactatctgaatttgtataaatcagagaatgtttatgtgacttgcccacggccaaagcactagtcatcacacagagccaaaaacagatcaaagacaacctcagtcctcagctctttctaggaatacacttggttaaggagctccaataagatttttaaatactatgta

SEQ ID NO: 193464 - DNA, 601 bp, Human
cactgacttattcttcaatacccaccagtgtaaacaccttcaaattcttccatataataatagctgccactgctaagaattctatttctgttaaaatggtcactgtgtatgagctccttgaaaacaaggggtctctcatccctgttgatgaaaataatgacagcagatgacatttattaagaattactgtgttctaggtacttttaaggaatcaaaccatttaaactacacaacagccctatgatctaaatattattattattgtcatttaacaaatgaggaaatttaacagagaggggtkaaataactaattcaagggcaaagaatctcaagtcagattacttggacccaaattctggttttagcatttatgtatttaactctctagatctttaaacacactttgagactatcacacagggatttgcaaactgatgatttcctgcctgctggtaacatatctttcagaacaaagggtatttagggaaatggaggctgtcaatcagtttttctgagcatacctttacttctatatcagaagtaaataaaagactatcaaaatcttagtgattcttggctcctctaatgttgtactatctga

SEQ ID NO: 193465 - DNA, 601 bp, Human
gaacagagattgctttcattagcaaatgtgagcacttcaaatcctgggggcagaggaaagatgccagttgtacttgctgcagtgcatcagaataatctggatggcttgtcaaaacacagattgctgggccccagcctcacagtctctgattcagcatgtctgaagtgatgctggaaaatgtgtatttctaacaagttctcagatacatagatgctgctggtctagggactagatattttatgaatcactgacttattcttcaatacccaccagtgtaaacaccttcaaattcttccatatmataatagctgccactgctaagaattctatttctgttaaaatggtcactgtgtatgagctccttgaaaacaaggggtctctcatccctgttgatgaaaataatgacagcagatgacatttattaagaattactgtgttctaggtacttttaaggaatcaaaccatttaaactacacaacagccctatgatctaaatattattattattgtcatttaacaaatgaggaaatttaacagagaggggttaaataactaattcaagggcaaagaatctcaagtcagattacttggacccaaattc

SEQ ID NO: 193466 - DNA, 601 bp, Human
gtattgagaattgctggaaatctgtatatgtatacactgaaagtagcagtgaattcactactgtgttccaattcaatgcaaaagctattgtactatttgctcttacaattttgccttcttttgtaatgtgtttaaaataaaaagtttcccatttttcaaaggtgaaaacaaaaatcattgtcatcttgtaggcttgcaaaatttcagatctatcagagatactggatattatcttttctaaacgcttcattttacagagtagaaaacaaaggattcattcctcagaggagaaatgaggggygggggaagtaaaccaaggaacagaaagtttgtgggacttaaataagttcactcagctatttagagaaagaacctggactggaaaccaggctgtctgactcacagcccaagctactttgtcttacaatcggtgatatttaaggggtttgtactgttcgtttaaagttctgttctgttattttgatttaacaaacattgagtgaaagccacaggtatctcaaactgaaaagtcttcaggccctaggcaggtaggaagaaaatgtggggaaaaaagtagatgcatctgttgcttacatacaat

SEQ ID NO: 193467 - DNA, 601 bp, Human
actctggctgctgtgtggaaaataggctgatgcggggaagctttaagtaaagagaccagttagagagttattgcaagagtccatacaaagaggatagtagcttggactagggagtggcaataggggtattgagaattgctggaaatctgtatatgtatacactgaaagtagcagtgaattcactactgtgttccaattcaatgcaaaagctattgtactatttgctcttacaattttgccttcttttgtaatgtgtttaaaataaaaagtttcccatttttcaaaggtgaaaacaaaaatmattgtcatcttgtaggcttgcaaaatttcagatctatcagagatactggatattatcttttctaaacgcttcattttacagagtagaaaacaaaggattcattcctcagaggagaaatgaggggcgggggaagtaaaccaaggaacagaaagtttgtgggacttaaataagttcactcagctatttagagaaagaacctggactggaaaccaggctgtctgactcacagcccaagctactttgtcttacaatcggtgatatttaaggggtttgtactgttcgtttaaagttctgttctgt

SEQ ID NO: 193468 - DNA, 601 bp, Human
attgaggatagggactgagatgtatatagattaactagaaaagatctttttgagaaaaggcttcccttttgagtggagtatgaagattatgagggattgagctatttagatatttggaaggacattccagaaagagggggatagctggtcccaatgccttcaggcaagaacatggttggtgtgtttgaggaacagcaagatggccagtggaaagaaagaggagagataatatgtgaggagggatgaaggagacaacgggtgagattatataaaacgttattggtcataggaaaaaggtcaytggcttttaccccgaatgatatgtgatgaaagggattgagcaaagaagtgagtttatttcattttatcttttaactgggtcactctggctgctgtgtggaaaataggctgatgcggggaagctttaagtaaagagaccagttagagagttattgcaagagtccatacaaagaggatagtagcttggactagggagtggcaataggggtattgagaattgctggaaatctgtatatgtatacactgaaagtagcagtgaattcactactgtgttccaattcaatgcaaaagctattgtact

SEQ ID NO: 193469 - DNA, 601 bp, Human
atgcccttaagtagttcataaccaaaaagaagtcagccagtcatatacacaataaatacatacagatgaaacagcataaaatcataagagatgtacagtttgttcagagaaaaagtagaatgtacagttaaatcagaaacaggcttcaaagacaaaaggcttttagaggatggcataattagtgaaagaaataacataagcaagtataggatagaataaaaaaagtatggtatatataagtaatattttagtagtaagaagacataataaaacaagtaggtatattagatagtggtaaggrttctaaagatgaaaacaaaattcaagtaggcaaaggagactgaaatattgaggatagggactgagatgtatatagattaactagaaaagatctttttgagaaaaggcttcccttttgagtggagtatgaagattatgagggattgagctatttagatatttggaaggacattccagaaagagggggatagctggtcccaatgccttcaggcaagaacatggttggtgtgtttgaggaacagcaagatggccagtggaaagaaagaggagagataatatgtgaggagggatgaaggagaca

SEQ ID NO: 193470 - DNA, 601 bp, Human
gctatagaattcacttttccagactaagcatactcaattttcttcctattttcaaaatggaaataatttccttactcatcccttgaattctcttaaatcatctgtcattctcaagacaaaatgcaagcatggtcccattagcattaatttttcaagctgggcattgtcacgcaaagtcatattcatttttgatggggttgttctgtgaattcactttcattcatttattcaacaaatactgaatacctaatatgtgccaggtattcttttaggtgctggagacatagcagtacaaaatgcrgataaagctcattgcccccatgaagcttatattctaattaaatcttttggtttcaatggtataatgattatactattgctactatcaatgaacttatccatatccattatcaaggcgttactcattattaagaatttattacaggccaacacagagataaagcaggtattgtcaatgcccttaagtagttcataaccaaaaagaagtcagccagtcatatacacaataaatacatacagatgaaacagcataaaatcataagagatgtacagtttgttcagagaaaaagtagaatgtaca

SEQ ID NO: 193471 - DNA, 601 bp, Human
tttaaatttatactgctgcccttagatgaataataaaagcaatgactctctctcttatgggcaaatataccatttgcttattttaagaaaatgatgtctctataattgtcaacatgaatatatatattcatgtaacactttgagaatatatgtaacactgcgaaagtgtcttcttttactattattgctatagaattcacttttccagactaagcatactcaattttcttcctattttcaaaatggaaataatttccttactcatcccttgaattctcttaaatcatctgtcattctcaaracaaaatgcaagcatggtcccattagcattaatttttcaagctgggcattgtcacgcaaagtcatattcatttttgatggggttgttctgtgaattcactttcattcatttattcaacaaatactgaatacctaatatgtgccaggtattcttttaggtgctggagacatagcagtacaaaatgcagataaagctcattgcccccatgaagcttatattctaattaaatcttttggtttcaatggtataatgattatactattgctactatcaatgaacttatccatatccattatcaag

SEQ ID NO: 193472 - DNA, 601 bp, Human
ctcacataggtatgtgttccagattcggtctcaatgtcaagggaagcagatgtactaagtgcaacctcgctagatcttggctggatgcctgttcagtaccactctatctaggctgctgaataatacatgaaaatatatatccacataaagacacacacatcctacacacctcaaacttctcaaatcagatatatgaaataggcaaccaggttatttaaaatctttaaaattattgtataatggtttattatctctaaaaaatgttttaatatatattttaaatacgtcaaacacattgaaraaaaatccttgcaagttcactgtttagcctgtctaaagtaaacctccataatattttagaactaaaccacgttgccttcttaatgccttttgaaagtgttgtcagaagaatgcagaggtatgatttaagagattgtttattatacactgggaaatattaaccaggaaagataaattcgagatacagtgtaaactgggtgaaggtattaacattggaactaaacttgctgaattcaaatcctgggtctattatttaatatctttaaggccatggactaattatttaaccttcctgtgcctc

SEQ ID NO: 193473 - DNA, 601 bp, Human
acatagtctcacataggtatgtgttccagattcggtctcaatgtcaagggaagcagatgtactaagtgcaacctcgctagatcttggctggatgcctgttcagtaccactctatctaggctgctgaataatacatgaaaatatatatccacataaagacacacacatcctacacacctcaaacttctcaaatcagatatatgaaataggcaaccaggttatttaaaatctttaaaattattgtataatggtttattatctctaaaaaatgttttaatatatattttaaatacgtcaaacayattgaagaaaaatccttgcaagttcactgtttagcctgtctaaagtaaacctccataatattttagaactaaaccacgttgccttcttaatgccttttgaaagtgttgtcagaagaatgcagaggtatgatttaagagattgtttattatacactgggaaatattaaccaggaaagataaattcgagatacagtgtaaactgggtgaaggtattaacattggaactaaacttgctgaattcaaatcctgggtctattatttaatatctttaaggccatggactaattatttaaccttcct

SEQ ID NO: 193474 - DNA, 601 bp, Human
gaatggagatatttgggtttataatctgtgcattttcaatgttagatttccttgaaaattcaatatcatttcccacatctcacaatgttctcaatcaagatattttattagagtgtgaataagatcatatcctacaaaatcttaaataaaaagttaagttagtaccaggttattttctcctacaataaatcctatagtctctcacaataatatctataattataatattcataatatttgcaggccactcaattggtttttcctcagttatgaaattaatatttacttctgttatttatartttacttaagtcaattattcaccctccccattctcaacaggaaaatgctattattgaatatacagcaaaggagtgagctcttaaatcttccaatacaaaagtggttatataaattatggtacaatggaatgttcacccaggcaaattaattattcattcccttaccctaattccacagcattccatacatagcacttatcacagtgcttattaatatttatatgtttgtctgagtttccctgaaaactagggattcatagaatataacatgtttttgttgttgttttgcatccagattgc

SEQ ID NO: 193475 - DNA, 601 bp, Human
aggaaggagaaaaaaaagctcattacaaattgtctttggaacatgtaaatccagtatctttccaagtaacttctaaggacagactcattgcttgtaacgaagaaaggtataaaagagtacagttgtatttagaaattctagatctattttgtcaaatggccaataaaaaagattcatcctgtgacccattaaaaacccatgtggaacatactgagagagaatggagatatttgggtttataatctgtgcattttcaatgttagatttccttgaaaattcaatatcatttcccacatctcamaatgttctcaatcaagatattttattagagtgtgaataagatcatatcctacaaaatcttaaataaaaagttaagttagtaccaggttattttctcctacaataaatcctatagtctctcacaataatatctataattataatattcataatatttgcaggccactcaattggtttttcctcagttatgaaattaatatttacttctgttatttatagtttacttaagtcaattattcaccctccccattctcaacaggaaaatgctattattgaatatacagcaaaggagtgagctctt

SEQ ID NO: 193476 - DNA, 601 bp, Human
gcactttgggaggctaaggcaggagaatcacttgagcccaggagtttgcgactagcctgggaaacacagggagactccatctctgtaaaaataaaaacaaaaataatttagtcaggtatgtgtgtgtgcctgtggtcccagctacttgggaggctgaggtcggaggatagcctgcacccaggaattcaaggctgcagttaagccatgattgcaccactccactcctgcctgggtaacggggcagggcatgcctctgtctcaacaaaataaaataaaaaataaacatcctgtccaatgataytgcaccaaaaaatgtactttctaaaagtgctatgttttactcagcttaatttctacctgtacacaccatattattccagtaagaaaaaggtaacagtcaatccaaaacacataggaaaacaatgtgacaaccaagaaagtttcaaagaaagagaagaagaggaagagagggagagagggagagagggaggaagaagggagggaaggaaggagaaaaaaaagctcattacaaattgtctttggaacatgtaaatccagtatctttccaagtaacttctaaggacagactcattgcttgtaa

SEQ ID NO: 193477 - DNA, 601 bp, Human
agacttcccaggataaatgctaagaacactggtttatgtagctgaccatagaaggaaaagcaactataaagtttttcctacatggaatgagagaaaactgataatgctaggcagggacaaaaacaagaaacctgtttgaaagttttatatgaaccacaacatgataatggcctttagctggtttgctttgtgagacttactaagcccatttttaaaaatcagtaaacgatttgaaacgagactttattggtaaaagctaaacatagtttctctggaaaggtcctcatctgcctcctaaaartcccaaaaggtggcaaatgacttactgttatctattaattatcttcagagtagcatactgtggctccagctcacaggagccctttgctactcctttcactactcctcaaagccactgtcctaactcatagtaactgggctgcttgactccacccactctttaagtcccttgcatcctcttatgccattttcctgcttacaacctgcagtgattcctccctgtctccaatgtcctttacaacctggctccaacccacatttccagcttatcacctgtcaccctttccatctgctgtaaccg

SEQ ID NO: 193478 - DNA, 601 bp, Human
aaacaaggactactccccagcgggtgttggcaggtgagctggaaggagctgggtccctgagagctttgtggagcagtggcacaagtccaacattcaattacccaggtctggcttttacgtgagaaaataagtccttgttctcttagtctgtgcgatgcagagccaactctaatcctaactgatagagatgctaatgaaagcagaattaatatgcaagatatgaactagatgcaaggtacttcattttaaataaaagcagatactggaaaacgattaagttcactgataattactgtgagarggagaaaagacttcccaggataaatgctaagaacactggtttatgtagctgaccatagaaggaaaagcaactataaagtttttcctacatggaatgagagaaaactgataatgctaggcagggacaaaaacaagaaacctgtttgaaagttttatatgaaccacaacatgataatggcctttagctggtttgctttgtgagacttactaagcccatttttaaaaatcagtaaacgatttgaaacgagactttattggtaaaagctaaacatagtttctctggaaaggtcctcatctgcct

SEQ ID NO: 193479 - DNA, 601 bp, Human
aataccttatatttgtgcaagattaattttcaaagtgctgatacattcattaattgtatttgatcctcaaccataaatgctatgaagaatttaggacagaatgattaccttaatttatagaagtacaaaaagatttagagttaacccaggggaaaatgcatctaaacaaaggctttcaggctccctaatgtggttacctgttcaaaacatcatatttcatctttttgttctttatttttcttttttgacagagtctagctctgtcatccagctggagtgcaagcaattctcctgcctcagmctccagagtagctgctattataggcgcctgccaccacaacccagctaatttttgtatttttagtagagacggggtttcactgtgttggccaggctggtctcgaactcctgaccttgtgatccacctgtctcggcctcccctttttgttcttttaatttcctctaatatccatttttgccttcttgcaaataaatagattattcagctacaccttctaacatatcctgcaaccagatgtaggtcctatggacccactactggccaatgagatgtaagtcatcacatcattataagcttgag

SEQ ID NO: 193480 - DNA, 601 bp, Human
caacaagacgtgtgacatatgaaaactagagcaacaacacagattatgagatttgcagacacatagtttctaaaccctccactcagtcacttggctttgagctattcatttaacttctctgccttagttttcctatctgtaaaatggacatgataatgcttattgcacagagttgatagaaccaaatgcattgtcatgtttctgaaagtgattcacagagatgtatcctctctaagagctatttgtcatgaatacctaattcttctgtttgtcagataaagttaccataagactattgtaraaactgacatattacctcagtaatattttttagtttatattcagcagattgctttaaagctttaaaatctaataccttatatttgtgcaagattaattttcaaagtgctgatacattcattaattgtatttgatcctcaaccataaatgctatgaagaatttaggacagaatgattaccttaatttatagaagtacaaaaagatttagagttaacccaggggaaaatgcatctaaacaaaggctttcaggctccctaatgtggttacctgttcaaaacatcatatttcatctttttgttc

SEQ ID NO: 193481 - DNA, 601 bp, Human
taccagtgtccttgtgttactgaaacaacttaagaaatacaagaactagacaaagtctagttggggagaaaaagctaagacatatggaataatatgatacagtgtataatttacttctataattaaatgtaatatatgcattctatatatatattccctatgttacagaagttcaggaaaatggaagctctgtgtggcctgaagtattcatggaatgccttacacagaaaatggaacctgagttgacacctaaagaagcggaagttgagaaagccaagaacagaaaacattttagtgaggyggaagttaggtggttttgcagagtaatgtgtgtatgcagaaagggactggcagattggtggatttgatttatattggggggaaatgagaaagaacagcatgtaaataaaataaggataaataaccgagtctgtcactctaatcttagatatctggactttaccaaataggcaacaagacgtgtgacatatgaaaactagagcaacaacacagattatgagatttgcagacacatagtttctaaaccctccactcagtcacttggctttgagctattcatttaacttctctgccttagttt

SEQ ID NO: 193482 - DNA, 601 bp, Human
atcggatcagtccttttgcctctttgaatccatttccacattttttacgaaaactgagactagataagaaactgtaagtagtttcttatagattaattgttggctcaatttagatttgaactggttttatttcttgctatattcttaccagtgtccttgtgttactgaaacaacttaagaaatacaagaactagacaaagtctagttggggagaaaaagctaagacatatggaataatatgatacagtgtataatttacttctataattaaatgtaatatatgcattctatatatatattycctatgttacagaagttcaggaaaatggaagctctgtgtggcctgaagtattcatggaatgccttacacagaaaatggaacctgagttgacacctaaagaagcggaagttgagaaagccaagaacagaaaacattttagtgaggtggaagttaggtggttttgcagagtaatgtgtgtatgcagaaagggactggcagattggtggatttgatttatattggggggaaatgagaaagaacagcatgtaaataaaataaggataaataaccgagtctgtcactctaatcttagatatctgg

SEQ ID NO: 193483 - DNA, 601 bp, Human
agacatggtccttaacactctaaattacaaaacctcaaaataatcccgaaaaacaggatcacaaaatataaaatgacttcaacttccaattttcttgcctaacatgatggttactccattacctctcagtggtagttcacacacatacacacaaatacacactacaatgtacttactgaactgtagagatagccttcaccattcatggccacatagaggctagccttcactccttggatggccactacacgcaggcccacgggaattagattgaagagagctggggggagaaaaagaaggrcggaaaggatcagtgaccttttgaataaataatccttcttataatcattcttttgagaattaaaacctattaattgaacttggtagaaaaatggagagagaaataaagagaggtctaaaaacgagagaaattgacttcttgaccctgcaccagcattaattacctatgtaacttcaggtaaattacataaactctgtactaaaggggttggattagaaggtctctaaaggcccagctggatctgagatttcaggatccctgatccttaaaatgatcctcaaacagtgtaatataagataa

SEQ ID NO: 193484 - DNA, 601 bp, Human
cctctctctccataaactgcagttatgacccttattggttgcccaactacagtgttgcctacgacatagaaaattgcttttcaaagaaattctagccttaatgcataccagaaacacctcaggaaagtcaaagttaacagatgacttttaactcacgaggcgaaagcattgtgattctagatgtgaggcaagtttgacttaagtcgagagaagaactgaaaatacagataccccaataggtttacaaaggtaaactccattacaaaagaaactccctcttttggctcaagattcccacccmctcgtaacctcagaactaagcaagaaggacagaaggaatgcatctctgaaaagcttcagaggatgaaaccacaacccagcaatccctccaaactccctccttcccttatacaattgtctcctgcttacaatactgttgtcaaactttctgtgtttttcttcttcatggacctttggggatcaattctagtctaataaactgaactctatagcttctgtggaattataacctgaattatgactttttaaatatacataatatagtctacatttagctgcttatttaatgactgattaaatc

SEQ ID NO: 193485 - DNA, 601 bp, Human
acatcaataatctcatcaaatatatatatggattaaactcatctattaaaacacaaaatttcagaacaactcttaaaactatagctctgtgctacctaacactcactccgtctttgacactctctcctcctgcttcctggtgaagaaatagaaatcaaaagtaacaagggaattacttcctattaattcctagcttaaaaataaatagaagccaggtaaatgacactagataaatgatactgcttgtgaatcttttgggttctaaattagcttatgtaggtcctcttagtttgcttcagcmctctcctctctctccataaactgcagttatgacccttattggttgcccaactacagtgttgcctacgacatagaaaattgcttttcaaagaaattctagccttaatgcataccagaaacacctcaggaaagtcaaagttaacagatgacttttaactcacgaggcgaaagcattgtgattctagatgtgaggcaagtttgacttaagtcgagagaagaactgaaaatacagataccccaataggtttacaaaggtaaactccattacaaaagaaactccctcttttggctcaagattccc

SEQ ID NO: 193486 - DNA, 601 bp, Human
aaaagagaaacaaaaggaaatttaaaaaaatacaaactattatggtaaaaacatatccagatacatcaataatctcatcaaatatatatatggattaaactcatctattaaaacacaaaatttcagaacaactcttaaaactatagctctgtgctacctaacactcactccgtctttgacactctctcctcctgcttcctggtgaagaaatagaaatcaaaagtaacaagggaattacttcctattaattcctagcttaaaaataaatagaagccaggtaaatgacactagataaatgatrctgcttgtgaatcttttgggttctaaattagcttatgtaggtcctcttagtttgcttcagcactctcctctctctccataaactgcagttatgacccttattggttgcccaactacagtgttgcctacgacatagaaaattgcttttcaaagaaattctagccttaatgcataccagaaacacctcaggaaagtcaaagttaacagatgacttttaactcacgaggcgaaagcattgtgattctagatgtgaggcaagtttgacttaagtcgagagaagaactgaaaatacagatacccc

SEQ ID NO: 193487 - DNA, 601 bp, Human
tgattttattttaaagtgcaactaatcaaactggcagcaagaaaggttgtgatatttactagcaagaaaacactgtaacctccataagctgttggaaaggaagacagaaacactaaaaaatatttagcaaagtatgtcgtgatttatgtatgattaaaaaaaataagactaaccactacaggaataaaaatacagcctgaggttacaaacttgcagaagaatttaataaaataaaaaaatgtgaataaagcaacagaattttttaaaaaagaaaagagaaacaaaaggaaatttaaaaaamtacaaactattatggtaaaaacatatccagatacatcaataatctcatcaaatatatatatggattaaactcatctattaaaacacaaaatttcagaacaactcttaaaactatagctctgtgctacctaacactcactccgtctttgacactctctcctcctgcttcctggtgaagaaatagaaatcaaaagtaacaagggaattacttcctattaattcctagcttaaaaataaatagaagccaggtaaatgacactagataaatgatactgcttgtgaatcttttgggttctaaatt

SEQ ID NO: 193488 - DNA, 601 bp, Human
taagcagcaaaagcaaaaatagacaaataggactacatgcaactttaaaaattctatgtatcaacagaaacaactaacagagtgagaaggtagcctacagaatgggagaaaatatttgcaaatcatatatctgataagggctttaatagccagaatctataaagaactcctacaactcagtaacaacaacaacacaaaacaactcaattaaaaagtaggcaaaggaattgaatagacatgtcaccaaagaagatttacaaatgactagcaggtatgttaaaagatgcccattactactagytattagagaaatgcaaatcaaaacaaaatgggttatcatctcacacctgttaggatggccactatcaaaagaaacaaaaagtatcaagtgttagcaaggatgtgaagaaattggaactttcgtgcactgttggtgggaaggtaaaatgatgctgctgatagggaaaacagtatggagttttctcaaaaaaaaaaaaaaaaaaaaacaaaaacaaaaacagaattaccatataatccaacaagatcttgacatttgtacgctcatgttcattgcagcagtaatctcatatccaagaggcca

SEQ ID NO: 193489 - DNA, 601 bp, Human
tacaattcctatcaaaatctcaatgtcgttttttgcactaatagaaaactccattccaaaatttatataaaatctcaaggaacctcaaatagccaaaaccatcttaagaaaaaataaataaataaagctgtaggtcgcacaccttctgacttcaaaatgtagtggaaaactatggtaatcgaacagtatggtactggcacaaagagacacaaacaccaatggaacacaatagagaggcccagaaataaaccctttaatatgtggtcaaatcatcttcaacaagattacacaatggagaaargttagcctctcaacaagtggtgttggaaaaactgtatatccacatgcaaaagaatgaaactggacccttaccttacaccacatgtaacattaattcaaaatggattacaaatctctgcataagaggaggctgaggcaggagaatcgcttgaacccaggaggtggagattgcagtgagctgagatcacaccactgcactccagcctggcaacaaagcaagactccatctcaagaaacaaaaaacaaaacaacaacaaacaaacaaacaaacaaaaaacctcctagaataaacataggaaaa

SEQ ID NO: 193490 - DNA, 601 bp, Human
gtttataaaaagtaaacaaatcatcgctatagtttgaaaaaaataaaccttttaaaaacattataaccaatattaaccactaaaatgccagcgataagtgtgctaagcacatcaaactattcattaaaaaaggtccaatgtttgcctagttatgcgttctagacatgtttcaaattatacaaattgctttttttgaggaagggttttgctctattgcccaggctggagttcagtggcacaaacgtggcttactgcagcctcgatgtcctaagctgaagcaatcctctcacctcagcctccyatgtagctgggaacagaggtgcatgctaccatccccagctaatttttaaattttttgtagagacagattctcacctcttgtccaggttcaaactgcattatttttaagtgctattctcctagatgcgaatgtcaaggctcctaagttatacaaagcagtaagttatatttttatttcccaagtgctgatatgccagatattacacccataaatttcttttctttcattattttcttcttctgagctggggtaagaaaatagacggtagtcagatgagtgagggcgtgggactggaagcag

SEQ ID NO: 193491 - DNA, 601 bp, Human
ttgtggacataaaatagtcctctccttatagttaccaatagcggccctttcatttttcttccttagagatcaccacccccaactcatgtttctcaataactcctgacacagcttttcaatataaaatcagtatcgtcatctcacaatcttaacattgtctgcttgcaccaaggcaatactttaagggagaaattcccaatggtgcagaggacatgcatcaatcaagcagtctctctttcatttttgttgttggtgttatcactgtaataaagccatcacaaacaaggtgataggctgcccyggttttcaaagaattatgctttttatattatgttggaacactgtagtatggcacatccttaattgcaacagcaaataggagaagcaatattgattaaagaaatgaatattgaactagaagttgctttttcttaacctgcctcacaatgctgagtgacctcattttagtcacatgacttctctgtttcccaggcatacttttgtcactcagcaataatagagttattgcaaggctcaaatgtgacagtttatgtgaaagcacatgggaaaatatgagaagcattccaatggaaaggtttta

SEQ ID NO: 193492 - DNA, 601 bp, Human
aaactttacatgcttcagtagaatagaaacagactactcaaaagtgaactagtcactgaactggaaagtgtgtagggtcatactcaggaaaattattataaagcccattgagtccagacagccagtgaattattgccaaaattaaactgtatgatgcctctatcaaccgattcaactagacttcagcagatgtctgaacattggaattacagttttcagtgccatgagagatattaatctatattagatatgatccctaacctcaaggaatttgcatctgataagatataaaaagcattargaacaaattctaacaaaagaaaggaaatacagagataaatgtcccatcaaagtataaaatgtggaagttatttggggctgcagaaattgggaaaatgtttactgggtcctaaatgatgggagaaatttggatatctatgatagtgaggaagtaaaagaaattagaggagggaataacaaccactttctcccatcatctaccttgtggacataaaatagtcctctccttatagttaccaatagcggccctttcatttttcttccttagagatcaccacccccaactcatgtttctcaataa

SEQ ID NO: 193493 - DNA, 601 bp, Human
taatctttacctctcccttaccttttataaacagtatttagtacagaaagaaaaacatggcaatatcagctcttaaaactacagcaccatatcagcctcaatagggaagcatgaacactaagattcctcgagtaaactttacatgcttcagtagaatagaaacagactactcaaaagtgaactagtcactgaactggaaagtgtgtagggtcatactcaggaaaattattataaagcccattgagtccagacagccagtgaattattgccaaaattaaactgtatgatgcctctatcaacygattcaactagacttcagcagatgtctgaacattggaattacagttttcagtgccatgagagatattaatctatattagatatgatccctaacctcaaggaatttgcatctgataagatataaaaagcattaagaacaaattctaacaaaagaaaggaaatacagagataaatgtcccatcaaagtataaaatgtggaagttatttggggctgcagaaattgggaaaatgtttactgggtcctaaatgatgggagaaatttggatatctatgatagtgaggaagtaaaagaaattagagg

SEQ ID NO: 193494 - DNA, 601 bp, Human
ttgaacaagcccctaagatttggcctttgacttttctctatttaggcatcattaagttcaaattctatgattcatttgacattaatagttaaggttcttgtttctctctctctctcgtctttcacttttctgagacgtcactcacttgctgtcccaagaaagagttgtgaatatgcctcagatttcagaactttccatgagaaagtacgttgataaggaaactcaaattccagagtgggcaactgctttgtacctctactccagatatgcttgttttataaagcctgcgtatctttttagratggaacagaattctttcactgagagattaactgtaaaaaccaggtggcttcccaggaagatatcatggctaatctttacctctcccttaccttttataaacagtatttagtacagaaagaaaaacatggcaatatcagctcttaaaactacagcaccatatcagcctcaatagggaagcatgaacactaagattcctcgagtaaactttacatgcttcagtagaatagaaacagactactcaaaagtgaactagtcactgaactggaaagtgtgtagggtcatactcaggaaaattatt

SEQ ID NO: 193495 - DNA, 601 bp, Human
attgccaggttcttgggttgacagaattccatattttctttctttttttaactgaaaaaatttccagttcatttaataaatatatatggggtgaaaaaagaaataggcaaaatagataatccttttccaagtgctataccccccaatttttttaaaggaatgtgacaaaggtcaaggaaatcacgagcatatgagaagaaaaaattatgtaaatgatctaaactgaatatttaacaatctacctgttgaacaagcccctaagatttggcctttgacttttctctatttaggcatcattaasttcaaattctatgattcatttgacattaatagttaaggttcttgtttctctctctctctcgtctttcacttttctgagacgtcactcacttgctgtcccaagaaagagttgtgaatatgcctcagatttcagaactttccatgagaaagtacgttgataaggaaactcaaattccagagtgggcaactgctttgtacctctactccagatatgcttgttttataaagcctgcgtatctttttaggatggaacagaattctttcactgagagattaactgtaaaaaccaggtggcttccca

SEQ ID NO: 193496 - DNA, 601 bp, Human
tcctcattagtgctgctctcaaaagctgagccttgcttttattttctaatgaaaaatgtttctagaaacatatatgctaattttccaattaaggttagccctggagctaaagtattaacattttccataagttataaactcttagaaaaaaaaccaacactatttactatgaatacattgtaagttaaaaatggatgcttactgttaatccttactgaaagtataactaataatctgttgtttctgaaaaaagacaacctaatcccaacaaaaaataacccatgtcacatgtttgcaagcrataattgccaggttcttgggttgacagaattccatattttctttctttttttaactgaaaaaatttccagttcatttaataaatatatatggggtgaaaaaagaaataggcaaaatagataatccttttccaagtgctataccccccaatttttttaaaggaatgtgacaaaggtcaaggaaatcacgagcatatgagaagaaaaaattatgtaaatgatctaaactgaatatttaacaatctacctgttgaacaagcccctaagatttggcctttgacttttctctatttaggcatcat

SEQ ID NO: 193497 - DNA, 601 bp, Human
aaattaattaattaattaattaaataaaatatcatatgtaccccataaatatatatgcctaccacgtgcccacaaaacttaaaattaaaaaataataataataaaatgcaactctctttcaacagataaagtcttgagcctgaagctaatttgccctaattagatgagaaatactcttcaagcaatcccccaagaccagagtgactaaagatatttgattaggcaaagcaggaaccagcactaaaactagcagtgagattaatcctacagaaactttatggattgatgctcaggagctgtytgagggtacaccaagcatctttttaaaatatatctactgctgctactgttactgcttatggctaacactgagtgttgagtacataatatacactgccctagggctttacgtgcatctttccatttaatccttacacaattctatacagctccatatcctcattattacccctgttttacacataagaaaacaatctagaaagttaaaaaactttccaattttttcacaaaggaagtaagttacagggctatgattcaaacacagttttatttctaaagcttacattttaaattactactt

SEQ ID NO: 193498 - DNA, 601 bp, Human
aagcaatctacagattcaatgcaatctttatcataatactaacaacattctttacagaaatagaaaaaaataatcctaaaatttataatttatattaaaccacacgcagacacacacacacacacacaccccagaatggccaaagctatcctgggcaaaaaaattaaaaactgagagaatcgcattacctgacttcaaattatactgtagagatatagtaaccaaaacaacatggtagtggcataaaaacagacatgcagaccaatgtatgaacagaatagagaacccagaaataaattcrtacctctacagagaactcattttcgacaaagtttccaagaacatacattggggaaaggagtctctttgataaatggtgcttggaaaactggatatccacatgcagaaaaatgaaactagacctctatctcttgtcatggacaaaaatcaaatcaaaatagattaaagacttaaatctaagacctcaaagtatgaaactactgaaatctggcaaaagatctgagtaggcatttctcagaagaagacttacaaatggcagacaggtatataaaaaggtgctcatcatcattgatcatcagag

SEQ ID NO: 193499 - DNA, 601 bp, Human
gtgagctgagatcgcaccactgcactctagcctgggtgacagagtaagactgtctcaaataaataaataaataaataaataaaataactacaaaaacctttcaagacatggatagtataataagatattaatagaaacagaaaaagtttaaaggcaaggggatgaatctaacatgtagagtttttattagttgtctctttgcttctttgttagtttgtttatgcagcctgtgttgtcatcagtttaaaatggtgggttatattatttgcaagtctcacggtaacctcaagacaaaaatcayacaacagatacacacaaaaaaatagcaagaaattaaaatatgctagcagagaaaatcacctccactaaaagaaagataagaaagaaggaaaaaaggaagagaagactacaaaacaaccattaaacaaataacaaagtggccagaacaaaattccttctttatcaataataacacagaatgtaaatgaaataactatccaatcaaaagacgtagagtgcctgcatagatttcaaaactagagccaataatgtcttgcctataagaaatacactttacctagaaagacacacatagacagat

SEQ ID NO: 193500 - DNA, 601 bp, Human
gctactcaggagactgaggcacgagaagaacttgaacctgggaggcggaggttgcagtgagctgagatcgcaccactgcactctagcctgggtgacagagtaagactgtctcaaataaataaataaataaataaataaaataactacaaaaacctttcaagacatggatagtataataagatattaatagaaacagaaaaagtttaaaggcaaggggatgaatctaacatgtagagtttttattagttgtctctttgcttctttgttagtttgtttatgcagcctgtgttgtcatcagttkaaaatggtgggttatattatttgcaagtctcacggtaacctcaagacaaaaatcatacaacagatacacacaaaaaaatagcaagaaattaaaatatgctagcagagaaaatcacctccactaaaagaaagataagaaagaaggaaaaaaggaagagaagactacaaaacaaccattaaacaaataacaaagtggccagaacaaaattccttctttatcaataataacacagaatgtaaatgaaataactatccaatcaaaagacgtagagtgcctgcatagatttcaaaactagagcca

SEQ ID NO: 193501 - DNA, 601 bp, Human
aaagctaaaagaggcattaccctgtttttgtttctgtttttaacttaaggttcaccacgtgatgtagttttatccaaggattcataagtaaaatctactggaacttctgggaagatgttagctttcctgataaaggcaccatctcttcctctgtgcctctttctactgcctagaaagctcccatgttatctggggatttaagagccatccatgccaggaagagaagtccaagcaaatgtaaagaggccttggacataatgggcccgttgagtcaatcaatgaaccaataccgataaatgtstatctttagacttctgggtgtatgaggaaatccaaacctctgatccctttaaaccattgttatgggcatcactttcctcacagctagactcaattcctcattgatacaggaaagtaaacataagaaatttgttattaataattggtcttaggaaataaaatcagaagaggaaactttcttcttagtgaggttttgtgcacatattgacacctcaaattacccactgagttacatgtagaattatgtggaaggcatgtgtaaggtgactgcataattattgccaaaatctgaatccaggat

SEQ ID NO: 193502 - DNA, 601 bp, Human
aacaaaataaaagctaaaagaggcattaccctgtttttgtttctgtttttaacttaaggttcaccacgtgatgtagttttatccaaggattcataagtaaaatctactggaacttctgggaagatgttagctttcctgataaaggcaccatctcttcctctgtgcctctttctactgcctagaaagctcccatgttatctggggatttaagagccatccatgccaggaagagaagtccaagcaaatgtaaagaggccttggacataatgggcccgttgagtcaatcaatgaaccaataccrataaatgtctatctttagacttctgggtgtatgaggaaatccaaacctctgatccctttaaaccattgttatgggcatcactttcctcacagctagactcaattcctcattgatacaggaaagtaaacataagaaatttgttattaataattggtcttaggaaataaaatcagaagaggaaactttcttcttagtgaggttttgtgcacatattgacacctcaaattacccactgagttacatgtagaattatgtggaaggcatgtgtaaggtgactgcataattattgccaaaatctga

SEQ ID NO: 193503 - DNA, 601 bp, Human
taggatcagtgtccttgtaagaagagacagggaagagcatgcctcctctttctctgcccaccaccacgtgagtgcacagcaagaagatggccaagtgcaaacaggaagagggcccttacaagaaacttggccatgctgcccccctaatcttgggctcaccagcctccagaactgtgagaaatgaatgtccattatttaagccaaccagtctgtgataatttgtcaaagcagcccaaactaaggcaactctggtttgatacacatggtaaagtatattgcttaaaattaaaaattaaaattaaaaaaaaaacaaaataaaagctaaaagaggcattaccctgtttttgtttctgtttttaacttaaggttcaccacgtgatgtagttttatccaaggattcataagtaaaatctactggaacttctgggaagatgttagctttcctgataaaggcaccatctcttcctctgtgcctctttctactgcctagaaagctcccatgttatctggggatttaagagccatccatgccaggaagagaagtccaagcaaatgtaaagaggccttggacataatgggcccgttgagtcaatcaatgaac

SEQ ID NO: 193504 - DNA, 601 bp, Human
aataggatcagtgtccttgtaagaagagacagggaagagcatgcctcctctttctctgcccaccaccacgtgagtgcacagcaagaagatggccaagtgcaaacaggaagagggcccttacaagaaacttggccatgctgcccccctaatcttgggctcaccagcctccagaactgtgagaaatgaatgtccattatttaagccaaccagtctgtgataatttgtcaaagcagcccaaactaaggcaactctggtttgatacacatggtaaagtatattgcttaaaattaaaaattaaaattaaaaaaaaaacaaaataaaagctaaaagaggcattaccctgtttttgtttctgtttttaacttaaggttcaccacgtgatgtagttttatccaaggattcataagtaaaatctactggaacttctgggaagatgttagctttcctgataaaggcaccatctcttcctctgtgcctctttctactgcctagaaagctcccatgttatctggggatttaagagccatccatgccaggaagagaagtccaagcaaatgtaaagaggccttggacataatgggcccgttgagtcaatcaatga

SEQ ID NO: 193505 - DNA, 601 bp, Human
tcaggtcataagagtaaagtcctcataaataggatcagtgtccttgtaagaagagacagggaagagcatgcctcctctttctctgcccaccaccacgtgagtgcacagcaagaagatggccaagtgcaaacaggaagagggcccttacaagaaacttggccatgctgcccccctaatcttgggctcaccagcctccagaactgtgagaaatgaatgtccattatttaagccaaccagtctgtgataatttgtcaaagcagcccaaactaaggcaactctggtttgatacacatggtaaagwatattgcttaaaattaaaaattaaaattaaaaaaaaaacaaaataaaagctaaaagaggcattaccctgtttttgtttctgtttttaacttaaggttcaccacgtgatgtagttttatccaaggattcataagtaaaatctactggaacttctgggaagatgttagctttcctgataaaggcaccatctcttcctctgtgcctctttctactgcctagaaagctcccatgttatctggggatttaagagccatccatgccaggaagagaagtccaagcaaatgtaaagaggccttggaca

SEQ ID NO: 193506 - DNA, 601 bp, Human
ccttcttaaaactctgtacttctcagtatttattttagagtacttcttcttttactcttttttcttctttttaagagatgggctgaattaaactacacaaggtgaagtagatatagaatatttaaaatggtaaattatcgagcatgaaatctcatctgattcaatgagtgaaagtaatattgattaacccagccactgaccttgagtaacagacataagaatactgtaataaacacaaaaaagtgctggtaaagtatttgtcgcaatgccaagagctacaacctggattaacagtcacacktcacaaaatagacttctatgactttagatgtgcttattatgtctaacgatgaagaaggtgaaacaaactaaactgagagtggaagacacatgttgcccctcaactgtgtgctattttgatatcgtagagatgatcattaagtgatttatcataaaatgtatgaactaaagataaatatttaattatagaaagtatgtcttcatgtgtctttctataaagatttctatgggcttcaaacttcagttagagcccttttaaaatatttatacttaaaactgcaccataaattgcaatttgcaa

SEQ ID NO: 193507 - DNA, 601 bp, Human
catttaacctcagtattactagagcactcaaaagtaataggttgttaaaccgtttggagggcaaatgacattggcagatctaatggcaaaacaaacaaaatatcaaatatatttaaaatttaaaatatcaaagaggccaggcacagtggctcacgcctgtaatcccagcattttgggaggccgaggcgggcagatcacttgaggttgggaatttgagaccagcctgaccaacatggagaaaccccatctctactaaaaatacaaaaaaattagccgggcatggtggcgtgtgcctctaatygcagctactcaggaggctgaggcaggagaatcgcttgaacctgggaggcagaggttgcagtgagccgagattgcaccattgcactccagcctggccaacaagaacgaaactccatctcaaaaaaaaaaaagaaattaataaacaaataaatttaaaaaaataaaagtccaaaccaaataaggtcctttaaaccactgacctacagcaatccattttacttgacggagcattgggtaggggaaagattacagataagttattttaaggaattaaattaggtgaatgttaaatattctagaa

SEQ ID NO: 193508 - DNA, 601 bp, Human
aggctgtacaactccattttacattttcacaccatacatcttagatagtagggacttcattttgtgaagaataagacaccaaaaatatagtctgtttgtaaatatagatttgagaataaagaccaagaaacgcacgttagaaatcttaagaaatgaatttttactataattatctacagctctatgctccatacttatattttaaattataatactaatgaaaaaaatcactgttgagatgataaattagcagaccattaaaagcttttaagaatgaaaaccactctccaacgatattcaygtgaaaaaccagacagtaaaagaacaaacaagtaaatgtggaaataaccagaacccaatatgcaactgtctcaatcacatttaacctcagtattactagagcactcaaaagtaataggttgttaaaccgtttggagggcaaatgacattggcagatctaatggcaaaacaaacaaaatatcaaatatatttaaaatttaaaatatcaaagaggccaggcacagtggctcacgcctgtaatcccagcattttgggaggccgaggcgggcagatcacttgaggttgggaatttgagaccagc

SEQ ID NO: 193509 - DNA, 601 bp, Human
aataacagtgctcaaagagttatatttactgccacgcaagatgaatcatgcctctttggggaatgctttttctgaaatttcatttcccattttggactactggatcagtctctcagaagagtttggaatgtggccaattacttccctctgcatttttcatctgagacttaggctgtacaactccattttacattttcacaccatacatcttagatagtagggacttcattttgtgaagaataagacaccaaaaatatagtctgtttgtaaatatagatttgagaataaagaccaagaaacrcacgttagaaatcttaagaaatgaatttttactataattatctacagctctatgctccatacttatattttaaattataatactaatgaaaaaaatcactgttgagatgataaattagcagaccattaaaagcttttaagaatgaaaaccactctccaacgatattcacgtgaaaaaccagacagtaaaagaacaaacaagtaaatgtggaaataaccagaacccaatatgcaactgtctcaatcacatttaacctcagtattactagagcactcaaaagtaataggttgttaaaccgtt

SEQ ID NO: 193510 - DNA, 601 bp, Human
ttaatcattacaacaaccaacagctttagaacattaaccatgtgttaagtaattaacatgttatctatgatgccagataaaaaaggcacaataaatagaaaatgttccttatcgtcacctccagggtacgctttaggtaatgaagttctaatatcagagatagcagcaacgacaggatgctaattgtggtgaatattagaaaagaagccactgatgtagtctagccgacctctatgatcacttttatcaactgaaagttaaaaaataaataaataaagctagagtgggcacaatgctagayagcagagacagaactggcatatttggaagatctctcaattctacaggcagaatttttttaaaacaaaccaaacaacaataataacagtttactgttaggggaagcactgaggttgggctttaagagtttgctgagaagctgatttgcaaagataggcaagcttggaccccagtgaagtggtcaaataaataacagtgctcaaagagttatatttactgccacgcaagatgaatcatgcctctttggggaatgctttttctgaaatttcatttcccattttggactactggatcagtctct

SEQ ID NO: 193511 - DNA, 601 bp, Human
aaatcaaattggtatagactatttttatcacaaacactcccatttttcatagctattccaatacaactctgatttaaaaactgcaatagaaatatttaatttaattaatttatttttaaattttattttattttttttgagacaaggtcttgctctgttgcccaggctgagtgcagtagcactatcacagctcactgcaacctccatctaccaggctcaagcgatcctcccacctcagcctcccaagtagctggaaccacaggcacacaccaccatgctgactaactttgtttttctttcytttttttttttttttttttttttgtggagacagggtttcaccatgttgcccaggctggtcttaaattcctgacctcaaccaatctacctgactcggcctcccaaagtgctgggattacaggcgtaagccaccatgcctggcctacaatgttttcattttattttatttttttttttttgagacagggtctcactctgtcacccaggctggagtgcagtggcacaatcatggctcactgcagccttgacctcccaggctcaagtggtccccccacctcagccttcccagtagctgggacca

SEQ ID NO: 193512 - DNA, 601 bp, Human
gtcaaaatcaaattggtatagactatttttatcacaaacactcccatttttcatagctattccaatacaactctgatttaaaaactgcaatagaaatatttaatttaattaatttatttttaaattttattttattttttttgagacaaggtcttgctctgttgcccaggctgagtgcagtagcactatcacagctcactgcaacctccatctaccaggctcaagcgatcctcccacctcagcctcccaagtagctggaaccacaggcacacaccaccatgctgactaactttgtttttcyttcttttttttttttttttttttttttgtggagacagggtttcaccatgttgcccaggctggtcttaaattcctgacctcaaccaatctacctgactcggcctcccaaagtgctgggattacaggcgtaagccaccatgcctggcctacaatgttttcattttattttatttttttttttttgagacagggtctcactctgtcacccaggctggagtgcagtggcacaatcatggctcactgcagccttgacctcccaggctcaagtggtccccccacctcagccttcccagtagctggg

SEQ ID NO: 193513 - DNA, 601 bp, Human
agagatattaaagaaggaaagagagagatttcatttaattcaatcaaagttttctctggttaatctaattctgtgccttagtgatgtttactgaaaaaaaaatggtggaatttagaggaagaaaaacactttctcttgggaaataaaagaaaatcatatgaaaatttacctgttacaattcgttaacagaagagaaaatgaagtgtatgtatctggagatttccaatcatctttccagtgctaaatttgaacctcattctcaagggttttctaaaataaaacttaacatacctttccatcrtcacatcctcatgtcctcaaggctaatttgatttagggattattctagtgtttcgatttgctatcagtttgagagcctttgtatcaaaaagaagtgccaaattttgtgaggttcttaagagaataatgcaggtgaataaagcctcagtatactgggcttctcaggaatgtagcactgactgccatttataattaattaaagatttagagattctgtacctttcaaacgttccttctttttgtgtggaacattttctaatatatattcaacatttgcctgccttttcttttgattcagggt

SEQ ID NO: 193514 - DNA, 601 bp, Human
tcatcctaccaacgtgctgggattataggcataagccaacaactgacttcttgagaggtaattttgatcatatgatctctcagaatttcatttaaatttctttcatagacatctgagaaagagatattaaagaaggaaagagagagatttcatttaattcaatcaaagttttctctggttaatctaattctgtgccttagtgatgtttactgaaaaaaaaatggtggaatttagaggaagaaaaacactttctcttgggaaataaaagaaaatcatatgaaaatttacctgttacaattcrttaacagaagagaaaatgaagtgtatgtatctggagatttccaatcatctttccagtgctaaatttgaacctcattctcaagggttttctaaaataaaacttaacatacctttccatcgtcacatcctcatgtcctcaaggctaatttgatttagggattattctagtgtttcgatttgctatcagtttgagagcctttgtatcaaaaagaagtgccaaattttgtgaggttcttaagagaataatgcaggtgaataaagcctcagtatactgggcttctcaggaatgtagcactgactg

SEQ ID NO: 193515 - DNA, 601 bp, Human
tctctctctctgactggctcactttctatctaaaacatacctatctgaaacaacaaacaacacacttcaatacaaacataccagttgaacaagggacttcttatttattttcaattttttgagacaaagtctcgcttggtcacccaggctgaagtgcagtggtatgatcatggctcactacagcctcgacctcctgagctcaaacgatcctcccacttcagcctcctgagtagctacaggactacaggcatgtaccactatgtccagctaggctttttttatttttttaagatgggggtcwtgctaagttgctcaggctgatctcgaactcctggcctcaagcagtcctcccacttcatcctaccaacgtgctgggattataggcataagccaacaactgacttcttgagaggtaattttgatcatatgatctctcagaatttcatttaaatttctttcatagacatctgagaaagagatattaaagaaggaaagagagagatttcatttaattcaatcaaagttttctctggttaatctaattctgtgccttagtgatgtttactgaaaaaaaaatggtggaatttagaggaagaaaaac

SEQ ID NO: 193516 - DNA, 601 bp, Human
aatattttaacggtctatacaattttctggcttgtaaagtcagtctctctctctgactggctcactttctatctaaaacatacctatctgaaacaacaaacaacacacttcaatacaaacataccagttgaacaagggacttcttatttattttcaattttttgagacaaagtctcgcttggtcacccaggctgaagtgcagtggtatgatcatggctcactacagcctcgacctcctgagctcaaacgatcctcccacttcagcctcctgagtagctacaggactacaggcatgtaccaytatgtccagctaggctttttttatttttttaagatgggggtcatgctaagttgctcaggctgatctcgaactcctggcctcaagcagtcctcccacttcatcctaccaacgtgctgggattataggcataagccaacaactgacttcttgagaggtaattttgatcatatgatctctcagaatttcatttaaatttctttcatagacatctgagaaagagatattaaagaaggaaagagagagatttcatttaattcaatcaaagttttctctggttaatctaattctgtgccttagtga

SEQ ID NO: 193517 - DNA, 601 bp, Human
agagtgatttatagcaattaatgcagaatacacttaacacagacatcaagaaatactatcaaagctgaagcacaattacataaaccatctaggtatcgtttaagagaaagacaaaacatagtatctattctcccgaaggattcatgaatcttccttcaaaattagatttatacctgtgattaatttttttaatttttactaaattatggtatgctcttttgttatagctgatatccagatgaaatttatatttaaaatacaaatgatacttgtatcttaattgatgattccacgtttccamttaacagcctgaaagttcatccatggccatcctattttcttgaatcatcaactataaagtgttcataattaggattttggcaatgataaatgtacttaagcaatggagctcaaactaattcttatttaatggcttttcagtatcaaagtagacaaaattttagtctatcccaaaactagtttgtgctggttaccaaggaacatgggacctggttataaatccatttttctatttgaaatgacactttaaagattggctgcaaactgtgcactcaagatataaacactatatttccatttt

SEQ ID NO: 193518 - DNA, 601 bp, Human
acaatggtttattgttgttctgagtatactcttgagattgatttttgtttaattatcttcatttttatcaacaagtgatcaaataacacaacagttccatgatagcagagggttttgaccacttatgggaaactttaagacactatatatctgctgctaagccatggcatgcacacttacaatgtacagaagtgttgctgtaaaatatgtcagcctttcaaaatgttttcttcagggtttacatcctatgcaattctaagataataaggcaatttacaaacttataaaaaagccaaaatasaaaattaatgatcaaacataaatggaattgtctgaatgactcagaataaattaaagactaccaggcctaaaataagaaaaatatagcatttgactatactaaccttttttctccaaataaattttgtcaatctccctgtttctttttgattaacgttcaatgtttagatctaatcacatcgactaccataataatttatgaaccatcctttatttactaattcccttagtgttacttccttaaccctcatctgcacttaacaattcactgctggatatattatctcattctccagttgta

SEQ ID NO: 193519 - DNA, 601 bp, Human
ttttggtggaaataaccaaagataattgagtgaacgaatagtgtgctccttaactatgacagcaaatgtttgcatatttacaatgtgctggagatacaaaaattagcacaacctggtgcctgtccctgacgagactgcagtttaggagagatggatacacaatcaattaaacaaaaatttatcaaacttagtcatataagcaaagaatggcaggcttagagaaggccagtcattcattcatgtgatgcaagtgaaaattccaataaggaggtgataactgaaccttgaagtaacagacatwcttttgctacaatatgaactttaaaaagctaaggagtaaaaggatcaatcctagagctctgaattgtatatcatcggatttctggttaagttttccattacatgtgctgttggcgcccatcagagagaggttaattttctgatggagctatgaagcctcccaaaggtccttaccaaatcagaaaaccctccaactcaaatatgcatccatggtagactctgtttggaagcgttcccactcactgtttgcattcactgttactagtgctgagtactgtggtgttactgagttatggagaat

SEQ ID NO: 193520 - DNA, 601 bp, Human
ctatagcccttatgcaatcctagagtgcaaaggcttcagtgtttcaaatcctcatacttcctgtaatcgtttcctgattatactgcagatgctagtatgaaaatgtctacttggagatttcctgcaaaactgtttccataaatctccaataacagtgtaaattagaaacgagaattaacctacactcatctgactgccatgacatacagagaacacactactcattcatttgctgtaggtagtcacttcatccacttgaagaacattcgtaagtgataggtggtgtttttaatcataagtyagtaaaatgtgtattttattggtaggttatattttcaatcttctaaatatttctgaacaattgtctgattaattccttagaatgcaagctccatttgttctcagatttcttgccaatatctaggtgaacatctggtacatagtaggtactcaacacaacacatattttttgagtaaatgaatgaatgagtgaatgaacttggctgaatgaatgaatgaaactggatgacaaagaagagaatgcaaaattactagattcttaaatacacaacatgcccccttattactctagtcaaaaaat

SEQ ID NO: 193521 - DNA, 601 bp, Human
cactattcatgtgtggagatactgtggcctggcattaagttgacattgacatacacctctgagagaccctatattaaacacataatctctgtaatgacttcacagatgtctccatgctgccgaaggtcgcactgtgacctcagcttgggcacttagcaacacatgggcaaacagttttcagcgatctcaaaggactgaggtgaaaggattaggggtaatcctctgagtacagtgcatccagggcttacctaaaacataacaaatatgtgcctcagccctcccaaagctgttccctatagcmcttatgcaatcctagagtgcaaaggcttcagtgtttcaaatcctcatacttcctgtaatcgtttcctgattatactgcagatgctagtatgaaaatgtctacttggagatttcctgcaaaactgtttccataaatctccaataacagtgtaaattagaaacgagaattaacctacactcatctgactgccatgacatacagagaacacactactcattcatttgctgtaggtagtcacttcatccacttgaagaacattcgtaagtgataggtggtgtttttaatcataagttagtaaaa

SEQ ID NO: 193522 - DNA, 601 bp, Human
ataaggtcacattctgagattcgaagtacacatgaatttggaggacactattcatgtgtggagatactgtggcctggcattaagttgacattgacatacacctctgagagaccctatattaaacacataatctctgtaatgacttcacagatgtctccatgctgccgaaggtcgcactgtgacctcagcttgggcacttagcaacacatgggcaaacagttttcagcgatctcaaaggactgaggtgaaaggattaggggtaatcctctgagtacagtgcatccagggcttacctaaaacmtaacaaatatgtgcctcagccctcccaaagctgttccctatagcccttatgcaatcctagagtgcaaaggcttcagtgtttcaaatcctcatacttcctgtaatcgtttcctgattatactgcagatgctagtatgaaaatgtctacttggagatttcctgcaaaactgtttccataaatctccaataacagtgtaaattagaaacgagaattaacctacactcatctgactgccatgacatacagagaacacactactcattcatttgctgtaggtagtcacttcatccacttgaagaa

SEQ ID NO: 193523 - DNA, 601 bp, Human
ctccttcttttataaggacactagtcattggatggagggcccactctgaatcaagtatgacatcatctcaaggtccttaattaattatatatgtagaaagcctatttccaaataaggtcacattctgagattcgaagtacacatgaatttggaggacactattcatgtgtggagatactgtggcctggcattaagttgacattgacatacacctctgagagaccctatattaaacacataatctctgtaatgacttcacagatgtctccatgctgccgaaggtcgcactgtgacctcagcytgggcacttagcaacacatgggcaaacagttttcagcgatctcaaaggactgaggtgaaaggattaggggtaatcctctgagtacagtgcatccagggcttacctaaaacataacaaatatgtgcctcagccctcccaaagctgttccctatagcccttatgcaatcctagagtgcaaaggcttcagtgtttcaaatcctcatacttcctgtaatcgtttcctgattatactgcagatgctagtatgaaaatgtctacttggagatttcctgcaaaactgtttccataaatctccaataa

SEQ ID NO: 193524 - DNA, 601 bp, Human
tattatttttttctcacaacgaacccatatctaggaactatcatcctcatttgacaaatgaggaaactgaggcagaaagagtaacttgccaaagttaatcagttagttgaagagctaggatgtgacaacagaccgttgagaggtgcagaataaaaccagaaacaacaggataaatagcaataatataagctaaaatattgtaatttttagttcaaatgtttgaggctttgatgtgatatcttagatatatttccacagaaggtctgtcttaaaaatgtaaaatttaggccttttttgaagycttatttattcttgaaaattctgtttcattacaaaaaggatttgacaagagaaatgctgttctccacttactcactacactgaatgatggggcctcagaaatttgtggtgcagttttccttacactttctgcagtctctcacattcagtgtgtggggtatattagtttcctggggctgccactacaatcaccacaaactgggtggcttagacaacaaaaacttattatctcacagttctgaaggccagaattctaaaaccaaaacgtcagcaaggccatcttccctctgaatcctctagg

SEQ ID NO: 193525 - DNA, 601 bp, Human
attcattattattatttttagaactgcacagctgttttggcagcttgttttgtaaatcctactttgcaaatgtaatgaggtttttttccaaacaaatgttagttaatggagcagataacacatttatttccttgtcatagcttagcattaaataagaaatgtaacaagaattcagagtttaaaatatgaaacatggtatttggtctctttacttactagttacaaaattagaaaataactcaatattttactttctctccatatatattataattatctgtaattataaaatatttttcakaacttcatttcttgtcacataagtcttttgctactgtaaaatcaatagttgtattactagtgcctcttcaaagcaaatctcaagtcgctgagcagaaatttttatagtatctgacatgatttaggcacttcttatgtgcaaaatactgctctgaatgctttacatttatgatattatttttttctcacaacgaacccatatctaggaactatcatcctcatttgacaaatgaggaaactgaggcagaaagagtaacttgccaaagttaatcagttagttgaagagctaggatgtgacaac

SEQ ID NO: 193526 - DNA, 601 bp, Human
gttaaagactgaaaatcatcactatgttaacatatattgatgaatagacattatgtatgtaacaggatttttttaaatgacaaactttgactaaggcatcagggaatagatatgaactctaaaattttattccagaaaatatagaaatctgaaaataggtaacacagaaattgattacactgctctaaattctacaaggaagacatagaaagtttaagagtagggcttggtaatttcttcatctaaaacctagagaaagggcttcaatagggccatggagagtttttgatcttcttcccaytgtactgagaagcacagtacaccaacgtcaaaatatagtcccacctaggaacgtagaaagcaagggcaaggagctcatcctatattttgactgaacggcattcccaaagctggtcaagacagaggagaatgagtgtataatacttctagaatagatgtgggccacatggcaaaaaagaaccagcctagagtcttttaaaactccaatgcaagagaacagggtaagaggaaacgaggctttaataggaaaagcctacatatggtagaaagtggaaaaccaagagctgatggaaaagtggtt

SEQ ID NO: 193527 - DNA, 601 bp, Human
cattctttcctccttgcgtgtattcagagcacggaagtccaccgcccagcatctgtatgaggatctggctgtcacagtccctgcagctcctatcccgtacacatacatttccctgttttctttttttgagacagagtctcgctctgtcgccctggctggagtgcagtggtgcgatctcagcccactgcaaccttcacctcccgggttcaagcgattcttctgcctcagcctcccaagtagctgggaatacaggcgcctgccaccatgcccagctaatttttgtatttttagtagagacggrgtttcgccatgttggccaggctagtcctgaactcctgacctcgtgatccacctgcctcagcctcccaaagtgctgggattacaggtgtgagacaccgcgcccagccacatttctcctttaaaggttttacgctgttaccaatcagtcagcttacctacgttaaagactgaaaatcatcactatgttaacatatattgatgaatagacattatgtatgtaacaggatttttttaaatgacaaactttgactaaggcatcagggaatagatatgaactctaaaattttattccagaaaatat

SEQ ID NO: 193528 - DNA, 601 bp, Human
gcatcgtaatgactgatcaccatcagccagataattatacaggctgaagatgatttttacaaacataaaacctaaaatagatgcctcaaggttaacacatcctaattatcttttgtataaacatcgtataaacactctatactctatttttaaaggtactgctaaagaaaaaataaaaagaaatagagttaataaagattatttgctatatccagagatatactgaaattccagaataaatcttcctattacattattacctatcaaggtagagcagagtaaaaattccaccaatacaagmatctttgtaaaataacatatttaatatgcacacttaccaaaatattacagtgagaaaatcagtgacaagtatttatgtatataaaatgtgtagagtaagccataccaaaaataaataacagagaaagtacttcaaaaattccatatttgcctactgtttatatacctcacaagaactatacctattaacacacttgagagaagatacatagtaataaaaataggaacgtggtcacactgatggctaatcagaaaaactatttggtgtaaaccagggtcgtcagagtttaagaatttggca

SEQ ID NO: 193529 - DNA, 601 bp, Human
gcccgtgtccttcctgctcagtggactgattcaaggatttgagtcttcaggatgttaagtgagtgaattaaaaaaaaaaaaaagtagaactgaaaacagtgaaaaatgcctgtcatcagcatcgtaatgactgatcaccatcagccagataattatacaggctgaagatgatttttacaaacataaaacctaaaatagatgcctcaaggttaacacatcctaattatcttttgtataaacatcgtataaacactctatactctatttttaaaggtactgctaaagaaaaaataaaaagaartagagttaataaagattatttgctatatccagagatatactgaaattccagaataaatcttcctattacattattacctatcaaggtagagcagagtaaaaattccaccaatacaagcatctttgtaaaataacatatttaatatgcacacttaccaaaatattacagtgagaaaatcagtgacaagtatttatgtatataaaatgtgtagagtaagccataccaaaaataaataacagagaaagtacttcaaaaattccatatttgcctactgtttatatacctcacaagaactatacc

SEQ ID NO: 193530 - DNA, 601 bp, Human
tcaaggtggtaaatattcttccctggggctttgtgcatggtacaccctcagtaaatattaaatgaatggatgtatatctgacactgggcgtgtcaaggcttcggaaaatttacttccactcccataaaacttcttctttaaaaaatgcttgcaaaaataatagataggaggattcaatttgtgtttgcaaccttgagacagcaagctgaggaactggtttgtctgcttgctgcccgtgtccttcctgctcagtggactgattcaaggatttgagtcttcaggatgttaagtgagtgaattaaaaaaaaaaaaaagtagaactgaaaacagtgaaaaatgcctgtcatcagcatcgtaatgactgatcaccatcagccagataattatacaggctgaagatgatttttacaaacataaaacctaaaatagatgcctcaaggttaacacatcctaattatcttttgtataaacatcgtataaacactctatactctatttttaaaggtactgctaaagaaaaaataaaaagaaatagagttaataaagattatttgctatatccagagatatactgaaattccagaataaatcttcctattac

SEQ ID NO: 193531 - DNA, 601 bp, Human
gttaaaaaataaagacaaaaagaccaagtttccctggggctgaagctgggttatgggcacagacaaacatagggcctctaagagagtcctgcatgctaggcaatatttagagttcttcctcaccagtagctcaggatgcattcagatgtaagctcgaggagtcacgcagcatctcttggcattattggttgtttgcacatccatgtctgtagctggactgcaaaccattctcaaggtggtaaatattcttccctggggctttgtgcatggtacaccctcagtaaatattaaatgaatggaygtatatctgacactgggcgtgtcaaggcttcggaaaatttacttccactcccataaaacttcttctttaaaaaatgcttgcaaaaataatagataggaggattcaatttgtgtttgcaaccttgagacagcaagctgaggaactggtttgtctgcttgctgcccgtgtccttcctgctcagtggactgattcaaggatttgagtcttcaggatgttaagtgagtgaattaaaaaaaaaaaaaagtagaactgaaaacagtgaaaaatgcctgtcatcagcatcgtaatgactgatcacca

SEQ ID NO: 193532 - DNA, 601 bp, Human
cctgcctatctctagctttccctatcacctctgccttccttctttctactaatggtatcttccaacctttacttaatttactcctaatttttcctttagatatcaattcaaatatttctgtttggggggaagtctttcccaaccctcatccccagattagatcagtccactctcatgtatcacatctgaatgttttataaacaaacacaaaggcaacttaatgcaggagtctgaaagacatacaatatgtcccaaggaagaggtagagaagctgaggacactagttttgcagcactgtaaraagaagtatcccaaaggattcagaatttcccaggctacagactgactccttggtttactgagacgtcttaaaacggctcttcaaagctgatctcctaattgtgattcttgcctagaatctgatctggtcctactcatttctcttatccagttctagggttttctgggaagacaggagagggaaaaatattgactttcctccaagtgatattaggaatgactaataaaaataatggtgagtcctggaaaattcagagagctgcattaaaaaattaatggcccgagttccttggagtcatct

SEQ ID NO: 193533 - DNA, 601 bp, Human
gacagatgaatggatggagggaagaaaagtgggaaggaaggaaggaaggaaggaaggaaggaaagaaggaaggaaggaaggaagataaaagaatccactaattcaatgggaagaaaatagggagatataatgggtgttggtggatgttagaattccaccaaaaacacctcaaattccatttaaattgatttgatatgtaggtttttcttgcccttctgagtttctcagatagtatattggcaggcagcctcattccctgcagtaaggatggttcttaaaaaactggaccaaaatcaatcarttagacattgccaaagatttctctccaagtgtcatctaaaaatcattaactgtggcatgaaatatcatggacattgtataagacatccatgcatcatttttggttaccaaggaagaataagcctcatgtttgaaactacagagcctccttcatgtcatgtatttagtaacatccagtacatctgctggctttgtatgaattcagaggttcaagcactcttcaaattcttttctcctgtattctgtgttattcgcccattaaactttttctgagtcgacataagtatctgcattgttgaat

SEQ ID NO: 193534 - DNA, 601 bp, Human
ctccaaaccaattaaatacgcatatgagtccagggatgaagtttcttttttaatgctccatgaagttctcaggtgcagccaagttgagaaacattgatttaaacaaaacaatgaaatatcatgctggctatgctggaattttctgaaataaatgaaattgagttttgaaattaaatcagaggaaataaacttctaataccatatatgaaaactccagtaagacattacttaataccctacagattttaggatcaaatggaaagacacattagtctaaatatgccctctaaggctcataaaygcagtccaacaaaatatcttattcttattcttctttgactcaaaatcatcttaaacagttaatatcagtatgcagaataaaactgaactttaaagttctgcaaaattaaagcaaactttccttactgagcctaaagaggatctaatgtgtcatatttcatctttaaagcctgaaacactgttttcccctaggaaaaatcaaatgaatcaatcctcccatcaagtaaactaatatctcattatgacttagattcttgttaaaaatttggcagagtattccgatttgttttcatatatcacc

SEQ ID NO: 193535 - DNA, 601 bp, Human
tgaggcaggggaatcacttgaacccgcgaggcagaggttgcagtgagctgaaatcacactactgcattccagctgggtgacagagtgagaccctttctcaaaaaataaataaatacataaataaaataaacaatagcagttaaaaacagtatagtttgtttataataaaaacgtatttaaagcataagcagtatgtagttgattcattttctttaaaattggagaaggttaatattggataccttaatcttttgctctgttgtaatccatatgaagatttaaaggtttttgaagcattttrtttttatactattaaagaaagtataaaaacttttgggtgactcaaaagcagattaacacaaatgggcagattgatgactagaagttcctcaagtaatgatatatgaaagaaattcatgttccacataaagagaaagaaagcagtgaacgacttgtgaaaatcgtgtttctataaatctttgaatatgatatgctgtcatcaatgcttagcaactgcagaaatatgcgtcactaacgaatcagattttattaaatgtatgtgtgatgtgtgtgtttgcatttgcacgtatatttatccccc

SEQ ID NO: 193536 - DNA, 601 bp, Human
acgacaataaatataatttaaaagatagggctgggtgcaatgactcatgcctgtaatcccagcaatttgggaggccaaggtggatggatcacttcaggccagaagtttcagaccagcatggccaatatggcaaaaccccatctctactagaaatacaaacattagccaggcgtggtagtgcacgtgtgtagtcccagctactaaggaggctgaggcaggggaatcacttgaacccgcgaggcagaggttgcagtgagctgaaatcacactactgcattccagctgggtgacagagtgagamcctttctcaaaaaataaataaatacataaataaaataaacaatagcagttaaaaacagtatagtttgtttataataaaaacgtatttaaagcataagcagtatgtagttgattcattttctttaaaattggagaaggttaatattggataccttaatcttttgctctgttgtaatccatatgaagatttaaaggtttttgaagcattttatttttatactattaaagaaagtataaaaacttttgggtgactcaaaagcagattaacacaaatgggcagattgatgactagaagttcctc

SEQ ID NO: 193537 - DNA, 601 bp, Human
tcaaactcttaaattccaatccttacggtaccctgtgtgattcagaaccagtgaagcttgcatattggtaaggtagtggtaaaatttaaaaaaaaaaaaaaaagcaaaacgaacagaaatgttacaaagtaaaggttgtttttgtttgtttgtttgtttgtttgcaggggagagaggaaccaggaaaattttgcatgaggaaaaatataagacacgacaataaatataatttaaaagatagggctgggtgcaatgactcatgcctgtaatcccagcaatttgggaggccaaggtggatggrtcacttcaggccagaagtttcagaccagcatggccaatatggcaaaaccccatctctactagaaatacaaacattagccaggcgtggtagtgcacgtgtgtagtcccagctactaaggaggctgaggcaggggaatcacttgaacccgcgaggcagaggttgcagtgagctgaaatcacactactgcattccagctgggtgacagagtgagaccctttctcaaaaaataaataaatacataaataaaataaacaatagcagttaaaaacagtatagtttgtttataataaaaacgtattt

SEQ ID NO: 193538 - DNA, 601 bp, Human
tactttgccagaagtctccctttgaagagtctttccatggtcacaggaaaattggctttctcctgatttcataacaaggaatacaaatttacactttatacaagattagggtgagcaaattctaaacgatattattctatttttgaacttcggcttgacttctgagagggcttgacttctgagagggcttgacatgcagcaaatgtttgagaatcaaactcttaaattccaatccttacggtaccctgtgtgattcagaaccagtgaagcttgcatattggtaaggtagtggtaaaatttaaaaaaaaaaaaaaaagcaaaacgaacagaaatgttacaaagtaaaggttgtttttgtttgtttgtttgtttgtttgcaggggagagaggaaccaggaaaattttgcatgaggaaaaatataagacacgacaataaatataatttaaaagatagggctgggtgcaatgactcatgcctgtaatcccagcaatttgggaggccaaggtggatggatcacttcaggccagaagtttcagaccagcatggccaatatggcaaaaccccatctctactagaaatacaaacattagccaggcgtgg

SEQ ID NO: 193539 - DNA, 601 bp, Human
gattaaataagtaccttcccatatcttttgggggtaattttatcagtatcaaaagccctgtcagagtctcagcattagcatttagctatagaaccagaattttgaatttatgtcctagttttgccaccgtgttatttagacccaatttcctattcaataacaatcaaaatatagcctgtccatcacccagatgatctctatatcaacatcagagagtggcagatgaagctctaatccctatatcagttgcacacatattgcttgtaatcgtgcacatccctgacttttgagtaatttctcrgaaacccttacccatcattatcttgggattttgacttcttaaagaatagatttctccatatcttctcttcagagccattttaacttccacttatggtgcagtggtggctaagtgtagttcatctatttcatgaaaaatattttggtgctgattttgctgattggttgagttaaccaaatgttctagttatttgactagggagggttttttgtttgtgtttttactcttaagcataaacatactactttgccagaagtctccctttgaagagtctttccatggtcacaggaaaattggctt

SEQ ID NO: 193540 - DNA, 601 bp, Human
aactagctacaatgaggcagagtcttacttcccatgcaaattagtcatttactttgatttccagcttctgacttataaatatgcataattttataattgttaaataatagaaactttcaataatctgaccaagtatacattgttccttttaatcttttgatacttttgcaataattcattgtcttattgatttgtaccctctatgcaaatctacttccccattactcataccgcacacacacacacacacgtaaacctataagcaacatacttgttactgtatagatatttacatattttatgtttacttataaatataaattgtacatattttatatatttatatattttaagtaaaatatgcgggtttactttctttagaaatgatgtgctctatactaatttgcatgttatttggtatggcatatgccatatatttaaagcatttaatggcaaaaaaactttttaacatcaagtttctcttgctcccttaaaaatgctctttgagccattttaattagactgaaatgaaatagattccttaggcaacagcataaaaatagtaaagtaggttttaaaagtcttattggagaataatttc

SEQ ID NO: 193541 - DNA, 601 bp, Human
ttacaactagctacaatgaggcagagtcttacttcccatgcaaattagtcatttactttgatttccagcttctgacttataaatatgcataattttataattgttaaataatagaaactttcaataatctgaccaagtatacattgttccttttaatcttttgatacttttgcaataattcattgtcttattgatttgtaccctctatgcaaatctacttccccattactcataccgcacacacacacacacacgtaaacctataagcaacatacttgttactgtatagatatttacatattttatgtttacttataaatataaattgtacatattttatatatttatatattttaagtaaaatatgcgggtttactttctttagaaatgatgtgctctatactaatttgcatgttatttggtatggcatatgccatatatttaaagcatttaatggcaaaaaaactttttaacatcaagtttctcttgctcccttaaaaatgctctttgagccattttaattagactgaaatgaaatagattccttaggcaacagcataaaaatagtaaagtaggttttaaaagtcttattggagaataa

SEQ ID NO: 193542 - DNA, 601 bp, Human
cacagaatgatttaggctatgaaaattattcactttagaaaagaaatgaatcatgtattattgttaacataagatttgtcattcatttataactggtttaaaacagctatttgtaaaaccaccacagtattttaaaaattaattaactttaacttgacgaataaaaaatgtatatatttatcatgtacaagatgatgttttgaaatatatatacattgttgaatggctaaatggagctaattaacatatgtatctcacatacttatttttttgagatgagaacacttaaatccactctctyagtgattttcaagaatacattgttattagctatagtcaccaccttgtaccatagttctcttgaacttattcctcctatcaaactgaaattttgtatcctttgaccaatatctccccaacccctcctctccccaagacccaggtaactaccattctactctctgcgtctatgaattcaaatatttagactccgcatatagatgagatcatgtggtatttgtctttctgtgcctggcttatttcatttaacataatgtcctctaggttcatttatggtgtcaaaaatgacaggatttcccac

SEQ ID NO: 193543 - DNA, 601 bp, Human
aagaaaacagggcacctgttcatatttggtcaccaaagaatgttctacatttaattaaccacttaatatttacaccttgagaaaaaattatgccacaatacaagcataagtgtttttgataaatattcaaatattagaaaaatatattaagatttaaatatttcaagtttgtttcagccataaaattctgatcatactctccctatctacctaattgctgctaacaataattcaaatgccaataatgatatatttagataattgattttaaagaatttatcaaacaaaaaatagaggatayctataggtatcttctttttctggagaatcaaaacatagtataaaatggaagctttctttgtgctgtaaagaattcaatacattatggggcaaataaatctattttgaaggtttttttttaatttctggtagactagaaaggaaggatccaactcggatgttcatttatttaaaatcaaacatagaagattaaattcatacaagccaaagaacatctggcccttccagaaagagaatagagttctaaatgctgaaatcaggtgaagcatacttaattactggtatccagaaagagcaaaag

SEQ ID NO: 193544 - DNA, 601 bp, Human
taaatgacagctgaataataaaacactattatagagaactcaagtatgaatctagtatttcattttaaaaacttgtctgattatacttacatatacaatactgcatgcagcagctactcgataaacgtgtgtaaaagattaagtttggtcaaacaattgctctgaatcaaatttgtgatataattcctgactcagcccccacagaatatttaaaatatagtaatacagtaaaataatttttccaccacttcatgaacagtcagtagggtcttgaatgctacctttcaatatgcaatatggwggccttaggaagagaggagttttttttttctcaacacgtagaatcagggtcttaagaatgactttgtgaaaactccagctttcgttgctagggaacattgattgttttccatggtgcttgtaaaggcattatttgccctgattcttttgatgagttgagactgttcacatagtaacttcagaatggaaagaacaaacccctctcttcctctggtggcactttgcctactgtcagactacaaaagggagaggcatgtgaggtgaccctctcaatgttgtctgaacaatgaggcaatcatta

SEQ ID NO: 193545 - DNA, 601 bp, Human
aaccccatctctactgaaaacacaaaaaattagccaggtgcagtggtggacgcctgtaatcccagctactcagaaggctgaggcaggagaatcgcttgaacccgggaagcagagattgcagtgagccaagattgtgccactgtactccagcctgggtgacaagagtgaaactccgtcaaaaaaaaaaaaaaaggagagagagagaggaaagagagagagagagaaagaaagagagagaaagagagaggaagaaagaagaaagaaagagaaaaagaaagaaagaaagaaggaaagaaagaagaagaaaaggaaagagagggagggagaaaaggcagggaaggaagggagagaaagaaagaaagaaggaagggagggagggaaggaaagaaggaaggaaggaaggaaggaaggaaggaaggaaggaaggaaggaaggaaggaaggaaggaatatcctaaagcaactctcaggaaacaaaacagaatgttgaggaaaggagactggtgatgtgcaatggtgctaagacttgctgatgggaaacatttgtgtagcacaaacccaaatctgtaggcatgcttgcagcctaatcccaaatagtcaac

SEQ ID NO: 193546 - DNA, 601 bp, Human
tttgactatggtataaattgggtttcatggattggtttcaattctgaatgcttttctggagccaaagctcacctcagcactcttgggctgcatgctgtaatcctgggggatgggggattagtcctgtggctttgctctctggccccttgagattaagcacctgctgtgctggaggtgctgaggtgttcccagttcacttgcaacaacactctggcaggggctgctggcaaaattgctccagtggggcagtgggagtctccacacacatgtgcaccaatggaggaggctgcaggcgagtacrcatcagtagggggaggctgagggtgggtgtgcactggcagggaaagactatgggcaggtatgcactgacagggggaggatgcaagcaggtacgtgctggcaggggaggtcatggttggagtgtgccagcagggggagacaatgggtggatgcataatggtaggggtccaccaggtcgttttcttactccaagtttcagttttgttaacctgtactataaaatgactgaactgtaatttttaaagttttcttaagcagaaagacttcaattattttatttgatgtgccactggacagactt

SEQ ID NO: 193547 - DNA, 601 bp, Human
tattggcctgttcaggatttcaatttattcctgattcaatcttcggaggttgtatgttttcaggaatttatcaatttcttctagatttctggttgtttttttgagacggagtctccctgggtcgccaggctacaatgcagtggcgcaatcttggctcactgcaacctccacctcccaggttcaaatgattctcctgccttagcctcctgagtagctctttccatttctttcaggaatgacaggtgcatgccaccacacccagctaatttttgtgtttttagcagagatggggtttcaccawgttggccaggatggtctcgatctcttgaccttgtgatctgcttgcctcagcctcccaaagtgctgggattacaggcgtgagccactgcacttggcctcttctaggtgttttagttggtgtgcagagaggtgttcataatagtctccggggaatttttgtacctctgtggggtcagtagtaatgtcacctttgtcatttctgattgtgtttatttggatattctttcatttttattaatctaccaagtggtctatcaatcttacttatccattcaaagaaccagcttttgggcttgttcat

SEQ ID NO: 193548 - DNA, 601 bp, Human
gtttggtgtacacatgattttgttacccagatagtggcatagtacttgataggtagtttttttgactctcgccctcctcctaccctccaccttcaaataggtcccagtgcctactgttccattctttgtatccatatgtactcaatgtttagctctcactgataaatgagaacgtgtgatatttggttttctgttcctctattaacctgcttaggataatggcctgcagcttcatccatgttgctgcaaaggacatgattttgttatttttttatggctgcatagtattccacgacgtacrtgtgccatgttttctttatccggtccactgttgatgggcatctaggttgattccatgtctttgctattgtgaataatgctacagtgaacatattactatgtgtatctttttggtaggataatttatattcctttgggtgtacattcactaaagggattgctgggttcaatgatagctctggtttaagttctttgagaaatctctgggctgcttcccacaatgggtgaactactttacatttccaccaggagtgtataagcattcccttttttccacaaccccaccagcatctgttatttt

SEQ ID NO: 193549 - DNA, 601 bp, Human
ggaaagagttctcataatttgtataattccatagtcaaccctagcaagtgaagattaatcaatggtgggctcccatgcacgtgtatttatttatttatttatttatttatttatttttcttttccactttcttttaggtccagggggtacatgtgcagttttgttactttagtacattgcacatcactggggtttggtgtacacatgattttgttacccagatagtggcatagtacttgataggtagtttttttgactctcgccctcctcctaccctccaccttcaaataggtcccagtgyctactgttccattctttgtatccatatgtactcaatgtttagctctcactgataaatgagaacgtgtgatatttggttttctgttcctctattaacctgcttaggataatggcctgcagcttcatccatgttgctgcaaaggacatgattttgttatttttttatggctgcatagtattccacgacgtacatgtgccatgttttctttatccggtccactgttgatgggcatctaggttgattccatgtctttgctattgtgaataatgctacagtgaacatattactatgtgtatcttt

SEQ ID NO: 193550 - DNA, 601 bp, Human
tgatgcactataaattttatggatctaagtgaataaaattttaaaaaaaaaaacctgagttcttggagggctatgcacacagaaggaatagatgaaagaattaagatgcgaacccaagaatgtctttccattttaccaagccatactggtaaaatgtttatttatataatggtacaaaacaagcatttgagaaaagcaaagaaaaatgattatcttcctccagtgataggtgggaatccttcacatttgttcctttaactgacttctctcatagggaaagtggaagagctaaaatttagaygcaggtattctggcccctgtgtttctctaaaacctcataacctactattggctaatcaagtgtgtgttgatcattgcagatttttatttttcagaaactctaaaattgttttttagagtactgctaccaggttagaggtcaactatcactattaagtgatacaatacaacattttgaaaattaattacagatcctggagactaagaagatccatgttatgtagtttaaaatgaggtaaatgtatatttctatgagcaatttataaatggctattgtaagtaatttgaatggtcatggaaa

SEQ ID NO: 193551 - DNA, 601 bp, Human
gggaaactagacactacgagagccaatacatttgcagtcacagagttcaattacgtttttttaaaattaacttattcaatcctcacaataattttccgagttacatatgtagcataatcctcatgttacagttgatcagataatttcaggctatggtagagcttattatattgtgagattcctcacctcatgattggagctcattgagagtaaggacattctatactaaacctaagttgtctaacttctgggacatggctgatgcactataaattttatggatctaagtgaataaaatttwaaaaaaaaaaacctgagttcttggagggctatgcacacagaaggaatagatgaaagaattaagatgcgaacccaagaatgtctttccattttaccaagccatactggtaaaatgtttatttatataatggtacaaaacaagcatttgagaaaagcaaagaaaaatgattatcttcctccagtgataggtgggaatccttcacatttgttcctttaactgacttctctcatagggaaagtggaagagctaaaatttagatgcaggtattctggcccctgtgtttctctaaaacctcataac

SEQ ID NO: 193552 - DNA, 601 bp, Human
gtggacacatgttataacatggatgaaccttgaaaacatgctaagtaaaagaagccagccataaaaggctacatattgtatgattctacttacgtgaaatgtgcaaaatagacaaatccatacagacagatagtaaactgatggctgccaggggctgggggaaggatggaataggaagtgactggtagtgggtatgggatttattttgggggtgatgaaaaccttctgaaattagatactggtgatgaatgcacaaccttctgaatatgttaaaacacactgaagtctccaatagctcctyaccacctgcaaaaaaacaaaaccctaaatttcctgacttggtatatgagacccattcttctatagcctctcttcatgcgtcctatacccaagactaagtgaaccattgctcttttgaagtcctggtatgcttttttccccatggcttagggcattttttgaatatctttgtttcatgcatgattaccataatatgtcacatagtatcggtactctatgcctgaatgcccagtaaaaaagcaaactatttttttcaaaacacagtatcctttaaattttgtatgtagcaatctccatttga

SEQ ID NO: 193553 - DNA, 601 bp, Human
ctgcttggacctttagaacatcataaatagtcctttaaatatctacattttggacgaagtgacttaggaaggcttaaagctggggcaaatcaagagaacaatatgcatgggtaatataaagaaagaaatatagttcaagtcttggacatctaaaagtaaaatgtaattcaggtcaacaaagatttactgaagtataaaatatagaagaaaatatcacgaaaatatttaagatacaatcctgtctctagttatgactggcagtgtaaaggtagaatataacaagtataaaatgatcatgatrtaaataccaccaaggttatatggtgtgaggattcgaagaagcaaaatataaacaaaaacaaacaaaaaatagattagcaaaagaaatagagaaacatttgatagagatttgccttataattcaaattacatttttaccaggaaaggtgtggtatgaagaggaagccacaggaacagagaacatgacaggtgtgacatgtattcagatactatccataaatcaaatctagagagaatacaagtaaatggggcaagaagtgggagacgagactgtaaaacttggtggggtcatcctgataag

SEQ ID NO: 193554 - DNA, 601 bp, Human
tctccaatttcctctttgctagagttgggtgaccttttctgtttgacaaagcctcacaaggctaacccacacacacattcatacatgattggtatttctttttattttaagtgttcttcatgttccggagccttctcaccttaaagccacaaattctgcacattctcttaggctcttatatgcaagccattaatctgacagatcagccaatggaaaaatggtaactaggttaaaatgctatgcatacgtagtactaattagaatttaataaggccttactcaaatgagagacactattatmcctgtaagcaccatgacagcgcagggatgtgatcagtatctttatactaaggtacgttaataaacaccagtggtgctggagggaggaagagatagccatcatgaataaccaactgcttggacctttagaacatcataaatagtcctttaaatatctacattttggacgaagtgacttaggaaggcttaaagctggggcaaatcaagagaacaatatgcatgggtaatataaagaaagaaatatagttcaagtcttggacatctaaaagtaaaatgtaattcaggtcaacaaagatttact

SEQ ID NO: 193555 - DNA, 601 bp, Human
ataatttactattgcctaaactttcctactccatattgacttttaactttatgtttcaacttatgctttcattccacttggattgaccaaactttgtcttctgttaccatctcctccaaattctcctcacactataattgtcccaaacaccatttccttctgaagccttccttgatccatcaaatcttaagtagttttgatccactctgtactaccttaggtttttattccgcctctcatacatcactcgacatactgagataacatgcacacacagacaacatattagttgtcagttacsaactatcatccatctagttggttaaccaaaaaaataataactgacttctataagataagaactgtgctaagctctatatgactggtaaatattggttcattgaaaagaagccttagaaatttgggggtataaatatgttttttaaaagtttctttgaaggatttttgaacaaatggaaacatgatgttaaatattccaatagtctactgaagatgataatctgtgaatcctctcctttccatcttcaaggcaattcctctattattactctctttattagatgaaatgagacacaaataa

SEQ ID NO: 193556 - DNA, 601 bp, Human
gctgccaagtctctttgccatcatgtcaataatggttttatgaataacttagaattaagctttagtattttattaggaaaaatatataaaatcaaatttgaagatgtttctctgaattgctttgctttaaatagttttgtaacggtacacatgcatttagttcttttaaaatcctaatttaaaaggatcaagggctcatcactgccatcagtaattcatgatatatgacatactaattaattcttgtcacttttctttttttcttttcttttcttttcttttttttttagatggaatttcrctcttgttgccaagactggagtgcaatggcatgatctcggctcaccgcaacctctgcctcctgggttcaagcaattctcctgcctcatcctcccgagtagctgggattacagacgtgtgccaccatgcccagctaagttttgtatttttagtagagatgtggtttctccatgttggtcaggctggcctcgaactcccaacctcaggtggcccacgtcggcctcccaaaatgctgggattacaagcgtcagccaccacgcctggcccttcttgtcacttttctacgtcaggaaatcacgtt

SEQ ID NO: 193557 - DNA, 601 bp, Human
tacatacagtatgcaagagcacagtggttaagaacatttgctttcagccagataaacctggcttcacatccccacccagccgataactagctttctggcactgtgcaagtcaattaaccacacaaggccttagtttcctcatccctaaaagagggataatgaaggtacctctttcataagcttgttttgaggataaaacgagttaatccatgcagtgcacataaaactgcccaacaccttaagcgctatatgagcgtctgctgttgtttttgttgttgttactatttttaaactgaataaktactttttccatattcttctcaggttcagtttgaatctccactcttttcactttgtaccagccggtaaccaaattcaagctgaagcaaagaggtctaatccaggggaagaagtgggcacaagagtttgactctattactgtgggtaaatgctctttattagagagcaaagaggaacgtagacaacaaaataaaaacacatggagctgtaaaacacctgcaggcaggtctcaatggctgccaagtctctttgccatcatgtcaataatggttttatgaataacttagaattaagctttagt

SEQ ID NO: 193558 - DNA, 601 bp, Human
ttctattatgtacaaggcaccttgctagaccctaggaatatagttcacaaggagctcagataacacagtaaatttaggaaaatttactttcctctgaaaccaatttccagaccattgttacaaagacaatgtagtgtattgttatattcaatgacagaaaaacaccatctcctcccatttacatttctccaagtgactatttcttttattttttctcctcgcacaaagaagtattattaaattattgttaaccagaattttatgaattggacattgtcacacatccagccatttgttatcyaccccctggtaatggaggttattccctgccacccagatcttgttttactatccattgtctttaacaacaaaatggaaattatttttccagctcttagtctgaaatcaaaacaagatcactcttgcatggaaagtaaatgaatttgcacatcgttccatcaaatgaaatacatatcataaaatttgtatgtgctaaaaaacttggtttccctttatataaaattttttataacgtgtaataaacaatacctttaaaatgctacataatcagaaacttctataaaagatttataaaaagaaa

SEQ ID NO: 193559 - DNA, 601 bp, Human
acaggaattaattttaagactcctccttcttcactttgctgccctcctctctatgcatcccactatcttatctgtattaaaatgttgaatatagtcatgattaattcattgtacaagcacgtgagtttctattatgtacaaggcaccttgctagaccctaggaatatagttcacaaggagctcagataacacagtaaatttaggaaaatttactttcctctgaaaccaatttccagaccattgttacaaagacaatgtagtgtattgttatattcaatgacagaaaaacaccatctcctcycatttacatttctccaagtgactatttcttttattttttctcctcgcacaaagaagtattattaaattattgttaaccagaattttatgaattggacattgtcacacatccagccatttgttatctaccccctggtaatggaggttattccctgccacccagatcttgttttactatccattgtctttaacaacaaaatggaaattatttttccagctcttagtctgaaatcaaaacaagatcactcttgcatggaaagtaaatgaatttgcacatcgttccatcaaatgaaatacatat

SEQ ID NO: 193560 - DNA, 601 bp, Human
ggtgaaaagaaatacatatatatttgctgctgtctgtctgccccctatactccactgtgtgaaaatgcagtaaactgggctaataacttatagcacaatttgcacagtcaaaatgaaggtttctgctagataccattaaactcaaaggtcacatttaatataaaccttttatcctgcctggactcaaagcagtttcaggatttgtcatttaacagtcataaataatgtgcctcattttgtggcatcctggagactgagaatctctcatattttcttctcaacattaaaattcacaaaaatggggggggggttaaaaaaagaaataaaaagataacttggtaatttctgttgataatttcaaaagctggtccttgagctttggtggagacaatctcgttagcatcagtgatgtgtaatacaataaagagaaacacacaaaaatcaaacaccctgtctggagtggcagctgctcttgtcagagctatctgtctcgtgccagtcccagaagtgcaatggtaccaatggtctttgtcccatgttcttcctgcagcaaaacttgtcaggttatgatgtgccaatctttatcaatgtctacagttct

SEQ ID NO: 193561 - DNA, 601 bp, Human
cacttatacagacgtgcacagcagggcctacctttaaatactgaaatctctgagaagttgattgctcttccaatcacttatctggctgcaaaccgctgagttgttgccatgattaacagttattctttcatagacaataaaaacaggaaggttatatagtgaagatttaaagctagaaacaaatatattgataatgaatacgaacactgtcattttgcagctatgaaaactgaggacagtgtagggaagagatttcccataaaacgtcaactctgatttagttcaggcagttagtttcagraaaaaaaaatgtattaaatgtgttatgtaaaacggtgtggggagaagaatggttaagtttaaataacttgttatttagaagatggtaggtgaaaagaaatacatatatatttgctgctgtctgtctgccccctatactccactgtgtgaaaatgcagtaaactgggctaataacttatagcacaatttgcacagtcaaaatgaaggtttctgctagataccattaaactcaaaggtcacatttaatataaaccttttatcctgcctggactcaaagcagtttcaggatttgtcatttaac

SEQ ID NO: 193562 - DNA, 601 bp, Human
gggattacaggtgtgagccaccgtgactggcctttattttttgtaaacataaaaatattgtaaaatattgttattttaacaatacattttaaagaaggtattagatctgctgcatggtcatttttaaatgctttaaaaaagacataatacaaaatagctttccctttcaaataacataataaatcctacataattgcatattttagaagaaataggaaaacacgaaagtttagactcttgctacaaagtgaagtctctcccacattaaacacaggaatgttaaacagcctatagcgttctyccaaatagcccattgtgcaacttgaacaacatgtatttgcaatttaacttctgttttgcctaacttctttttcaaatgcatcctctctgtgttgcaacactgtcacttatacagacgtgcacagcagggcctacctttaaatactgaaatctctgagaagttgattgctcttccaatcacttatctggctgcaaaccgctgagttgttgccatgattaacagttattctttcatagacaataaaaacaggaaggttatatagtgaagatttaaagctagaaacaaatatattgataatga

SEQ ID NO: 193563 - DNA, 601 bp, Human
cttggaatgctggaacagtgatatttgagctgaagcttttgcagaaggagggattcttcaggtacaaaagttgttggacacggagcgatcccggcatagccaaaggcaaatgcagagaagtatgaaatgttcagtgtatttggagagtggggagaagtgaagtgtggctagagcatatggcatgtagggggaataccaggaagtgttgctggaaaagcagtcagggccaaaatgtgaagggtcatcgatactttgctaaagggcttggcatttatccagcagaggatgaagatctgcaacrgggatccagcagaggtttttagcagggcagtgaaatgagtggatttgtttttcaggaaatatttccttggcatcagagtggctgatgaattagagttgagagaaactggtgtcaagacttacagcaacagcctcctacctgggctccctgccaccatttcagacacgctgaagtggaggtgcctgcaggacactcagtgtaaaccacactcacaaagctaagcagaggaaaatcctacttagggccagataaattacagggtaattatttccactgcagaaacattctctgcttcataaa

SEQ ID NO: 193564 - DNA, 601 bp, Human
gtcctgagaaagccccttagcatttgaatatccatccattcatcagtgaaacgaaaataatacttcataattgtattgaaagtccttaatgatatattatttgtagagcatatagtttctgggatttagtaaacatccaaatgttatcaaccttcaacataaaaagattatgatgtcatgcctcctaaacttaaaggccagttgtggagacatataattacaataaaatgtaatgagttctctcagatgtgagcagattgctatgacaataaagaggcagatgactaactttccttggaawgctggaacagtgatatttgagctgaagcttttgcagaaggagggattcttcaggtacaaaagttgttggacacggagcgatcccggcatagccaaaggcaaatgcagagaagtatgaaatgttcagtgtatttggagagtggggagaagtgaagtgtggctagagcatatggcatgtagggggaataccaggaagtgttgctggaaaagcagtcagggccaaaatgtgaagggtcatcgatactttgctaaagggcttggcatttatccagcagaggatgaagatctgcaacggggatcc

SEQ ID NO: 193565 - DNA, 601 bp, Human
agaaccaggccaatccagagcaatgccatagacatcactccactatcttcatgtgcctttataaggagatctctgcctttccatccttttccctttccctgaaaaactgaaggctctaggcccagaagcagcaacggaaggggaaatctcagagaaccctcttctctttcactctacccaacaaaggatcatagatcatagctctagtctccaaaagggaagatcaatagcctgaaatcagatatgagattaaagttttttgctaaattagaccaagtggttggagaataatagaatctaytcagtacgttgttaagcaggaaagctggatttgacaaagtacagttaaaagtaatgacaggaagaacaaaacaaagcgtaataggttcatatttatatccaccaagttgagactgctcaattacaaaagaaatattaatgcacttctgtgtttttggtttttagtccagtttaacagcactcaatctacattagtaaatgaatatttctaaaccatatcacacattttgaaacaaaacccactcatattttcgggcactttttcaaaaaagaaaaaatatattttcgacaagatagggtg

SEQ ID NO: 193566 - DNA, 601 bp, Human
tctgatgaagagatttggaaatcaggctccctgctataattgattatgggatcatagaggaggccttgaagtggtgtgataagcgtggaagaagatgagaatgccagctattccactccagtctttacatccctgcagggacacagaagaagacctctggattccgcatggctatgcatattgaaggtccagttcaaagaatgtggtgctctacacagaggaggtgttactattgtgcaccattgatggggtaatcagagacacagctccttctctgagagggtcctcaccaagagaaggwcacaggaagttgaagatgactccaagaaaaccatgcatattgctaatatggagacaattacatcacctgaagctttagcagcagacagaaccaggccaatccagagcaatgccatagacatcactccactatcttcatgtgcctttataaggagatctctgcctttccatccttttccctttccctgaaaaactgaaggctctaggcccagaagcagcaacggaaggggaaatctcagagaaccctcttctctttcactctacccaacaaaggatcatagatcatagctctagtctccaa

SEQ ID NO: 193567 - DNA, 601 bp, Human
gcccagcaagaagagactagcatcttatccttagactgggtgcttgataaacagtagtcctgttggtgtaggcagagtagggagtgcttaagaagttcttgtaaaaatgtgacttgtgccacctcatgttttcggcctttgagaacatagaaaatggtgcccacttctgatgaagagatttggaaatcaggctccctgctataattgattatgggatcatagaggaggccttgaagtggtgtgataagcgtggaagaagatgagaatgccagctattccactccagtctttacatccctgsagggacacagaagaagacctctggattccgcatggctatgcatattgaaggtccagttcaaagaatgtggtgctctacacagaggaggtgttactattgtgcaccattgatggggtaatcagagacacagctccttctctgagagggtcctcaccaagagaaggtcacaggaagttgaagatgactccaagaaaaccatgcatattgctaatatggagacaattacatcacctgaagctttagcagcagacagaaccaggccaatccagagcaatgccatagacatcactccactatctt

SEQ ID NO: 193568 - DNA, 601 bp, Human
gattagttaggggaagggagaatatccctcctgcctgaagctaagtgaaggaagctccaagaatattatgcataaaacttaagtgcccagcaagaagagactagcatcttatccttagactgggtgcttgataaacagtagtcctgttggtgtaggcagagtagggagtgcttaagaagttcttgtaaaaatgtgacttgtgccacctcatgttttcggcctttgagaacatagaaaatggtgcccacttctgatgaagagatttggaaatcaggctccctgctataattgattatgggaycatagaggaggccttgaagtggtgtgataagcgtggaagaagatgagaatgccagctattccactccagtctttacatccctgcagggacacagaagaagacctctggattccgcatggctatgcatattgaaggtccagttcaaagaatgtggtgctctacacagaggaggtgttactattgtgcaccattgatggggtaatcagagacacagctccttctctgagagggtcctcaccaagagaaggtcacaggaagttgaagatgactccaagaaaaccatgcatattgctaatatgg

SEQ ID NO: 193569 - DNA, 601 bp, Human
aatatcaggagttcactttcagatttgcacttggagccaggagtggtggctcaggtttgtaatcccagcactttgggagatcaaggtgggtgaatcacttgaggtcaggagtttgagaccagcctggccaacgtggcaaaaccccatctctaccaaaaatacaaaaatgagctgggcgtggtagcatgcacctgtagcctcagctacttaggaggttgaggcaggagaatttcctgaacctgggaggcagatgttgtggtgagccaagatcgcaccaagactgtactccagcctgggcgayagagtgagactccatctcaaaaagagaaaaaaaaagaaagtaagaaagaaagaaagaaagaaaaaatttgcactccttggaagaagtatgcacagctctgcttcattatctctgcatttctcttccttagacttggtcactattgattttctactctcctaagtttggactgctcattcctcctaatataaatgctgtctaagcatgtgttgtggaagaagtatcctctgttatcttttgggaggacaaattatgacagccattagaaaaaaaaagattaatctaatttagaaaatctct

SEQ ID NO: 193570 - DNA, 601 bp, Human
ccagcaatttactttctttactatgatttcaattttagacatgtcaggggcctccctgaataactgcactttttagaaataaaggccagtggttcattggccaaaaagaatttgtcgttaaaaaaaaagcaaatctgtccgatttattaattatgattgtgtgatttgatccaaccaatgatagatggcaaatttcacttttcaatttgtctaggtattagatgaaggtcacccaaaaactgagttggaaaaaaaacttgaaaaggaatccatctaatccatgtcttttagccccacacayggcagatctgagcaaaaagatgaaagaaaattccattttctttatcacagagcaaataagagtctcaacatgcaaagctgtacagcagaactttctctaatgatggaaatggtatacctctgcactgtctaatacagtagacacataccacatgtgactactgagcagtcaaaatgtggttattatgactgaggaactaaattttaaatagccatatttgtttagtgtctactatattagagagtgccactaaatattttagtcacactttactgaagcaagaattgtaaagtgccacaa

SEQ ID NO: 193571 - DNA, 601 bp, Human
acataaacctctggggaacaatgttcttctatttaccaagaacaaatctactaatagttattaacaatacattctttaaaaggctttatttctaataatctcttacatatggatgtttcttcaatgtgaattaccaaattgactttgaacaatttatgctgccaaatttttccatttatctcattcagatgacaaaagtaaatacaccaaagattatttctatgcaaaaatgtcttaagtggagtggtatttgagatgggaccctgaaaaaaaaagtaaggtatccaacagaaagttccartgcagaaggaatgcaagatgaaggaaacagcaaaagaaacagacagattgaggaagtggcacagttcccaagaacagagattggcccggtagctctaatgaaagcattagaggaaagatctaaacagagttttgatgtcaggctttggaaggtcatgagtactttgtctacatgatagcaaaatccaaatatttaaagccacagataactgcccaagatttttgtctccatttgtgtttggtcttaggcacagatttattatgtgcctgttctaattaatgtaggcaaaaacactgtttt

SEQ ID NO: 193572 - DNA, 601 bp, Human
ctgtggaaactctattagcctaggaactcattaaaatcatgtttacacttttactaacttaaaatcatatttatttaactagatgtctcattagcttattgaagtcattactgcctgtcagtcagagaaagcaaacgaatgaatattcttcataatagaagagcaagcaggactgtaattaatgactttgctaataacagccccgtgtttgtgcacattgattttcagatatggaatatacacataaacctctggggaacaatgttcttctatttaccaagaacaaatctactaatagttrttaacaatacattctttaaaaggctttatttctaataatctcttacatatggatgtttcttcaatgtgaattaccaaattgactttgaacaatttatgctgccaaatttttccatttatctcattcagatgacaaaagtaaatacaccaaagattatttctatgcaaaaatgtcttaagtggagtggtatttgagatgggaccctgaaaaaaaaagtaaggtatccaacagaaagttccaatgcagaaggaatgcaagatgaaggaaacagcaaaagaaacagacagattgaggaagtgg

SEQ ID NO: 193573 - DNA, 601 bp, Human
caaagctttatcaagaaggtgtgagtggacacctactctacaggtctttaaaattcatttttatgcatttaattaacacttgccattttacaaaatacaatgtcaatgtgagttatttgacattatcctcaccacatctccatgcagtaagcccagagactacagtttagagaactgatatagctccaatcaggccacacatcttgtaacccgcagagcttgaataggaacccagtcttatattcatccctctctgtataccaccaccatcagcccataactgtggaaactctattagccyaggaactcattaaaatcatgtttacacttttactaacttaaaatcatatttatttaactagatgtctcattagcttattgaagtcattactgcctgtcagtcagagaaagcaaacgaatgaatattcttcataatagaagagcaagcaggactgtaattaatgactttgctaataacagccccgtgtttgtgcacattgattttcagatatggaatatacacataaacctctggggaacaatgttcttctatttaccaagaacaaatctactaatagttattaacaatacattctttaaa

SEQ ID NO: 193574 - DNA, 601 bp, Human
acgtcacttctccaactcatacagccctgtatttctggtcctaacataatgttcaaaaataaatctgagcggttttaaatgtaggcacatattttataaaatgcatagctttctattccttcaagcagctgatttatataaagcagaaatccattcacataggtcagaaatttgtaaaatgtatgacaagagatttagctcattatgcttatcttgtggtctgcccaaattgttaaagcttgtgcctcaaagtatgctgagcctctttggcacactgacccagtgattagtattttctcayccagtgcaaggataatgcatacctcagaggatcaggtggtaactaaaatcattgaatcaggctgagtgagagctatgaaactctggagattctcatttctccacttacaaaatgaaactgtggcttagagtctaattgacactgataataccatagagctatacattcatattactctggatgaaattttcattcacagcactaaacatctgggtatttccacatggacttattttcatatatatttagatgtttgacaacctaaaaataaaatagtatatacctggtggaatttttctt

SEQ ID NO: 193575 - DNA, 601 bp, Human
tccccagtccttactgaaacacttttaaatactagaaagcagccactgtcttcttttttttttaaggatatttttattccaaatgcattataatttgtatatgtaccatcagcgtgattctcaggaatacttctggcctgtcctacaaagcaattacagtcggctcatcttcgtgtacttgagtttgactgtgaataaatagctttctcaacttttctttctaccaaatatacatactgggccagcagggatgtgtagtatgtagaaaaaataaaagcaatatttttctagctaaaacaaygtcacttctccaactcatacagccctgtatttctggtcctaacataatgttcaaaaataaatctgagcggttttaaatgtaggcacatattttataaaatgcatagctttctattccttcaagcagctgatttatataaagcagaaatccattcacataggtcagaaatttgtaaaatgtatgacaagagatttagctcattatgcttatcttgtggtctgcccaaattgttaaagcttgtgcctcaaagtatgctgagcctctttggcacactgacccagtgattagtattttctcacc

SEQ ID NO: 193576 - DNA, 601 bp, Human
ggatcccaggggaaaagtcaggtgaatccatgaaaaatagaaaatttttagggcagtgaagctactctgtgtgatactataatggctgatacatgtcattatagatttgtccacactcgcagaatgtaaaaaaccaagagtgaaccctattgtaaactattgactttggttgataatgatatgtcagtgcagggtcatacattgtaactaatgtgccactaatgcagaagatgctgataatgtggaggctatgcatgtgtgtttcagggagtatatgggatatctttgtaactttttctcmatttttctgtgagcctaaaactgctctaaaaatagtctttaaggccaggcacagtggctcacgcctataatcccagcactttgggaggctgaggtgggaggatcatgaggtcaagagatggagaccatcctggccaacatggtgaaaccccgtctctactaaaaataacaaaaaattagccgggcatggtggcaggcgcctgtagtcccagctactcaggaggctgaggcaggagaatggcacgaacccgggaggtggagcttgcagtgagcagagatcacgccactgtactccagcctg

SEQ ID NO: 193577 - DNA, 601 bp, Human
atcaaacacagtggtcaaagctttatagttattatataacaatacatcttcccataacaagcatacaaacaaaaacaccttttataaattgcaactagtatgaagttttatgtttcaaaaattccttatgtttcaaaaactattttaaagggcaaatgattaattcattgaaaatattttaaagcatccacattttagaagaaaatttaatgaattatttaacagagctacaatattctttttatataaaccaactatacattgataattaaaatctgacaatctgtaagcccaatactcyttttttttttttttttttttttttttgagactgagtctcgctctgtcgcccaggctggagtgcagtggcgggatctcggctcactgcaaactccgcctcccgggttcacgccattctcctgcctcagcctcccgagtagctgggactacaggtgcccgccaccgcgcccggctaattttttgtatttttagtagagacggggtttcaccgttttagccgggatggtctccatctcctgacctcgtgatccgcccacctcggcctcccaaagtgctgggattacaggcgtgagccaccgcg

SEQ ID NO: 193578 - DNA, 601 bp, Human
ttgaaactacgcacgtgtttttgtgtttccattttcaggttgctttcctgaggtggtacttaacctccaattagagaatgccgccactaggtggcggggtggtgacttggttccaagaggctacagttggtgggaccaagaaagggagggttatgggtcccatgattcttatatctatttcattttttctttcaaaaactgcagtggacagttgagaaataagcttcgataataagtttttagaaacaactaagtgtgtcatgtgatacctggatgacaatacattgtctgagaaatacartaagacaaatgaaaactctgggctttgatgcaagacactgagtttcaattttgcctgtgccatttattagttgaatgaaaagcagaaagttccttcatttctatgagcgttggactcatttaaaacttgaatcatcatacttatttcacaagtctgttagaagacaaagccatgtggtgcaatgtgctttgaaaagaacgtgggtaaccacctagatatgatccacaaatatgcctgatccaatcccaagaggtttttcaagttcacaacatttcacatagaaatgtaatctctaatttc

SEQ ID NO: 193579 - DNA, 601 bp, Human
gtatatcttataatttatcataaacaggtcagtaaaaccataagcatatttttgcctgcattctcaacttccacatatatttttaatgtaaaacagctataaatgagccagtccaggtagaaagagaaggttaatgtgaagttgaccaaacagcatttgctatttaattacacgatagacactaaaataattatgtaattcatgtagtcttttagctaacacttaaatcctgtccatgttctaactggttaatgataaagagattaataaacagtttttgcagtcaaagaatttgccatamtgtgaggtataagattaagtgataatgcttccttcttgaataagaatcaggaccaaggagagcttcctgaagaggctgctttggattgacccttgaagaatgtgtaggaacttggaagcaaatgaagagagataaacgaaaggagagagagaaataaatagaacagatggaaagaaaaaagaaaaaagagaaaactaagaaaagaaagtgaaggaaggtgaagaaaggaaagaaaaaggaagggaagggaaaaggaagaaagaatagtaagttttcctcgacatggggggtcaactgtgg

SEQ ID NO: 193580 - DNA, 601 bp, Human
tgcacatagtaagcctactagaaagaaggctatctacttcctttctatagactcattctattaaagttatttttcaggaatatcgaatgaataaacaatttcttcttcagatcatcaactacaaaaaccatcagttcattttctcttacatttgtgtgtgcgtgtgtgtgtgtatactgctactttatttgaaaggagaataattttgattcatttcctgttttgattttcatgctcttgcaaaaaaataaaataaagaactgcgttggcagtttcaagaacaactgaaaaatctattgtktagtatgagtcatgtctcctcttgaccttaaattcttttatctgcctaaacttcagttttgaagtttgaggttcaattgttgataagcagttagtatttgattttggttccccctgaaatgtaccaacacactcaaacatagtctgctcttttcagatattttgcagcttggcatttttaattctcttctccttagtagaaatctgtattagtacagatgaagctgaaaggaagcttggaattcttctaattggaatttcatcattttataaaaggaagccaacctcactactgtttctg

SEQ ID NO: 193581 - DNA, 601 bp, Human
aaggtaaaagttatagctaataggccaggcgtggtggctcacgcctgtaatgccagtactgtgggaggcctaggctggtggatcacggagtcaggagttcaagaccagcctggacaacatggtgaaaccccatctctactaaaaatacaaaaattagccaggcatggtggtgggtgcctgtaatcccagctactcgggaggctgaggcagagaaatgcttgaacccaggaggcggaggtggcaatgagccaagatcgcaccactgcacttcagcctgggcgacagagcgaggctccgtctwaaaaaaaaaaaaaagttacagcgaataattaatggatcagtagcctaaaaaataaccatttaatttttcagaaaatattcactcattggtgaaagagagagaaaaaacattaaaaaaatataaactgaagcatacaatctcaagaagcctataatatgagagaataaacacaggtatgattcaacctcctcttcacattctatgttagtttacaaaagatagtgattttatgttgagtgtaagagatactatttttttttcttgaactgagaaccaattgtgtagaaattcaaatatatg

SEQ ID NO: 193582 - DNA, 601 bp, Human
aatagcccttgtaacggcttatgaagcctattacagatagcttccagcagtagactttctacaaatcaacatagctaacaaaattcagaacttaactcaactgtttacattttctttttttttcatgaattttttttttaattgaaaggtaaaagttatagctaataggccaggcgtggtggctcacgcctgtaatgccagtactgtgggaggcctaggctggtggatcacggagtcaggagttcaagaccagcctggacaacatggtgaaaccccatctctactaaaaatacaaaaattmgccaggcatggtggtgggtgcctgtaatcccagctactcgggaggctgaggcagagaaatgcttgaacccaggaggcggaggtggcaatgagccaagatcgcaccactgcacttcagcctgggcgacagagcgaggctccgtctaaaaaaaaaaaaaaagttacagcgaataattaatggatcagtagcctaaaaaataaccatttaatttttcagaaaatattcactcattggtgaaagagagagaaaaaacattaaaaaaatataaactgaagcatacaatctcaagaagcctataat

SEQ ID NO: 193583 - DNA, 601 bp, Human
cctgtcatctaaaattatctctttctcttctgactcccgtcatagctatttatctgtggctgtcttaacataatgatcactttgtattacatatcatgtgtatttgcaatgatgacatactatatagaactcacttgagaccccggcctctgtcttatttctcactgaaataagatacttgcacagtagctggcatctgacacccagtagctcctccataactgtttgtaaatgagctaatgaatggaggagtctagcctgttccatgtcgggagtagtttgatgaaatagcccttgtaayggcttatgaagcctattacagatagcttccagcagtagactttctacaaatcaacatagctaacaaaattcagaacttaactcaactgtttacattttctttttttttcatgaattttttttttaattgaaaggtaaaagttatagctaataggccaggcgtggtggctcacgcctgtaatgccagtactgtgggaggcctaggctggtggatcacggagtcaggagttcaagaccagcctggacaacatggtgaaaccccatctctactaaaaatacaaaaattagccaggcatggtgg

SEQ ID NO: 193584 - DNA, 601 bp, Human
gcaggtaggaagttatttgctcttgattccataaagcagacactagtaatgtaagagctggcaaagggcaaaaaagggtgattctttttatatgaacaggataaaaccagagtaagcttgaccgatggtctgaattagagatggtgaatggagaaaatactgtatttttcaaagtagaattgccatgtgtgggcaaagggaacaatgggtgaaaggtcaggggaaggccaatccaactctgaaaatcaatagccgtactgctacctaatgatgctatcaatgcacattttgagttcatttstgattcagaacttatgatttgatcctaaagtaattttctctagcaaactgaaagttggcaagtgccttcctcaaagcatctttgcagaccctacaaaaatggtaaagaaatgaaatcgttctccaaacgtgttttatctaccaattttcccatttacagtgttggattacaaatccataaaaagaattcagatatatgtggataatttacattctctatctttaccaccagattgctaaatcacctcatatatgtgcctccatctcattagggtacttgatatatatcttatcacttctc

SEQ ID NO: 193585 - DNA, 601 bp, Human
tgaagatacccagcagtgagtaggctgagatctgacatcatatccttagcagagctagaaacgcacatctcacaggtgttttctgctcagactcaatcaagcctgcatggactgtcactccagccacgttcattttaacagcctaaagagtaatctgctagataaacagttctgatggcactgaaaagccggggctgtgtttttgaaaaaaatctttgctgcaatgcttcttgctgtgatggtgtgtcctcagaatgagaatgcaaagtaaacacctgcaccaccaaagaagaatgaagasagagaggcctggttcactttatgctttatttctaaagtcccaggaatatcatttacctgtatcatgttttggatatactaccatttggacaaagagatcacaagtacacttgtttaatttcataaaaggtactaaaaagaaagttcataagctctgtcctcatcatagaatccttgaaatctaaaattgcaaatatgtagtttgactcttcactttacagatgaagaaagcaaggctgagcaggggaaggaattaacccgatcaagaccatggcgctaaataacagcagaataaggatta

SEQ ID NO: 193586 - DNA, 601 bp, Human
gttcctgtaggcatgacataaaattatgcctacggccatggggaagaaacaactccagaatttgtttgtgttacttgtttgctcattgggtttaaattatacattcatctaaacatagacttcctgcaggtgattacaatgctcagtgactgaaacatttctcagtgaggagagactataatggtcaatgaaggagaaacgtggactgggacgcagcatgtggtgcagtattgctgagatattgatgtgagtacagcagacacctcaaatcctttttatggatctggagagcatgtaagattttttttttttagaaaagcaaagaagccccaacaacatgaagatacccagcagtgagtaggctgagatctgacatcatatccttagcagagctagaaacgcacatctcacaggtgttttctgctcagactcaatcaagcctgcatggactgtcactccagccacgttcattttaacagcctaaagagtaatctgctagataaacagttctgatggcactgaaaagccggggctgtgtttttgaaaaaaatctttgctgcaatgcttcttgctgtgatggtgtgtcctcagaatgagaatg

SEQ ID NO: 193587 - DNA, 601 bp, Human
tctccagaagatgatgacatttcacctgcgaatatgcagtaaagggcttttattgggggtcttatgttcctgtaggcatgacataaaattatgcctacggccatggggaagaaacaactccagaatttgtttgtgttacttgtttgctcattgggtttaaattatacattcatctaaacatagacttcctgcaggtgattacaatgctcagtgactgaaacatttctcagtgaggagagactataatggtcaatgaaggagaaacgtggactgggacgcagcatgtggtgcagtattgctragatattgatgtgagtacagcagacacctcaaatcctttttatggatctggagagcatgtaagattttttttttttagaaaagcaaagaagccccaacaacatgaagatacccagcagtgagtaggctgagatctgacatcatatccttagcagagctagaaacgcacatctcacaggtgttttctgctcagactcaatcaagcctgcatggactgtcactccagccacgttcattttaacagcctaaagagtaatctgctagataaacagttctgatggcactgaaaagccggggctgt

SEQ ID NO: 193588 - DNA, 601 bp, Human
attcctcctccaacactacctaattttctaatcaaagctggaatgaaggatgtaggctctccagaagatgatgacatttcacctgcgaatatgcagtaaagggcttttattgggggtcttatgttcctgtaggcatgacataaaattatgcctacggccatggggaagaaacaactccagaatttgtttgtgttacttgtttgctcattgggtttaaattatacattcatctaaacatagacttcctgcaggtgattacaatgctcagtgactgaaacatttctcagtgaggagagactayaatggtcaatgaaggagaaacgtggactgggacgcagcatgtggtgcagtattgctgagatattgatgtgagtacagcagacacctcaaatcctttttatggatctggagagcatgtaagattttttttttttagaaaagcaaagaagccccaacaacatgaagatacccagcagtgagtaggctgagatctgacatcatatccttagcagagctagaaacgcacatctcacaggtgttttctgctcagactcaatcaagcctgcatggactgtcactccagccacgttcattttaacag

SEQ ID NO: 193589 - DNA, 601 bp, Human
aatttacttacccaggctcacaaaacaaagatgactataaggatataccataagttttcctaatcccatataaaagaatggccccttcctctgaaaaattactgaaggaagaaaatcaatgaagaacccatgaaataggcaatctctaaatggactcgttgagtataggagggaatgagaataaatatgtttacttaccccatcgtctatgtcctgcttagaccaccagaactacactggacctcagtacaagggatatatattaaagcaaacaaactcatcattctttgaactctactcrcttcatttttcagtattttcatgactcagatcaatcccaacatccagggggccctgaaattcctcctccaacactacctaattttctaatcaaagctggaatgaaggatgtaggctctccagaagatgatgacatttcacctgcgaatatgcagtaaagggcttttattgggggtcttatgttcctgtaggcatgacataaaattatgcctacggccatggggaagaaacaactccagaatttgtttgtgttacttgtttgctcattgggtttaaattatacattcatctaaacatagac

SEQ ID NO: 193590 - DNA, 601 bp, Human
acctccaattactaatagggttttatttcaaatcttataaaacatatattctgaagtgcaaatttacttacccaggctcacaaaacaaagatgactataaggatataccataagttttcctaatcccatataaaagaatggccccttcctctgaaaaattactgaaggaagaaaatcaatgaagaacccatgaaataggcaatctctaaatggactcgttgagtataggagggaatgagaataaatatgtttacttaccccatcgtctatgtcctgcttagaccaccagaactacactggmcctcagtacaagggatatatattaaagcaaacaaactcatcattctttgaactctactcgcttcatttttcagtattttcatgactcagatcaatcccaacatccagggggccctgaaattcctcctccaacactacctaattttctaatcaaagctggaatgaaggatgtaggctctccagaagatgatgacatttcacctgcgaatatgcagtaaagggcttttattgggggtcttatgttcctgtaggcatgacataaaattatgcctacggccatggggaagaaacaactccagaa

SEQ ID NO: 193591 - DNA, 601 bp, Human
aaaaattctgggtcaagtacaattaatgtactagttaaatatagactacagacctccaattactaatagggttttatttcaaatcttataaaacatatattctgaagtgcaaatttacttacccaggctcacaaaacaaagatgactataaggatataccataagttttcctaatcccatataaaagaatggccccttcctctgaaaaattactgaaggaagaaaatcaatgaagaacccatgaaataggcaatctctaaatggactcgttgagtataggagggaatgagaataaatatgyttacttaccccatcgtctatgtcctgcttagaccaccagaactacactggacctcagtacaagggatatatattaaagcaaacaaactcatcattctttgaactctactcgcttcatttttcagtattttcatgactcagatcaatcccaacatccagggggccctgaaattcctcctccaacactacctaattttctaatcaaagctggaatgaaggatgtaggctctccagaagatgatgacatttcacctgcgaatatgcagtaaagggcttttattgggggtcttatgttcctgta

SEQ ID NO: 193592 - DNA, 601 bp, Human
tagagaaaacatatctcaatgaaaaaaaagaacataatgaataaacaataaacagcagaaaaaatataaatgatttttaaaacccaataaaaatttaagaactgaaaggaaccatatttgagggaaaatattactggatataattaattataggctggatactggcacatataaacaactcggtatttgtgtgtattatgtatgattggaaaatatcttgaagcttacacaagctggtaatagtgttggctcctgggaagggatttggttggctagggagcagagatataagaaatagactttttttttttctacatgtattattacttcaagtaatgaatttaggggaaaaattctgggtcaagtacaattaatgtactagttaaatatagactacagacctccaattactaatagggttttatttcaaatcttataaaacatatattctgaagtgcaaatttacttacccaggctcacaaaacaaagatgactataaggatataccataagttttcctaatcccatataaaagaatggccccttcctctgaaaaattactgaaggaagaaaatcaatgaagaacccatgaaataggcaa

SEQ ID NO: 193593 - DNA, 601 bp, Human
gatcactgttcgctgcaacctccactgccccagctcaagcaattctctgcctcagcctcccaagtagctgggactacaggcatgcaccaccacaccctgccaatttttgtatttttagtagagacagggttttgctgtgttccccaggctggtttcgaactcctgggatcaacccacagtgctgggattacagacatgggccaccatgctcagccaacagataagaactttaaaacagccactataaatatgttctagagaaaacatatctcaatgaaaaaaaagaacataatgaataaayaataaacagcagaaaaaatataaatgatttttaaaacccaataaaaatttaagaactgaaaggaaccatatttgagggaaaatattactggatataattaattataggctggatactggcacatataaacaactcggtatttgtgtgtattatgtatgattggaaaatatcttgaagcttacacaagctggtaatagtgttggctcctgggaagggatttggttggctagggagcagagatataagaaatagactttttttttttctacatgtattattacttcaagtaatgaatttagg

SEQ ID NO: 193594 - DNA, 601 bp, Human
tgccagaacaaaacacacacctgtatcagcagataatgtaatacactctacaatgttttttataaatgtctaacatacaatatcacaaaacatggatgcaagcagcacgatgtaactcatggtcagttacgcagatagtagaaaagatcacaaggtcgcctagatgttaaaattaagagaagtaatttgttttttttttttttttttgacacagggtttcactcctgttgcccagactggagtgcagtagcgggatcactgttcgctgcaacctccactgccccagctcaagcaattctccgcctcagcctcccaagtagctgggactacaggcatgcaccaccacaccctgccaatttttgtatttttagtagagacagggttttgctgtgttccccaggctggtttcgaactcctgggatcaacccacagtgctgggattacagacatgggccaccatgctcagccaacagataagaactttaaaacagccactataaatatgttctagagaaaacatatctcaatgaaaaaaaagaacataatgaataaacaataaacagcagaaaaaatataaatgatttttaaaacccaataaaaa

SEQ ID NO: 193595 - DNA, 601 bp, Human
attacaggtgtgtgccaccacaccgggctaatttttatatttttagtagagacagggtttcattatattgtccaggttggtctcgaactcctgacctcaagggatctgcctgctttggcctcccggggtgctgggaatacaaccatgagccattgcatccggccaggttgtgattattagactagacaatgaaggtgtgtcaagcatgtagtacctgacttattactcactctccttactcctggttacaatttcaggggaaaactgatatcacaaatgagaatgcagtagcctgagcagygggcagagaaaagtcactgtagttgtggatccacataacgtgtcatgaggatctcttacctgtgagaggttaattaagattatcttgcttaaggctcaacttggtcatctatatatagagaacacagagatatcagatcacttttctttctctggtagaggaatttggtgccatcaattggagataagtgatgtggtaatttcaggttcttgtcacctcctaatgaggcattataccacaataccactggactcagcctctagccagaagactgtaagtatagaagtgaggtgggagaaa

SEQ ID NO: 193596 - DNA, 601 bp, Human
atctgtaagttaaggttaattatatcatcactgtaaggttgattttttttttttttttgagacagtcttgctctgtcactcaggctggagtacagcggcacaatctttgctcactgcaacctccgcctcccgggttcaagtgattctcatgcctcagcctcccaagttgcttggattacaggtgtgtgccaccacaccgggctaatttttatatttttagtagagacagggtttcattatattgtccaggttggtctcgaactcctgacctcaagggatctgcctgctttggcctcccggrgtgctgggaatacaaccatgagccattgcatccggccaggttgtgattattagactagacaatgaaggtgtgtcaagcatgtagtacctgacttattactcactctccttactcctggttacaatttcaggggaaaactgatatcacaaatgagaatgcagtagcctgagcagcgggcagagaaaagtcactgtagttgtggatccacataacgtgtcatgaggatctcttacctgtgagaggttaattaagattatcttgcttaaggctcaacttggtcatctatatatagagaacaca

SEQ ID NO: 193597 - DNA, 601 bp, Human
agggcctctgattttggttctatctttcccacttaaaaccccaaatctaaactcttttttttttccagagggagtctcgctctgtcacccaggctggagtgcagtggcacgatctcggctcactgcaacctccacctccctggttcaagcaattcccctgcctcagcctcctgagtagctgagattacaggcgcctgccaccatgccttaatttttttgtatttttagtagagacagggtttcaccctgttggccagacgggtctctaactcctgacctcagacaatccgtccaccttggmctcccaaagtgctgggattacaggcataagccactgcgccaggtctaaactctttttaatgtatataaccaccttctctgtttgctgtgccaccttgtggattcagttttgtgtaagaaagaaaggaatcaaaaacaactggggaatcttccaacacaatttacatccaacaactccagagacagagtcctttcggttattctcactggatatttggctgtgaagcttctgatttgctaacttcattaatggcctttagatggagagaacttgaaaatccttgctataatagctgctact

SEQ ID NO: 193598 - DNA, 601 bp, Human
tccttttgcttctcatagcatttgatatttcttttagtatttaatgtgttctgtcttgaatcacgatggtttttcttgctcctatagcagacaatgtgagctttagttcacagggacataatcctcttcaatgctttttatgaagccaagcaattcagcgcccagtttattcttgtttaaataaatgtagcaataatttaagtcaaggaaacagcaaaggttatgtggtgagatagaactgattgacagtactgattcagtccctttacctgtatgaacttggacatgctatttaattttkttaaaaatctctttttctattacattaaactgggagcaataattctcacattaaaaatgtttgaagattaagtaaaatgacaaaaattacttcccaaaaatctttgtccttctttcaatatcaagtttttcctacataattagctaacagatgatgtatggtaagtttaataacaaataacaaccattcatttataggttgcaagcaaattttgttcaagatgtaaatataacattgtggatcacataagttattcaagaaaaaatattttccattctgtctccaactaacacattcccc

SEQ ID NO: 193599 - DNA, 601 bp, Human
ttcctaaccctcaagctgtgctttgctcaagctgttctctctgtttctctatcaaataggaccataacagatgctctttcaagactcttcaggttacagcaaactttccttccttttgcttctcatagcatttgatatttcttttagtatttaatgtgttctgtcttgaatcacgatggtttttcttgctcctatagcagacaatgtgagctttagttcacagggacataatcctcttcaatgctttttatgaagccaagcaattcagcgcccagtttattcttgtttaaataaatgtagmaataatttaagtcaaggaaacagcaaaggttatgtggtgagatagaactgattgacagtactgattcagtccctttacctgtatgaacttggacatgctatttaattttgttaaaaatctctttttctattacattaaactgggagcaataattctcacattaaaaatgtttgaagattaagtaaaatgacaaaaattacttcccaaaaatctttgtccttctttcaatatcaagtttttcctacataattagctaacagatgatgtatggtaagtttaataacaaataacaaccattca

SEQ ID NO: 193600 - DNA, 601 bp, Human
catcacatgctaatttcttgcaatgcccccacttcctaaccctcaagctgtgctttgctcaagctgttctctctgtttctctatcaaataggaccataacagatgctctttcaagactcttcaggttacagcaaactttccttccttttgcttctcatagcatttgatatttcttttagtatttaatgtgttctgtcttgaatcacgatggtttttcttgctcctatagcagacaatgtgagctttagttcacagggacataatcctcttcaatgctttttatgaagccaagcaattcagygcccagtttattcttgtttaaataaatgtagcaataatttaagtcaaggaaacagcaaaggttatgtggtgagatagaactgattgacagtactgattcagtccctttacctgtatgaacttggacatgctatttaattttgttaaaaatctctttttctattacattaaactgggagcaataattctcacattaaaaatgtttgaagattaagtaaaatgacaaaaattacttcccaaaaatctttgtccttctttcaatatcaagtttttcctacataattagctaacagatgatgta

SEQ ID NO: 193601 - DNA, 601 bp, Human
cgccccctcatctgaatggaattccccttaagatataaacaccatcaaggataaatagacagaaatttagagattttaatgaatacttggataaaatgctgtatcttttcaggtttgactcccactgtcaacactgttttcatcacatgctaatttcttgcaatgcccccacttcctaaccctcaagctgtgctttgctcaagctgttctctctgtttctctatcaaataggaccataacagatgctctttcaagactcttcaggttacagcaaactttccttccttttgcttctcatagyatttgatatttcttttagtatttaatgtgttctgtcttgaatcacgatggtttttcttgctcctatagcagacaatgtgagctttagttcacagggacataatcctcttcaatgctttttatgaagccaagcaattcagcgcccagtttattcttgtttaaataaatgtagcaataatttaagtcaaggaaacagcaaaggttatgtggtgagatagaactgattgacagtactgattcagtccctttacctgtatgaacttggacatgctatttaattttgttaaaaatctctttttct

SEQ ID NO: 193602 - DNA, 601 bp, Human
agtcagcctctaactgtgtcagctttggcctttcccaccgccccctcatctgaatggaattccccttaagatataaacaccatcaaggataaatagacagaaatttagagattttaatgaatacttggataaaatgctgtatcttttcaggtttgactcccactgtcaacactgttttcatcacatgctaatttcttgcaatgcccccacttcctaaccctcaagctgtgctttgctcaagctgttctctctgtttctctatcaaataggaccataacagatgctctttcaagactcttcrggttacagcaaactttccttccttttgcttctcatagcatttgatatttcttttagtatttaatgtgttctgtcttgaatcacgatggtttttcttgctcctatagcagacaatgtgagctttagttcacagggacataatcctcttcaatgctttttatgaagccaagcaattcagcgcccagtttattcttgtttaaataaatgtagcaataatttaagtcaaggaaacagcaaaggttatgtggtgagatagaactgattgacagtactgattcagtccctttacctgtatgaactt

SEQ ID NO: 193603 - DNA, 601 bp, Human
aaagtcctttcctctctagtcagcctctaactgtgtcagctttggcctttcccaccgccccctcatctgaatggaattccccttaagatataaacaccatcaaggataaatagacagaaatttagagattttaatgaatacttggataaaatgctgtatcttttcaggtttgactcccactgtcaacactgttttcatcacatgctaatttcttgcaatgcccccacttcctaaccctcaagctgtgctttgctcaagctgttctctctgtttctctatcaaataggaccataacagatgytctttcaagactcttcaggttacagcaaactttccttccttttgcttctcatagcatttgatatttcttttagtatttaatgtgttctgtcttgaatcacgatggtttttcttgctcctatagcagacaatgtgagctttagttcacagggacataatcctcttcaatgctttttatgaagccaagcaattcagcgcccagtttattcttgtttaaataaatgtagcaataatttaagtcaaggaaacagcaaaggttatgtggtgagatagaactgattgacagtactgattcagtccc

SEQ ID NO: 193604 - DNA, 601 bp, Human
ccaacctcctctccctagaatgctccctgaccccagcttcatagtttcatactctaccttgattcctctccaacactgaatttcttcctgtttcttctccctgcacatagacaactgtcacacagtttctggcttcttagggtctaccactgcccaggaaaagtcctttcctctctagtcagcctctaactgtgtcagctttggcctttcccaccgccccctcatctgaatggaattccccttaagatataaacaccatcaaggataaatagacagaaatttagagattttaatgaatacktggataaaatgctgtatcttttcaggtttgactcccactgtcaacactgttttcatcacatgctaatttcttgcaatgcccccacttcctaaccctcaagctgtgctttgctcaagctgttctctctgtttctctatcaaataggaccataacagatgctctttcaagactcttcaggttacagcaaactttccttccttttgcttctcatagcatttgatatttcttttagtatttaatgtgttctgtcttgaatcacgatggtttttcttgctcctatagcagacaatgtgagcttta

SEQ ID NO: 193605 - DNA, 601 bp, Human
accttgtgccataagagtagttaaggcaggttacaaatatatagacattttaaaaataatctaaagcttttggtaaagacttagacaatcacatatattcagaaggggttctgtggttataaaatgtgtgttcagactgacaaaaaatctaatgtataacggaaacaggcaggcttggggtcaaaggtgataaaatcctaggccaccttgatccagtgcatataatagaaagcagagtaaataatcagtataataaggatgattttgtttctttcgtaagactaaccagtagtcatgttgyatctcatgagtgtttctttttcctatagtcttgagccctcagttcaatgtaggcatcagagaaaacttatagaaatctgctgaaatagaaacacccccgtgttctattctatgtcatgtgtgtagatatgtgaaatgataggtctatttttcacaattattactttaaaacctgcccattcttcaacttccactcactttgacttcagcagaaaatgaatattttgatagtgttccgaaattatttttgaatgctccctcttttatcagcatttgcagaactgagtttttgttctatcat

SEQ ID NO: 193606 - DNA, 601 bp, Human
cattattcacttttcacatagcaggaaaaatgcaatgaatcctataataaggcactcaattctggtttttgtcacatgtttatatctgctccaacatctaggaccttgtgccataagagtagttaaggcaggttacaaatatatagacattttaaaaataatctaaagcttttggtaaagacttagacaatcacatatattcagaaggggttctgtggttataaaatgtgtgttcagactgacaaaaaatctaatgtataacggaaacaggcaggcttggggtcaaaggtgataaaatccyaggccaccttgatccagtgcatataatagaaagcagagtaaataatcagtataataaggatgattttgtttctttcgtaagactaaccagtagtcatgttgtatctcatgagtgtttctttttcctatagtcttgagccctcagttcaatgtaggcatcagagaaaacttatagaaatctgctgaaatagaaacacccccgtgttctattctatgtcatgtgtgtagatatgtgaaatgataggtctatttttcacaattattactttaaaacctgcccattcttcaacttccactcact

SEQ ID NO: 193607 - DNA, 601 bp, Human
aaaaaaaaaatcagggttttccttctggctccacacatattagctgtggattttaggtaagtgattacaattctctaaatttcacattttcaactgtaaattgagttattttaaggaaaatcatgcatatggacacatgttttaaatgtttagaatttaacaacctccaactcattattcacttttcacatagcaggaaaaatgcaatgaatcctataataaggcactcaattctggtttttgtcacatgtttatatctgctccaacatctaggaccttgtgccataagagtagttaaggyaggttacaaatatatagacattttaaaaataatctaaagcttttggtaaagacttagacaatcacatatattcagaaggggttctgtggttataaaatgtgtgttcagactgacaaaaaatctaatgtataacggaaacaggcaggcttggggtcaaaggtgataaaatcctaggccaccttgatccagtgcatataatagaaagcagagtaaataatcagtataataaggatgattttgtttctttcgtaagactaaccagtagtcatgttgtatctcatgagtgtttctttttcctat

SEQ ID NO: 193608 - DNA, 601 bp, Human
gtggagttttccattcagtataattccaacagggctatgcagagtcagaatctgaaaatgaggcagctattaatacctgaccagggcaagacatttccggctggaaacatggcaggagtttgctgcaggcacttgtgtggacacaggcaggctaccctataaactggacgggaaatcttaatggcactgaaccagcttggatagtcattctaagtagaacctttacaatatatgtgcagtttcagtttcaatatggagttgggcatcaaagaatttacattgtatttgctattatgcctcytttttttttgtaatgagaaatcagagccctacacgtggagtaaaaaaaaaaaaaaaatcagggttttccttctggctccacacatattagctgtggattttaggtaagtgattacaattctctaaatttcacattttcaactgtaaattgagttattttaaggaaaatcatgcatatggacacatgttttaaatgtttagaatttaacaacctccaactcattattcacttttcacatagcaggaaaaatgcaatgaatcctataataaggcactcaattctggtttttgtcacatgttt

SEQ ID NO: 193609 - DNA, 601 bp, Human
gatataaaaggccacatgtatgattccatttatatgaaatgtccagaataagcaaatccggagatagtaagtactgtagtgattatcaagggttggggaaggaggtgagagggataagggtggagtgactgttttgttggagggatgaaatgttctgggattagataccggtgatgtttgcaaaactttctgaatgtaccaaaaaccactaaagcatgcatacatttttaaaatgtaaattacgtggcattcaattgatatctcaatgaaaaaaaatcagataaaccaggtgattaaagaragtgagggaaggaatgaaactattgcacattccttgcctggcagcacagggctatatgataacccatgtgaaggaaaactggctcttcgaaggccttgtctcaatattgccaggacagagtttagtcattgccaagtatatggataaaagtaactcagattcaatatagatgataatattaagttctgtttttttcctaggactaataaagtatttttaaaatgcttagatttaggtctgaattttaattcattttcttttaaaaacaaactaattaaaataatcccaaagctttttatt

SEQ ID NO: 193610 - DNA, 601 bp, Human
cagtctctcaggctcaccttttctgcctgagtcttgtttagtgacttataatgagatttaaaaatcaatacaataaaatcatatcctaacatgtcacatgaacaaaatgtattgtgtggaaggaagaaatttctccccttctgagatcagcagaagaaaaacaaatgctattgcatcttcttcagctgcaattaaacaggagtcctacatgtcagacatattcaccacagtcaccatcttcctctccatgaactggaagaatttcagtgtgagactcccatgatttaatgcaagcaaaccyggaattaagttattaatgaatataggaatattaatgaatataggttggttgaagccatgtccttgtaggtgatactcccatgccaatctccttatttgtagagagtgctctctctctctctttctctccctctctccttttttttctttttctttttgtaagaggtggggtcttgctatgttgcataggctggcctcaaactcccgggcccagaagatcctcccacatcagcctcccaagtagctggaactacaggtgtgtaccactgcacccagcttgtttttgaatagttccaacatt

SEQ ID NO: 193611 - DNA, 601 bp, Human
aatgccagagctcacattcattgcttcacaatcacagtctctcaggctcaccttttctgcctgagtcttgtttagtgacttataatgagatttaaaaatcaatacaataaaatcatatcctaacatgtcacatgaacaaaatgtattgtgtggaaggaagaaatttctccccttctgagatcagcagaagaaaaacaaatgctattgcatcttcttcagctgcaattaaacaggagtcctacatgtcagacatattcaccacagtcaccatcttcctctccatgaactggaagaatttcartgtgagactcccatgatttaatgcaagcaaacctggaattaagttattaatgaatataggaatattaatgaatataggttggttgaagccatgtccttgtaggtgatactcccatgccaatctccttatttgtagagagtgctctctctctctctttctctccctctctccttttttttctttttctttttgtaagaggtggggtcttgctatgttgcataggctggcctcaaactcccgggcccagaagatcctcccacatcagcctcccaagtagctggaactacaggtgtgtaccac

SEQ ID NO: 193612 - DNA, 601 bp, Human
caaatacacatttaagaaactactgagtcaatgccagagctcacattcattgcttcacaatcacagtctctcaggctcaccttttctgcctgagtcttgtttagtgacttataatgagatttaaaaatcaatacaataaaatcatatcctaacatgtcacatgaacaaaatgtattgtgtggaaggaagaaatttctccccttctgagatcagcagaagaaaaacaaatgctattgcatcttcttcagctgcaattaaacaggagtcctacatgtcagacatattcaccacagtcaccatyttcctctccatgaactggaagaatttcagtgtgagactcccatgatttaatgcaagcaaacctggaattaagttattaatgaatataggaatattaatgaatataggttggttgaagccatgtccttgtaggtgatactcccatgccaatctccttatttgtagagagtgctctctctctctctttctctccctctctccttttttttctttttctttttgtaagaggtggggtcttgctatgttgcataggctggcctcaaactcccgggcccagaagatcctcccacatcagcctccc

SEQ ID NO: 193613 - DNA, 601 bp, Human
ttccttaaaacatttttttccttagtaatcaaaatctcaggtaaaaagcccaggaataatagaaaaaaattactattatattgaagaaaattactaatagtattaattcctattactattgacctcagtgaaacacagaatgagagttctagtctcagaagaaactgtaagatcctgtacttcaactccagcatttggtaagtgagaaaaccaaaaggtcacgtgattaattcaaatacacatttaagaaactactgagtcaatgccagagctcacattcattgcttcacaatcacagtcyctcaggctcaccttttctgcctgagtcttgtttagtgacttataatgagatttaaaaatcaatacaataaaatcatatcctaacatgtcacatgaacaaaatgtattgtgtggaaggaagaaatttctccccttctgagatcagcagaagaaaaacaaatgctattgcatcttcttcagctgcaattaaacaggagtcctacatgtcagacatattcaccacagtcaccatcttcctctccatgaactggaagaatttcagtgtgagactcccatgatttaatgcaagcaaacctggaat

SEQ ID NO: 193614 - DNA, 601 bp, Human
atttccttaaaacatttttttccttagtaatcaaaatctcaggtaaaaagcccaggaataatagaaaaaaattactattatattgaagaaaattactaatagtattaattcctattactattgacctcagtgaaacacagaatgagagttctagtctcagaagaaactgtaagatcctgtacttcaactccagcatttggtaagtgagaaaaccaaaaggtcacgtgattaattcaaatacacatttaagaaactactgagtcaatgccagagctcacattcattgcttcacaatcacagyctctcaggctcaccttttctgcctgagtcttgtttagtgacttataatgagatttaaaaatcaatacaataaaatcatatcctaacatgtcacatgaacaaaatgtattgtgtggaaggaagaaatttctccccttctgagatcagcagaagaaaaacaaatgctattgcatcttcttcagctgcaattaaacaggagtcctacatgtcagacatattcaccacagtcaccatcttcctctccatgaactggaagaatttcagtgtgagactcccatgatttaatgcaagcaaacctgga

SEQ ID NO: 193615 - DNA, 601 bp, Human
ttgagaaaggaaattattaggtttagaaaaggaggaaactgcatactagatagtaactaccacttcttttctactttcaaaatttttccggcttctatattcaggcattttttttaagtgccaagtatttgtaatagaattttccttttttttttttttaataggaaaagattcccagctactacggaggctgaggcaggagaattgctcgaatccgggaggaggttgcagtgagccgagactgagccattgcattctagtgtgggcgacagagcaagactctgcctcaaaagaaaaaaaraaaaaaaaggaagagatactattgtgttctctgaatatttcttttgaatctttcttctgatctgttgcattccaggcaaactctctggaccaaaagggcaagaagcagaattgatgtcaacacacagataagggtccaacaaagacagtcagttggtttcataccttcaataggtttcggtacaaaatgtgatgagggcttggttttcttcactctgttccccttcataatttgaccttctttattgagtcccagaaaccaagctcggcctgattcttgctggcggtacagtgtggaaga

SEQ ID NO: 193616 - DNA, 601 bp, Human
ttttcaagggtgtatcttgagaaaggaaattattaggtttagaaaaggaggaaactgcatactagatagtaactaccacttcttttctactttcaaaatttttccggcttctatattcaggcattttttttaagtgccaagtatttgtaatagaattttccttttttttttttttaataggaaaagattcccagctactacggaggctgaggcaggagaattgctcgaatccgggaggaggttgcagtgagccgagactgagccattgcattctagtgtgggcgacagagcaagactctgyctcaaaagaaaaaaaaaaaaaaaaggaagagatactattgtgttctctgaatatttcttttgaatctttcttctgatctgttgcattccaggcaaactctctggaccaaaagggcaagaagcagaattgatgtcaacacacagataagggtccaacaaagacagtcagttggtttcataccttcaataggtttcggtacaaaatgtgatgagggcttggttttcttcactctgttccccttcataatttgaccttctttattgagtcccagaaaccaagctcggcctgattcttgctggc

SEQ ID NO: 193617 - DNA, 601 bp, Human
cagtgcaatacggtaaatataaaagtatcatttgtttttcaagggtgtatcttgagaaaggaaattattaggtttagaaaaggaggaaactgcatactagatagtaactaccacttcttttctactttcaaaatttttccggcttctatattcaggcattttttttaagtgccaagtatttgtaatagaattttccttttttttttttttaataggaaaagattcccagctactacggaggctgaggcaggagaattgctcgaatccgggaggaggttgcagtgagccgagactgagccaytgcattctagtgtgggcgacagagcaagactctgcctcaaaagaaaaaaaaaaaaaaaaggaagagatactattgtgttctctgaatatttcttttgaatctttcttctgatctgttgcattccaggcaaactctctggaccaaaagggcaagaagcagaattgatgtcaacacacagataagggtccaacaaagacagtcagttggtttcataccttcaataggtttcggtacaaaatgtgatgagggcttggttttcttcactctgttccccttcataatttgaccttctttattgag

SEQ ID NO: 193618 - DNA, 601 bp, Human
agctaaggaatttctgagggaacatagcctagctgccaaaaatcggtttcctcagaaaaaaaaaaacaaaaaagtttattctaatggtcagtttgaaataaatgaacagagaattaaatgattacgagagaaaaggttataggctcacctgagaaggatacagtgcaatacggtaaatataaaagtatcatttgtttttcaagggtgtatcttgagaaaggaaattattaggtttagaaaaggaggaaactgcatactagatagtaactaccacttcttttctactttcaaaatttttccrgcttctatattcaggcattttttttaagtgccaagtatttgtaatagaattttccttttttttttttttaataggaaaagattcccagctactacggaggctgaggcaggagaattgctcgaatccgggaggaggttgcagtgagccgagactgagccattgcattctagtgtgggcgacagagcaagactctgcctcaaaagaaaaaaaaaaaaaaaaggaagagatactattgtgttctctgaatatttcttttgaatctttcttctgatctgttgcattccaggcaaactctctgga

SEQ ID NO: 193619 - DNA, 601 bp, Human
tgtattcctgtctcaattttgcatgatttaaaactagtttactattcaaattgcatcatagtataaggtttctgctttgctatcactgacttttctgagtatttgcatattcacaggcttacttcagattgaagggcaacatagtacagaggttacgtgacatcagggttcctggactgcaaccccagttctgtatttatctagccctgtggtcttggactggttacttagttactttaaattacgtttcctcatctataaaatgaggataaaaatacagaactattgtgaggcttaacakagataacatacgcaacctggctagcaaatagtaaattgataaactgcatacagaagtagtaagactagtaatagaagtaatggtggcagcaaaaataatttgagtatcccagcagcgaggagaaaggtttcaatgtccagtggattaatgcctgacacaacctcaagtgtacatatctttgatagtaatggtaacctgttaaaatcatttaaggatataatgtataactgcatggagaatcataaggtaattgttcacattttctgtattataaggacatcaaagcacataggaggcaga

SEQ ID NO: 193620 - DNA, 601 bp, Human
gctttagtgggctctctaggtaattctgatgcacactcaacttgtagagttgctgtccttaattcttccatgagaaatacccggatgttctaagaatacacatttgtatctatgtcttgcctctgcagattctaattcataagaagttacacacaaatacacacacacacacaactgattaagtaactaaattgaataactttaaggaatgacaacgcctatttacacacacacacacacacacacacacacacatcacatcacatttgtagtaggaaaagcatgacatctgaagttaccrggtaacaattctagttttgcttctttctagctgtatacacctaagtgagttaacctctagaaatgacatctttctcgtgtttaaaatagggatagtaaatcttaaccttcatacttccaaggatttagtggctattaaatgatactttggttcagaaagcatgttgaaaggacaatatgccattcaaatggaatataaggtagtatagctgctactaattatcactttatattgttgctgtattcttgacagatcctttgaaatttgagagtgctagcagtaatttttaagtgtcaatgt

SEQ ID NO: 193621 - DNA, 601 bp, Human
gtgcccctgctctaagctgatagcctaacagttgagtatgtgtaaatatgctgaaaaacataaaactgttttgactggtcgtaagtcaaaaccttgaccccaaacctcatggttgtacacagcactttctggaattctactacatctttctggtcaatcagctctctcatgcttcgcaagttacttatttcacaccttccccttgtacctcaagcttccaataccaccttagcccctccacagactcaggaaatagacctgcctgcttttccctttctctttctctttctttctttctttttttctttctttctttctttctttctttctttctttctttcttttctttctctctctttctttttctttctttctctttctttttctcttttttctttctttctttcttcttttttcttgctttcttgctctttgtctctctctcccttccttcctctctctttcctttttctttcttctttccttccctcccttcctcccgccctccctctctccctccctccctttctttctctttctttctttcttctcgtctttctctttttttcttcttccttctttctttctctctgttttttcc

SEQ ID NO: 193622 - DNA, 601 bp, Human
aatccatttgagactaaccctggtgcccctgctctaagctgatagcctaacagttgagtatgtgtaaatatgctgaaaaacataaaactgttttgactggtcgtaagtcaaaaccttgaccccaaacctcatggttgtacacagcactttctggaattctactacatctttctggtcaatcagctctctcatgcttcgcaagttacttatttcacaccttccccttgtacctcaagcttccaataccaccttagcccctccacagactcaggaaatagacctgcctgcttttccctttctctttctctttctttctttctttctttctttctttctttctttctttctttctttctttctttcttttctttctctctctttctttttctttctttctctttctttttctcttttttctttctttctttcttcttttttcttgctttcttgctctttgtctctctctcccttccttcctctctctttcctttttctttcttctttccttccctcccttcctcccgccctccctctctccctccctccctttctttctctttctttctttcttctcgtctttctctttttttcttcttccttc

SEQ ID NO: 193623 - DNA, 601 bp, Human
aaatccatttgagactaaccctggtgcccctgctctaagctgatagcctaacagttgagtatgtgtaaatatgctgaaaaacataaaactgttttgactggtcgtaagtcaaaaccttgaccccaaacctcatggttgtacacagcactttctggaattctactacatctttctggtcaatcagctctctcatgcttcgcaagttacttatttcacaccttccccttgtacctcaagcttccaataccaccttagcccctccacagactcaggaaatagacctgcctgcttttccctttctctttctctttctttctttctttctttctttctttctttctttctttctttctttctttctttcttttctttctctctctttctttttctttctttctctttctttttctcttttttctttctttctttcttcttttttcttgctttcttgctctttgtctctctctcccttccttcctctctctttcctttttctttcttctttccttccctcccttcctcccgccctccctctctccctccctccctttctttctctttctttctttcttctcgtctttctctttttttcttcttcctt

SEQ ID NO: 193624 - DNA, 601 bp, Human
gctttaaaatccatttgagactaaccctggtgcccctgctctaagctgatagcctaacagttgagtatgtgtaaatatgctgaaaaacataaaactgttttgactggtcgtaagtcaaaaccttgaccccaaacctcatggttgtacacagcactttctggaattctactacatctttctggtcaatcagctctctcatgcttcgcaagttacttatttcacaccttccccttgtacctcaagcttccaataccaccttagcccctccacagactcaggaaatagacctgcctgcttttcyctttctctttctctttctttctttctttctttctttctttctttctttctttctttctttctttctttcttttctttctctctctttctttttctttctttctctttctttttctcttttttctttctttctttcttcttttttcttgctttcttgctctttgtctctctctcccttccttcctctctctttcctttttctttcttctttccttccctcccttcctcccgccctccctctctccctccctccctttctttctctttctttctttcttctcgtctttctctttttttcttc

SEQ ID NO: 193625 - DNA, 601 bp, Human
tgaccatgtagccatagaaagccctgcagttctggtaacacaaatacaatgcaacacttggtcagaacaggaccataatatattgactctgtgatgatatatggtatttgttctatttatttaattcttgcttcattttaaagtgaaaaatttacacttttagaaaagagaaatgtgaaatatatatcactgagctttgaagtattgtcaaaaacaatccattttctctttgtaggattaggtatggattttttccagggcaagctttctatttaatatttttctattacattcttttcaygggtgcctgtgttgcaaatgcagttaccagaatatgcaggctttccttgccatcgtgatggctcagattcccctatttacaacttctaacattcaacaataacttctattttagttataaatttcttctgaaaaaattacaatgaaacaaagactttcttaaaagtatgaaaaaagtaaaatcttgggcattgctgttatttataaagcacacagctataataaaccgggtgccaagtaccatcctatgagtactctcctattaagcattagtcatcctcataataatatctaacgttaa

SEQ ID NO: 193626 - DNA, 601 bp, Human
acatagagtaggaaaagaaatatttgcttccctcaccccaggatatttctgagataaaatatcattgctcctctaatgcatgtatcatcataatagttttggacaaatggtaaaatacgatcatgttttgaagaggaagcatttctttttggttcttctgtactctttcttcaaatcaaagcacactcttatttcacttcttttcttcttatttttcctctattctgacttacatttcaattttcttccttcttcttaatgtttctttctattcatgcttttgacttttctagagctatcrtagattgaaacggagagatttaacccagctttctgagtgaaaataaggtagagatttggtgcgagagtgttcctccttattttcagacacaaggacaagcaggtttctaataacacagctcacagtatgtactactttaaagcacagtatttactagaaaccagtttaacccttgaatgtcagcagaatgcacttgtgagatagacagtagttaccaggtgacccagcacagtgaaggttttgattttaacagctgtctgagcatgcactgaccatgtagccatagaaagccctgcagtt

SEQ ID NO: 193627 - DNA, 601 bp, Human
atgttatttccctttcatctggcttttctgggttgtccttgatcaagccgcttgccctctttctattcatttgtcaagtacatagagtaggaaaagaaatatttgcttccctcaccccaggatatttctgagataaaatatcattgctcctctaatgcatgtatcatcataatagttttggacaaatggtaaaatacgatcatgttttgaagaggaagcatttctttttggttcttctgtactctttcttcaaatcaaagcacactcttatttcacttcttttcttcttatttttcctctrttctgacttacatttcaattttcttccttcttcttaatgtttctttctattcatgcttttgacttttctagagctatcgtagattgaaacggagagatttaacccagctttctgagtgaaaataaggtagagatttggtgcgagagtgttcctccttattttcagacacaaggacaagcaggtttctaataacacagctcacagtatgtactactttaaagcacagtatttactagaaaccagtttaacccttgaatgtcagcagaatgcacttgtgagatagacagtagttaccaggtg

SEQ ID NO: 193628 - DNA, 601 bp, Human
gcttcccaggtgaggcaatgcctcgccctgcttcggctcgcgcccggtgcgcgcacccactgacctgcgcccactgtctggcactccctagtgagatgaacctggtacctcagatggaaatgcagaaatcaccagtcttctgcattgctcacgctgggagctgtagaccggagctgttcctattcggccatctttcagcatttgaaacttttatgagttgttctggtgctttgcaaacacaatcacaatttcgtaggaataaatctagctgaagtcccactgtgtgtatagggcccactgyttatctaatatacccattccaagtaccataattctgaatgcaattgaaaggtgaggttcatttgggcgatctaaaacatgttcttttgttttgggggggagcttaagaagcctaaacaaacaaaaaataaattaagaattactaatgtcattgcttctggccttttggctatgaacaagtatggagaattactaataccacatagaaaatgggaatcacatgtactttatagtaaaatttattcatgatcttatataaatatcagcactagaatttggagttctgctattaatttctaat

SEQ ID NO: 193629 - DNA, 601 bp, Human
tccgtgggcgtaggaccctccgagccaggtgtgggatatagtctcgtggtgcgccgttttttaagccggtctgaaaagcgcaatattcgggtgggagtgacccgattttccaggtgcgtctgtcacccctttctttgactcggaaagggaactccctgcccccttgcgcttcccaggtgaggcaatgcctcgccctgcttcggctcgcgcccggtgcgcgcacccactgacctgcgcccactgtctggcactccctagtgagatgaacctggtacctcagatggaaatgcagaaatcaccrgtcttctgcattgctcacgctgggagctgtagaccggagctgttcctattcggccatctttcagcatttgaaacttttatgagttgttctggtgctttgcaaacacaatcacaatttcgtaggaataaatctagctgaagtcccactgtgtgtatagggcccactgtttatctaatatacccattccaagtaccataattctgaatgcaattgaaaggtgaggttcatttgggcgatctaaaacatgttcttttgttttgggggggagcttaagaagcctaaacaaacaaaaaataaatt

SEQ ID NO: 193630 - DNA, 601 bp, Human
ctcagactgctgtgctggcaatcagcgagactccgtgggcgtaggaccctccgagccaggtgtgggatatagtctcgtggtgcgccgttttttaagccggtctgaaaagcgcaatattcgggtgggagtgacccgattttccaggtgcgtctgtcacccctttctttgactcggaaagggaactccctgcccccttgcgcttcccaggtgaggcaatgcctcgccctgcttcggctcgcgcccggtgcgcgcacccactgacctgcgcccactgtctggcactccctagtgagatgaaccyggtacctcagatggaaatgcagaaatcaccagtcttctgcattgctcacgctgggagctgtagaccggagctgttcctattcggccatctttcagcatttgaaacttttatgagttgttctggtgctttgcaaacacaatcacaatttcgtaggaataaatctagctgaagtcccactgtgtgtatagggcccactgtttatctaatatacccattccaagtaccataattctgaatgcaattgaaaggtgaggttcatttgggcgatctaaaacatgttcttttgttttgggggggagc

SEQ ID NO: 193631 - DNA, 601 bp, Human
caagcctgggcaatggcgggcgcccctcccccagcctcgctgccgccttgcagtttgatctcagactgctgtgctggcaatcagcgagactccgtgggcgtaggaccctccgagccaggtgtgggatatagtctcgtggtgcgccgttttttaagccggtctgaaaagcgcaatattcgggtgggagtgacccgattttccaggtgcgtctgtcacccctttctttgactcggaaagggaactccctgcccccttgcgcttcccaggtgaggcaatgcctcgccctgcttcggctcgcgcmcggtgcgcgcacccactgacctgcgcccactgtctggcactccctagtgagatgaacctggtacctcagatggaaatgcagaaatcaccagtcttctgcattgctcacgctgggagctgtagaccggagctgttcctattcggccatctttcagcatttgaaacttttatgagttgttctggtgctttgcaaacacaatcacaatttcgtaggaataaatctagctgaagtcccactgtgtgtatagggcccactgtttatctaatatacccattccaagtaccataattctgaatgcaa

SEQ ID NO: 193632 - DNA, 601 bp, Human
aggaggtagtctgcccgttctcagatctccagctgcgtgctgggagaaccactgctctcttcaaagctgtcagacagggacctttaagtctgcagaggttactgctgtctttttgtttgtctgtgccctgcccccagaggtggagcctacagaggcaggcaggcctccttgagctgtggtgggctccacccagttcgagcttcccggctgctttgtttacctaaacaagcctgggcaatggcgggcgcccctcccccagcctcgctgccgccttgcagtttgatctcagactgctgtgctrgcaatcagcgagactccgtgggcgtaggaccctccgagccaggtgtgggatatagtctcgtggtgcgccgttttttaagccggtctgaaaagcgcaatattcgggtgggagtgacccgattttccaggtgcgtctgtcacccctttctttgactcggaaagggaactccctgcccccttgcgcttcccaggtgaggcaatgcctcgccctgcttcggctcgcgcccggtgcgcgcacccactgacctgcgcccactgtctggcactccctagtgagatgaacctggtacctcagatggaa

SEQ ID NO: 193633 - DNA, 601 bp, Human
gggtcaggggtcagggacccacttgaggaggtagtctgcccgttctcagatctccagctgcgtgctgggagaaccactgctctcttcaaagctgtcagacagggacctttaagtctgcagaggttactgctgtctttttgtttgtctgtgccctgcccccagaggtggagcctacagaggcaggcaggcctccttgagctgtggtgggctccacccagttcgagcttcccggctgctttgtttacctaaacaagcctgggcaatggcgggcgcccctcccccagcctcgctgccgccttgsagtttgatctcagactgctgtgctggcaatcagcgagactccgtgggcgtaggaccctccgagccaggtgtgggatatagtctcgtggtgcgccgttttttaagccggtctgaaaagcgcaatattcgggtgggagtgacccgattttccaggtgcgtctgtcacccctttctttgactcggaaagggaactccctgcccccttgcgcttcccaggtgaggcaatgcctcgccctgcttcggctcgcgcccggtgcgcgcacccactgacctgcgcccactgtctggcactccctagtga

SEQ ID NO: 193634 - DNA, 601 bp, Human
gaggtgtcagtgtgcccctgctgggcggtgcctcccagttaggctgctcgggggtcaggggtcagggacccacttgaggaggtagtctgcccgttctcagatctccagctgcgtgctgggagaaccactgctctcttcaaagctgtcagacagggacctttaagtctgcagaggttactgctgtctttttgtttgtctgtgccctgcccccagaggtggagcctacagaggcaggcaggcctccttgagctgtggtgggctccacccagttcgagcttcccggctgctttgtttacctaawcaagcctgggcaatggcgggcgcccctcccccagcctcgctgccgccttgcagtttgatctcagactgctgtgctggcaatcagcgagactccgtgggcgtaggaccctccgagccaggtgtgggatatagtctcgtggtgcgccgttttttaagccggtctgaaaagcgcaatattcgggtgggagtgacccgattttccaggtgcgtctgtcacccctttctttgactcggaaagggaactccctgcccccttgcgcttcccaggtgaggcaatgcctcgccctgcttcggctcgcgc

SEQ ID NO: 193635 - DNA, 601 bp, Human
caactttggtgaatctgacaattatgtgtcttggagttgctcttctcgaggagtatctttgtggcgttctctgtatttcctgaatctgaacgttggcctgccttgctagattgggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcrtttcatcttccattgctgatacccttcttccagttgatcgcatcggctcctgaggcttctgcattcttcatgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaact

SEQ ID NO: 193636 - DNA, 601 bp, Human
tagttgatgcagtttcttcctaatctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccrctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattgggggaagttctcctggataatatcctgcagagtgttttccaacttggttccattctccccatcactttcaggtacaccaatcagacgtagatttggtcttttcacatag

SEQ ID NO: 193637 - DNA, 601 bp, Human
cgtcctctccagcacctgttgtctcctgactttttaatgattgccattctaactggtgtgagatggtatctcatagtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgactaggttgcgaaaattttctcccattttstaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctatccagttttcccagcaccatt

SEQ ID NO: 193638 - DNA, 601 bp, Human
ttatagcagcatgatttatagtcatttgggtatatacccagtaatgggatggctgggtcaaatggtatttccagttctagatccctgaggaatcgccacactgacttccacaatggttgaactagtttacagtcccaccaacagtgtaaaagtgttcctatttctccacgtcctctccagcacctgttgtctcctgactttttaatgattgccattctaactggtgtgagatggtatctcatagtggttttgatttgcatttctctgatggccagtgatgatgagcattttttcatgtgtyttttggctgcataaatgtcttcttttgagaagtgtctgttcatgtccttcgcccactttttgatggggttgtttgtttttttcttgtaaatttgtttgagttcattgtagattctggatattagccctttgtcagatgactaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgccca

SEQ ID NO: 193639 - DNA, 601 bp, Human
aattaagtgatatgatagcaaatgaagagttaacgtccatccgacatgagtgtataaagaaaaatctattaattcctttatgtagaaaaatgtctaggtttacgtgatatggatacaactagtcagtatagtcaagaaaaatcattcaaactgaatctcactgagtgaactctgtaaggaatgactggcagcatttgaacctttttttttattattatactttaagttttagggtacatgtgcacattgtgcaggttagatacatatgtatacatgtgccatgctggtgcactgcacccaytaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcat

SEQ ID NO: 193640 - DNA, 601 bp, Human
ctattaaagccagaggtgttccatttgcataggaagagccagcaattccccaataataaaaaacattagttttagaactgtattaaggaagagagagttgagatataactgaggaggtacagggcgaggaaaaggatagagaaatctgatgaaaatattctaggactgtgctgcctagtatagcatccatttagccatatgtggccactgagcacgtacaatgtagctagtcctaattcagatgagacataagtgcaaaaataaacactacaggactgggtaaaatagggaggtgatgacraataagaaggataaggctaatttgtgtcagagcttgctgaattccaggccagaaaatttaaaccgtgaacatcatatatatcaggctcaatatgatagcaagtgaagagttaatatacttagttaattaagtgatatgatagcaaatgaagagttaacgtccatccgacatgagtgtataaagaaaaatctattaattcctttatgtagaaaaatgtctaggtttacgtgatatggatacaactagtcagtatagtcaagaaaaatcattcaaactgaatctcactgagtgaactctgta

SEQ ID NO: 193641 - DNA, 601 bp, Human
taccataatttatccaacaaacaatgtaaaatgactgacatatcagtgtttgaattcttatgtctgtatgttaatcaagatttaagttggccttaacttcactaaatattcctaaagtcattcagaaatggtaataaaagaaaacatatggctgttataaacaaaatcaaaaaagaaagtaacaagagttggtgagtatgtggagaaattgaaaccctattcatttctacttaaatgtaaaatggctcagccaccgtggaaaatgaaatggtgattcctcaaaaaattaaatacggatgtrccatatgatccagcaattccaactgtaggtgtacactcaaaataaatgaaagcagggaccccagcatctatctgtacatccatgtccatagaaggattattcactgtagccaaaagatggaagcaccaaaatgtccattgacaaatgaatgggtaaatataatgtggcctatacatataatgaaatattattcagcctaaaaaacaaaattctgacacatactacaacatgaatgaaccttgaagaaattctgctaggtgaaataagccagttacaaggagccaaatattgattccactt

SEQ ID NO: 193642 - DNA, 601 bp, Human
gagacggagtctcgctctatagcccaggctggagtgctttggtgctatctaggctcactgcaaactccgcctcccgggttcatgccattctcctgtctcagcctcccaagtagctgggactataggcaccagccaccacgcctggctaatttttgtatttttagcagagatggggtttcaccgtgttagccaggatggtctcgatctcctaacctcgtgatccacccgcctcgacctcccaaagtgctgggattacaggcatgagccatcgcgcctggcctaaagtgtatatttttatcaytttttaagctgagtttcttagagttgcaatttcctttttagtttttttatgccacagattctacccaaaacattcacttggacttttatctttttttttgttttgttttctatttctcacttgcacataaaatacttcatttgtgtcaacacacaatgttactgttataattactgctgcagataacttttccagtaatttaaccctgctggccatccttatattgagcggtattgcaaattgacatctgaaaatatacagtgtttcaaaaagaccaaaagtcaccagtgccacagcaag

SEQ ID NO: 193643 - DNA, 601 bp, Human
ttcattaaagtgtatattttttttttttttttgagacggagtctcgctctatagcccaggctggagtgctttggtgctatctaggctcactgcaaactccgcctcccgggttcatgccattctcctgtctcagcctcccaagtagctgggactataggcaccagccaccacgcctggctaatttttgtatttttagcagagatggggtttcaccgtgttagccaggatggtctcgatctcctaacctcgtgatccacccgcctcgacctcccaaagtgctgggattacaggcatgagccaycgcgcctggcctaaagtgtatatttttatcactttttaagctgagtttcttagagttgcaatttcctttttagtttttttatgccacagattctacccaaaacattcacttggacttttatctttttttttgttttgttttctatttctcacttgcacataaaatacttcatttgtgtcaacacacaatgttactgttataattactgctgcagataacttttccagtaatttaaccctgctggccatccttatattgagcggtattgcaaattgacatctgaaaatatacagtgtttca

SEQ ID NO: 193644 - DNA, 601 bp, Human
agcttcatccagggatacttgaggaataaattttctaattttcattaaagtgtatattttttttttttttttgagacggagtctcgctctatagcccaggctggagtgctttggtgctatctaggctcactgcaaactccgcctcccgggttcatgccattctcctgtctcagcctcccaagtagctgggactataggcaccagccaccacgcctggctaatttttgtatttttagcagagatggggtttcaccgtgttagccaggatggtctcgatctcctaacctcgtgatccacccgsctcgacctcccaaagtgctgggattacaggcatgagccatcgcgcctggcctaaagtgtatatttttatcactttttaagctgagtttcttagagttgcaatttcctttttagtttttttatgccacagattctacccaaaacattcacttggacttttatctttttttttgttttgttttctatttctcacttgcacataaaatacttcatttgtgtcaacacacaatgttactgttataattactgctgcagataacttttccagtaatttaaccctgctggccatccttatattgag

SEQ ID NO: 193645 - DNA, 601 bp, Human
tgcaaaatacaaccatttacataaaactgctcaatgcacaggggaacgcaagaagcaacgaggtgatttagctggaacactattcatatgataccataaaatagttcttcccaactctgtcacctaatcagctgtgaaaacttacacatctgcaggtcaccccacagattgctaaatcagaatctcaatgaatttacaaaaatctcctttttcaaaaataatatattttgacctgcaaatccttaagcttcatccagggatacttgaggaataaattttctaattttcattaaagtgtatwttttttttttttttttgagacggagtctcgctctatagcccaggctggagtgctttggtgctatctaggctcactgcaaactccgcctcccgggttcatgccattctcctgtctcagcctcccaagtagctgggactataggcaccagccaccacgcctggctaatttttgtatttttagcagagatggggtttcaccgtgttagccaggatggtctcgatctcctaacctcgtgatccacccgcctcgacctcccaaagtgctgggattacaggcatgagccatcgcgcctggcctaaa

SEQ ID NO: 193646 - DNA, 601 bp, Human
gtgcaaaatacaaccatttacataaaactgctcaatgcacaggggaacgcaagaagcaacgaggtgatttagctggaacactattcatatgataccataaaatagttcttcccaactctgtcacctaatcagctgtgaaaacttacacatctgcaggtcaccccacagattgctaaatcagaatctcaatgaatttacaaaaatctcctttttcaaaaataatatattttgacctgcaaatccttaagcttcatccagggatacttgaggaataaattttctaattttcattaaagtgtatattttttttttttttttgagacggagtctcgctctatagcccaggctggagtgctttggtgctatctaggctcactgcaaactccgcctcccgggttcatgccattctcctgtctcagcctcccaagtagctgggactataggcaccagccaccacgcctggctaatttttgtatttttagcagagatggggtttcaccgtgttagccaggatggtctcgatctcctaacctcgtgatccacccgcctcgacctcccaaagtgctgggattacaggcatgagccatcgcgcctggcctaa

SEQ ID NO: 193647 - DNA, 601 bp, Human
ttgtgcaaaatacaaccatttacataaaactgctcaatgcacaggggaacgcaagaagcaacgaggtgatttagctggaacactattcatatgataccataaaatagttcttcccaactctgtcacctaatcagctgtgaaaacttacacatctgcaggtcaccccacagattgctaaatcagaatctcaatgaatttacaaaaatctcctttttcaaaaataatatattttgacctgcaaatccttaagcttcatccagggatacttgaggaataaattttctaattttcattaaagtgaatattttttttttttttttgagacggagtctcgctctatagcccaggctggagtgctttggtgctatctaggctcactgcaaactccgcctcccgggttcatgccattctcctgtctcagcctcccaagtagctgggactataggcaccagccaccacgcctggctaatttttgtatttttagcagagatggggtttcaccgtgttagccaggatggtctcgatctcctaacctcgtgatccacccgcctcgacctcccaaagtgctgggattacaggcatgagccatcgcgcctggcct

SEQ ID NO: 193648 - DNA, 601 bp, Human
ctgttatgtaaattagccacatatattttaatgagatttaaaaatatttcaattactgcacggatggctcttccaacatccccaaaggactaaatgcccttggctgaagtaacagagtatacagaggaaaccagctcagagagtagatcatataattttcaaatgacacaagtaagtcattcaagtttgtctttcttcttctttttttgtttcaacaaatagaagatccttagggaatatcttgccagaatcttgaagttccctaagtctaatggtgcttacctctctttctattataaaraaaattaaaaactccaaaattaaagcatagttttttatttgtgcaaaatacaaccatttacataaaactgctcaatgcacaggggaacgcaagaagcaacgaggtgatttagctggaacactattcatatgataccataaaatagttcttcccaactctgtcacctaatcagctgtgaaaacttacacatctgcaggtcaccccacagattgctaaatcagaatctcaatgaatttacaaaaatctcctttttcaaaaataatatattttgacctgcaaatccttaagcttcatccaggg

SEQ ID NO: 193649 - DNA, 601 bp, Human
aggctgttatgtaaattagccacatatattttaatgagatttaaaaatatttcaattactgcacggatggctcttccaacatccccaaaggactaaatgcccttggctgaagtaacagagtatacagaggaaaccagctcagagagtagatcatataattttcaaatgacacaagtaagtcattcaagtttgtctttcttcttctttttttgtttcaacaaatagaagatccttagggaatatcttgccagaatcttgaagttccctaagtctaatggtgcttacctctctttctattataaaaaaaattaaaaactccaaaattaaagcatagttttttatttgtgcaaaatacaaccatttacataaaactgctcaatgcacaggggaacgcaagaagcaacgaggtgatttagctggaacactattcatatgataccataaaatagttcttcccaactctgtcacctaatcagctgtgaaaacttacacatctgcaggtcaccccacagattgctaaatcagaatctcaatgaatttacaaaaatctcctttttcaaaaataatatattttgacctgcaaatccttaagcttcatcca

SEQ ID NO: 193650 - DNA, 601 bp, Human
atgttgatgctgataaaacccagactacactctgagtagcagaaaatatatgaataaaatatgtgtgttaaggctgttatgtaaattagccacatatattttaatgagatttaaaaatatttcaattactgcacggatggctcttccaacatccccaaaggactaaatgcccttggctgaagtaacagagtatacagaggaaaccagctcagagagtagatcatataattttcaaatgacacaagtaagtcattcaagtttgtctttcttcttctttttttgtttcaacaaatagaagatycttagggaatatcttgccagaatcttgaagttccctaagtctaatggtgcttacctctctttctattataaaaaaaattaaaaactccaaaattaaagcatagttttttatttgtgcaaaatacaaccatttacataaaactgctcaatgcacaggggaacgcaagaagcaacgaggtgatttagctggaacactattcatatgataccataaaatagttcttcccaactctgtcacctaatcagctgtgaaaacttacacatctgcaggtcaccccacagattgctaaatcagaatctc

SEQ ID NO: 193651 - DNA, 601 bp, Human
tgagacttcagttcatatctatataaaccgttcttttctcctctattgtattgtctggctgtaaagttcagtcatctgtgagccatcatggctattcctagataattgtttagaaagaacgatgttttcaaattattcaagttattcttacaaaacacgttaattcagcttcattacactcttgtgaaatagacaaatgtgactagataagagtatatgatatgtctcaggtaaatatcaggagttacttttatcctcggcttaggaacaaacaggtatctccacctattaaaccatcatkacaaagatttgataatttgaatgttacttccaacatcaaatagcttcctcccttgaactttgagtggttaccgatttgcgaaccatgctacccggatccacaccctgactcagccatctcctagccttgttaatttggacacattttcataaatgaaaaattgcatatttatgaagattaaatgccttgcatagagcaagtaccaaaaaatgtttatgaaaattaaggagctgatttctttgtgagcattttgaataacagatcttcagagaatatagaaataaattgttttggctgaaa

SEQ ID NO: 193652 - DNA, 601 bp, Human
gaggaaaaaagatgaagcaatttccccgactgccctacatttagctaaagtaagaaacacagtccgtgactttgtagtttttcatcaatagggaacgtgattatgcaagcatgagacttcagttcatatctatataaaccgttcttttctcctctattgtattgtctggctgtaaagttcagtcatctgtgagccatcatggctattcctagataattgtttagaaagaacgatgttttcaaattattcaagttattcttacaaaacacgttaattcagcttcattacactcttgtgaaayagacaaatgtgactagataagagtatatgatatgtctcaggtaaatatcaggagttacttttatcctcggcttaggaacaaacaggtatctccacctattaaaccatcattacaaagatttgataatttgaatgttacttccaacatcaaatagcttcctcccttgaactttgagtggttaccgatttgcgaaccatgctacccggatccacaccctgactcagccatctcctagccttgttaatttggacacattttcataaatgaaaaattgcatatttatgaagattaaatgccttg

SEQ ID NO: 193653 - DNA, 601 bp, Human
cctatgtaaaaaaataagggaggacagagaagaggaaaaaagatgaagcaatttccccgactgccctacatttagctaaagtaagaaacacagtccgtgactttgtagtttttcatcaatagggaacgtgattatgcaagcatgagacttcagttcatatctatataaaccgttcttttctcctctattgtattgtctggctgtaaagttcagtcatctgtgagccatcatggctattcctagataattgtttagaaagaacgatgttttcaaattattcaagttattcttacaaaacacrttaattcagcttcattacactcttgtgaaatagacaaatgtgactagataagagtatatgatatgtctcaggtaaatatcaggagttacttttatcctcggcttaggaacaaacaggtatctccacctattaaaccatcattacaaagatttgataatttgaatgttacttccaacatcaaatagcttcctcccttgaactttgagtggttaccgatttgcgaaccatgctacccggatccacaccctgactcagccatctcctagccttgttaatttggacacattttcataaatgaaa

SEQ ID NO: 193654 - DNA, 601 bp, Human
tatcaaactgaaatatttattgccatttccagggcatcctatgtaaaaaaataagggaggacagagaagaggaaaaaagatgaagcaatttccccgactgccctacatttagctaaagtaagaaacacagtccgtgactttgtagtttttcatcaatagggaacgtgattatgcaagcatgagacttcagttcatatctatataaaccgttcttttctcctctattgtattgtctggctgtaaagttcagtcatctgtgagccatcatggctattcctagataattgtttagaaagaacgmtgttttcaaattattcaagttattcttacaaaacacgttaattcagcttcattacactcttgtgaaatagacaaatgtgactagataagagtatatgatatgtctcaggtaaatatcaggagttacttttatcctcggcttaggaacaaacaggtatctccacctattaaaccatcattacaaagatttgataatttgaatgttacttccaacatcaaatagcttcctcccttgaactttgagtggttaccgatttgcgaaccatgctacccggatccacaccctgactcagccatctcc

SEQ ID NO: 193655 - DNA, 601 bp, Human
ggtaaaaaaatattcatttacatgttgctaatctttaccctaccataggaaatataatgtatcaaactgaaatatttattgccatttccagggcatcctatgtaaaaaaataagggaggacagagaagaggaaaaaagatgaagcaatttccccgactgccctacatttagctaaagtaagaaacacagtccgtgactttgtagtttttcatcaatagggaacgtgattatgcaagcatgagacttcagttcatatctatataaaccgttcttttctcctctattgtattgtctggctgtraagttcagtcatctgtgagccatcatggctattcctagataattgtttagaaagaacgatgttttcaaattattcaagttattcttacaaaacacgttaattcagcttcattacactcttgtgaaatagacaaatgtgactagataagagtatatgatatgtctcaggtaaatatcaggagttacttttatcctcggcttaggaacaaacaggtatctccacctattaaaccatcattacaaagatttgataatttgaatgttacttccaacatcaaatagcttcctcccttgaactttg

SEQ ID NO: 193656 - DNA, 601 bp, Human
tagcgatggttctctgtacatacacactgaaaggcaaaataacaaaaattacttatgacagtggacataaatttccttcaataagcttttcaaatttgattttacaatattcttcactctcatcacaagctcttcttctcattataaaaaaacagttttaacttgataatcagtgaatacacttaattttctttcagttctttcagtcacaaccttttaaacttttcttgaactgcagacatttaagtaagttgtttctgttctctcatagataaggcttgaatctttacagtttcctaacctagaaaacaggattttcatccagagtcagaggagacatgggaaatatttcgctttttggtccttagtctgcagtctaattcgggtaggtaaaaaaatattcatttacatgttgctaatctttaccctaccataggaaatataatgtatcaaactgaaatatttattgccatttccagggcatcctatgtaaaaaaataagggaggacagagaagaggaaaaaagatgaagcaatttccccgactgccctacatttagctaaagtaagaaacacagtccgtgactttgtagtttttcatc

SEQ ID NO: 193657 - DNA, 601 bp, Human
gcaggcagttcaggtgcaagccggctgctgagcttaacagatccagaaaaagatcctctgtgactcatcagagcatgctgcttcctccacccatgccctccccatcccttgggtggcagacccaggaatgggccatggagggcagggctgggctgatgagcctgttggggctcctctaggggatggccaaggccagctgccaccatccctatacccaggaccccctcactctactcctcccaccccccaacagggcaccttcagcctgcggaagctatgggccttcacggggcctggcttyctcatgagcattgctttcctggacccaggaaacatcgagtcagatcttcaggctggcgccgtggcgggattcaaagtaactaagtcgggacctgagtggggacactttcgagagggaggtgaccaggctaagtgttgaaggcccctgctggccatgtttctccaatgtggcctgggagctggtgttaagttcaaatgggcccgaaaagggtccccagggcagccctgccagaaggtggggcatttgtgtggggggtaggggactggactcctctctttaaaatatatatatgtatattta

SEQ ID NO: 193658 - DNA, 601 bp, Human
tggctaatttttgtatttttagtagagatggggtttcactgtgtgggccaggctggtcttgaactcctgacctcaagtgatccaccgcctcggcctcccaaagtgctgggataacaggtgtgagccaccttgcctggcgtaatttatttatttatttagagatgggggtctcactatgttgctcaggctgctcttgaactcctggactcaagcaatcctcccaccttagccttttaaagtgctgggattacagggtgagctaccagcgcccagccaggatgggactccatctctcccaccscctccccgaggagtatgcttggttagagggtaccacgagctcaggggctttctgaggctggcctctctggctgaaggcctctccctgcctcctcacagcttctctgggtgctgctctgggccaccgtgttgggcttgctctgccagcgactggctgcacgtctgggcgtggtgacaggcaaggacttgggcgaggtctgccatctctactaccctaaggtgagcttggggggcctggacagggagaaccactggccccaaaccccaaacagccattttcagcttccacgatcaaataaat

SEQ ID NO: 193659 - DNA, 601 bp, Human
tttaaagtgctgggattacagggtgagctaccagcgcccagccaggatgggactccatctctcccaccccctccccgaggagtatgcttggttagagggtaccacgagctcaggggctttctgaggctggcctctctggctgaaggcctctccctgcctcctcacagcttctctgggtgctgctctgggccaccgtgttgggcttgctctgccagcgactggctgcacgtctgggcgtggtgacaggcaaggacttgggcgaggtctgccatctctactaccctaaggtgagcttgggggscctggacagggagaaccactggccccaaaccccaaacagccattttcagcttccacgatcaaataaatacatcatctcacatggggcatcccaagtctgtttgtttttgttgttgtttgtttgtttttcagtcggagtctcgctccgtcgcccagtcaggagtgcaatggtgcgatgtcagctcactgcaacctctacctcccaggtacaagtgattctcctgactcagcctctcaagtagctgggattacaggcgcccaccaccatcatcggctaatttttgtatttttagtagagctg

SEQ ID NO: 193660 - DNA, 601 bp, Human
ctcagcctggggcggtggctcacgcctgtaatcccagcactttgggaggccaaggcgggtggatcacctgaggtcgggagttcgagaccagcctgaccaacatggagaaaccccgtctctactaaaaatacaaaactagccgggcatggtggcacatgcctgtaatcccagctactcgggaggctgaggcaggagaatcgcttgaacacgggaggcggagattgtggtgagccgagatcatgccattgcactccagcctgggcaacaagagcaaaactctatttcgaaaaaaaaaaaaaaagtttatctctgcctttccatctcctgtatgctcttcctacataaggtaggaagcccattggccagactgtctagtaaatgtagtctgagacgacagacaaatgtagtctgagacgacaggcaaataaccggcccacccttaatgaaggatcatctcctccccataggtgccccgcaccgtcctctggctgaccatcgagctagccattgtgggctccgacatgcaggaagtcatcggcacggccattgcattcaatctgctctcagctggacggtaccaccccagtgtaccccaactctt

SEQ ID NO: 193661 - DNA, 601 bp, Human
cacggccattgcattcaatctgctctcagctggacggtaccaccccagtgtaccccaactcttcaggccaggcagagaacagctgctgctacttccccccctaaccagtccctcccagagtctattttatcctgctgtcccctctgaagcagggctgctgccctgttttccagaaatgtaaagtgacttgtctaaagtcacacagatgtgagtcatgcaggactttgggactgcagccccaaactccctgctgcgccgggtgccaggtctctcctctagctctgccctgcctcgactgttstatgccacactcccactccccttgccctagctgtctgggggcgcttagggtcctgctcccaggaggccagattcctgtctccagccctgaggctccgtaggagttagagacccctggaccaggctgggctgacccgggccactctggtttcagaatcccactctggggtggcgtcctcatcaccatcgtggacaccttcttcttcctcttcctcgataactacggtgggtgcacaccccacctcataggggagtggtggtggtgagggtgctgtactgggagaagggctctgacatcgaa

SEQ ID NO: 193662 - DNA, 601 bp, Human
gttgcggtgagccgagatcttgccactgcaccactccagcctggcgacagagcgagactctgtctcaaaaaaaaaaaaaaaagaaaagaaaaagtgtctactgtgcgctgggaggaacagaccgtcaaggcctctgcccttctagagtttccgtgctagtggggtagacggatgacaagcaagtaaaccaacaaaggaaagaattataggccgggcgcagtggctcacgcctgtaatcccagcacttcaggaggccgaggcgggcgggcggatcacgaggtcaggagtttgagacctcaayagcctggccaacatggtgaaatcccgtctgtactaaaaatacagaaaattagccggaagtggtggcgcgtgcctgtaatcccagctactcgggaggctgaggcaggagaatcgcttgaagccagtaggcggaagttgcagtgaggggagatggtgacattgcactccagcctgagtgacaaagcaagactccgtctcaaaaaaagaaaaagaacaagaactatagagctgggcgaggtggctcacgcctgtaatcccggcacttcaggaggcagaggcaggtggatcgcttgagcccagg

SEQ ID NO: 193663 - DNA, 601 bp, Human
gtggtggctctgagggactttggcacttccctctccctttgatcttcgtagtctcgagagatagaccgggcccgccgagcagacatcagagaagccaacatgtacttcctgattgaggccaccatcgccctgtccgtctcctttatcatcaacctctttgtcatggctgtctttgggcaggccttctaccagaaaaccaaccaggctgcggtgagacacactttcccccgcacctgaggccacacacgtactcatgtcctgtaagccttgccgaggaccctaggcaatgcagctgagcccytctgagtctctgccctgatgatcttccctgttggcagatatcattcattcagcaaataatcattgagcatttgttatataccaagcacatcctagaccctggggatacagcagtcaatgctacaaagacccagctctctgcagcttaaatagggagggaggtgagcagacaggaatgaatacccaagggaagtacagagtgggaagaaataaagggggtgaagaagcatagttgggggtatgggggtggggtctgcattagcccaggtggtcaggaaaggcttcttggaagagatgacat

SEQ ID NO: 193664 - DNA, 601 bp, Human
tgatcttcgtagtctcgagagatagaccgggcccgccgagcagacatcagagaagccaacatgtacttcctgattgaggccaccatcgccctgtccgtctcctttatcatcaacctctttgtcatggctgtctttgggcaggccttctaccagaaaaccaaccaggctgcggtgagacacactttcccccgcacctgaggccacacacgtactcatgtcctgtaagccttgccgaggaccctaggcaatgcagctgagcccttctgagtctctgccctgatgatcttccctgttggcagatatcattcattcagcaaataatcattgagcatttgttatataccaagcacatcctagaccctggggatacagcagtcaatgctacaaagacccagctctctgcagcttaaatagggagggaggtgagcagacaggaatgaatacccaagggaagtacagagtgggaagaaataaagggggtgaagaagcatagttgggggtatgggggtggggtctgcattagcccaggtggtcaggaaaggcttcttggaagagatgacatttgtgctaatactggaaaaggaactagccagctcctccc

SEQ ID NO: 193665 - DNA, 601 bp, Human
taagccttgccgaggaccctaggcaatgcagctgagcccttctgagtctctgccctgatgatcttccctgttggcagatatcattcattcagcaaataatcattgagcatttgttatataccaagcacatcctagaccctggggatacagcagtcaatgctacaaagacccagctctctgcagcttaaatagggagggaggtgagcagacaggaatgaatacccaagggaagtacagagtgggaagaaataaagggggtgaagaagcatagttgggggtatgggggtggggtctgcattakcccaggtggtcaggaaaggcttcttggaagagatgacatttgtgctaatactggaaaaggaactagccagctcctccctgactctctgggatctgggacctgtgtctgtctccccttctgagtggatctcagtcatgaggctctaacaactgcagccagggttgggggcttcctgaatgctgagccctgtgggagaaggggtggccaggcctccaaggacctgggcactgccactgccttgctctgtgaccttgggaggtcacactcctccctgggtctcactctgttccttggcacaag

SEQ ID NO: 193666 - DNA, 601 bp, Human
cttcttggaagagatgacatttgtgctaatactggaaaaggaactagccagctcctccctgactctctgggatctgggacctgtgtctgtctccccttctgagtggatctcagtcatgaggctctaacaactgcagccagggttgggggcttcctgaatgctgagccctgtgggagaaggggtggccaggcctccaaggacctgggcactgccactgccttgctctgtgaccttgggaggtcacactcctccctgggtctcactctgttccttggcacaaggagggagatcaacatcaggrctgcaaacccttgtcttcaagaccaggcaggcgcagagttgtgggaagtggacagtgtgaagagggcatggcagccagctgtctctgtggtgatgccagctcttacgaacctaaaagaagctggaaactgggttcttatgccaggccttctcaattttaaatgttggcaacaaatccacattaaagaaaaaaaaaacccggccgggtgcggtggctcacgcctgtaatcccagcactttgggaggctgaggcagatggctcgcttgagcccgggagttcaagaccaacctgggcaacatg

SEQ ID NO: 193667 - DNA, 601 bp, Human
atttgtgctaatactggaaaaggaactagccagctcctccctgactctctgggatctgggacctgtgtctgtctccccttctgagtggatctcagtcatgaggctctaacaactgcagccagggttgggggcttcctgaatgctgagccctgtgggagaaggggtggccaggcctccaaggacctgggcactgccactgccttgctctgtgaccttgggaggtcacactcctccctgggtctcactctgttccttggcacaaggagggagatcaacatcaggactgcaaacccttgtcttyaagaccaggcaggcgcagagttgtgggaagtggacagtgtgaagagggcatggcagccagctgtctctgtggtgatgccagctcttacgaacctaaaagaagctggaaactgggttcttatgccaggccttctcaattttaaatgttggcaacaaatccacattaaagaaaaaaaaaacccggccgggtgcggtggctcacgcctgtaatcccagcactttgggaggctgaggcagatggctcgcttgagcccgggagttcaagaccaacctgggcaacatgacaagacccccatcgcta

SEQ ID NO: 193668 - DNA, 601 bp, Human
taactgatcttaatgcattctcaggtccagactagcaaagaatgagacctgggcggttataagctgatctacaagataaatggctgtgtattttcaagtagaggcatgtcttttaacataggagtacattctcatctatttgtgtattaatgacttgtgattccaaaatgtggcccattattcggaacttcagttctttctttttcttttagaaaattattcttaaaaagagaagctaaccatttcggagggattaaataggccctcaagtctggaagacataagttagaacttccaggayttttttttttttttccgagacagagtctctcactggctggaatgcagtggcgcgatctctgctcactgcaacctcgccctcccaggctcaagtgagtctcatgtctcggcttcccaagtagctgggattacaagcacgtgctaccacacctggctaatatttgtatttttagtagagatggggtttcaccatgttggccaggctggtctcaaactcctggcctcaagtgacccgcccgcctcggcctcccaaagtgctgggattacagcactgctcctttcctcaggacattttttacaa

SEQ ID NO: 193669 - DNA, 601 bp, Human
catgttggccaggctggtctcaaactcctggcctcaagtgacccgcccgcctcggcctcccaaagtgctgggattacagcactgctcctttcctcaggacattttttacaaagatatgcattgtagggaagctgtatagggggtgcactggtgtgtatgcttgtgcacatgtgcgggtgtatgtgtgtataaatctaggcttttattctggcccatctccccctttgagatgtggttttcaataagcaggctcaaaacattctgctgaaaatttgaaactttgaaaatctttaaaaaaaaagagaccatgatattgtgcctggtaggcagggctctcctgggattacagatgtatcacccagtagaagcccgaatgaagcaaatgtaaattatcagacattccagtaaggtaaggcaaggtgcatgcctattccagaacttacagcagagtttgcctagtgtggttatcataaacatgtatgggattctaccagtgctcagcccaggcagcaacagaaaaaaaggggcctctctgagagcctattagccaagttagggaggtgctaaggggtgaaaggtgttggggtggagatcagagaaa

SEQ ID NO: 193670 - DNA, 601 bp, Human
tttccagagtgcatcttccatctctgtgatgtccaataagatagccatacaaagtggctggctaaatttaagtaaaaattaagttgaaataaaattgagttcctcggtcacactagccacatttctggtgctcatttgccacatgtggctggtagctgttgtatttagcacagacatggaacatttccattattgcaaagttctattagcactgttccagcttctgaaaatgaaagcatgagatggtcttaaaaatagttctgtggcatatacttcagaatatagttgcattaattttccrtttgaagttgattttttttttttttaatgattcctctcagatcatcctgctggatcttctcaccagtggcctcctactaaaagtatcagctttcttttgggtaaagcagtgttgtcatctaaactgtttaagaatacatttgatcatgataaccttttaatttggaggcagtttgacaaagcctaaggttcattccaaacagattgctttttaattttttcctacacacttctgggaagtggcttattgaaacaactcatagattgtcacaaaataataattattggtaaattgtcttcc

SEQ ID NO: 193671 - DNA, 601 bp, Human
tattgaaacaactcatagattgtcacaaaataataattattggtaaattgtcttcccagcagcccacaaactaagagaatgtgactgacttaaaagctatgcccaacactgcaaataacctcatgcacaggtctgatcaacagcattgccttttcatttggaaattcttacccagaccctcaaagcaaaagtaatcagacaaattaatttaattctttcgttagtgtacacaccaagaaccgtttcataactgagaagctaggcctgtcaacttagctggagtctggagtccaaaattgasgaaattctgtcagatgcaaattgctgttggatttaagtgtgtgctggctccgtgccacagccagtgcatattgcggggagctgtggttccatgggggggagtgaaactcagtaagcaagcagtgccagttggggtgggcgaggatgatgggaagagaaatttgaaaaaggaataaattaaatcttgctgatactctgttctcattcccaaatatattgcatatgtcctcagagagacaggctgtttggagtgatttggaattaggacattgtttaagcatttagaagaaatggaatgttg

SEQ ID NO: 193672 - DNA, 601 bp, Human
ggtctgaaaatattaaatggaaaatcccagaaataaacaatccattaattttaaattgtgcaccattctgagtagcataatgaaatcttgcgctgtcccgcccaggacatgaatcatctttttgtctagcatatctacagtgtgtacgctaccctctgttagtcgcttaatagctgtctaggttatcagattgactgtcacagcattgtagtgcttgtgttcaagttacccttattttacttaataatggctccaaagtacaggagtaatgatgctggcaatttggatatgccaaagagaacccatgaagtgattcctttaagtaaaaaaagtgaccttggtgtttctttgctacagttcagtgctatccacacttttatttatccactgggtgtcttggaacatatcccccacagataaggggagactgctgtactgctggacatatatcatctcagtcttcacaccaacctgggaggtagatgttttgtccccattttgtagaagaggaacctgaggcccggtgacatttgaggagcattgcctgtggtcacatagccaataaattctgaattctaaataacttgctttttctcacccc

SEQ ID NO: 193673 - DNA, 601 bp, Human
aagtcagacagcagaccacttaagatcgatcgtagcaacttttcccacaaggatctgtgctcaggatactttatgcctagagaaatttgaaattagagactcaaagtgtgtatgacttggagcccaaaggttatttatttatagttggtttttctcaggtcttttgacaaagtaggagagtgaggaactcagcccttctttggctgaattaaaacctaaaggttaaaaaaaaacttactaagtgatgtaataatgggcttttataaactccctgactcttcagcacagtcagccttccccwggaaagtatgcttccatgcttcctcccattggtcatcctcttaatatttcattcagttggtccatgattaacatttccatatttttgttctttgctcttgttttctagaggtgaggaatggtattggactcgttgcctttgtttcctggctacagtttcaaaatgaaggctcagaagcaatttaaattttcatctagttttttccttctattctgaactctctgcttctccgtaaacccacttgatacttcaattcgtagagatacccagtgcgcttttcctaagtcacatatagagggc

SEQ ID NO: 193674 - DNA, 601 bp, Human
catttttattcccccattttattgatgataggggagaatgcaaaggtgtaagggtatttgtcccaaaacatgagcgtgatgagaaagctaaagttgtaaagcagatgtcctgactattcttagtgatttcatagtgttattttgtgttacactgtctattttaagttccgagctggaatttacaaagcaagacaaaactagggtagaactaaagagggtttcttgaaggtgagtggtaagtactttggtgatgtaaaggaagaaagaaagatgagtaggaaggcttacagacgggttttgwagtggaatagaacttgccgttttgtttatggcccgaaatcatcctttctctttaagcatattaaaaccattctacattatacttagccattttcctgctgaacgttttactcctaataccactgtcctgtggggaaggcattgaccaaaagatggcattttgtggtatatagcatgttgttaggaaattcagaattgaaagcgagcaccaaccaaagcagtagattcaacagcaggtgaaaaacaaaagctatagctgaccttccttttttatctgaccttccttttttatcctctactt

SEQ ID NO: 193675 - DNA, 601 bp, Human
tcccagctactccggaggccgaggcaggagaatggcatgaacccaggaggcggagcttgcagtgagcagacatcgcgccactgcactccagcctgggcgacagtgagactccatctcaaaaaaaaaaaaaaaaaaaaaaagctttgacattttggatactgtccctcatcaggtctttttgagctctttataatagatgaccatttcatgtatttaatccactgatgactgacaatataaagttacctgctgataaattagaagtttggatttaattttgtggtaaaactgaggtttttttgttgtgttttttttttaatttggaaatattacattatcttcaagtagctgtcagtcttagtttgcctagcactagagtagtagggaaacatgaacagctagagatgtgttcatcaagtcagagagagatgttgctgctttctgttccctataaagaattaggtgttggtactatttacttgttaggtgaatgaactcagaggaatacaaccaccctttctacaacaagagtcctcgacaagatgatcttggaagacttttgcagctctgaagtgctgttacctggaggccaggcaccatc

SEQ ID NO: 193676 - DNA, 601 bp, Human
aaatagtcttctgtatcttccaaagatatattctgagtatttatggatgaaattatgtgttgtatctgggatttgcttcaaaataaatcaatgggaaggaggatgtctaaatgaaacaagaattgtccatgtgttaataattgttgaggctgggcaaggtggttcacgcctgtaatcccagcactttgggaggctgaggtgggcagatcatgaggtcaggagttcgagaccagcctggccaacacagtgaaaccccgtctgtactaaaaatacaaaaattagctgggtgtggtggcacatrcctgtagtcccagctactcgggaggctgagacaggagaatctcttgaacctgggaggcagaggttgcagtgagccgagaccacaccattgcactccagcctgggtgacagagtaagactctatctcaaaaaaaaaaaaatcgttgaagcctcatgatggagatgagagttcattatactgttcgttctgcttatatacatgtaaaatccaattatttcagcaccaagctgtgattaaggaaagaatagctttgtaattttaagaaagagcaaagaaacgagtgctcagcaattctatccc

SEQ ID NO: 193677 - DNA, 601 bp, Human
aacaatctgttctctcacttggaatttggcatccttttgctctcttgaaaacaaaacatgattaagtacaatgtaggatctggaggagaacagagaacatattaagggtgtagtcaagtcctaaaaaaggatgagctttgattaaagattctcggccaggcatagtggctcatgcctataatcccagcactttgggaggacgaggcgggtggatcatccgaggtcagtagttcaagatcagcctgaccaacatggagaaaccccatctcaactaaaaatacaaaaaaaaattagccgggcrtggtggcgcatgcctataatcccagctacttgggaggctcaggcaggagaatcacttgaacccaggaggcggaggttgtggtgagccgagatcgcgccattgcactctgtcccaggcataaaaagatactcatctcagttttgtgacttgtttggtgactaaatccacttcccctctgtctctactttcccatccaccaaatgaaagttaggaagaatgccaacttaggaagagcttggcaagtgcagtactttaaaaataatgaaattatcatggcctttggattaacgtatttggttt

SEQ ID NO: 193678 - DNA, 601 bp, Human
ctttttttacccaaaggatttcgtttaaatattattacaaatatttctgcatgagcccattcctaatttcaactccctccataaaaatagcttttaaggggctttgctttgtccaatatggaacacagtagaggtacaaaattgatgtgtgacatttttaacatttacttgatggggccacatgactcttacttaatctttcagccagagggccacatttgtttgttcatggtgattaaaatggctttgaaaagaatgagcaaacattgattcccaccctcggcccttagtaattctgcayactacatatttggagaaagaagaggaatattcaccacactattcttgtgatttcaagtaataaaaatcagaccctttcttaatccagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccaggtagtaagaccattgga

SEQ ID NO: 193679 - DNA, 601 bp, Human
ttggggaggccaaggtgagtgaattgcttgagctcagaagttcaggaccagcctgggcagcataatgagatacctgtctctataaaaaatacagaaattagccaggcatggtggcagccacctgtaataccaggtactcaggtggctgaagcacgagaatcgcttgaacccaggaggcagaggttgcagtgagctgagattgcgccactgccctctagcctaggcgacagagcaagattcagtctcgagaaaaaaaaaaaagaccgtagagtctctcctcctcttttttaatgggtttatstaggcacgtttggaaaactcagcaagttatactagatttttacttctcttcatcctcagtatattctgttcatcatgttagaagccttacttaaagacagactttaccttagctatagttttatttgctcttatttggcttcctaaaactagcaaacctcagctctaaatcttttcttttttaatctaaccttgtaatctgtgtgcttatttggttttcaagtacccaaaatagaatgatgattgatattatttaatactggagtgcctctccagtattaaataaaatgtgctaagcatt

SEQ ID NO: 193680 - DNA, 601 bp, Human
gttcccaggttctgactttctcccattacatatttgtaattagtcatctttgatactgattcaaatttttgattaacattaattatatatatttacaagaatcttataaaaattaagattttatttcacctcattttgccctgtgagatagatggaaatagactatattctacccaggttaaaagtacagataatgagacaaaatgtcaatagaacctgaaaaaagatttttttagttgcctctagtctctgtttacttggtatagatagtatgctgctttttttttttttttttttttttaaatgtaactgctgggttgttttttgtttcttgttttttctttccctccaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtgagtatagaatttggtcctgaagcctggatatggctgctacaccaccatggcacttactg

SEQ ID NO: 193681 - DNA, 601 bp, Human
gtctctgtttacttggtatagatagtatgctgctttttttttttttttttttttttaaatgtaactgctgggttgttttttgtttcttgttttttctttccctccaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtgagtrtagaatttggtcctgaagcctggatatggctgctacaccaccatggcacttactgaaagaaatatggcttggtcaaactttcagctgtattgcgtgaaaatgtttttcctcataaaatgtcttaagccaggaagtagatgatagggcagaaatcagccactcctcctactctccagatactgagagctgacagatggtggaaagagaatccagtgctttcctttaaggcaccactgttctgagtcatgtttaagagtatagcctggataatcagcaggcagggtgaccataggtccatgt

SEQ ID NO: 193682 - DNA, 601 bp, Human
taccttcattctgttccttggcagggtggtaaagatttttaaattctgaagcagaatctcttttgccaaatagagttgaaagacagctgtgcttaacagtaaagatactttgcatagccttctaagtggctaggaaaatcttcaaaagtgatattctcaactgctccatccctagtggcttttgtattttggctaattaatcagaaactagtttgggagtcactatacagaaaaattggaatattgacacttcagcatttgctagtgctgaacttgatgaaggaatatataaatatacatrtatctcttgggtcctaaaagtaagcctctagagaggcatttcatgtgtttttatgcagaattgacaggggaattaaatgcagtagctcagaaattgggctaaatccagagtaacaaaactaattttaaaagctctgaagtatatatttagatttggctggttttttaccaatcttattccattttattccaggaaacaacttatttttatactttaaacagatcttatcttggagagtgtaccggagatttgttccttaggagaattttgtgtattcttttttggcatatgatttaaatg

SEQ ID NO: 193683 - DNA, 601 bp, Human
tcctagccagaaggagagtaaaaaggcaatattgcttgattacgtataacaaagatgccaatgaagatggagggctgtttgggtgtgtttgtttgtttaagctttatttaggagagagaactgaggagaagcaaagacatcagagaatctaaagaatagtcccagtcaggcacagtggctcacgcctgtaatcccagcactttgcggggcctaggcaggtggatcactagaggccagtttgagaccagcctggccaacatggtgaaaccctgtttctactttaaaggccaaaaattagccrggaatgatggcacacgcctgtaatctcagctactcgtgaggctgacacatgaaaatcacttgaacctaggaggtggaggttgcagtgagccaagatcacgccactgcactccagcctgggtgacagagtgagaccctgtctcaaaaaagaaagaaagaataggcccaagccagaaacgtatcgttgaccgagccttaaatatgttattttccatatacaaaactaatgagtgctaataagtcaccactggtttataaataccccatctcattgtgaataccacatgtacctgtgaattag

SEQ ID NO: 193684 - DNA, 601 bp, Human
aaagtaaaaccagtaaaagttaaaaagcttcttaacccctttgtagaataaaaaatgttttctagagaagggcgattttagaagctttgctctagaaatttccatttgggataatcttgactccttcccttcctttttggatatttttccttcggggaacaaaatctgttcaaaaggggactaatctaacccagttgatggtcatttcttttcctacttaaagcttggtagtgttagcatgagaggcagtttgtgaaataggtgaggtcccaggctgggcattggggctcctcagccatcrtctttcttttgccactaattgtcgagagggcttgctaatcagtgtttattcttcctgcctgcaactggaaacagcccttgcctattcctgtacagtgtgatgatactaaaccagctagggtagaagcacttgctttctctcagcaaggcatgtgctgcatagcctctttgaaagacagaagaataaattacaaagataaattaagcaggatctttgatttgaactcataacctggtaggggagccagatacattaatgaatggtaaaatatcatagtagaggtttgtagaaaagacatgg

SEQ ID NO: 193685 - DNA, 601 bp, Human
cttgctaatcagtgtttattcttcctgcctgcaactggaaacagcccttgcctattcctgtacagtgtgatgatactaaaccagctagggtagaagcacttgctttctctcagcaaggcatgtgctgcatagcctctttgaaagacagaagaataaattacaaagataaattaagcaggatctttgatttgaactcataacctggtaggggagccagatacattaatgaatggtaaaatatcatagtagaggtttgtagaaaagacatggcagctccagcaagagagcagtacctgcctgsgtttgttggagatggtattaggaggcggtatttgagcagcagtagaagggcacgcaggccacatggctgtgtaaccatgccttcagaactcctaaaacaagagaccttggagagtccttggcagcatcctcctgctgtctatcatcttggaaggcccacttgatgaatttggattatccagttttactggcattgctagaaaatctacttctgttcttgcagatctggctgagagagagaagccttgtattacttgtctatttacataggaatgtatggactgtagaagcttcaggtttg

SEQ ID NO: 193686 - DNA, 601 bp, Human
gctacattacctttggtgagcagggtgcacttgctgcttttgtgccgctttaatgagttcacacagcagaatacctaaatctgcacagaaccttggttaacattttaaggtaggcaaacgcaggcataccaacttgttcctgttgccattgcagtgactaaaggagggatgtcacagggtattaattacagagcaggccatatgctatttttgtacagtaatcctttcctttttttccccatttttcttaaatcttaaaaataagactgaattctgatatcaagagttaaggtcccttcartagttcagctggtagagcagaggactatagctacttcctcagtaggagacgtccttaggttgctggttcgattccagcttgaaggagacaagtacagttttggctgggcacggtggttcatggctgtaatcacagcactttgggaggttaaggcaggtggatcacgaggtcaggagatcaagatcatcctggccaatgtggtgaaactctgtctctactaaaatacaaaaaaaaattagctgggcatggtggcgcacgtctgtagtcccaggtactccagaggctgaggcaggagaattg

SEQ ID NO: 193687 - DNA, 601 bp, Human
atacctaaatctgcacagaaccttggttaacattttaaggtaggcaaacgcaggcataccaacttgttcctgttgccattgcagtgactaaaggagggatgtcacagggtattaattacagagcaggccatatgctatttttgtacagtaatcctttcctttttttccccatttttcttaaatcttaaaaataagactgaattctgatatcaagagttaaggtcccttcagtagttcagctggtagagcagaggactatagctacttcctcagtaggagacgtccttaggttgctggttcrattccagcttgaaggagacaagtacagttttggctgggcacggtggttcatggctgtaatcacagcactttgggaggttaaggcaggtggatcacgaggtcaggagatcaagatcatcctggccaatgtggtgaaactctgtctctactaaaatacaaaaaaaaattagctgggcatggtggcgcacgtctgtagtcccaggtactccagaggctgaggcaggagaattgcttgaacccgggaggtggaggttgtaatgagctgagatcgtgccactggactccagcctgggcaacagaa

SEQ ID NO: 193688 - DNA, 601 bp, Human
ggatgtcacagggtattaattacagagcaggccatatgctatttttgtacagtaatcctttcctttttttccccatttttcttaaatcttaaaaataagactgaattctgatatcaagagttaaggtcccttcagtagttcagctggtagagcagaggactatagctacttcctcagtaggagacgtccttaggttgctggttcgattccagcttgaaggagacaagtacagttttggctgggcacggtggttcatggctgtaatcacagcactttgggaggttaaggcaggtggatcacraggtcaggagatcaagatcatcctggccaatgtggtgaaactctgtctctactaaaatacaaaaaaaaattagctgggcatggtggcgcacgtctgtagtcccaggtactccagaggctgaggcaggagaattgcttgaacccgggaggtggaggttgtaatgagctgagatcgtgccactggactccagcctgggcaacagaacaagactcttgtctccaaaaaaaaaaaaaaagagttgaggctgggtgcggtgtctcacgcctgtaatcctagcactgtgggaggccaacatgggca

SEQ ID NO: 193689 - DNA, 601 bp, Human
ctcatgcactggctgattatgatagcttacagtttggaattaataagcttgttcacactgcacccaatgccactggaatgtctcctttgtgaaatgtaatttaattcacctcagtggtaaaggtgaacctgtttattggtgatgaatctgttgatttaccaaatttcattaaatctaaactatacacttttttcttttttctttctctctgtcacccaggctggagtgcagtggtgtgatctcggctcactgcaacctctgcttcccaggctcaaacaattctcgtgcctcagcttcccargtagctgggaccacaggcgtgtgccaccacacccggctaatttttgtatttttagtagaaacagggtttccagctgggcacggtggctcacgcctgtaatcccagcactttgggaggccgaggcaagtggatcacgatgtcaggagatcgagaccatcctggctaacacagtgaaaccccatctctacaaaaaatacaaaaacttagctgggcgtggtggtgggtgcctgtagtcccagctaccctgaaggctgaggcaggagaatggcgtgaacctgggaggcggagcttgcaataggc

SEQ ID NO: 193690 - DNA, 601 bp, Human
tcccctttccctgcttgctctacacaggagtacttttctcaccgggtacttgtttggtgacctggagtgtgaggcagtgaatttcatgctgctttcagggcccagtagacaggcagttcagtagaggccaagaggtaaactggcagccaggtacagtgagagggaagcctgacctggcagcctgtgataaccggactggaaggctgggcatcataatagtctcagggctgccagcatcacctttggcactggtagctgcttgtgcatccaggaggaaggcctgttaggcagctgctgcccrattccacagccagcaggcagtcgtgggagtccctgcccagtgagtgcagttgtgtagcgggcagggatagctccctgtcctggtgagagacccaggaagggatgaatccttaaaatgaacagactgttcataagcctcctctctgggacttagaaagagcaactttgccttcttctgtgctgcagcttctctttggcagagttgggccccagaaaggagaagcaggagacaaacagctgcatccaccctgaaaaccagattatgttactaatggtgggtaggagttaagtgactcagctg

SEQ ID NO: 193691 - DNA, 601 bp, Human
ttgagattggaaatctcagatgcagctaatgcatatttttgcctcatgcatatttttgcctcacctgtccttcactagtgtcgtgaaactggttggtggtgtctacttacagatacatactgagagagagggtgccttaagagaaactggttggtggtatccacttacagatacatactgagagagagggtgccttaagaggttctgttgctgctttaatagcacaggtgctgccattctcttagccttccagggcaagcagcagcttgttaggtgacaatttgctagcatgttgatcttygtgtgagtgtgagtcacaagctacaggtctgtgtatcccagatgagaggactttgctgtgaaagatgacattagcatgtggattaacactttatttgaataactgttttgtttaatttgcattaggaaacaactagtgaattacatatagtgcaacttaggacaaagatgtcttctttaaaaagtgaattaacttaaagaaaaatattaaatacaggaattgcaaagacatggcaaaaacaatgagacacagaaccgaagtgtgagaaccccatagggaattctaggcatgcatatgtga

SEQ ID NO: 193692 - DNA, 601 bp, Human
gactgtctgaatctgggttgctttggacaagtgtacttgttgatggaattatttgcaaggtatcatcttaggtcaggaggggaataggaacaaagatgtagaagacattgttcctgtctgtaaaagcttatcacctagaggaggtaagatgtattcatgaacattgaataagtcccattgtggacagtctttctcacaaggcttttagaagtgagctttatgtcaagttgagcaatgcctgagagtaatttggtaggattatttctttggtttgaaaaatctacataagacagtgaagacrtgtttttcaaatttcttcaacctgctacatgtatctgaagtattttctgttttggaaacagcttttcaagctttaatttactcaaccatttcaggagaagctactgtgtgtcaggcatccttaggtcctggacacactgtttaacaagatgggccctgcctatgggagcccataatttgaagggaaagtcagatgctggacaagtcatctcactgtgagtgagccagaaaaaacagcattgtaggtcaaagtggtgcaaagatcgtgaggtaggaaaagagactaaagtggttctaggaa

SEQ ID NO: 193693 - DNA, 601 bp, Human
tgaggtaggaaaagagactaaagtggttctaggaaaaatacaggcagggtaaaggaggatacaggtgaggtgtgggatcagatcagggagggccttacggatttctgagctggatcttttacccttttatttagccaaagaggtcatgtagttattttactaatttgcattcagattgttctggcttttagaaactacaaacatttctatgattagtattcttgaaatgatcttgttgtaagtttgtgagtacatctggagggaaactttgagaaggattgctgagttcaagggcttgtgygattaagttttaaaattataaaatgtggtgcatccgtgctaataattaccattcagccattgaggaaaatgaggtagatttatgcatattgatgaagaatgaagaccacaatatcctgtgttacaggaaagagatattgctaagtggcccttcaaaatagtgtaaattgttaaatccgtctacagtggatgaagatgtctgcttcctccaggttcactatcaatgttttaaaactctaatctttatcagaaaagaaatatttcattgttttaaatttgttgtgtgtatggtgaacatatt

SEQ ID NO: 193694 - DNA, 601 bp, Human
gctagggaataatctgctgggaagcgcgaggcatcacttccctaactgtaggagctcaaactcctgtgttcttccagtagacctgggagcgaagagaagcaagacattgctgtggaggcgaagtctccgtattaagatcttgctggttttttaagttttcttggcacatactagggcaaattcagactcttgtcgtgatacaagggtcgttggcgtgattttgctgcgactagagcaatttacgttcttgcaaatctgtcgcaaatttttgcaaatgtctgggctgctgatgctctgactyagcttctacagcagtggttcgcaattggctgcatatcagaatcacctgggatgaaaacataaataaataaataaataaacctgatgcccttgcttgacgcgacactaataaatcagaatttggtcagggtctgagcagtggtattttctaaagtatctctagtgttctcttgggcagctagggttcagagtcacgctttctaatgcctgactctggcccccacggtaatcctgattagggtcacctgcgccagggttccccttccagtgtaagctgagtgggctctaccacacgcatttg

SEQ ID NO: 193695 - DNA, 601 bp, Human
gacctgggagcgaagagaagcaagacattgctgtggaggcgaagtctccgtattaagatcttgctggttttttaagttttcttggcacatactagggcaaattcagactcttgtcgtgatacaagggtcgttggcgtgattttgctgcgactagagcaatttacgttcttgcaaatctgtcgcaaatttttgcaaatgtctgggctgctgatgctctgactcagcttctacagcagtggttcgcaattggctgcatatcagaatcacctgggatgaaaacataaataaataaataaataatcctgatgcccttgcttgacgcgacactaataaatcagaatttggtcagggtctgagcagtggtattttctaaagtatctctagtgttctcttgggcagctagggttcagagtcacgctttctaatgcctgactctggcccccacggtaatcctgattagggtcacctgcgccagggttccccttccagtgtaagctgagtgggctctaccacacgcatttgggttaaagtgatcacaattttggcacggattttattttgaagtctactagaaacgtattcttgggcttcctgtggtggt

SEQ ID NO: 193696 - DNA, 601 bp, Human
tctgggctgctgatgctctgactcagcttctacagcagtggttcgcaattggctgcatatcagaatcacctgggatgaaaacataaataaataaataaataaacctgatgcccttgcttgacgcgacactaataaatcagaatttggtcagggtctgagcagtggtattttctaaagtatctctagtgttctcttgggcagctagggttcagagtcacgctttctaatgcctgactctggcccccacggtaatcctgattagggtcacctgcgccagggttccccttccagtgtaagctgmgtgggctctaccacacgcatttgggttaaagtgatcacaattttggcacggattttattttgaagtctactagaaacgtattcttgggcttcctgtggtggtgctaaaaagacggaccgtagtttcttactcgtgccttggttattcattctgaatggagattagggctgcttcctttttcttggcactgttttagtttctgcctaatttttgctatccaaacagaacacgaacggtggaacgtggaagagttacattaaaaacggcttcttttgttgcttttaagaagttctgggccag

SEQ ID NO: 193697 - DNA, 601 bp, Human
aaaattttttaaaaagcctttaaaaataaaaataatcacgtgtggcacaagcctgtagccccaccactcaggaggctgaggtgggaggatccctggagcctgggaagtcaaggctgcagtgagccatgatcacgccactgcaccccagcctgtgcaacagagtgagaccttgtctcaaaatgaataaataaataattttaaaatcgtcacatgtggctagtaagtaccatattggacatgacagcattaacgctgattctcttgtagccatttatttcaaggaaattattagaaatatacmcaaatgtatatacatagatgtgttgcagcatcattcataattttggaaagctagacaatgttaaacagggtatttgtagtatagtaaatttatttggtctttgtccctggttcctgttacagagccactagaacccttggaattttctgatagtgtagtgtatttttttgttattcttaatgtaccccttttgataacacctgagttcatcctaatgagataacttttaggatctggcctatctatagcctaaggaaggatggggccagtcaccaaaaagactaagtgattagagtttta

SEQ ID NO: 193698 - DNA, 601 bp, Human
ctctaaaacaggggtcgtcaacccccggccatgtactgataccagtctgtggcctgtaaggaacccagccacacagcaggaagtgagcagcaggctagtgagcgaagcttcatctgtatttacagccacttcccatcgcttgcattactgtctgagctccacctcatgtcatatccatggtagcattagattctcgtaggcttgtgaaccctgttgtgaattgcacatgcaagggatctgtgttgcctgctccttacaagaatctaatgcctgatagtctatcactgtctctcatcacccscaggtaggaccgtctagttgcaggaaaacaagcttagggctcccactgattctacattatggtgaattgtataactatttgattatatattacagtttaataattataaagtacacaataaatgtaatgtgcttgaatcattatgaacacccccttccccaagaccctagtccgtggaaaaatagttccccacaagagcagtccctggtgccaaaaagggtagggaccgctgctctaaaacatttggaagttagtgaggtgtgtttacattatttgctggcagaaaagttaaaatgacgt

SEQ ID NO: 193699 - DNA, 601 bp, Human
tgttttgttagcaagcctcccaggtaattttgatataggaagaactgtggccacaccatgggaaacagatccagatggacacagatgactaagcttccaaaacaagaagtattgacctaacccgtacattgactgcatccaacatcggaagaactgaataggaggttttcttttacctacatccgttgatcaaggtctaaaaacaacttgttgggccgaatttaagcagtcctgacatagaaaatttatttctgttaaagattgagttttgggaaatagaattttctgatttaagaaacamgggactatttccaagattaattcctcatagatcagtcatttttttcctcagaaggataacacctactgagaggcaggttctaactgtggcttagatccaaagatcctccctcatgcctcccctagaggacctgtaaaggtgacttgtggaaagaacagatatgtctttatgtatgtaaagcaagtgatatctgatttcaaagaagacaaaaccaaaagcttatttttttaatgataaggaattcccttcaaaataattatagaactgatgtccctagcccttccagtatttgcattccaa

SEQ ID NO: 193700 - DNA, 601 bp, Human
atatgagattattttttaaatgtatttcatgcaagtttttaactatttaataatgatagatggggtatacacttataagctcaaagtcaagtgtgtttatgttgtattcactgacctaaagtaaaagaaataccctactcagccactgcattgtagtctgctgaagagtggtttatttataagggactagagaagcactttctaacattttgccatgctacccaggattttaaattatatcagttgaagttctctagcttggatttttgggttttttggagggtggtttttttgttgtcarttaaaaaattatattcaagctacttctaatattttaagaaagtgaatcaatccatttgaagctcttagcacaatgtttggcacataataagtattatgagttttagctcattgaatgagttacacagccatggaatcaggcatctaatatagtataggtaattaagcagataggggtactatgttagtaaataggaaattacaaggtaagattatagccaagtcatggatatttgctttacaggaagactcttcacttagcaatagtagcataccatttccatttttcatcctaactagt

SEQ ID NO: 193701 - DNA, 601 bp, Human
aaaggttgcaagcatacattccacagtgttatagaagtatgacaacctcaattatttagctccttcaagttatgaagaaaagttgtttggctagggatgtcggggtgagagaatttagaaaggagtacactggaagcttctgaggttctggcagtgttctctatcttaatttgtatagtagttttgtgaatgtatattttgcaacagtgtactaagctgtacatttctgtatgtttttccatatgtattgtacctctggttgtttaaagaatttctgatattggggtattgaaatcttcarctaatgttgtattgtctgttgctcctctgaattcagtcagtttttcctttatatattttatggttctgctgttagatacgaatacacttatagttgttatattttcccaatttgttgacctttttaccgttatgaaatatccccttttttggtctccagtaatgtatcttgtcttaaagcctgttttgtctgatagcacttcagctacttaaggttgctgtttacacagtatcttttttttatacttttattttcaacctgtatatgtctttgaatgtaaagtatgcatcctatagtcaa

SEQ ID NO: 193702 - DNA, 601 bp, Human
tagtacctaatttcagtgaaatatattgatagaagctttgctttagcatagctccatttcctctcctccacttcgaactatcgttgtcatgtacattttatcaatatatgttgtaaacctaaccactgagtgtcataattacagctttttataatcttttgtcttttaaagaaattaaagaagagagaaaataatattagagtcttatatctgcttaccgtttctgatgttcttcatttcctcctgtggttttgagtgaccatctactgtcatttcctccagcctgaaggactttaatatrtttgtgaggcaggtttcacagcagtaaattttctttgttcattgtgaaagtctttatttttccttcatcttgaggtagttttgttaaatgtataatctttgttgaaaatttttctcattcacattttaagtatatcattacactgccttctggcctccactgttctggtgagaagtcagaaattaatagtcttgttctcttctatcatttttctcttgtggctttcacattttctctttgtctttttctctcaccactctgatactctggtgtcttcagatgtagatcttctattctact

SEQ ID NO: 193703 - DNA, 601 bp, Human
atgaaaccatttaagcattaagtaacactccaaattttttgcagtgcttttattgtgtttataatttaaaacaatctgtgaggcagaattgaattacaaaatcaaaagcagtatgtacagtctgcattcaaagaaaggtaatgtgggaaaagaactgaaaggtggccccagggaggagctgtggtttgtactagactttgaaaactacagaaaatttggtgttagagaattaggaggaggatatggaagagttattccatggaaggacatgggggacacataagcaaacaaatggaatgarggataagcatggtaagctctgagagacaatagtgagatcagactgtctagcagagaggacttgtgttgcatagcttgagtaggttggaatagaagcttgatgtagtgtgaacaagagatttctgaatcttgatttttctcgtctgtaaaatgagtcaagacctccatgcccacctctcaaaattatcttgaaaaacaaatgagctgatgtatgtgacagcagattttcagcagtgaagcgctgtactggtataggttgtaatgaattttgaataccatgttgagaagtttacagttgtgg

SEQ ID NO: 193704 - DNA, 601 bp, Human
ctactcaggaggctgaggcagaaggatcacttgagtccaagagttcaaggttatagtgtgtgttgatcacatctgtgaatagacactgcactctagcctggacaacatagtgagaccctatctctttttttttttttttttttttaagggactttggtagattttctgtttttggggtttttttgttgtttttgttttaaagcactgtcaaaaggtggcaggcatacagactcttctggtttggcttgtgccagttatattgttaagatgttccacaaaaaagtgcacacactcagcatgygtctactttgctttgcaggataacattctctcagcctttgtgtttgatgagtttttggccatctatgtgagtttctgagttgtttgaataagctaagaaaagacagacttatttatttaggtttcttcacattttcctatgttaacctgctaacagtatactgccctaaccctacagacttggcttgtacccacaaatgtgctctcctagcatactgtgtctccttcatgacacaaaccatgaagggttcttataaggattaaagtacttatttcacagaaaataatagcttatttattg

SEQ ID NO: 193705 - DNA, 601 bp, Human
tatgtaattctctgatgtctttcagaaaagaagagaagagagcactagactaaaggaggagggaaatgaacagtttaagaaaggaggtaagacgactttcagcactgataatctggtcatcttgactcctcatcctgttgtagagtctgtgaagaaaccccaaagaacatctgaagaaaccccaaaaccagacttcacaatacagtgttgcttcccagtaccttggcattttgagtttttaaccaggccaaattattcatctgatggtgaccagttaccatttgtctcttggcacatgcayagtctttctgtaatccactatctgttagtctagaatcaggggtaaaactcttgagctcttgctttggaaaacactaacctggaatattaaaggttatgtgctgcattgctgtgaaagcagagtcgccgctcctcacttgctgtggggctgtgaaagcagcctgactgctctggtatggcctagggctgcctgtcctttggttgctctttctttctttctttctttttttaaattctccaaactgcttcagaaaggttgctctttcatgtgccattttctttggatgccttaagtagggag

SEQ ID NO: 193706 - DNA, 601 bp, Human
tagatttgtttctgatttgtctgattttcctatttagtcttcataatccttggattgaaatgagagtggttttttttttttttaaaccataccactttttaaactatggctacttacatccaaagtacaaaggataggttatttaacatacctttaagcaaccatgatgctggctcaagattggaagtggcagtgttttcatttgtttgtttagatcagatatctctttgatactgtctgaaattctcaaatgcctctaccacagtcactttaggtgacaaggttttttttgttgttgttkttttttttaaaggccccagggcagggttgcgggggtgggtgcttgaatgcttggacatgcagaaaggttacggttttttttttttaccagaacttgtgtaagattcaatcttcaaagcagagtatttttggagtatttcatgtggcatgagagaagaaataattttatagtatacaaaccaacattttgtattagagaaaacaaaacaattggtttaactttatttaaaacaatattcattaatgtgtcccaccagcaatcagaattaacatctaacagtttttacacttacctggaaaa

SEQ ID NO: 193707 - DNA, 601 bp, Human
ggctggagtgcagtggtgccatcttggctcactgcaacctctgcctcccaggttcaagcgactcttctgcctcagcctcctgaatagctgggactacgggcgcatgccaccatgcccggctaatttttgtatttttggtagagacagggtttcaccatattggccaggctgctctcgaactcctgacctcgtgatctgcctgcctcgtcctcccaaagtgctgagattacaggcatgagccactgcccccagctcaagattagggttctttcagaaaaccttctcctgacccaatattctmcttcaattgctgtaccatttatctgatccctttcattgaaataattgtctatacttggctgtctctactttgtcttatcctatttttctccttacttcacttccatggagcatttgttttatccatgccattgaaacccatcttgtaaaggtcatcagcagtttcatcttgctcaatttagtcgttgcttctctagcctaactttacttgaccttacctgcatttaatacagtttatcattcctttctcctttaaaattctctctcttaaatttaatgaactctattcattttttccctg

SEQ ID NO: 193708 - DNA, 601 bp, Human
actaataaatacatgccatgtgtatggcagagtttctgtcttcaactctgacttctaccctgtagtctagtgtcctgtatcccactgcaaagttctttcttcttggatgtctggtaggcacctcagatttaacgtgcccagcccccacacacacacaaaacttgcagttagttttttccattctaataaatgacattaccatctgtccccttgcttaagttaaacctttggagtcatccctgattgttctttcgtgtcacatggctaattgattaattagcaagttccatgggctcaaatktaaagacatatttaatgtaatccggctgctgttttccatctctactacttccagcttagaccaagccaacatcttctctcatctggaccactgcattagctttccagctgatctcacagctttcagtcttgccccacccgccaacactacagccaaagcagtccttcaaaaatgtaaatcagagtatgtctgaagcttgcttgaaaactttccagtggcttctcatcacactgaggaaaaagtccaaactcctttccctggccaggaaggtcctccatggccctacatttcagcctctga

SEQ ID NO: 193709 - DNA, 601 bp, Human
cactgcgcacttgaactctgttctggcctgtcctggactgggcaaatgacaagtaggcaaaaaccaggacttggagtatagaccaggatatggcaaactacagccacaagccaaatccagcctgccacctgtttttgatagcctaaaagctaagaatggtttttacagttttaaatcattggaaagcaaaatatttcatgataatgtgaaaattatgtgaacttaaattttagtgtccataaatagtttattggaacacacctatccttttttgtttacatattatctgtgcctgctctcrtgctacaatagtatcattgaggagctgcgacacagatggtctgtctgacccacaaagcctacaatctttactatcttgctctttatagaaaaagttttccagcatcaggtatacacttggcaaatgactcttcctttcgtatccttggaggatgattgatgaaggaatctgatatagccaaagatatgtaggccatttttctttgtgataaaaattatttcttctctttttacagcaattcaattaaaccccagctatatcagggcaatattgaggagagcagagttgtatgagaagacg

SEQ ID NO: 193710 - DNA, 601 bp, Human
gcagcgtggcttagagagggtattggctttttttggaaaccagatttcctttttgattttcttggaaatttttcttgcctgcaagaatttaagcataattcagttccctgggattatgcttaaatgggatttaaaatcctaggataccaccaacctcgatttcagataacaattacataaaaacagtttagtttcttcattaaataatcattccttgaggttcattaggatgcagtcaagatcatgagaatttttatttagaaaatggcactcaaagtccctttagtgtttgagaacacaygagagggcaggaattaggagtaaagagaaatcagactgggggtaggggtagggcaaatggattcatttgatccatgtttagttatttctcatatttgccaaagcattttagagttggaacctcccacgagcaatctgcttaagtaagaggagtgagggttcctgaacacagacttaagtcttttccacatgtaacctgtctgatatttcgctggtgaagatctgccatgtattttcctttttgagtattttctaaatctgttgtttgaattacattttataaactgcaatcatgtggccc

SEQ ID NO: 193711 - DNA, 601 bp, Human
ctgaacagtaggtctcaacaataggcttaaaacgctcagtaaattattctataaatagatgtgctgtcatccaggctatgttgttccatttctagagcacaggcagagtagatttagcatcattcttaagggccctaagatttttggaatggtaaatgagcactggcctcaacttaaagtcaccagctatattatcgcctaacaagagagtcagcctatcctttgaagccaggcattgaattattctttcctgttgctttgaaagtcctatacggcatcttctttcaatatagtgctgtttcatctacactaaaaacatgcttagtgtagccaccttcatcagtgatcttagctagatcttctgaataactttttgcagcttctatgtcagcctttgctgcttcactttgcacgtttatgttatggagatggcttctttccttaaagcagcttcctcactcaaccttggtaggattgaagaaagttagggccttgctgtggtaatccaaggctttggcttaagggaatgttgtggctggtttgatcttctatccagacacctagaactttctccatataagcaataaggctgttttgcttt

SEQ ID NO: 193712 - DNA, 601 bp, Human
ggtaaatgagcactggcctcaacttaaagtcaccagctatattatcgcctaacaagagagtcagcctatcctttgaagccaggcattgaattattctttcctgttgctttgaaagtcctatacggcatcttctttcaatatagtgctgtttcatctacactaaaaacatgcttagtgtagccaccttcatcagtgatcttagctagatcttctgaataactttttgcagcttctatgtcagcctttgctgcttcactttgcacgtttatgttatggagatggcttctttccttaaagcagyttcctcactcaaccttggtaggattgaagaaagttagggccttgctgtggtaatccaaggctttggcttaagggaatgttgtggctggtttgatcttctatccagacacctagaactttctccatataagcaataaggctgttttgctttcttattcatgtgttcattgaagtagcacttttaattttgttaaagtctggctcttccctttacttgaacacttaaaggtcattacaggattattaattgacctaatttcaatattgttgtggcttagggaagagggaagcctgaggagag

SEQ ID NO: 193713 - DNA, 601 bp, Human
tggctggtttgatcttctatccagacacctagaactttctccatataagcaataaggctgttttgctttcttattcatgtgttcattgaagtagcacttttaattttgttaaagtctggctcttccctttacttgaacacttaaaggtcattacaggattattaattgacctaatttcaatattgttgtggcttagggaagagggaagcctgaggagagggagagatacaagggaatggctggtcagaggagcagtcagaacatgcaccgcacttaccatttcagttagctgtcttatgcrggtgcagttcatggcaccccaaaataattaaatagtaacctcacagatcattgattacagatcaccataacaggtataagaatagtgaaaaggtttgaaatattatgagaattaccaaaatatgaaagagacatgaaatgagcacgtgctattggaaaaattgtgctgacaaacttgctcaatgcaggattaccacacatcttcaatttgtaaaaaacacaatatctgtaaagcacaaaaagcacagcacaacaaaataaagtctgcctgtataagaatttcaactgggcatgaatttta

SEQ ID NO: 193714 - DNA, 601 bp, Human
tgggtaatggtgatatgctacttggcagagaaattaatatttatcaactgaaccgagtggcaagcactcggatccctgtctctaaacattctggtctaagcacgagtagttctgtactcttctctttgccatgggatctagtctgatagacgagatcctaatagttcaggacatgtggacatattcaggctgagtgatggtgccacctgtgctgtaggtggaaacaaggaaacctcattgattactgtccagatagggaagacagaatttgacagccagtggaaagtgtggcagataggcwagtttggcacatgatcctatttggatacaaggaagctgctttagcctctgagcacccaacctgactctaaacagcaggcagaaaaacgtatgcatgtgcatatatttaggagactgagctctcctgaaggctgttgcttctctgtcatcggcacaaacagcaaaaggtaaatttttcagtcaccaaaaacttgttgattctaccatactgttttgccctgttctttgtgttccactgaccacactctggcttcagagcccatctacccaagcattgtagaaattttaatgtttgttcagt

SEQ ID NO: 193715 - DNA, 601 bp, Human
caaggaagctgctttagcctctgagcacccaacctgactctaaacagcaggcagaaaaacgtatgcatgtgcatatatttaggagactgagctctcctgaaggctgttgcttctctgtcatcggcacaaacagcaaaaggtaaatttttcagtcaccaaaaacttgttgattctaccatactgttttgccctgttctttgtgttccactgaccacactctggcttcagagcccatctacccaagcattgtagaaattttaatgtttgttcagtgaataaatgggctctttcccacaatgtrggactaactttctgtcagaaccacccccagggtctccccttctggttcattcttcattttgccacaggattactaaccctgaaaactcagttctcaagctgtcagtggcctcctgtggcacgggaaccgtaggctgacgggcctggctcaggacagcctggcaggaggcacctgcctgccccgcttcagccccattggacacacagctcgcctgcctatctctgtgcattggctcacgctgtttgggcttgcacggacagcacctctgtctcatatggttgcagtcctatggcctttggt

SEQ ID NO: 193716 - DNA, 601 bp, Human
acagcaaaaggtaaatttttcagtcaccaaaaacttgttgattctaccatactgttttgccctgttctttgtgttccactgaccacactctggcttcagagcccatctacccaagcattgtagaaattttaatgtttgttcagtgaataaatgggctctttcccacaatgtaggactaactttctgtcagaaccacccccagggtctccccttctggttcattcttcattttgccacaggattactaaccctgaaaactcagttctcaagctgtcagtggcctcctgtggcacgggaaccrtaggctgacgggcctggctcaggacagcctggcaggaggcacctgcctgccccgcttcagccccattggacacacagctcgcctgcctatctctgtgcattggctcacgctgtttgggcttgcacggacagcacctctgtctcatatggttgcagtcctatggcctttggtgcctggttcaagtgtaaactcttagacaaagatagaccaaatctcttctttcctccacccctttcctgtcttcctgccccagccaaaggaatcttccccttcctgactctcgtagcattttataactca

SEQ ID NO: 193717 - DNA, 601 bp, Human
cctgtggcacgggaaccgtaggctgacgggcctggctcaggacagcctggcaggaggcacctgcctgccccgcttcagccccattggacacacagctcgcctgcctatctctgtgcattggctcacgctgtttgggcttgcacggacagcacctctgtctcatatggttgcagtcctatggcctttggtgcctggttcaagtgtaaactcttagacaaagatagaccaaatctcttctttcctccacccctttcctgtcttcctgccccagccaaaggaatcttccccttcctgactctcrtagcattttataactcagctacatatgaatttggttttgtgtgtatgtcttttcttccttgtcaaattctaagcttgttttggtgtatagaccatgtcatgtatctttgcatctctaccacacatagcaaggtgccacacacatgtaattagtacatgttggttgaattaatctatgtcaggtgaccttaggtcttctctaacgcagagactatttatttgtgtgccttttattatgtgtctactacctgccaggtattatatatatgtaatctcatttagaaagcagaatttcgcattt

SEQ ID NO: 193718 - DNA, 601 bp, Human
actcagctacatatgaatttggttttgtgtgtatgtcttttcttccttgtcaaattctaagcttgttttggtgtatagaccatgtcatgtatctttgcatctctaccacacatagcaaggtgccacacacatgtaattagtacatgttggttgaattaatctatgtcaggtgaccttaggtcttctctaacgcagagactatttatttgtgtgccttttattatgtgtctactacctgccaggtattatatatatgtaatctcatttagaaagcagaatttcgcattttcttttttttttycccccttaagtgatggtcggtgaaactaatgtgaaatgttataaaggcagagatactggaattgaaggaaaaagaataattatctatgtgttagtttgggtcatccaaaaaacagatgccaagataggattaaaagtacaagagatttactgggggaaacacctgcaagggaaaatggggctgggagctggaggctgttggcagagttggcagacccctgtggaggaggaaaggccgggggagcggggacgttttccactggagtgtggtgctgagaaagtttcagcaaagccattgggg

SEQ ID NO: 193719 - DNA, 601 bp, Human
gctacatatgaatttggttttgtgtgtatgtcttttcttccttgtcaaattctaagcttgttttggtgtatagaccatgtcatgtatctttgcatctctaccacacatagcaaggtgccacacacatgtaattagtacatgttggttgaattaatctatgtcaggtgaccttaggtcttctctaacgcagagactatttatttgtgtgccttttattatgtgtctactacctgccaggtattatatatatgtaatctcatttagaaagcagaatttcgcattttcttttttttttccccccttaagtgatggtcggtgaaactaatgtgaaatgttataaaggcagagatactggaattgaaggaaaaagaataattatctatgtgttagtttgggtcatccaaaaaacagatgccaagataggattaaaagtacaagagatttactgggggaaacacctgcaagggaaaatggggctgggagctggaggctgttggcagagttggcagacccctgtggaggaggaaaggccgggggagcggggacgttttccactggagtgtggtgctgagaaagtttcagcaaagccattggggagcca

SEQ ID NO: 193720 - DNA, 601 bp, Human
tggttttgtgtgtatgtcttttcttccttgtcaaattctaagcttgttttggtgtatagaccatgtcatgtatctttgcatctctaccacacatagcaaggtgccacacacatgtaattagtacatgttggttgaattaatctatgtcaggtgaccttaggtcttctctaacgcagagactatttatttgtgtgccttttattatgtgtctactacctgccaggtattatatatatgtaatctcatttagaaagcagaatttcgcattttcttttttttttccccccttaagtgatggtcrgtgaaactaatgtgaaatgttataaaggcagagatactggaattgaaggaaaaagaataattatctatgtgttagtttgggtcatccaaaaaacagatgccaagataggattaaaagtacaagagatttactgggggaaacacctgcaagggaaaatggggctgggagctggaggctgttggcagagttggcagacccctgtggaggaggaaaggccgggggagcggggacgttttccactggagtgtggtgctgagaaagtttcagcaaagccattggggagccagtgctgcccctcag

SEQ ID NO: 193721 - DNA, 601 bp, Human
attatatatatgtaatctcatttagaaagcagaatttcgcattttcttttttttttccccccttaagtgatggtcggtgaaactaatgtgaaatgttataaaggcagagatactggaattgaaggaaaaagaataattatctatgtgttagtttgggtcatccaaaaaacagatgccaagataggattaaaagtacaagagatttactgggggaaacacctgcaagggaaaatggggctgggagctggaggctgttggcagagttggcagacccctgtggaggaggaaaggccgggggagsggggacgttttccactggagtgtggtgctgagaaagtttcagcaaagccattggggagccagtgctgcccctcagacgagtccctcccatgctcaggcattggctggaagcagcaggtgggaagggtggcctctgcatgaatgtgctgatggattttagagtgcagccactctgtcccctgcatttggagaaatacatcttcatgactgccacaccatagaatcaaccaagctaaaagttcaaaggtggcttgtggcacacaggccctttagccagttaggcaaaacgagggcctgggaa

SEQ ID NO: 193722 - DNA, 601 bp, Human
tatatgtaatctcatttagaaagcagaatttcgcattttcttttttttttccccccttaagtgatggtcggtgaaactaatgtgaaatgttataaaggcagagatactggaattgaaggaaaaagaataattatctatgtgttagtttgggtcatccaaaaaacagatgccaagataggattaaaagtacaagagatttactgggggaaacacctgcaagggaaaatggggctgggagctggaggctgttggcagagttggcagacccctgtggaggaggaaaggccgggggagcggggamgttttccactggagtgtggtgctgagaaagtttcagcaaagccattggggagccagtgctgcccctcagacgagtccctcccatgctcaggcattggctggaagcagcaggtgggaagggtggcctctgcatgaatgtgctgatggattttagagtgcagccactctgtcccctgcatttggagaaatacatcttcatgactgccacaccatagaatcaaccaagctaaaagttcaaaggtggcttgtggcacacaggccctttagccagttaggcaaaacgagggcctgggaaagagaa

SEQ ID NO: 193723 - DNA, 601 bp, Human
taaaagttcaaaggtggcttgtggcacacaggccctttagccagttaggcaaaacgagggcctgggaaagagaattcttcctctcgtcggcagtttgaatatttgcagtcttagcttggaatggtctttctgcactagagggaaacctcctttagtgcagaccagcctaaagccaagccattgctgcctgaggaagctgccatctctggagcacggtgacatgccaccaccctggacctattcccatcccccggagcactgtggcatgtagcctcttcgtgccactgcaaggtcagaaagyacctctgggcacacctccgtcttttgggtctgcctccccactagactgagcattgtgcatagaagctacttttattctttacatcccagtggctcacatgatagatgccaagtaaaatttccagtttgtactttaaattgtttttctggcactggagatgggcttgcagtgatccctccatccatgtaatggccctgggctcagtggaccatccagagtaggcttctccaccatggagctgcccctcctcaggagtctgatgtgagtggctcttgatactcattctcacttcactcactc

SEQ ID NO: 193724 - DNA, 601 bp, Human
ctacgcccatgtgcccgaggctgtgccgctgccttgtgcaggcacccagggtttatgccagtgatttcctgacacaagcagcagcacagaacgtgtgtgtcccaggtttaggtttgggaggcctgcctggagaacagccatcccaggttctgggagctttctcaatttactgttttatccaaagatgggttggcctttctctggacatagtgagcttccttgggctagttcttaagcctgagactaaaagttctcaccatgagttattagggaggcctgtaaaatgtaaaggccatgcgtyttttttgctctgttacccaggctggagtgcaatggtatgatcatggctcactgcagccctgaactccttgggctcaagcaatcctcctaactcagcctctgcatagctgtgacaacaggtgtgtgccaccacacctagctaatttttaaatttttgtagatacagggtctccctatgttgcccaggctggtctcaaactcctaggctcacatgatcctcctgcctcagcctcccaaagtgctgggattacaggtgtgagccactgcacccagccaaggccatgcacctttaagttcttta

SEQ ID NO: 193725 - DNA, 601 bp, Human
aaagcagtttagaaagggttgaaactgtttattcacccatccctgccaaaattttctggaacattcctagtttcagatgttccttatatcttaaaacagcataagaactgttttttgtttttaaaaaaaaaatttgtagagatagagtctcactgcgttgctcgggctggtcttgaactcctgggctcaaaccctcctcttgcctcagcttcccaaagtgctgggaatacaggcatgagtcaccatgcttggcaagaaccgctggctatagaccatgacttttttttttttttttttttttgagacggagtctcactctgtcacccaggctggagtgcagtggcgcaatctcagctcactgcaacctctgcctcccaggtgcaaacgattgtcctgcctcagcctccctagtagctgggactgtaggcgtatgccaccaccctcagctgatttttgtattttttgtagagatagggtttcatcatgttggccaggctggtctcgaactcctgacctcaggtgatccacccatctcggcctcccaaagtgctgggattacaggcgtgagccaccacgcccatcctatatacctcacccaagt

SEQ ID NO: 193726 - DNA, 601 bp, Human
taataataactgccattatatcaaatatatttaccaatagctattgtagtccaactctggaatgtaagtactgctttaaaataaacatttataatgtcaacaactcaaaatttcaagcatatgattaattatattgacatacgattatactataatagcaaaatatttcttttataaacaccttaaaagttttcgtgacaaaattattttggttagaatttaatataaatatgatttattctgtgttaggattcaaaagcttattcaatttaaataaaaaccatactccagaaactaaaayatttcttagtagatataacggaaactgtttttgttggtaaatctataataggaattgcttggcccaggtcactgaagcattttctgcttactttacttaggaacgtttttgggggtatgttgaacagttttcatgtttcatataaaaacacgtcagatgtgtttatatgtttttgaaaaatgtaaaacaaggcttgaaacgttccattgtatgcgtctgtaggatacacattttgacatatttttaaaaggatgttggttcccaaatctcataggcatatataaataaaacagaatttaa

SEQ ID NO: 193727 - DNA, 601 bp, Human
gatgctcttgaggatatgtacaatatgatgtatatttttaatacttcacagtgtataccccagtatttagaataattgaagaatcaattaaaaagcatttgtcagagcttatataaaaaagaactagtccctatatacccaaagattatggcttttaatgtcaacttgtcattgctatgtttgtgagtttctactagagcagaacaatacatactactatcaaatctcaaactgctccaggaagaaactagattatttctaatgctttatttagggatcagtaattcatttgctttttctktatttgcttattctagctatctaattgcggttctaaggaagatacaagttcatctgaataaataaaaattgctaaaataataagttgtcttgtgtcctggatcttctgtctcattactaaaatgtttattgtactcactttatttctatgatcacctcactgtagctatcacaatgatttcccagtaggaacagttaatagaagctgggtgaagacaactggggattattatatcttagcctttgggaggcatttcatagccgttttccatttagaaacattctcagacccagaactgtt

SEQ ID NO: 193728 - DNA, 601 bp, Human
ccttatttaacatattataaaataatttaaacattgcacctcttatctgcccctgacttcttcatctatagctttaagaaattctaatgactcatttgaatacagacattttgtgtcagaaatgggatttttggcttgaaaaatatacttaacgttttctcaagtagaatttacatatggtttctcttctattgatacattgataaactttcccccattttgagacatgagggaacaaaacaaggagaatgagcatttacgaataattagctacactgaatcatttaaactaagccaggtraaaactcgtttttgaaaacaccttttaacaaaaagttcttaacttggattaagctataatcttaattttagaaaacacaagtgaaagactctttttatgaaagcgggaataacatatacaacccctccctttattgtaatgatttcatattgtgtgtttgaagacctcttcatgtttactctagtccccaaaagattaaagtcagtaattcagagagagaaaatgtgtatggttcacaggaggattttcactttattccttgggaaaaggaccaaacagcagagtcctcaaccctgagtt

SEQ ID NO: 193729 - DNA, 601 bp, Human
ttcaacagtaaaatatcatatccttttaactttaaatccagtgttttgttattggggttgggttggggtggggaagctgttgaaagtggagaaacggaaaagatgcagatgagaacagagtatgaacgagggaacacatagagagaagcaggagaggacacagacctgccagcatcgggagcgagacggctctggactcttcttgccacttgcttgggaaatgttgtgcaccctcaggatttgattcctttatccagtgagcatttattgggcatttattttgtctgtttgtagatggtcrcttattgagcatttattctgtctcatttctaggtgctgggggtataatgttgagccagtcagaccaggcccctgcagacactgagctcacgttctaggggggggaagatgtgtttgctcatggttgccttcttaacgcctttctcctgctcctctggtccagggctcctttctggatctgatatcacaagaattgtctggcatattttgagacaatcacctggctctgcctgtagcttcctgaaaggtctggacatggaaatcatacataagggatgacctgctatccgcagcttatgac

SEQ ID NO: 193730 - DNA, 601 bp, Human
ttttaaactgatcctttaagtaaacgagttttcatggattccagtcactgtggatatcactggggatagcaccgtgggtcaccacgacctgttcctgatgacctggaaaggcaggtgctaatgagattttctggggttgacttagtgacttggcaaggccacttgtaaggttgataacacactcaattacttcatgcccagatacgtcatttgacagattgctaatttctctggggtgtgtacagacattttggggcatacttccggaagcaacttgtccaaaaaccactcataggattgyattttatcatttggatctaaaataccttacatatgtatttaattgtagctttacccttaaaaattttacatatttgtatatgaaaacaccagtcttttaaaaggcttcagttatgatgaaataatcaaaagaactatagctaatggtaaaaccccagggaaattgagctgttaacaatttagcatgtccaacttactactttttttttttttgagacagtctcactctgttacccatctggagtgcagtggtgcaatcttggctcaccgcaacctctgcctccagcttcaagtgattctc

SEQ ID NO: 193731 - DNA, 601 bp, Human
gctaacttcagcccatataaagataagaaaccaaaaggtattgagcagtaactttctctactccagcaatgttgcagccggattagtctggagaactcatgtcactaaatgggtttaaatttttttttttggtcttgtgctatccagtttaactacctacataacctaaaccagacaggtgaataccagcttgctccttcacttcctgccttttgagaacctattgaaaacccaatctgtacattgtttagatcacataccaaaatatcaagtggcctattcaccatttttgtacgatctrtagtgactcttgaaatggacttcagctggtaaaagaatatgagtacattttcagttgtagtgcagtttagtcaggatcatgtggatttaacctgagtgtaatgaagcttatgaaatcagtttagggatttgaaacacagagttaaatcctgggagacttcggcctcccagtaatgaacctactcaacaagcatttataactactctcaccctactgtgtgccagacatagtgcccgtactgggtagataaacaatgatcaatttagaacttttacttatgccatgttttatagcggttat

SEQ ID NO: 193732 - DNA, 601 bp, Human
gcaaaaagaaatattagtattaatgtaaatatttatcatactttccagttagtgttgctgtaagctcaagacagagaatggatgtatatggtgtgtttaccgctaagtcaagattgtctctggtctcaagtatggccccatatctgcatttactctctagaggtattaatgctaacttcagcccatataaagataagaaaccaaaaggtattgagcagtaactttctctactccagcaatgttgcagccggattagtctggagaactcatgtcactaaatgggtttaaatttttttttttkgtcttgtgctatccagtttaactacctacataacctaaaccagacaggtgaataccagcttgctccttcacttcctgccttttgagaacctattgaaaacccaatctgtacattgtttagatcacataccaaaatatcaagtggcctattcaccatttttgtacgatctatagtgactcttgaaatggacttcagctggtaaaagaatatgagtacattttcagttgtagtgcagtttagtcaggatcatgtggatttaacctgagtgtaatgaagcttatgaaatcagtttagggattt

SEQ ID NO: 193733 - DNA, 601 bp, Human
tttaagacaaagcaaaaagaaatattagtattaatgtaaatatttatcatactttccagttagtgttgctgtaagctcaagacagagaatggatgtatatggtgtgtttaccgctaagtcaagattgtctctggtctcaagtatggccccatatctgcatttactctctagaggtattaatgctaacttcagcccatataaagataagaaaccaaaaggtattgagcagtaactttctctactccagcaatgttgcagccggattagtctggagaactcatgtcactaaatgggtttaaatttttttttttggtcttgtgctatccagtttaactacctacataacctaaaccagacaggtgaataccagcttgctccttcacttcctgccttttgagaacctattgaaaacccaatctgtacattgtttagatcacataccaaaatatcaagtggcctattcaccatttttgtacgatctatagtgactcttgaaatggacttcagctggtaaaagaatatgagtacattttcagttgtagtgcagtttagtcaggatcatgtggatttaacctgagtgtaatgaagcttatgaaatcag

SEQ ID NO: 193734 - DNA, 601 bp, Human
aaaaagtccatttttccacatgcatgagagataccaagagatttttgtaaaaaaagcatagtcatttaagacaaagcaaaaagaaatattagtattaatgtaaatatttatcatactttccagttagtgttgctgtaagctcaagacagagaatggatgtatatggtgtgtttaccgctaagtcaagattgtctctggtctcaagtatggccccatatctgcatttactctctagaggtattaatgctaacttcagcccatataaagataagaaaccaaaaggtattgagcagtaactttytctactccagcaatgttgcagccggattagtctggagaactcatgtcactaaatgggtttaaatttttttttttggtcttgtgctatccagtttaactacctacataacctaaaccagacaggtgaataccagcttgctccttcacttcctgccttttgagaacctattgaaaacccaatctgtacattgtttagatcacataccaaaatatcaagtggcctattcaccatttttgtacgatctatagtgactcttgaaatggacttcagctggtaaaagaatatgagtacattttcagt

SEQ ID NO: 193735 - DNA, 601 bp, Human
tcctcatgttgcctgtatttgtttccctgtgtttatacagaggaggatactatgtatactaaatgtatacacagttcatgtatgcatttactaaacactatacgttaacaggggtgggggagtttaaagtgaagtcttgattcttagacgtgacttttcaacatacatttgggcatcttttttttttcatgagaatctatctgaaattgtaagtcaaaattgctgactcatgtgatgtgacaatttggaggtatatctaaggagtgacagtcacaatgtgctaaatgttggggaccttacrtttcaagttgatgaatagaaatttggttttcacagttgcctttagtctataaagtcttaaaggagaagaaatgaactgtcgccaagctgtatcgtaaattccagggttaaaagtgaaacttacactatgccactcccacatttgtcacagagcggcatcctctgtgccccgcctgaaccgccatggactttcgtcaccggagctctcacactccgcgttccagccggacggtcatctgaaaaacaaagcgtttccatttatggctagggaacagctggccgcagcctgtgcttggcttct

SEQ ID NO: 193736 - DNA, 601 bp, Human
aaagccatgaatgtcttctcgtgtaagtgcgcgtgggtgggtgcgtgcgtgcgtgccacgcctgcagagacttaagctttgggatacagagtgaccgtgtcatagccctctgggggctttgtgcgggctcttgcgtgggtttcgcagtacagctccccttctatgaagaagtagcccttttgcttgaggttgaggttgcagtcggcacacacgaagcactcagggtgccggtacttatcccgcgccttcaccacagcaccactgttggggaagaaaacgagctcaagttaaaaaaccacaragcaaaaatatgagacaaaggagagaacccaacagagaaggcagatgttctctatttcacagtcaggaaacaatggcctccagctgtgaaagcaggcacagccgtgaaactgtatgtaattgtcatggagatctaggatatccacaataaaccatcccgtgtttctctctgatgttgacgtgtgactatttttcagattttcaaacaagtactttatagaaaatttgtaggatcctacttcatgatctttccccatcgtttctttgaagagggagacatgatggagacaagaccaacccc

SEQ ID NO: 193737 - DNA, 601 bp, Human
aatctgcacaatccttctgcccaaagccatgaatgtcttctcgtgtaagtgcgcgtgggtgggtgcgtgcgtgcgtgccacgcctgcagagacttaagctttgggatacagagtgaccgtgtcatagccctctgggggctttgtgcgggctcttgcgtgggtttcgcagtacagctccccttctatgaagaagtagcccttttgcttgaggttgaggttgcagtcggcacacacgaagcactcagggtgccggtacttatcccgcgccttcaccacagcaccactgttggggaagaaaacragctcaagttaaaaaaccacaaagcaaaaatatgagacaaaggagagaacccaacagagaaggcagatgttctctatttcacagtcaggaaacaatggcctccagctgtgaaagcaggcacagccgtgaaactgtatgtaattgtcatggagatctaggatatccacaataaaccatcccgtgtttctctctgatgttgacgtgtgactatttttcagattttcaaacaagtactttatagaaaatttgtaggatcctacttcatgatctttccccatcgtttctttgaagagggagaca

SEQ ID NO: 193738 - DNA, 601 bp, Human
tttagatttggagttgacaatctgcacaatccttctgcccaaagccatgaatgtcttctcgtgtaagtgcgcgtgggtgggtgcgtgcgtgcgtgccacgcctgcagagacttaagctttgggatacagagtgaccgtgtcatagccctctgggggctttgtgcgggctcttgcgtgggtttcgcagtacagctccccttctatgaagaagtagcccttttgcttgaggttgaggttgcagtcggcacacacgaagcactcagggtgccggtacttatcccgcgccttcaccacagcaccrctgttggggaagaaaacgagctcaagttaaaaaaccacaaagcaaaaatatgagacaaaggagagaacccaacagagaaggcagatgttctctatttcacagtcaggaaacaatggcctccagctgtgaaagcaggcacagccgtgaaactgtatgtaattgtcatggagatctaggatatccacaataaaccatcccgtgtttctctctgatgttgacgtgtgactatttttcagattttcaaacaagtactttatagaaaatttgtaggatcctacttcatgatctttccccatcgtt

SEQ ID NO: 193739 - DNA, 601 bp, Human
gtctgtaggaaaggagaaaaaacatcctgttggcttgttaatagtcatgtcttttaaaacacatacgtgtaagtgttatgcatttgaaagaaactacttaatgtagaattgctttttatgttgagttttttcttaattacaatgttgaataatcatgtccaaatgaaaagtgggagaattaatccacaactagttgatttaatcattggaagatttatatttattttctacagccattttacacagttggttcttaaggaggtgtgtgtgtgtgtgtgtgtgtgtgtgtgtgtgtgtgtggtttaaaaagaaagctgttctgttcgccaaggaaagtgaaacaaacaattatgccacttctacattgttgtttgatcttaataaaccctttcatgtgtgttggggaaatttttgccctaagataatttcaaacttttaattattagatatgagaagaaggatacaaggtttgaaagagacgtatagttaattagcagggaaataaaatagggcaaagtattacaccaaatcctactagttagactttaaacttcagtaatatcaaaatccgttagcacagtgcctggtacataacaaaggc

SEQ ID NO: 193740 - DNA, 601 bp, Human
tctgtaggaaaggagaaaaaacatcctgttggcttgttaatagtcatgtcttttaaaacacatacgtgtaagtgttatgcatttgaaagaaactacttaatgtagaattgctttttatgttgagttttttcttaattacaatgttgaataatcatgtccaaatgaaaagtgggagaattaatccacaactagttgatttaatcattggaagatttatatttattttctacagccattttacacagttggttcttaaggaggtgtgtgtgtgtgtgtgtgtgtgtgtgtgtgtgtgtgtgtgttaaaaagaaagctgttctgttcgccaaggaaagtgaaacaaacaattatgccacttctacattgttgtttgatcttaataaaccctttcatgtgtgttggggaaatttttgccctaagataatttcaaacttttaattattagatatgagaagaaggatacaaggtttgaaagagacgtatagttaattagcagggaaataaaatagggcaaagtattacaccaaatcctactagttagactttaaacttcagtaatatcaaaatccgttagcacagtgcctggtacataacaaaggct

SEQ ID NO: 193741 - DNA, 601 bp, Human
tgtaggaaaggagaaaaaacatcctgttggcttgttaatagtcatgtcttttaaaacacatacgtgtaagtgttatgcatttgaaagaaactacttaatgtagaattgctttttatgttgagttttttcttaattacaatgttgaataatcatgtccaaatgaaaagtgggagaattaatccacaactagttgatttaatcattggaagatttatatttattttctacagccattttacacagttggttcttaaggaggtgtgtgtgtgtgtgtgtgtgtgtgtgtgtgtgtgtgtgttttaaaaagaaagctgttctgttcgccaaggaaagtgaaacaaacaattatgccacttctacattgttgtttgatcttaataaaccctttcatgtgtgttggggaaatttttgccctaagataatttcaaacttttaattattagatatgagaagaaggatacaaggtttgaaagagacgtatagttaattagcagggaaataaaatagggcaaagtattacaccaaatcctactagttagactttaaacttcagtaatatcaaaatccgttagcacagtgcctggtacataacaaaggctta

SEQ ID NO: 193742 - DNA, 601 bp, Human
tacactgcagccaagggaaccattgtgaactgcactattcacagtggtgctctagttggcctgaaaaagttggttcagtttttcaagaaggttttctcatattcttaggtgatagagggacattggagttacccttctccaacagcaaaatctattccaacctcagttcataaacaagtggtcctatttgctattgtatgttacttgtttttctctgtaatttagagccttgcctatattgtttattttccttcattccttacattttagtcttatgttactgttttaccaaagtcttatygcacatcttatttagtccttgcagttattctgtgagtcaagttcggatggtatcattgccctcagttttaaactgtaactaggttagacagtcttacgcaagattacatagcttgggtgtatcagagccaggcctgcttggtaggtctttgaatgccttctccaatccttttctgtttcctctgagagcaatgctatgagactatcatattcttaataactagtgttttaaagaccaatatttattgagaggaaagggaaaaggggagttgtttaatgggtatggagcttcggatttgca

SEQ ID NO: 193743 - DNA, 601 bp, Human
tctgatctcagtagagtgcccaatgaggcatcttgctatagggattttaattcatttccctttttgatgtgcactgtcgtcaatccatgctaatcacagcagtactttctgtagtttttcatgcatctcaatccatttctcactaggtatcccccacgttgctctttgtctcccccaccctgtccatctcgctgtctatggcagaaagcattctctctctcagtcatgtacatatctcttctttagaatatagttagaaaatatgttcttgtccagaagaagcttagaattagatatctgktcaacataggtctatcaatgacttggagatgtgtatcagttgctattatttatccctaacaaatcatcataataacacagtgagttttgcatacaatttgcctatgaaaaccatatgtgtgatttacctttctagagcaagtggaataatttttcttttagcttattgctttgaattttcaagtcacattcttggtttgttaaaacctcaacgttttcccaaaatccaaaattctcaaaagataggggaataaagctttggaatccaaggagttaccagacatcatggcagctgtataag

SEQ ID NO: 193744 - DNA, 601 bp, Human
tcctcccggacgttgaacttttcaaacagagcaattcacttataataatggtctccagtcttctgaatgcttatattttgaaatgccacatctctcattcactgcagtgattcctcagctgtggggtggggaggtgggaagccacttccctgttggggtgcattttagattctgggtagtgaagtagaggtagtgtgtaatttgaaagccctcctttcccctcccctcctctactttggcttttgttgttggttttatgttctgtctcttcaataagtagctataggtatttaatctctcraacatagtctacctatttataaaagcagcttgtgggccgggcacgtggctcacgcctgtaatcccagcactttgggaggccaaggcgggtggatcacaagatcaggagttcaagaccagcctggccaagatgttgaagccccatctctactaaaaatagaaaaattagctgggcatggtggcgggcgcctgtaatcccagctactcgtgaggctgaggcagagaatcacttgaacccgggaggcagaggttgcagtgagccaagatcgcgccactgcattccagcctaggcgacagagtg

SEQ ID NO: 193745 - DNA, 601 bp, Human
gttgaacttttcaaacagagcaattcacttataataatggtctccagtcttctgaatgcttatattttgaaatgccacatctctcattcactgcagtgattcctcagctgtggggtggggaggtgggaagccacttccctgttggggtgcattttagattctgggtagtgaagtagaggtagtgtgtaatttgaaagccctcctttcccctcccctcctctactttggcttttgttgttggttttatgttctgtctcttcaataagtagctataggtatttaatctctcaaacatagtctrcctatttataaaagcagcttgtgggccgggcacgtggctcacgcctgtaatcccagcactttgggaggccaaggcgggtggatcacaagatcaggagttcaagaccagcctggccaagatgttgaagccccatctctactaaaaatagaaaaattagctgggcatggtggcgggcgcctgtaatcccagctactcgtgaggctgaggcagagaatcacttgaacccgggaggcagaggttgcagtgagccaagatcgcgccactgcattccagcctaggcgacagagtgagactccatct

SEQ ID NO: 193746 - DNA, 601 bp, Human
tgtgagaagacctctcactctcaccaagaccaccctctgggggcagggtgggcagtgacacctgtgagccctggattttccccaccccccacatcgagcagggcagcaccccaggcttcacgggtggaggcaccccagtactggctttcacaaactgcttcccagacatccaccacttagtgagattggcggggccctcgtagtgagctggctggcagcagaagaggcatagaagggaatgaggccaggcttctgccttccaggagtgcaccctagccccggaactaggcagccagactgktccctcgataacaaactgcctggccattctgcggcaaagcacattgcaggaactcgggatctaatattcctgccccacgaggagatggtctctgtacactgaccccctattctgccaccccaaggcggggaccacgtgctccagtcaagatccgcccccctccccaaaatcccatcttgctagagctgcaggtcgtctctggtttctacccagagagctggaggaactccccacaccccttgacccacgcttggtgtccagtcagccggcgagctcggcagcttccccagggacacaaag

SEQ ID NO: 193747 - DNA, 601 bp, Human
ctggcttcccaggccatccagtgtgagaagacctctcactctcaccaagaccaccctctgggggcagggtgggcagtgacacctgtgagccctggattttccccaccccccacatcgagcagggcagcaccccaggcttcacgggtggaggcaccccagtactggctttcacaaactgcttcccagacatccaccacttagtgagattggcggggccctcgtagtgagctggctggcagcagaagaggcatagaagggaatgaggccaggcttctgccttccaggagtgcaccctagcccsggaactaggcagccagactggtccctcgataacaaactgcctggccattctgcggcaaagcacattgcaggaactcgggatctaatattcctgccccacgaggagatggtctctgtacactgaccccctattctgccaccccaaggcggggaccacgtgctccagtcaagatccgcccccctccccaaaatcccatcttgctagagctgcaggtcgtctctggtttctacccagagagctggaggaactccccacaccccttgacccacgcttggtgtccagtcagccggcgagctcggc

SEQ ID NO: 193748 - DNA, 601 bp, Human
cagaaggctgacaagagaggaatatctctcccggtgtggtcaaggtcttcagcatctccctgcgagcaggcagaggcccagtctaaagccaagggcagaacagaaaaaggaagcatcatagaggcttcccaccccccaaaggacccggtagtgtgtcctagaagagctaaccaagggcaaatcctgggtgccctcccaaagtcaccctcaccgacactctgacacataaaataggcattctcaagtctggaccactcacaggtcctagtcagaaaactctaagcagtcagttacatgtgamtatacattcgatgttatatatttatggccctagtcccatagtgacccacagacacaagcacatacaccttctactcctagtccccatagatgcacacacacacagtgaatggtagatcaccaacacaaacaccaaagccctgtatacctgtgtgcacacacacactttatactaaaggtgagaccctatgcagactgtcagaaatgtcacagcttaagttccacagctggctcatgaccattttagcctggcacactggctaatgtttaaagtttttttgttttttgttttttttaaatc

SEQ ID NO: 193749 - DNA, 601 bp, Human
gagacaacagaaggctgacaagagaggaatatctctcccggtgtggtcaaggtcttcagcatctccctgcgagcaggcagaggcccagtctaaagccaagggcagaacagaaaaaggaagcatcatagaggcttcccaccccccaaaggacccggtagtgtgtcctagaagagctaaccaagggcaaatcctgggtgccctcccaaagtcaccctcaccgacactctgacacataaaataggcattctcaagtctggaccactcacaggtcctagtcagaaaactctaagcagtcagttayatgtgactatacattcgatgttatatatttatggccctagtcccatagtgacccacagacacaagcacatacaccttctactcctagtccccatagatgcacacacacacagtgaatggtagatcaccaacacaaacaccaaagccctgtatacctgtgtgcacacacacactttatactaaaggtgagaccctatgcagactgtcagaaatgtcacagcttaagttccacagctggctcatgaccattttagcctggcacactggctaatgtttaaagtttttttgttttttgtttttt

SEQ ID NO: 193750 - DNA, 601 bp, Human
attgcccagagtatgctacctcccctccccacacacaccatgattctttttcttaaatacccatgtaggaagcaaagatgccaaattaggagctgaaaaactgcctccctttgcccctcccagccgttcatggatcatgagaactcgtggggcaggccaggccccaggtaatgccaggttccagtgctgctatgcctgccagggagacaacagaaggctgacaagagaggaatatctctcccggtgtggtcaaggtcttcagcatctccctgcgagcaggcagaggcccagtctaaagccragggcagaacagaaaaaggaagcatcatagaggcttcccaccccccaaaggacccggtagtgtgtcctagaagagctaaccaagggcaaatcctgggtgccctcccaaagtcaccctcaccgacactctgacacataaaataggcattctcaagtctggaccactcacaggtcctagtcagaaaactctaagcagtcagttacatgtgactatacattcgatgttatatatttatggccctagtcccatagtgacccacagacacaagcacatacaccttctactcctagtccccataga

SEQ ID NO: 193751 - DNA, 601 bp, Human
cccctcaaatgtggaagtgaaagaaggcaggggctgagtcccaggccctctctatggccacggctagcctccagatgggcaatggtgccccagctgggccacagccagggagcgaggcaggtgccgggagagccctcagtgacaggcggcagaacaaaggccacccagcacctgctgcctaggtagccctcaaccacctcagctgaacctgtgcattacccacaggcagccaggctcccgagtgggggcagggactcgcttcccaagtagcacctggctggggacacgggaagtgaggtcrgcagtgcgcaggcagctgagtggctctttctcaagggaacacgagtagcagactcagaggggccaggaccattgagagggaaggcataggggatagaagttcacttcactgcatgtgttcacatgcctggcaatgtgctacgcacttttcatacaacattctcaatctcatcttcacaaacctctttgggcatctgtattaacaaaaacctattttaaagatacgaaaactttgggaggctgaggtgagcggatcatgagatcaggagactgagaccatcctggctaacagggtgaaacc

SEQ ID NO: 193752 - DNA, 601 bp, Human
catcttcccctcaaatgtggaagtgaaagaaggcaggggctgagtcccaggccctctctatggccacggctagcctccagatgggcaatggtgccccagctgggccacagccagggagcgaggcaggtgccgggagagccctcagtgacaggcggcagaacaaaggccacccagcacctgctgcctaggtagccctcaaccacctcagctgaacctgtgcattacccacaggcagccaggctcccgagtgggggcagggactcgcttcccaagtagcacctggctggggacacgggaagtraggtcagcagtgcgcaggcagctgagtggctctttctcaagggaacacgagtagcagactcagaggggccaggaccattgagagggaaggcataggggatagaagttcacttcactgcatgtgttcacatgcctggcaatgtgctacgcacttttcatacaacattctcaatctcatcttcacaaacctctttgggcatctgtattaacaaaaacctattttaaagatacgaaaactttgggaggctgaggtgagcggatcatgagatcaggagactgagaccatcctggctaacagggt

SEQ ID NO: 193753 - DNA, 601 bp, Human
gagggtaatggggatatttcctgggaagggtgtttgtgagcagagcttggggaggaggccagaaagactctgcagcagcactgagaggtgggcgccgaggactgatgctctctccctcttccatcatcaccgccccttcaggactggccacgaggcccatcatctgacccctgggagggtggggaacggtgctgtggtcagggcagaggcaggccgggagcagggggctgtcgcacacgttcccccaaaggcctatccatcacgccagtggagaccatcagagtgctctgccggcccaggrcactgatgactctccaggcaccataaagacagggaataaatctgggaagttgctgggtaggagggtgcctcaacggcagggctggccaccctgcccgggaagggagaggcagcccctccatcattctgagagatgcagcaatctaggccaatgagattgggacagttcagggggtgggggaggtgggcaatcacgataaaataatccagtgcagtgtggctgctccgctccagtgttatttacagtgttatttacactcagggagatgcctgtccctgcctccgctccaatttatgccta

SEQ ID NO: 193754 - DNA, 601 bp, Human
tgcaatggtgtgatcttggctcagtgcaacctccgcctcctgggttcaagtgattctcctgcctcagcctcctgagtagctgggattacaggtgcccacaaccatgcctggctaatttttgtatttttagtagagacagggtttcaccatgttggccaggctggtctcgaactcctgacctcaggttatctacccgcctcggcctcccaaagtgctaggactataggtatgagccactgtgcccagtgggctcaggtgtttaacacatctttgcagaatgaaggagaatgcaggcccctgyctagtgtcactgtcccttcacgtccaaacaggatggcttaaagagactgaggcctgacccacaaggccctagctccatctctccaccatccacccaggcctcaacccgactagcattcctgcttgaaagagctgacaccctcagggatcacctgctgtgtgtgaggtcagaggtcagagcgtggatgccatgcagtgctggactggatattatgtttgttgctgtctacagctcccacctctgtgcctggcacatgtcgagtgaatgccaggatgaacctgtctgcctctcccacaacac

SEQ ID NO: 193755 - DNA, 601 bp, Human
gagtttcactcttgttgcccaggctgggatgcaatggtgtgatcttggctcagtgcaacctccgcctcctgggttcaagtgattctcctgcctcagcctcctgagtagctgggattacaggtgcccacaaccatgcctggctaatttttgtatttttagtagagacagggtttcaccatgttggccaggctggtctcgaactcctgacctcaggttatctacccgcctcggcctcccaaagtgctaggactataggtatgagccactgtgcccagtgggctcaggtgtttaacacatcttkgcagaatgaaggagaatgcaggcccctgcctagtgtcactgtcccttcacgtccaaacaggatggcttaaagagactgaggcctgacccacaaggccctagctccatctctccaccatccacccaggcctcaacccgactagcattcctgcttgaaagagctgacaccctcagggatcacctgctgtgtgtgaggtcagaggtcagagcgtggatgccatgcagtgctggactggatattatgtttgttgctgtctacagctcccacctctgtgcctggcacatgtcgagtgaatgccag

SEQ ID NO: 193756 - DNA, 601 bp, Human
caggttagttttttatttttatttttttttaagatggagtttcactcttgttgcccaggctgggatgcaatggtgtgatcttggctcagtgcaacctccgcctcctgggttcaagtgattctcctgcctcagcctcctgagtagctgggattacaggtgcccacaaccatgcctggctaatttttgtatttttagtagagacagggtttcaccatgttggccaggctggtctcgaactcctgacctcaggttatctacccgcctcggcctcccaaagtgctaggactataggtatgagccrctgtgcccagtgggctcaggtgtttaacacatctttgcagaatgaaggagaatgcaggcccctgcctagtgtcactgtcccttcacgtccaaacaggatggcttaaagagactgaggcctgacccacaaggccctagctccatctctccaccatccacccaggcctcaacccgactagcattcctgcttgaaagagctgacaccctcagggatcacctgctgtgtgtgaggtcagaggtcagagcgtggatgccatgcagtgctggactggatattatgtttgttgctgtctacagctcc

SEQ ID NO: 193757 - DNA, 601 bp, Human
caacttaattccttaattcctactggagataagcggatctttcactgaaatttatcattaatcctaaggaaaacaggggtgggaagggggtgggggtgggaaagggatagagggaggtggggaagcttggagggcccacccacactgcctcctcctagatctgggacagctgtggtggctgggaatcctaggctgacatccctgggcgtggcagcccacatatggagctgttactggggatctgaggggagcacctgagatggtgaggtgtgtgagactcaggagaggtgagacgggggcygaggctgtctgtaaatgcctgcaggatcacatgagctccatgcgattccaacactaatgggagggagcttcagggggaagggggagctgggggcagtcagggctgtcctggcttccatggagggtggtgagtaccctgtcagtggagggattcagctgcagctggaggatgaccaacaggccagaatgtggttaggggttttaggaagtgaatggggtgctacagcatttgatttcccttccaatgctaagactccaggattctctgacatcctctccaccttcccctgcagggcaggga

SEQ ID NO: 193758 - DNA, 601 bp, Human
cccaacgtgccccgcctccccccttcccctgccccctccccacccttaccccagactgtgactgtctccgcccagccttgcccttatctcctcttatctccaggtgctctggtggctgctactgaacaccaaccgctactcccagccttgggggtgacaggaaagaatgggaccgcagtgattgaaacttatttggggcaggaagcttggcctggatgacctgaggggcagtcatgtcctctggcccacccagtcttcacttctcacctcctcaccccccgccctctggagggcagctccyatctctcctgggttagcctcagagttcggcgaggggaggcactgtttggggctacagtcctgggcccggcgttgcttgccagtgagatgtctgatgccaggggggtgccaaggagcagcaagcctggggacttggggagaaactctaaacagagtctcctgggctttgggggcaagggatgctgcagaccctgagtggccccccccttggtattcaggacagaggcttctgagttgctctgagggtacatcgaagctcagattctccaggggtaagagattctttcagccattgctgcag

SEQ ID NO: 193759 - DNA, 601 bp, Human
gaaggatctctagggttgtggggtggaaggagaagctgaaattaggaagaaaaaaccatccatgatttattaaccagagtcactaattattaaccagtttgactcctggacttgaggccccaattcctggcctcccctagcttccagagtgttgagctccccaacgtgccccgcctccccccttcccctgccccctccccacccttaccccagactgtgactgtctccgcccagccttgcccttatctcctcttatctccaggtgctctggtggctgctactgaacaccaaccgctactcycagccttgggggtgacaggaaagaatgggaccgcagtgattgaaacttatttggggcaggaagcttggcctggatgacctgaggggcagtcatgtcctctggcccacccagtcttcacttctcacctcctcaccccccgccctctggagggcagctcccatctctcctgggttagcctcagagttcggcgaggggaggcactgtttggggctacagtcctgggcccggcgttgcttgccagtgagatgtctgatgccaggggggtgccaaggagcagcaagcctggggacttggggagaa

SEQ ID NO: 193760 - DNA, 601 bp, Human
cttgcctgggaggtgacagcccagggcaggggtaggtgtgggggcttcttttctgaggcctgggcagagcctagaaggatctctagggttgtggggtggaaggagaagctgaaattaggaagaaaaaaccatccatgatttattaaccagagtcactaattattaaccagtttgactcctggacttgaggccccaattcctggcctcccctagcttccagagtgttgagctccccaacgtgccccgcctccccccttcccctgccccctccccacccttaccccagactgtgactgtctcygcccagccttgcccttatctcctcttatctccaggtgctctggtggctgctactgaacaccaaccgctactcccagccttgggggtgacaggaaagaatgggaccgcagtgattgaaacttatttggggcaggaagcttggcctggatgacctgaggggcagtcatgtcctctggcccacccagtcttcacttctcacctcctcaccccccgccctctggagggcagctcccatctctcctgggttagcctcagagttcggcgaggggaggcactgtttggggctacagtcctgggcccg

SEQ ID NO: 193761 - DNA, 601 bp, Human
gagttagagatgaaaaatgcccagcatccccttttctcctcaccctaaactgccagtcctggagtctcctggtcttcaggtccccgctcacgtgcatcagcctttaacctcaattccagttgcttaaagtattttttttcttgacacatagtgcctggcacatagtagatgcccaaagaacatctgctgactgacctcacctaaagcatttgggcagttacccacaggtgctccatgacaccttctggccagcagaaaggacctgcagccaagtgagtcaatgggtggggcgggtggcacygtcaaggagggcacctggagacgctctctgggtggccatgggggcctgcccttccagcagggaatatttaggggcatccaagcagcctgtgggggagggtggtgaaagcaggtcactaatctctcttggagattaagtaccacactggctttggagaccagaaaccagctgggggagggggcagaggcctatggagggctgtggagggacagagggtgaatcttgcctgggaggtgacagcccagggcaggggtaggtgtgggggcttcttttctgaggcctgggcagagcctagaagga

SEQ ID NO: 193762 - DNA, 601 bp, Human
ctagaccagtgttttctcaactggggtgctcttgtcctccagggaatattcggcaatgtctgaggacactttttattgtcaccctgcacaggaatggctggatgggtgtggtggtgctaggattggggaggggtcctgcagaaatgggataagaactcacagcaaatcagaggcaggggtgaaggagggagccagggctccggtgcacagcagaactgggctttcatcacagaaatgggaagagctcagggagggctgtgtcttgggaagaagaggacaagggtggctctggacaagttgrgcttggactgcgcacaggtcaggctgaaatcagagagaacagatttgggggttgttcttttcaagtcccagtccacaggctgcggaggcgctggttttcttccaggcatgctcgtggctgggtctcccttggctgtcctggtcacgtcccagcccactccttctcagcctccaggtttcagaatcaaggtcacggtcccagagaagcctcccctcccctcccccagttcaggcccccgagtctccaccatagccccgggcatagtttaatcacctaagtaaatctctgggggctttgtgc

SEQ ID NO: 193763 - DNA, 601 bp, Human
gactcaaacactaacaccccacacaaagaaccgtgccatcacacagcgcccgcctgtcaaaccacacatccacgcacaacttcacacacacataaccgcagaccttcctggtgctgataaatattgagcaaatggaaaaaagatgattttgtttactgcaaacaaaatgagatgggaggggaggtgtcaagtaaaaggaaagcatcagaagttttcctttcttggcatgggggttaaatagggttgccaaaaaaaaaaaaaaccaaaaacagaaagaaaggggcacgggaggctgggcacrgtggctcatgcctgtaatcccagcactttgggaggccaaggcaggtggattacctgaggtcaggagttcgagaccagcctgactaacatggtgaaaccctatctctattaaaaatacaaaaattagccaggcgtggtggtgggtgcctgtaatcccagctacttgggaggctgaggcaggagaatcatttgaacccaggaggcagagattgcagtgagctgagatcgtgccaccgcactccagcctgggcaacagagtgagactctgtttcaaaaaaaaaaaaaaggcatggagaaggaa

SEQ ID NO: 193764 - DNA, 601 bp, Human
tcagtctcaagccacttggttgtcatggaaacaggccggaatagaacagatggtctccactagccaaattccaattaaacagggcagagatggatagggaagggagtgtgatgtgacgaggccgcagagagctcagcccccaggatggacgggaaaccctgggtcaccgttcttggagggggacatcaggtgggtagagaaagctgcctgggggaagtcaccacccagtcaccccttcagtcctcaaaggtgggggcgtggtgctgagggaatgtcagcttggggaggggcagccacagcyttccatttacagaagcgctgaaacagagccacatgcacgcacacacgcgcacccaagcacacatgtgcagctgaacgctgcggtatgcacacaggtcgacatgctcaggaacacgcgggagcagtgcgggaaggtcaggcagagtcattgcacagacacattcctctaacaccgtacaaagaaaatgctttggaaaaccaagcaagcaatttattctcatttatttaataaacaagtattaagaacctaccaagtgcctgccagtagggctataaacacacacacacacacaccctgcat

SEQ ID NO: 193765 - DNA, 601 bp, Human
acagggtgaatggaaagcaaggtaggagccagttgtaaaagggctttgtattagatgagggtctgaacttcaccttgtaggcaactgggagccactgacgccttttaagcaaagtggtgacatggtcacatctgtgctttggaaagaggcacatggaatgctaagtagaagatgtcagtcacaaaaggccacatactgtatgattccatttatatgaaatgtccaggataggcagatccatagacacagaaagtagatgagtggttgtcaggggccgggggagggaaaatggggagtgacwgctaatgaataccgaggttctttccgaggtgatgaaaatgctgtggattaggcagtggtgacggcctattgtgaatatactaaagccactgactcgtatacttcaggagggcgaattttgtggtttgcgaattatatctcaacaaagacaaaagaagaaaagaggcacatgaagaaggatggatgatggcagggctaggctggagacaagcaggctaccagaagacctctgcaagcctgcagcacccccaagcgtgggggccctggggtcccacggctcagcgcagctgctaagagcacc

SEQ ID NO: 193766 - DNA, 601 bp, Human
aggggaagaggaaaagaggaaagagtgtctttaaaagcttggatgtggcgaaagcactggatatgtggggcagaggagaggggaatacagggtgaatggaaagcaaggtaggagccagttgtaaaagggctttgtattagatgagggtctgaacttcaccttgtaggcaactgggagccactgacgccttttaagcaaagtggtgacatggtcacatctgtgctttggaaagaggcacatggaatgctaagtagaagatgtcagtcacaaaaggccacatactgtatgattccatttataygaaatgtccaggataggcagatccatagacacagaaagtagatgagtggttgtcaggggccgggggagggaaaatggggagtgactgctaatgaataccgaggttctttccgaggtgatgaaaatgctgtggattaggcagtggtgacggcctattgtgaatatactaaagccactgactcgtatacttcaggagggcgaattttgtggtttgcgaattatatctcaacaaagacaaaagaagaaaagaggcacatgaagaaggatggatgatggcagggctaggctggagacaagcagg

SEQ ID NO: 193767 - DNA, 601 bp, Human
gtctccccactccaactgcccatgtaggcagttcctaggtccagtcataccccaccttgtccctgctatgccaagttgcagaatcctctccttcctccaggttcctctatagggttgcctctctcagactaatgtactgtctctggttcttccccttgcttttatttttttggatttttaattgatatatcatagttgtacatattttgggggtacatgagcttccagccctgatttgataattatacattgtaggcaggtatcaaaatatcaaatcagggctgggctatccatcacctcracactcttctacccctgctttaattcacaaagcattactacacctatacaatgtgtcaagcatggtgctggcaccttttgggtgaaagtgacagtggtagtggcaagaggaaggagcgtggaggaataagaaagactaagacattttcttttaccttaaaagctctgtctagcaggggccccagacatgaaaacaaataatgactgagtgataaacgcagtttttgtttgtttctgaaaaatacaaacccaaagcaatgggagctcagaagggggagtgattctgtctgaaggtgacgga

SEQ ID NO: 193768 - DNA, 601 bp, Human
ggctgctgctcactccaccagcccaacctcaccactgacctctctccccaccccacactgggctccactcctgggtcttttaggcactggctctcacttgccttggggcctttgcacaagcggttctgtctgctgggatcaccctaccctgtacccaccactccccttttcttgctaaaggtcacctccaccttctcttttatggccgttccccattcccctcccatccctgccaaaccttccaccccatctctcatgctagtgaccaccatgacactccacaaggctgtcgaacagggtraacaacacctccccaccgtctccccactccaactgcccatgtaggcagttcctaggtccagtcataccccaccttgtccctgctatgccaagttgcagaatcctctccttcctccaggttcctctatagggttgcctctctcagactaatgtactgtctctggttcttccccttgcttttatttttttggatttttaattgatatatcatagttgtacatattttgggggtacatgagcttccagccctgatttgataattatacattgtaggcaggtatcaaaatatcaaatcagggct

SEQ ID NO: 193769 - DNA, 601 bp, Human
agtggagaaagctttgggcccaccccaactcaccccccagcgccaggaaggacccattttcctttgctctgagaactgctggttgcctaggaagagggagggaccttctagccaggcaccactgtatcttctctctgcacgcattgcacccttggagtaagggtggaagctaaatttgtgtttccccctagaaaatatagtattgattgctttcaagtcgatttcaaataaacagcatgatattgcccccaccagggcttctaatcgcttggaaatgtcatcaaagacaacagcacaaaasagggcaggggccttggtgattccttcaaactggagaccctgggcctctgcttccttccttgtcaccttgtcctaacagcacacaggagaataaatgctggaacagccttttcggagcatttgtatatactcttatttaatcctcgtgaactccctctgggtttatatcattatcccacttttgtcctcagtgggtcagtattcacggaagaaactgaggaccagagtgttggtgtagggcgtccaagggcacaaagctagtatgtggcagggaacccaaatctgcccctgtccctcaatt

SEQ ID NO: 193770 - DNA, 601 bp, Human
tctgtttggcaccctccttgggaactggatcccacagtggggagggccagtggctcctgtgactcccagtggagaaagctttgggcccaccccaactcaccccccagcgccaggaaggacccattttcctttgctctgagaactgctggttgcctaggaagagggagggaccttctagccaggcaccactgtatcttctctctgcacgcattgcacccttggagtaagggtggaagctaaatttgtgtttccccctagaaaatatagtattgattgctttcaagtcgatttcaaataaacrgcatgatattgcccccaccagggcttctaatcgcttggaaatgtcatcaaagacaacagcacaaaagagggcaggggccttggtgattccttcaaactggagaccctgggcctctgcttccttccttgtcaccttgtcctaacagcacacaggagaataaatgctggaacagccttttcggagcatttgtatatactcttatttaatcctcgtgaactccctctgggtttatatcattatcccacttttgtcctcagtgggtcagtattcacggaagaaactgaggaccagagtgttggt

SEQ ID NO: 193771 - DNA, 601 bp, Human
cccactccttctccctgcagacaagctgtcttcccatcctgggcctgagagggaggcggggaggggcggggcaggggtgaagaagaagccctgcacaaaacaatggccttgagccaagacaagagagatgcttgttcccctttatttatgattgttattgggagaaataaagccctcagctgcagcctcccctcggccgccagccaggccctcgctcctctcttcttccaccttccccttccgtccccacctcttccctgggcacaggctttcctctgacacacagagatcaaataacttytcactcaaagggaaagatatgatctccttttactattcagcaccaacaccagcggaccgacagcccaagattaaaggcaattagacaggtttgtttttgtaggggcagaaggtctgtttggcaccctccttgggaactggatcccacagtggggagggccagtggctcctgtgactcccagtggagaaagctttgggcccaccccaactcaccccccagcgccaggaaggacccattttcctttgctctgagaactgctggttgcctaggaagagggagggaccttctagccaggcacca

SEQ ID NO: 193772 - DNA, 601 bp, Human
tgcaaaggccccgtggcgggagagcgtctggtaactgtggccggtgtagctagacggaggagactgatgcaggggccaggcctctcccctgagctggaccatgctgttggaggccacgagcagagggatgagatctgtgacccggctttgtttcaacaagaccactgacaactgctgagaatgaacaggagggagcgcaggccgggagactggtggaggcgactgcaatcatctggggcatcttggcggcccctgcagagctggggagggagccccaaggccagaggcggggcaggggctkcatcaaggtctacggagccctcctctcccacccctccaggtgagacagctggcagcccactccttctccctgcagacaagctgtcttcccatcctgggcctgagagggaggcggggaggggcggggcaggggtgaagaagaagccctgcacaaaacaatggccttgagccaagacaagagagatgcttgttcccctttatttatgattgttattgggagaaataaagccctcagctgcagcctcccctcggccgccagccaggccctcgctcctctcttcttccaccttccccttccgtc

SEQ ID NO: 193773 - DNA, 601 bp, Human
tgaagcaggccttggtggaggtgagaatgccccactccaccccgggaggctctctccgggcaggtgagcagatgcagaaaaagggctgagagctcagccatgactgcgcacgccagggaggggggaccaggtgtcctgggaccttgggcagcaaggggacagctctagctaagatctggtttgagtcctggccctgccacttacatgtggtgttattttcaagtaaattagtcattaacctctgaactttcttttcttaaatgtaaaccagggtgatagtcctgacctcagagagtgctargaagataaggtgagagaactgtgtagatgccataaagctctgcaggatgataaggctctacgggaggccagcccacatcacaggccagggtggaaccataagggagatgcagtgtgtgctggccaggcagggctcgagattaggccttcatgagcaggaatttcagggagacttcatgtgattgcatgcagaaacagggtgtgcaggcagaggaggcagcagctgtccattagggtattcatttattaaaatattcctgctgtcattcagtacctattaggtcccaggcatacagcactg

SEQ ID NO: 193774 - DNA, 601 bp, Human
tgtctgcttcctccttctgggtctacatccaggaccaccccagtgtttccttttttttttgtatctgagacggagtctcactctgtcgcccaggctggagggcagtggtgcaatctcggctcactgcaacctccacctcccaggcgggcaattctcatgcctcagcctcccaagtagctgggattataggcacccaccatcacgcccagctaatttttatatttttagtagaaatagggttcatgttggccaggctggtctagaactcctgacctcaagtgatccacccgcctcggcctcycaaagtgctgggattacaggtatgagccactgcacgcagtccacccccgtgtttcttgaaatggagagcccagagctggagggaagggcttcccagaaagaggctgtggatttcagccccttgcctgagggtaggaagaggtccactgggtgctcccagcttctaccgccccatctgtaacttggttttctaagtgttggcagggctcagaatgagtctccctctcctccgtggggtatgaagcaggccttggtggaggtgagaatgccccactccaccccgggaggctctctccgggca

SEQ ID NO: 193775 - DNA, 601 bp, Human
ggctcacccaaggtcacacagctgggtgcacccctcacgccccaccatcattttcctgcacacgaacctgcgggcaggggctgtctgcttcctccttctgggtctacatccaggaccaccccagtgtttccttttttttttgtatctgagacggagtctcactctgtcgcccaggctggagggcagtggtgcaatctcggctcactgcaacctccacctcccaggcgggcaattctcatgcctcagcctcccaagtagctgggattataggcacccaccatcacgcccagctaatttttayatttttagtagaaatagggttcatgttggccaggctggtctagaactcctgacctcaagtgatccacccgcctcggcctctcaaagtgctgggattacaggtatgagccactgcacgcagtccacccccgtgtttcttgaaatggagagcccagagctggagggaagggcttcccagaaagaggctgtggatttcagccccttgcctgagggtaggaagaggtccactgggtgctcccagcttctaccgccccatctgtaacttggttttctaagtgttggcagggctcagaatgagtct

SEQ ID NO: 193776 - DNA, 601 bp, Human
ccagggaatgcctgaggtgacccgacccacaagtggctgaggcaggactcccaacaacgaggctgacgctctttcatgaaagcacacctggcccatgttagcaaagaacctcctgtctgcctcgtaccctgaatttccatcaacctggattattggtaaagtcctctgccacccacactcttcatgagatcccaaaaggattgatcatggaaaatgcaaggtagcttattgctagagtaatgagatgcgcggctcagcctgttcagcctgtcacctccactgcatccaggatgccgggctyggaactggcacacaggtgctcaggaatggcgctcacagggagagagtggcctttatcatgcccatcctttcacactcggagtacgcgttagtgtgcctttttgccacctcttctccaagacaatggttcctcctggcaaatctccccagctttacccaggaacacggttctccgggcaagaagctgcctcaaaaggctcacccaaggtcacacagctgggtgcacccctcacgccccaccatcattttcctgcacacgaacctgcgggcaggggctgtctgcttcctccttctgggtcta

SEQ ID NO: 193777 - DNA, 601 bp, Human
cccaggagcaacaagcccaacctacttgctgtacagataaggaaattgaggccagggaatgcctgaggtgacccgacccacaagtggctgaggcaggactcccaacaacgaggctgacgctctttcatgaaagcacacctggcccatgttagcaaagaacctcctgtctgcctcgtaccctgaatttccatcaacctggattattggtaaagtcctctgccacccacactcttcatgagatcccaaaaggattgatcatggaaaatgcaaggtagcttattgctagagtaatgagatgcgyggctcagcctgttcagcctgtcacctccactgcatccaggatgccgggctcggaactggcacacaggtgctcaggaatggcgctcacagggagagagtggcctttatcatgcccatcctttcacactcggagtacgcgttagtgtgcctttttgccacctcttctccaagacaatggttcctcctggcaaatctccccagctttacccaggaacacggttctccgggcaagaagctgcctcaaaaggctcacccaaggtcacacagctgggtgcacccctcacgccccaccatcattttc

SEQ ID NO: 193778 - DNA, 601 bp, Human
caggaagccagccccagacattaagctgtcaaaccactcccaattatctccctctatgcccgccggctccaggggcgacagttgtagcaagctgacgttgactcattctgtcaccggcctgccctgctctgggaaaatgcaatttaatgaagtccgatggcagggctggggcagacagggtcccaggaagagggtggcaccagcctggggacagctgacagtgccctcttcctgtgggacagtgtttttgatctgtgtgacgtgatctcatctctagacactggaggggtcatcctggacytccccctgccccactcacctctccagcagctctgagcaaccaaggcattaacctttcccaccagggcctccacctccctcggctgcctgttttaatagcgtatggtcatgacagctgggaaattcgtcctgtggtttcatctcaatcccttctgctgaagagcaagtccatttccctaagccttttgatacagagcctgggagtgggtcagccaccgccagatgccatcaaggcgagtccagggctgtggctgaggccatctgtgtactgctaggctaactctgctgctgggaagaagca

SEQ ID NO: 193779 - DNA, 601 bp, Human
tggcgaaactgatatgtgggtaccctaggatcatggacagggctgcaagctgagaccattcctcagggtcagagcaagaccctttctagcatcccaaagtgggctccaggccctccccaaaggccacagctgctcccatttgtgtggattctctaagctgccctgtgccagcctgcagaaaaatgggcagcctcaaagctccacaatgggtgtcagacagctcaattgtttcctcgaaaatcagcatcctcactctggcctgtggtgcctgccctggtcctggagtcctatgtttttcagktaggggcccaggagagctctgcaaagagctaggatcatcatctctgcagaggataaggggaagtgccatgtgtctctgccagccggccccctggtaggtaccagcacaggcctgtgtttatactgtggcatgtgatgagccctaaggatgcaggaaaacaagggaccagtgctggagctttgacctgagctgaggggacttttcccagtctcctccctgagttcctggagtctaagagttccgactgtcctcaagggaactctgggactctttcccacggccccggccagcagacgccaa

SEQ ID NO: 193780 - DNA, 601 bp, Human
attcagtaaaataacgtatgtacatggttagccaagtgcctgacacagaataattgctctggaggtggcgaaactgatatgtgggtaccctaggatcatggacagggctgcaagctgagaccattcctcagggtcagagcaagaccctttctagcatcccaaagtgggctccaggccctccccaaaggccacagctgctcccatttgtgtggattctctaagctgccctgtgccagcctgcagaaaaatgggcagcctcaaagctccacaatgggtgtcagacagctcaattgtttcctcraaaatcagcatcctcactctggcctgtggtgcctgccctggtcctggagtcctatgtttttcaggtaggggcccaggagagctctgcaaagagctaggatcatcatctctgcagaggataaggggaagtgccatgtgtctctgccagccggccccctggtaggtaccagcacaggcctgtgtttatactgtggcatgtgatgagccctaaggatgcaggaaaacaagggaccagtgctggagctttgacctgagctgaggggacttttcccagtctcctccctgagttcctggagtctaa

SEQ ID NO: 193781 - DNA, 601 bp, Human
acccgaacctgagtcttctggttgtggtccactgtgctccctttcagactgacactgccccttggttttctgtctcctcaactggaaccctctcttaagaccagattccagctttctaggcaggcagtgcctaatcactggtgtgcacattataagttctcaacaaattctgaagagtgatttccccagaggacaggcaggatgggctgcagaggctgaagccctcggtgtcctgcccagcctgagtcttctcccagctccttaccagggacagggaaggggaaaagaaagagcaaaaacyggggttttggcatggcagagctctcaatgtggatccaactagtgcccagacaggtagctggggaccacacctgcccaggcccaggccctgccctgcctgacatgctgccccaggcactagttggcaaaggctcccaagtggacttggacaagaaagttcttggaaaagcaattcccatgctggacccttttggcaaggtggcagcagacagaggtcataccccaccagagttgggggcctgagcctctagactttcccagctgaagggtgctgtcataactacccccgacactggcaagg

SEQ ID NO: 193782 - DNA, 601 bp, Human
cagaacccgaacctgagtcttctggttgtggtccactgtgctccctttcagactgacactgccccttggttttctgtctcctcaactggaaccctctcttaagaccagattccagctttctaggcaggcagtgcctaatcactggtgtgcacattataagttctcaacaaattctgaagagtgatttccccagaggacaggcaggatgggctgcagaggctgaagccctcggtgtcctgcccagcctgagtcttctcccagctccttaccagggacagggaaggggaaaagaaagagcaaraaccggggttttggcatggcagagctctcaatgtggatccaactagtgcccagacaggtagctggggaccacacctgcccaggcccaggccctgccctgcctgacatgctgccccaggcactagttggcaaaggctcccaagtggacttggacaagaaagttcttggaaaagcaattcccatgctggacccttttggcaaggtggcagcagacagaggtcataccccaccagagttgggggcctgagcctctagactttcccagctgaagggtgctgtcataactacccccgacactggc

SEQ ID NO: 193783 - DNA, 601 bp, Human
gcattttatttttgcacaattggccctgctgtgtctcttcatctctgctccagccctggtcccatcagctcggttggcatttcacagcaacttttcatcttcaaagtgattagacagattatgtgcccaagtttttataaggctcagcccctctccttcgtaggctcccgcaaccctaaaaataaatactggtggtcagtatctgtgcttcctgcttcccagaattctggcagcaagttattttatttccaccactattggctgaataccttctatctaccaggcactcagaatctcctayttttcacttccatcttctggagcaaggactgatagtcccattttacagagggagaaactgaggcccagtggttgagaaatttgccaagttgtgtagctaaagggtggtggatccagaacccgaacctgagtcttctggttgtggtccactgtgctccctttcagactgacactgccccttggttttctgtctcctcaactggaaccctctcttaagaccagattccagctttctaggcaggcagtgcctaatcactggtgtgcacattataagttctcaacaaattctgaagagtgattt

SEQ ID NO: 193784 - DNA, 601 bp, Human
gggaggggcagcctgcgagcagctcagggaaaggccctctcacccacaatagatgtggggggcggggaggtcgaggtgaggattagggcggggagacgctttgaaccccagaaagactggtgggaactggttcttgactcacagccgagagaggggggtagggaaatgcaagggcttgcgctttattattttttcttttatgagatgtgaactcaagcaattaaaaaatatgcattttatttttgcacaattggccctgctgtgtctcttcatctctgctccagccctggtcccatcagcwcggttggcatttcacagcaacttttcatcttcaaagtgattagacagattatgtgcccaagtttttataaggctcagcccctctccttcgtaggctcccgcaaccctaaaaataaatactggtggtcagtatctgtgcttcctgcttcccagaattctggcagcaagttattttatttccaccactattggctgaataccttctatctaccaggcactcagaatctcctacttttcacttccatcttctggagcaaggactgatagtcccattttacagagggagaaactgaggcccagt

SEQ ID NO: 193785 - DNA, 601 bp, Human
aatacaaatcagatcttgttacacaagtccccggtcgctctccactgccttggggtaaatctaaactacttatcaggccttcacaatctgtccctgcccatattcccatctccctctcccacccctcccaggtccccaccctccccaccagtccccgctgccagtggaaaactcctacccacccttcaacactcaggtcccacactggcatcagctctgacctcaggttcccacagcacctggctccttgctcaaacagctctccctggcacacagtgttggctgtgccacgaagacagaygtgctcacccccgacgtcccagcacacagcctgacacccggcacgcagtaggccctggatccaggtctgctggatgaactgagagccagagtcaaatcccagagaaccaactcagggatgggggtgcctggtggcttctcaggtcactgcgatcttttaatcaagacttcttaggaagctgagtgatcaaagaaggaccagaatccctggtgagggccatgcttatttaccaaaatgagattctctgtaagagaaaggctgatgggctgcatatgtgggggccgcattcaattcatgcct

SEQ ID NO: 193786 - DNA, 601 bp, Human
agtggatttaaatacaaatcagatcttgttacacaagtccccggtcgctctccactgccttggggtaaatctaaactacttatcaggccttcacaatctgtccctgcccatattcccatctccctctcccacccctcccaggtccccaccctccccaccagtccccgctgccagtggaaaactcctacccacccttcaacactcaggtcccacactggcatcagctctgacctcaggttcccacagcacctggctccttgctcaaacagctctccctggcacacagtgttggctgtgccaygaagacagatgtgctcacccccgacgtcccagcacacagcctgacacccggcacgcagtaggccctggatccaggtctgctggatgaactgagagccagagtcaaatcccagagaaccaactcagggatgggggtgcctggtggcttctcaggtcactgcgatcttttaatcaagacttcttaggaagctgagtgatcaaagaaggaccagaatccctggtgagggccatgcttatttaccaaaatgagattctctgtaagagaaaggctgatgggctgcatatgtgggggccgcattca

SEQ ID NO: 193787 - DNA, 601 bp, Human
actcctgctttcatttttaatgctgggaaagggtgggttttctttttctctctcccccgtgcattttcaccctagctaatgactcctcactcagaaaggcccctaccactgctaattagatttaattactggggtaattaatgatttgattggaaaactaaaatattgtgggtgaattttgtgtataaacaggaaagtcaaagggacagggaactcaggctgagaccagtctggggcaggaggaaagaccaggctgagcattggtcagctagcagctctgagacagggactgtctgctctygactccccattcacagagggggaaatggaggggcagagaaggagagctcttccaagattgccaagcagttagtgggaatcaggggaagcaggagctggcagggtcggacccagggagaagaggggtgggaaggagtgatctgagcctggatggcttggctccgtggctcggctggctcagcagtgtgatcatggcccaggagcacctgggcaagaatcatcaactgaacactagcccatagaaatgtactgtggtggtttctcttgtggttacaaagaccctgcctctgggtcaccagat

SEQ ID NO: 193788 - DNA, 601 bp, Human
accaaattagcttaatgagtgaggcccagctttagtaggggccctccatgttgcagcgctgactcctgctttcatttttaatgctgggaaagggtgggttttctttttctctctcccccgtgcattttcaccctagctaatgactcctcactcagaaaggcccctaccactgctaattagatttaattactggggtaattaatgatttgattggaaaactaaaatattgtgggtgaattttgtgtataaacaggaaagtcaaagggacagggaactcaggctgagaccagtctggggcagraggaaagaccaggctgagcattggtcagctagcagctctgagacagggactgtctgctcttgactccccattcacagagggggaaatggaggggcagagaaggagagctcttccaagattgccaagcagttagtgggaatcaggggaagcaggagctggcagggtcggacccagggagaagaggggtgggaaggagtgatctgagcctggatggcttggctccgtggctcggctggctcagcagtgtgatcatggcccaggagcacctgggcaagaatcatcaactgaacactagcccat

SEQ ID NO: 193789 - DNA, 601 bp, Human
cactccaggagcgagattgtccccatcttagagatgaggaaactcagggaggtcaagtcacctgcccacggtcacacagtctgcaagactgattctgatcagggcagtctgtctccacaggtgacgttcttcaccacactcatagctccacggcctccctctctccccttcctggggaaaagagcggccagcaccctctgaaccagacctgggtgagcagcccctgcctgctggcagtgctggcctgaggctgacgatggggctgctgggagtgccttgtagagagggcaggcaccatccycccacccctgccactcctccttcgttctgcgggaggctgagctgacacctccacctcccccaggactacaggggctagcaaccccggcagcccagcacaaggatatgactgaagactccagacatgaaaagcccccattcttcccctgttcctcttgcctcctcgtcccagagctcagagacttgacttccagtccaaaccctgccactctcggggtgtgtgtctctctctctctgcccctcagctcctccacctgtgaaacctggaggtggcacctgcaccctttgcctcctggagctg

SEQ ID NO: 193790 - DNA, 601 bp, Human
ccttgcttccttgccaccctatgagctctgctcctggatcacagacctccgagctggggggtggcagtctttatccgatgtgcttcaatgaccaggggctggggccagaaaaaaaaggggatgggaaacggaactagcaaaggcttaaagttgagttttctcttgacttcttcagctagtgtggcctcaggagcccccaccaaagggtctccagcagcgctgccggaggtaggccaggagggcaggtcccccaggcaccagcagatcagggcctcaggactgctggggtaagaggcaaaaycccggccctgtgttcccttggctgatgagagaacccaaaccccacagaggggagaccagcccgtgcccagatgttcaggcttatgtctgagtagcatctgggtggggcctggggtggggagggtcccacatcacaggatgccacagaggtgggggaactcggggacaggggcagggactctgagtggcccttccatcactgcagaagccactcacttttcacgccgccccccacctcaacctaccttccggctcaactaccaccccaaccccgattctctcccctggccaatggtcctgt

SEQ ID NO: 193791 - DNA, 601 bp, Human
gtggggctgggccttctgctgaacccttccctgtatggatgatacaagaactgcaccaggccttggcacaaggtgctcagggcctcttctgtacctggacttaggcggtgccaggaaagggagctgtgatgctggaggagacagccggagctcctttcctcgcagcccctccttggtgaaacgtcaccctgcagtgtctcaggtggcacaaccatggactgagaccccagcaggccagcctctctttccatgtctcctggctcagggctgtctccatccaacaacaacaaaaaaaataaawaaataaaaaataaaggcttccttgcttccttgccaccctatgagctctgctcctggatcacagacctccgagctggggggtggcagtctttatccgatgtgcttcaatgaccaggggctggggccagaaaaaaaaggggatgggaaacggaactagcaaaggcttaaagttgagttttctcttgacttcttcagctagtgtggcctcaggagcccccaccaaagggtctccagcagcgctgccggaggtaggccaggagggcaggtcccccaggcaccagcagatcagggcctcaggact

SEQ ID NO: 193792 - DNA, 601 bp, Human
tggggatcagtgaccagggccccagagcaatctcttccctccacctgcttccaaagcagcttgagaagaagaaggtatctgcataggcaccaaacctgctatttcatttctgggcagaactcactggtctggacccaatgagcgatactgcattcaaattgcacgtaacgtctgggttagacataacattcccaggtggggctgggccttctgctgaacccttccctgtatggatgatacaagaactgcaccaggccttggcacaaggtgctcagggcctcttctgtacctggacttaggyggtgccaggaaagggagctgtgatgctggaggagacagccggagctcctttcctcgcagcccctccttggtgaaacgtcaccctgcagtgtctcaggtggcacaaccatggactgagaccccagcaggccagcctctctttccatgtctcctggctcagggctgtctccatccaacaacaacaaaaaaaataaataaataaaaaataaaggcttccttgcttccttgccaccctatgagctctgctcctggatcacagacctccgagctggggggtggcagtctttatccgatgtgcttc

SEQ ID NO: 193793 - DNA, 601 bp, Human
ccaggcacctcctgctcctaggcaaggctttggagtcagaattctgcctgcccagaggcactctgctgtgggagggagctgcaaagtgagggactatcggttcaggcttcagggtgtgggtggggccctgctgctgaaggggcaatgaggagaaggcaacctgactgttcagaagttctgaatgtgccccgcacattccaaacaggcagcagggctaggagctccgtgcgcactgccagagcagcaggtgggggccactggagcaacattgggatggagggctctcgaccccatcccctcragaaggtcttggtctcaccaatccccaccgcaatgacccctgaaataatactttgtagccacagcacagtggtgaccttgaactcttggacagcgagtggggatcagtgaccagggccccagagcaatctcttccctccacctgcttccaaagcagcttgagaagaagaaggtatctgcataggcaccaaacctgctatttcatttctgggcagaactcactggtctggacccaatgagcgatactgcattcaaattgcacgtaacgtctgggttagacataacattcccaggtggggct

SEQ ID NO: 193794 - DNA, 601 bp, Human
ctgttgtggggggctgtcctgtgtgttgcagaagtttagcaagatccctggcctctacccaagtgcaccccctccatttgtgatgacaaaataaccacagacattgctgcatctcccatggcaggcaaaatcatccccgggtaagaccactggcctagaggaagggagtaaagctcaggcagggatggtggagctcacgagggacatgcagggctggctgtggcaagctggtgcagagaggagtgggaaacatagttggggggcactctggtggggaactgtccttgtttgtccagggacrgagggtccagaagtggctgggaacagggctggagagtctgggctctgtaggaggggcagtgagttgtgtttgggggagacaggtagagagaacagggtcctctggggagctggctgtcagaatatgggttatagagtggcatgtgtgtcctcagaggatgcaagagggtgggtaggggcagcgaggggagggacacaggggacatgcggtggggtgttgtgagcacctttagacagggaggggagggaggctgccaaggtaggggctgcgctaggtttctaagagctgaaacaaagtcag

SEQ ID NO: 193795 - DNA, 601 bp, Human
aggtggctgaggacacctggattctgtcctgcaggcctgtttcatgctggctgccccatccacatggcccatcatggggccagtcctgagccagcctctgactccatcgtggcaccccaggaacacagagcctctctcttggccctgcctgcctctagccttcaagacatcacctcttggatcactctcctgtacctgccacctttgctctgctcacctggacactgagagaggcgagctctggtccccactacttgctcattgtttttctgtatggccttggatagggtggtttcctttsctgtaaaatggggaatattggctctgatgaccttgggggactgcactttggacatgacctgtccagctcactctgacccagctgtgcctttgccttggatcaacttctggggacctatctaccaagtggctgctctgtctctctacactgcccagctcttccaggaagacctcccaggttaagtgggatgccaggaaaatccaggccacagcatggcaaagctggagcacacagggactctcctacagtcaagtaatcaccaagtcttactgatgccagctcctaaacagcttttgaatt

SEQ ID NO: 193796 - DNA, 601 bp, Human
aaggattaaaagagggagtccatgggaaactcagaaagcagcacttaggacaaatgaaaggctcattagatgctagcttccatcatcatcatcaccatcatctttcatctatgaagcaacaggcctccctccctggaacttcattcaacaaatatttgctgagcacctactccatactggacactgtagggagtgctactaggcgcccctcttccaggacgcccttgtgactgtcatctcttcctactcagctgacagttctattaataccccaataacatgtaacactgacctgtacccytttattttctacttcctggcatatgtgtctagcctgtctcccaaccaattgtaagcccctgcaggagatgaaaggagcaggcctggccttgggttgagttgaccatgtcacgcctgccactggcagggtccagggcttggggagttccctgctgactttctctgattccctaagcagtcagggctggtccacagaacacatcctgtctcctttcccgcaggttccctcttacatgagaagcagaggctggcccagatgtgggaactgggaccactaaaatggtagcatattggagcttga

SEQ ID NO: 193797 - DNA, 601 bp, Human
tgtctcatgacagcccagtgcagctgtggccccactccagatacagttccatggtgaggtcagtgggccagacggcccagtactcttgctgacgggctagttggcaagcagctaagccctaggccctctccagcaggataattgggtgctccccacccctcccccaggctgctggaggctgcccagtggctgagataatgtgggcataattggggaacttgcaccacacaaagctaggaacaggaaaagccagttgggagggcttgggccccaggtgagagcgcagggaaggggtgtgggmtccaggagccattttgggattggtgccatgcatggattggtgccatgcatggtggacctgcaacgggacacggccctctgagcccctgcaatcctgtctcctctcatcccctgaaggtgtggaggcaggcagggcacagtccctggggcacaggctgacattcattgtctgagtcttcagtggtgacctcaccctcagagctgtgtcaatgccaggaggggagacggctgatagcggccaggcatggggtggggagggtgctgcaaggtggccgggcaccccagaggcccccttacatct

SEQ ID NO: 193798 - DNA, 601 bp, Human
cagcgtgacggggatattgtagcaacacaggctcctctgagggccccaaaacccatggtcagtgcagtaagttgctcccctctcttccgctcgagaggccacaggccaggtctctaggtcactgcagtatccctggtgctcagcataaagtagctactcaagaaatgcttgctgaataagtctatctttggcttcaccaagccaggccctaccgtgttctgaaagtttccctgaggttcccccttctctgtgctgattcacatccacacagccctcaaggtccatcaggcctatccccacyctcactcctccagctgttccctctgccagcctgtggggtgcttcggagctgatgctccctgggcagaggccccatgggttgggaatacgatgggagaagtatccagccacgagttgggaaggctgggctgtagcctgcctctgcctttagcaggcagtgggaccgtggccagtcacctcccctttctgagccctagcttcctcctctgtaaggcagcagactggcctcccgagtcccagtggtcctcctggtcctaactgtctcatgacagcccagtgcagctgtggccccactccagat

SEQ ID NO: 193799 - DNA, 601 bp, Human
gttccggatctcctggtactctgcctcaccttttaaccgagtttcccaggataccacactgggaggcttcccattggctgaggtgcaggtggccaccaggaccttgtcatcctgccccttcttggctcgaagcactgcctgggtaccctctatccaattggtgggtttggctgcgaggaagcagagagagtgatgggactagccctgttgacttgtccaagatgcaccggccaaaagggcgtggcatccgtcaggccttgtcttcaggtccccttggccatccctgcctctcagctgtgckgcaccaaagactgtcccagaacctcttgcaggaagttcatcatgtctaacgttatgtcctccctgccctactagtcatatccctgtcatcgagcttaggcctcctggagtcccagcatgtctaaggcaagcagcgcaggtggctcctttccttaccgtggtgtctgatgctgctgccagcacagtgccttgtgggcttcaacctgaagaatcacgttccccactgtctagagataagcccctgcccctaatccctagtgaattgtggggtggcctggctagaagggactggaagcctcat

SEQ ID NO: 193800 - DNA, 601 bp, Human
catcacccgtggtccagtcagctgtcttccaaggtgactggtcagccctgcagcacttacgtggtccagtggtactcagtggctggggggttagcatcagctttgcaggtgagcttcacgtccatccgctgcaggtaccagttgccatcaaacccctcaatggttacctcaggctcatctgtggggcaagggatgtttgaagagggtgaggtcaggagagcgggacttagaacaagggaacttcagccaggaagggatggaaggagcagtggcatggaaacagccaggagagagggaagtrtgggtgggagggtggcaatcacagagcccgggagtggaaacaggagggcgacagggaaggaggagagaaaacgagcaaagggaggagataggggagacaggaggggagaagaaagcacccccagaaagagaaagggaggagaaaggagaggaggagggaggagggacagtggcgcccaccccaggaggcccctggcagccagccctgctcacactgcacgttgagagtgaggctttccttgaagcggtccatgtggtagttgacgatgcaggccaaggactgctggtgggcttccctgct

SEQ ID NO: 193801 - DNA, 601 bp, Human
aatccgtctcaaagaaaaaaaaaaaaaataataatacagatgccttggttctaaccccagatctcctgaagcagaaccactggggcaaagacctgggaatctgtatttgacaagccactcaggtaacgagataggaagtatgttccattccactactttgtgtttttgctgggaatgtcacaggaccttttcatgtgggaagtgacttgcaaatttgccaaggacaaaggatcttcttccttcctcctgaccctcaaaggccacaaagctattctgttgaacctagcagctcctgggtccrcagagctgaaaccagccagcaggctctgcccactcacaccttcagaagcactttttattccaggaagtggaggatcataggtagggcataccagtgccctctgctccccagaaaaagaaggcagactccttctgggcagctgtctcctggccacccatatcaaccttctccttggttccccacgtccctgtctttctgtgtgttccatccagctcttctctgggaagagccttggccccagctgtcagagccggctggaggggagaaggcgaaggcaaggcaaggcgaagaccgtgaggc

SEQ ID NO: 193802 - DNA, 601 bp, Human
tggtagttttatattattcagcttttcatatttgatcataatatgggaatataggcaggctaggtaggtgccggtcccacttaacagatgaaacctgaggttcaaggccagggaaccacagctagcaggcagcagcatgggagctccagccaattctcgggactcctggtaaagtgctctttctactttccattcacgtctcatggttgttggtccttggtctcctgggcagctggttaataatacagatgccagccaggtgtggtggctcacgcctgtaatcccagcactttgggaggcygaggcaggcagatcacatggtcaggagtttgagaccagcttggccaatatggtgaaaccccatctctactaaaagtacaaaaattagctgggtgtggtggtgcacgcctgtagtcccagttactcgggagggtgaggcagaagaactgcttgaacctgggaggcggaggttgcagtgagccaagattgcgccattgcactccagcctgggtgacagagtgaaaatccgtctcaaagaaaaaaaaaaaaaataataatacagatgccttggttctaaccccagatctcctgaagcagaacc

SEQ ID NO: 193803 - DNA, 601 bp, Human
tcacagtgggacaccacttccttttttaagacactcggtcaccctgtcaccctgcagatagctcaggtccactgtaaaagacgctccccatgtgaagttgtgatggcagtttacccctgtgtggacttgttttgatgcttccattaataataatgatgatgatggaggtcagggtaataatcacggaacattggccatttattgacagactgatctgtgctaggtgcttgacttacatcacgtagaattctgacaacagcccttcaaggtacatcatactgtccccgttttacagatggtggggggggccctgtccagggtcacagctgtctgacatcaagcccatgctcctttcacgtcccaggtgaagtctctcctcagaacatcctagctcttgtcctccctttgcccggatagataagttgacagaaagctgcagggaaagctcagttgcagggcacacaaagcactatggctttgggctacatcttcgctttctctccagtctccctgcttgaggtaagcctcactttctggcccatgaagaggtccttgaccacaggtgcagagcttggaggagatgagctccacctgcaaacct

SEQ ID NO: 193804 - DNA, 601 bp, Human
gggaccaaagaaccccggttattttgtttagggctgggcctgtgtagcagcagcagaatggctgggatgaccttccagtatcaaagactttcgagtgaggatactgagtgagggagagaagaaaggagaagcatggggatctaactcatttgcaagcagaaggggctgtctggcgtggagtggagcgtcctcccctccccctccatccctccagctgttacactcagccagtagctcctgtctctgtgccaggagcagagctgcaagggccgcagctgggaggagagagaagagccaggcygcagggtcatttgtgtttgctggcaggggcccagccagcctccctcacatcctcttacaaagggagcagcttgtccctattcctgaagggttgtaacctctcttctggggtccctggctggccaagacagtggggaagtgggggctctgcatgcctttggggtcctggttctctgactgaggtgggtgggctggtgctgggggctttggatagatctgaggtggagtgaagtgttagggcttacagtctggatctaggatctggaggtttggggtcaaagagaatgtttgggtttgcctc

SEQ ID NO: 193805 - DNA, 601 bp, Human
cacaaggatagggactttttgtctgttttgctcatggatttataccaagcacctagaccgcttgtcatgtggtcaatgttcaagaagtatctgttggacgacagaatgaattctacaatggcaagattatgtcttagagataagccttgttctaggcagagcaagtattgtaaggagagactcgaataaacctgcatggggcccactgggaccttgtttctctggagtgggtgacaggaggagtggtgtggtggcttgggaccagatgacactaggctttttttctcctccaggccttctrtttaattctttttcctaagtcctttttttttttttttttttttgagacagagtctcgctccatcgcctgggctggagtgcagtggcacgatctcggctcactgcaacctccgcctcccaggctcaagcaattcttgtgcctcagcctcctgagtagttgggactacaggcacgcactgccacacccggctaatattttgtagagacggggtttcacaacgttggccaggctggtctcgaactcctgatctcaagtggtctgcccacctcggcctcccaaagtgctgggattacaggtgtg

SEQ ID NO: 193806 - DNA, 601 bp, Human
catcactaccaccctgatccaagatactctcatctttcatctggattattgattgcaatagctgcctaactgctcccctgattccatcctttccctctgtggactgttttccacacagcagccagacaaatcctgttgaagtgtaacatatctgctcagagccctccaatgactctccctagagccttaacgtgctctgcttgccctacgccccgccccacctctgaagtcatctgttcccgctttcctgcaggcttgccccactcctggcacacactgcacgggctgccctgccccctgraagccacttccccagggcccccaggttcactcctttactctctttgggacacagctcaaatagccccttctcatcaagaccttccccaactaccctatttaaaactgcagctcataagcccactccacctgtgtggtccctagcacttgggatccccttactctctttttttcctcctcaatatcaccttcaaaattactactttttttttttttttgagacggagtcttgctccgtcgcccaggctggagtgcagtggctcaatcttggctcatgcaacctccgcctcccgggttcaag

SEQ ID NO: 193807 - DNA, 601 bp, Human
cagtttgccccgccaggagtgcctttcctcatcctccctccccaccgattgcacttctccagccccttcttcaggagccttctcttctccagtttaccgtgatctttttctctttcgaatttttatgtactaatggtctgcacctctcattctggttgtgacaattgctaaggtcattccattaatcacatactgacatagcatggtaaagcctgtataaattgcaaataaatgcaaattagaagttaccatggctggctctggtccttctgccagttttcaaatggctaaagttcttctsttctgcaggaatgaggacagggtttgaggaagtggcagcctcatgatcatttgggattgactcatttcagtgtgttgcagtagtctataagctcactattgttacatttgtgctttcttcaacagcagagacccaataaaaaataaagctctcctacatcttcctcaactaggttgaattttctggacctctcaagccacatcattgcagtatggtagagtgtacggtcttatctgtttcacaggaatgactggtgtcccaactagtttgtaagttataattgaaaatgcaggctgggca

SEQ ID NO: 193808 - DNA, 601 bp, Human
tcactctgtagacacaaccactcgctttctcaaagaccagcaatggctccccaactgcctgttgggctgtgcagtctggccttcaaagcttccatcatgcaaccgtatcttgggtttggtcaactcaccttccttgctgtccttgttatccaagttgattccttactgcaagcctttacacatgcagtttgccccgccaggagtgcctttcctcatcctccctccccaccgattgcacttctccagccccttcttcaggagccttctcttctccagtttaccgtgatctttttctctttcraatttttatgtactaatggtctgcacctctcattctggttgtgacaattgctaaggtcattccattaatcacatactgacatagcatggtaaagcctgtataaattgcaaataaatgcaaattagaagttaccatggctggctctggtccttctgccagttttcaaatggctaaagttcttctcttctgcaggaatgaggacagggtttgaggaagtggcagcctcatgatcatttgggattgactcatttcagtgtgttgcagtagtctataagctcactattgttacatttgtgcttt

SEQ ID NO: 193809 - DNA, 601 bp, Human
ccacgtaaagggccagtttgcccgtatactgtttgcctgtatactgctgccagctcactctctgattcagtatctctcactccatgggaatcatgctcctccctgagcccactccctcctcctggggcgtgtgtggggtgctatcccactcggcaggctgcagcagggtggagattctaggaaagaggaaaggccttccaggaatttgggcgggaagggctgacgaaaacacagggcccaaggaaggggaggccactcactcatccaaggtcacgcggctgagccaggaccccccaggggytcctatacacgtgggcactggcagaggagcactgccatggaggaccccgctccccacctgccaccaccatcctcggtgcaggtcagccagcagctgcccagtacatatccatgggatctttgtcctgaccgcctgtctccgcagcagcctccctggaacctcaagcatctcccggctcaccaggtcccatctgtttaccgccctcaaaagggccccgcaactgctccccacgagatgggagcagcctccaccaggggttccccagaggcagctgggaagaacctagcctcctctgtactc

SEQ ID NO: 193810 - DNA, 601 bp, Human
gcagggcacagggaaaacaggttcccaggcactggctcaggagatgccccgtgagtgccaatcagctgccaaggtgccagaaactagggctgtggttcttggctgtggtctgggcctgcagggcaaggtgggggcctggcagtgctgccagcctgggttataagtgtaagacaccagcatggcagggcacaagcacagggcaaggacggcagaaatgggggtgaaagcatgtgcgtgtgtgcgtgcgtggcaatgtcgagtacacacaagtgggcacatgcacaggcatacacgcttgccrtcatagcaagcctgccacccagagagcacatgctgggagggcctgcatgcctgtgccgacatgatgaacatgagtgtgcaaatctgtatgccccgtggacacagccaaaatgaggaggcaggaaaggtgaaaagaagagaaaggaagcaggtgggacaggagagaaggctgggtgggtggctttctgtgccagtggggccgggccacagtactgttctttggccaacactgccccttcccttgccttacagggcctgggaaggtggctgaaaccagggccatgccacgggccaaagaggc

SEQ ID NO: 193811 - DNA, 601 bp, Human
gaatttttagacattacccatcaagtaattgtattagattaatttgccaatttggcgggatttttttgatgtggaaattaatgtggattatctgtggaaaagaaaaacttcagaaaagcacttctgtaattgggacagctgaatttgcttgctggcaaaaatgtaaagtttctttcatagaaatgactcaatcacaaacaatagcacatgtgcaataactgctttgatgtcaaaagataaacttttctacctaacacagctgactcgaaaggcaccctactttaccttttcttttcttccyttattccctcccctgcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagaggtgagtaggggataaagcaaaaatatggcctgt

SEQ ID NO: 193812 - DNA, 601 bp, Human
aaggtgtctagaaactgttctcttaaacatgtttcaagttgttaacacttcagaaggccaagtaaatgattagtagtacaaatgatgactagtgctcaaaattgcaatgcattgtgaaatagagtgaaaatgttggctgaacaccttcgaaaggctaagttaaatgtccatgatgttagtgcttatcgcaacacttcagcatagtgacttttttatttgcctctgtctatagtttgtaatctatctgacaaagtgaagttacaacgttcattcaaaatatttctcttaaaggacttttctrtcttgtgcttttttatcgtcagagaaaagtttcaatataaaaattgcataaccacctcttaaacatttgctactaattttacttttgttaaatgttattataataaactgctaaaatactcagtatttattttccatttccttaatcacagatattctatctttgataccctagttgaccttcactatgtttctaatgttttgtattgaatgggtgctgcatgaccattatgactaatggtattttctctttactgaaatctgtttgctaaatattcacttggataaacctcttcagaca

SEQ ID NO: 193813 - DNA, 601 bp, Human
cacctggaagcagtaacatgcaagtaagttttcctaaagcatatagaattttgtatttctagcaccatgtctgaaacccctaactgcaggaaaccatttatttttccaatgtataaaccaagggtcagtaaactttttgttaaagcaccagatagtaaatattataggcttagtgggccaagattgttacatgtacttaaacaacgaattaaagtgtaaccatttaaaaatgtaaaattggtgggtgcagtggttcacacctgtattcccagcactttggggggccgaggtgggcagatcycttgagcccaagagtttgagaccagcctgggcaacatggggtgaaaccccatctctacaaaaaatacaaaaaagtttagctgagtacaatggtgacagcctgtagtcccagcagtctgggaggctgaggtagcagaattaattgcttgagctcaggaggttgagactgcagtgagccgtgatcgcaccactacactccagcctgggagacagagcgaggccctgtctcaaaacaaaacaaaacaaaaatgtaaaaactattcttagcttgcaggttgtttaacaaaacaaaaaagcagca

SEQ ID NO: 193814 - DNA, 601 bp, Human
tcataagacatggcatagcaagcaaggacaattctattactgtttcactccagcgtatcttccctgtgctcataataacagatcacacacttcacttcatggccagtaaatgttaggactagactgtcccaggtagtaggcactgatgggtgcatcaaaatggcattgtctgtcaaacagaagtcactgaataagggaagctgggggaggacatgaatggctctgtgatgactcatgtgctactagagcttgggaaaagcaagggactcattcttctaattttaggtcttggtaaataacyttaacagctatccacttgtgtacatgatctaccacgactaccattcaggaaacaaggggttatcttctgccattgttgacaattattttaaatttagatgagatcatcataacatgacacataaaaattgtttcatcatgcatatcaagtttgatatgtagcttaaatttattttgcacacactagaatttgtcctggttttctagtacctcaaggcagatatgcaaaggtgtttaggagacatactctcagacaaaccattattattttaaaggatagaacaaaacaatcgctagttaa

SEQ ID NO: 193815 - DNA, 601 bp, Human
gggttatcttctgccattgttgacaattattttaaatttagatgagatcatcataacatgacacataaaaattgtttcatcatgcatatcaagtttgatatgtagcttaaatttattttgcacacactagaatttgtcctggttttctagtacctcaaggcagatatgcaaaggtgtttaggagacatactctcagacaaaccattattattttaaaggatagaacaaaacaatcgctagttaaggaagatgttttgtaataattaaacttgtaattatttgacttgaaatatttaatcattttttgggaaagaatggatagattttgttaatgttagcactcttaaaattaagcagtggcttttttccccgtgtctcccatattctccttgtgtttgaaacataaaacaaacactaaacctaagcaaaagttgctgggtttgttttcataattgaggtgagtttttccctcaactattacaataaaagaaaactttttatgattttaatgataatgttttgtggtgggttaaagacctcctaacaacagggggtttttatacaacaacaagaagtttttaaataattgagtttttaaagt

SEQ ID NO: 193816 - DNA, 601 bp, Human
tctccttgtgtttgaaacataaaacaaacactaaacctaagcaaaagttgctgggtttgttttcataattgaggtgagtttttccctcaactattacaataaaagaaaactttttatgattttaatgataatgttttgtggtgggttaaagacctcctaacaacagggggtttttatacaacaacaagaagtttttaaataattgagtttttaaagtggaaagcagcagtaaattaaactagaaggatatattttatacctagaaataaataaagctcaacttgttttgtaagcctgtttyaaaaatatttaatcatttaatttgtgcaagtatagagttctcctatggcaaaactataccatcatcttctccaattgtgcatggcagctgtactaagttctgcaaaaacaagacatatggatgtgtttcataccttctcagaattggtatatcaagacacatttaaatataagccctctggaaatggatttatatacagtcaacataaatacccccttagaaattggtaatattttatagccaggtttaggtttagtgtcaagtatagtgattgctggtctatcactactcatgaagtgg

SEQ ID NO: 193817 - DNA, 601 bp, Human
ggaagaggaaaagatgtgttcggggtggccttggaagtgaacgttgaaggactagtgagattggttcaagaaactgtgaagggaaagaaagggttatactgagaaatggaagagataattttagaaacttgtgaaaaatggcttaatctaaatgagtgttaggggagatacagttgtgatgataggttgagctcacatggtggagagccacagttgcgggtgcttgcactgataatgtgagggcatggagacagacaataggttgaatgctctttttttacaaaaggaagtagaaagggagggggatgtaaatttgataaataggttggtgaaaacttatattttcttgtaaagagagagaactgagcatgttgtaggtataaggtaaaaaggcgtgaagaggaatatttcgttgataatgaaagtgagcagctagggaagaaaactcccagaggaagagggaggcaaggaaatcaagaacacacttaaagtttgtcagaagaaggaactttatttccttaaacattcaagaaagatgatgtcatttcagttattgattgtctaacttcagtaggtttaagagttacttgagggctgggca

SEQ ID NO: 193818 - DNA, 601 bp, Human
gaggtgggcggatcacctgaggtcaggagtgcaagaccagcctggccaacatggtgaaaccttttctaaatatacaaaattttctaaaaatacaaaaaattagctgggtgtggtggtgaatgtctatagtcccagctacttgagaggctgaggcagtagaattgcttgaactgcaaggcagaggttgcagtaagccaagatcgcgccattgcactccaacctgggcaacaagagcgaaactccatcttaaaaaaaaaaaaaaaaaagaattacttgagatgcttgttgaatatgcatattsctaagcccagccctaaatctactgaatcagaattctatttttaatgtacactccagatggttctgatacttgaacaacgctatatttagcattggttaagtacagatattttgtttttagcctattgcagaattagctcaataattcataaaatgggtaattattcataccaatgctaaactcagtatttattacatcaaaatttttaatgtattggctaattttggtaaagctaagaccaccagtgtgaataaggatggatttttggttatttgccactgagattttttagcatagatc

SEQ ID NO: 193819 - DNA, 601 bp, Human
atcagcttagcaaagtaatattttatctgtctctacgatcagaattgtttaaattaaaaaccttggtactgtgacgacactcaagttttttgaaattgtacatatttgaaattcttctctaaaggtgcgaaataacaagcctttagaaacttaaaatatagggaggtaagacagccacatgcaaagataactcagtctaaggtagtctaaaaaaagtgcaacacggatggtataggcagtaaggactattgaccctccctaagagaaggaaaaagggatgctgagctgggctgggctggcyagggagcctttatgtagaaagagtggcaggatggggatgtttcagaagagagagaggaaggaggaggacatcaagaggaaccttggggactgagaagttgtgactgtgtggatggtcttcccttctgttacttaacaagtattccttgcatctgtgtcaggcactattctgggtgctggagtttcagcaaagaactaaaatgacaagggtccctgttcacatggaatcacattctggagagtggggagtacaggccaacagatgaagtaggtaaaccttgtcatgtcagtagtgttttgc

SEQ ID NO: 193820 - DNA, 601 bp, Human
gatcaccctaccaatgagtgtcacagtcagaatttgaaccagttttcccatgccttttcttctacataatgtggagctttttgtccactcctacatgcagttgacaacaacagaagtgacagcattggttccatttaaagttgaacttagagaatacatttaataaaagcagagagtggacgggcttccgtggagtttgatctcctaacctttcgtagcagccagcagctctgtttcaggctctaagctgaatgacagaggcctggctgtggtgtctgaggatgatggtagatgggccctrtgcctactgggtgcctggtgggcaggtcctgtgcccactgacttatagggcactggcctgtggttcctgtttgcaggtgctggagcaggatgtggagtgcttggacatggcagtattcctgtgtctggctttttgctggcaagcttgtggcatgagacacaaatgagctgtttctgggttggtcagtcttggaggggcctgtctctgctgtagctttctggctgcctcctagctgagggtgcctttgctgagcattgaatgtcccgtctctggtggttgcctgccaggatgaactctgct

SEQ ID NO: 193821 - DNA, 601 bp, Human
tatgcatgatgtttctaagtaggacagttatactgtataaattgcagtgttttatttgctttactaactagccaaggtgaattttcactgctcactgtaagaagtgcccactttaattctaaataccaagactatgattaagtgaagtgtttggtgtaggagagaccagtcatggtgacaccttcagctgtttttgctttggagatttatggattgcataggtatattgtattccttcaaacaccccaaatagtttttaaaaacacagattgcatttttactgctttctagctattgtctytcaagtgttttttaaatgacatatttgttggtttaagtttctaatgaatattttctttctcttaggttttatattattttggcattagttttgaaaccaaaagagcacagtaagacattgcttttgcctaactccctctgcagtgcagaggatcgagtttaggattatagagctctttcattttgtcttattgatgagaagctttagctgtcagctctgcagcactggtcttgtgttgagactgggttaacagtctggttgttccaccaataaaaatacacattttaaagttttcttaag

SEQ ID NO: 193822 - DNA, 601 bp, Human
gctttagctgtcagctctgcagcactggtcttgtgttgagactgggttaacagtctggttgttccaccaataaaaatacacattttaaagttttcttaagctgaatgttatatagacaatgaacatgctttttaattaatgtgtagtctaaagattaattacagaaactgtaagtgcaattctgatttgtttgtggatataattgagttacatcatgcttgttagtcttttcagctttaggtggtgacattttgttttttatttgttttgccaaaatgtttatttgcagaggtggatagcttttttttttttttttttttaactttcatttaagaggaatgcacatgaactatttgaagcagtaccttcctaagaggttttgtttgctgataaagctttcctattctagctgcttgactcataccagaggagaagcattaaagaagaccagaaggtgaaaagagtcaccctaacctatccatgtgtgctcttgaattttcctaaggaggggcacgcgttgatttcctcattgtctttatcccacaatagattcttagaatatgtatgtctatataaaatttttaaaactgcttgagtttgt

SEQ ID NO: 193823 - DNA, 601 bp, Human
gaatagtttcagaggcaagagatttattctaatgaataagataatgatactgtgtgtgtggtatataaaaataacagtttataagataagaatataacatctaaaatactgctaatttgatacttttcatgactttcaattttatatgttcttgttagtttaatcagtgtctgaatgatgaaaaactaatttcactcttagtgaattagctgtctgttaccagttatggagagtagcaaaggattggccggttaaaaagaaaactaattcagcattgcttaggctaaaattcccctacccyttttttttttttttttaaatgaaaactacagcgataaacaatcttttttcttgtatttataaacctacctcttggggcagtcttttgtagatttcctgaaacaccacatgccagaaaaatgaaggcaaactggtttgttcacccatgtttagaaccccaagacggaattatgtgcaatgtttgaagttgcaatgccgtttagaatgggcaacaatgcagtttctgagccttttgttattctttttaccatttggcctctcaggttcagttttcattctgttgccagtttgagatgtagga

SEQ ID NO: 193824 - DNA, 601 bp, Human
agaggaaacagatgatttttttgtttgaagtgatgatgtgtagcatggaattgaaagatgtctaccaaaaggttaacagggtaatttgaatgctaagcatttttggctatttaatggtatctcttgtatttttaatccctttaaagtctttataactgtgtgtccattgtgggtttgatgttactggggattgtggtttttttcctgaacggttttcctgagttttatgggtaggcagtagacaagagagaaacacttgagcagtactttttgccatctaggccaagtacaaagtagaggytttttccaaatagcacttgtaaaactgcgtattttacaaaattttaaagtgttatattttgtctcaaccaataaaaacattttcaattatctcattgtttttacttttgttggcgtcttctttatgaaaaatcatgtattcatttttttgtgtgtaatgtaaccaagtgctcatctgagaaaatacaatcagatagaaatatcatacccttatcaatactctctcactgggagccacctgccaaaatctgaatgtatatcctcttgattttccttaaatttatctctgtggatatatcgt

SEQ ID NO: 193825 - DNA, 601 bp, Human
agaagctcacaaatgccatctcccctctgtaaatgtccttatgggtttggttttttcttttaatttgatgacatataggacagaaatcaggtgtcagaagaaatcagtactggtttaaggaaatgtagcaggttccaccgcctgttgctgcaatatttggcggttgtgagggacaccaagcctgtgtatgtgtgggcaggacccctggttctgctttctgttctgccataggctaattacttcccctctggcgctggccttcactttctcccacaaaattgaaggcaggacaggtgatttmaatagccccttcatctctagtccaaggccctcacgatgagacgtaacttaactgatggttctcatgaagattgagaacattgttccaggtgtcagataatctcaattccatggatgaatgatatagacttgtgatagactcatttccttgataaactaagtgtgttggtattcaccaaatttagtttggtggtaaatttagttcttcatctctccatttttagaattggcttattagtgttattcaagtactttttgtagtttttaatacatgtatagaccgtcgagtgtgatccagaaa

SEQ ID NO: 193826 - DNA, 601 bp, Human
tgtcagataatctcaattccatggatgaatgatatagacttgtgatagactcatttccttgataaactaagtgtgttggtattcaccaaatttagtttggtggtaaatttagttcttcatctctccatttttagaattggcttattagtgttattcaagtactttttgtagtttttaatacatgtatagaccgtcgagtgtgatccagaaatgcattgatctagtccagtggttcttaacctggggaaatcttctccccaggggacatctggccatgtctagagactttggattgtcacarttagaagggggggtgccactagcatctagtaaatagaggctacaggtgcagttaaacatcttccagtgcatcagacagcccaccccacagccaaggatgatctggcccagatgtcgttcatgctgcggttgaggcgccttggtaccctgtagtggtctgtggcgggatcccctccttagtcctctgataagatactggagatgtacctactgcaaatggcttctcctcacagtggattgggtttccagggtcatggcttttaaagaggacacctggagagagaaaagggagttctcgctg

SEQ ID NO: 193827 - DNA, 601 bp, Human
acttgtgatagactcatttccttgataaactaagtgtgttggtattcaccaaatttagtttggtggtaaatttagttcttcatctctccatttttagaattggcttattagtgttattcaagtactttttgtagtttttaatacatgtatagaccgtcgagtgtgatccagaaatgcattgatctagtccagtggttcttaacctggggaaatcttctccccaggggacatctggccatgtctagagactttggattgtcacaattagaagggggggtgccactagcatctagtaaatagwggctacaggtgcagttaaacatcttccagtgcatcagacagcccaccccacagccaaggatgatctggcccagatgtcgttcatgctgcggttgaggcgccttggtaccctgtagtggtctgtggcgggatcccctccttagtcctctgataagatactggagatgtacctactgcaaatggcttctcctcacagtggattgggtttccagggtcatggcttttaaagaggacacctggagagagaaaagggagttctcgctgattaggttttgtttgtccaataaaggacatttgacat

SEQ ID NO: 193828 - DNA, 601 bp, Human
ttgatctagtccagtggttcttaacctggggaaatcttctccccaggggacatctggccatgtctagagactttggattgtcacaattagaagggggggtgccactagcatctagtaaatagaggctacaggtgcagttaaacatcttccagtgcatcagacagcccaccccacagccaaggatgatctggcccagatgtcgttcatgctgcggttgaggcgccttggtaccctgtagtggtctgtggcgggatcccctccttagtcctctgataagatactggagatgtacctactgcawatggcttctcctcacagtggattgggtttccagggtcatggcttttaaagaggacacctggagagagaaaagggagttctcgctgattaggttttgtttgtccaataaaggacatttgacatttagtatcagctaggtgctctaacattcttttaggtagggaataaaacttaaaatagcacttatgttttagacagttatgtgatttcattttgagtgcatcttaatggtattaagattgtacttccttttgttaagatataaatctagacattttacttatttaatactctatttaca

SEQ ID NO: 193829 - DNA, 601 bp, Human
tctggcccagatgtcgttcatgctgcggttgaggcgccttggtaccctgtagtggtctgtggcgggatcccctccttagtcctctgataagatactggagatgtacctactgcaaatggcttctcctcacagtggattgggtttccagggtcatggcttttaaagaggacacctggagagagaaaagggagttctcgctgattaggttttgtttgtccaataaaggacatttgacatttagtatcagctaggtgctctaacattcttttaggtagggaataaaacttaaaatagcacttaygttttagacagttatgtgatttcattttgagtgcatcttaatggtattaagattgtacttccttttgttaagatataaatctagacattttacttatttaatactctatttacatgtagaacagtgtacttggctttttatatgacctacagactgggtttgtacaacacttgggaggttgtagaaaaatctttgcatttttttttgcaagtgactgtattacaagaaattgacatcggtttttctattaaattttacactgtggcccttctttaaatgtgtgtgaggtttatgcaagga

SEQ ID NO: 193830 - DNA, 601 bp, Human
catgtagaacagtgtacttggctttttatatgacctacagactgggtttgtacaacacttgggaggttgtagaaaaatctttgcatttttttttgcaagtgactgtattacaagaaattgacatcggtttttctattaaattttacactgtggcccttctttaaatgtgtgtgaggtttatgcaaggagtgaaggtttagattacacctctccattttaatttattttaaaagctcatactaagtaagtactaagtaaatgatcagtaaaaaaaggccacattccttggcctgtttggggktacctgaggggtatgtcttataaaaatgtcattgtttgggttcagagaaaaagtttctgaatatgatttttgaatctgtgggctacaccaggaactctctcttcacatggtaataaaagaagccgtgaatttcctcacacatcagttgcagcacagagaagttatgttatgtcagtagtcattatatttgcattatggatgtgggtgggcgataagcattttgtttgctctcagtaatctaatacgggctgagcatcacacacaggcagaactagcttatgtcataagcataagaaaact

SEQ ID NO: 193831 - DNA, 601 bp, Human
tggtcatctccatgcagatccttcactcttgttatcaccagagtgtggtcccggtgaagtgtgtgctcgttttttgagttccattttaagtgcctttggaaatgaatggatagacaggctatcaggaatttatttgctcaaaccctgataaacgtagtggcaaaaacatcggatttcctatgggctgaagaattaggtatgtaggccgggcacggtggctcatgcctgtaatcccagcactctgggaggccgaggcaggcggatcatgaggtcaggagatcgagaccatcctggctaagakggtgaaaccccgtctctactaaaatacgaaaaattagccgggcgtgttggcgggcgcctgtagtcccagctactcgggaggctgaggcaggagaatggcatgaacccgggaggcggagcttgcagtgagccaagattgtgccactgcactccagcctgggcgacagagtgagactccatctcaaaaacaaagaaaaaaaaaggtgtttaaaatggtattttagaatttacgttttaagactaacaagcaaaatgactgttaaggttatgtctcaaatttttgtcaaaatctggtggtgtt

SEQ ID NO: 193832 - DNA, 601 bp, Human
tgattggattaataattatcttcagtaattcagaataacacatgagggaatgaatgaatgaataaataaaaaaaaaatgaatgaataaattaaaaaaaattgtgtttcagggaagaaaaaatcccaggaaaataaaaacaaaggaaacaaaatccaagacatacaactgaagacaagtgagccagatttcacctctgcaaatatgagagattctgcagaaggtaagcttgtgatattggcttggtctgaattgggtgtgtatgtacccagtgaatttaactttgtatctctttatattgtycttctgagaatcatttaggatctttacgaggttaaacagcaaaaaagctgcctaaatttaatgtggtaagctgagccttctatatgctaccttcccttcaaacaattgtgaaagacttttcttcttaaaaatgaacttgttcctttgttaaaataaaatgagaccaggtgtggtggctcacacctgtaatcccagcactttgggaggctgagccagaaggatctctggaggccaggagtttgaggccagcccgggcaacatagtgagaccctgtttctacaaaagaaaataagaaaattc

SEQ ID NO: 193833 - DNA, 601 bp, Human
aaacaaaggaaacaaaatccaagacatacaactgaagacaagtgagccagatttcacctctgcaaatatgagagattctgcagaaggtaagcttgtgatattggcttggtctgaattgggtgtgtatgtacccagtgaatttaactttgtatctctttatattgtccttctgagaatcatttaggatctttacgaggttaaacagcaaaaaagctgcctaaatttaatgtggtaagctgagccttctatatgctaccttcccttcaaacaattgtgaaagacttttcttcttaaaaatgarcttgttcctttgttaaaataaaatgagaccaggtgtggtggctcacacctgtaatcccagcactttgggaggctgagccagaaggatctctggaggccaggagtttgaggccagcccgggcaacatagtgagaccctgtttctacaaaagaaaataagaaaattcactaagatgatggcatgtgcctgtagttctagctacttgacaggctgaggtgggaggatcactggtgcccaggagttagaggctacattgagctgtgatccccccactgtactccagcctgggtgacagggcgag

SEQ ID NO: 193834 - DNA, 601 bp, Human
tttaggatctttacgaggttaaacagcaaaaaagctgcctaaatttaatgtggtaagctgagccttctatatgctaccttcccttcaaacaattgtgaaagacttttcttcttaaaaatgaacttgttcctttgttaaaataaaatgagaccaggtgtggtggctcacacctgtaatcccagcactttgggaggctgagccagaaggatctctggaggccaggagtttgaggccagcccgggcaacatagtgagaccctgtttctacaaaagaaaataagaaaattcactaagatgatggyatgtgcctgtagttctagctacttgacaggctgaggtgggaggatcactggtgcccaggagttagaggctacattgagctgtgatccccccactgtactccagcctgggtgacagggcgagactgtctctaaaaaaataaaaataatgataataaaatgaaacatatgattgcatttaaaaatagcatgaagttcaaaaccatcaaaaaatagtgatagcaaggacatgaggaggcacctggggtgctcgctgttttctattattcatctgtggaatggtcacatgggtatatatattta

SEQ ID NO: 193835 - DNA, 601 bp, Human
aaaaatgacacttgctcttcaccccccagtatttggcacagctggtcaaagtggtgtcgtaggcttccgctgaatgttctgcgttgtcctcagcaaatggtctataccatgagcaaacagttcagactcttctttgtgctcccaaacctccctttatgttcaaaactccagagaccacataaagtgcgtggatccactctggcatgggccgtgcttgttaatggagctgtgcagacttcggtttatgttactttggacagttttatatctgggattgtttaccagtcatggggaaagacattttttccccatcaaaagaagccacagattttgactgaaaataaagtctgttaggaaatttctgagccttagagttggcgttttctgttgtctcatttcaactcttttggcagtattcggggtctctattgaaaatatctttgaaaagagaggtagctcctaatttgaaatatgttactactgtcgaatgactggtttcccactttgtggaaagctcatggaatttatgaaattagtctagggggagagaaggctgtttctgtttggaaacagaaacctcattgctagtaaatggagtagc

SEQ ID NO: 193836 - DNA, 601 bp, Human
tccacattaatttacagtgttctctatgttttgactcttttctgcttgcttttcctcttctgtccttaattcttgtattcttcaggttctgtctgcttagtcctttctctaagaagcctttcctgattaatcaaacccatatgagatgcttccgtaccacactcacttccataaacacagccatcaatgttctacagtttcgttgccttcctgcttgtgtgtggcttgtattaaagtgaagctctctatgggtaaggatcgtgacagtcttgtttacctagtactggcagatagtgggtgmtaagtcagtatttgcaagtgattgggggaacagccaggtaatgtagcctggagaagaagtcagaatagctctgcctcctccgtggaacctttcttaactctcctagtgcctgcagtagaggggtccgcttctgcagtgcagcaagtgggactgtcgcgacagcagcattggggaccattcctactagcacgaaaccgcgattacagcttccgtctttaagaatcccctcttgtccctgtgttttcttccagtctcttctccatttctttttctttacaggtaaacttgaaagagttgcta

SEQ ID NO: 193837 - DNA, 601 bp, Human
cctgctgccacccctgtgccaccatcctgcctctcctggaggatgcattgggccccatctttccatctgcctccacccttgtcacctagggttcactatcttccttgtagtaaccagagtgattctcttgaatacaagtcagattatatatttccgttagatctttctggtagctccctgttttcactcaagagtaaaagccagcagcctgcaggggcttgtgtaagtaggcccctgtttgcatctctagtcttacctcctgccctcactttgcccagcttccccacctcacctcactgaygtctttgctgttctttgaatgcatctagtatgttcttgactcagcgcttatgcattttgagggttcctctatccagtagggctcctcctcccacccccccccccaatatttgcatgcctcattttccttaggtctctcctccactgtcaccttctaagcaagtccttccctgactgccttctaccacccacctcaggtgggctaggcctagggactccgaagtgactgcagatttctgttcccttcagtgagatgctcctgagttcttaataacttggctaggcttagaagagatgatct

SEQ ID NO: 193838 - DNA, 601 bp, Human
agaagagatgatctccaaagattgtctagcttgaaaaacttgtgattacatgattctggaaaatgttctagcttctgagaataacattttatttaagagggagagaggatcatttactccagacagacttccaaggatctaacctggtgatatgtctggtaaagaactgtttccagtttggaatcatgagaaattagaatttacaactactcctaaaatgtagtagtgactactccaacacgattttaaacactacagtttctgtcaacagagttgtatctgtgtgcaactaaacacaaawccccagctccacacggacatccttgtctgttgcgctcgtgtgtgtcctcactgccgggaatattgcctggtacgtggctggtaccctaaatacttgttgaatgaagtggattcatatccaatacaactttgtcaattaagtatataaagtagaagtaatttattgttcatcatcatctcccttatgttttaggtggtaagagaaataacttgaatcattcagattgttcaccaagtagctggtttcccatgcttcacttccatgcttctgcttccatgtgctttctaggtcctaaagaag

SEQ ID NO: 193839 - DNA, 601 bp, Human
tagaatttacaactactcctaaaatgtagtagtgactactccaacacgattttaaacactacagtttctgtcaacagagttgtatctgtgtgcaactaaacacaaaaccccagctccacacggacatccttgtctgttgcgctcgtgtgtgtcctcactgccgggaatattgcctggtacgtggctggtaccctaaatacttgttgaatgaagtggattcatatccaatacaactttgtcaattaagtatataaagtagaagtaatttattgttcatcatcatctcccttatgttttaggyggtaagagaaataacttgaatcattcagattgttcaccaagtagctggtttcccatgcttcacttccatgcttctgcttccatgtgctttctaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggag

SEQ ID NO: 193840 - DNA, 601 bp, Human
cagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcrcggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggtaagctcaggagctggtgggagggaaagaccgggaaggcgacagtatccttgcctacgggtgttttttggtttcttgttgctttttt

SEQ ID NO: 193841 - DNA, 601 bp, Human
taggacggtaaacaagtcaggatctggatgggaagcagagcaggagagacatgcttggaactccaggcaggacccttgcagctctttcaggcctgtgtgatacccagggcatgtcagcctcatttgtcagtgcctttgtttccccagtaatgatagaaggatttgtcttagatttgaagtgactttactgctttattccctgtgcttcctatattaagaactgttctcagtgacagatgaagagagggcagcggttaaatttgttacattggattctcaaacttcctgagtcctttgtccraagtggatgtgtattggaattcctgctgtttctgaatagttcagtctcatgtgaaaattactcatcagatagcatttctgcaaaatacttttaagtcttgtcttttcacaggatgccacctgactctaggctttcatgctatagcttttggtgtctgaaaattctttggtgttttaagcaagcagaattagggatcctaagtgtggacgcgactgccattttgtagaggtcacgaggacacagaggtgccattagccctgcatgattgatgaggtagaatttttaatgctggtgtgcctt

SEQ ID NO: 193842 - DNA, 601 bp, Human
tattaagaactgttctcagtgacagatgaagagagggcagcggttaaatttgttacattggattctcaaacttcctgagtcctttgtccaaagtggatgtgtattggaattcctgctgtttctgaatagttcagtctcatgtgaaaattactcatcagatagcatttctgcaaaatacttttaagtcttgtcttttcacaggatgccacctgactctaggctttcatgctatagcttttggtgtctgaaaattctttggtgttttaagcaagcagaattagggatcctaagtgtggacgcractgccattttgtagaggtcacgaggacacagaggtgccattagccctgcatgattgatgaggtagaatttttaatgctggtgtgccttaaatcacagctaaagatagagaagaatcattagctaaggctgatttgaatgatttactgtaggattaatggatcagatttttaaaaagttacttcataaatgtgttaaatatttagttgccataggtctgaccaacgctcggtctctggccgcggcacatacataggtagcatcttggaggttagctctgctgaaaataagcacctgtgtt

SEQ ID NO: 193843 - DNA, 601 bp, Human
aacttagacctgggtaatatgatgattgtcattaacgtgttgcccagggctcgtagagaggaggcctcagcctcagtgcatatttgttgcattacactaataaggagttgtttgaactacagtcgtctttctgtttaagtatagttctacttgtaaatttcgtgtagggatgattcctgacacaaggaatcatcacatctattacatgtcgaggaatactcactttcactctgtttgcagcttgctttacttaccctgttgggtacacagggatttcttacagaacaggcagcacatcctygtcctgtgttatttctttacaacaagctgtgattaagagctagttttccatactcagatattttacatgtgaatgccactttcggattccacagtttttcaagtacatgcttgcaatcagccatatgatttttccatgagttttctacttaacactgagggtcatttcctggaacacaagccatggtgccagacaaggtgtcaaaaagccatgtgctccaaatatttttcttaggagaaaacacaggaaagcaggcatgccacagtcattcaggttctcctgctgcagctcttactacag

SEQ ID NO: 193844 - DNA, 601 bp, Human
tcagcctcccgagtagctgggactacaggtgcccgccaccatgcccggctaattttttgtatttttagtagagatggggtttcaccgtgttagccaggatggtctcgatctcctgaccttatgatccgcccgtctcggcctcctgcagtgctgggattacaggtgtgagccaccgtgcctggtgtttttgggttctttaatgcttcttttagagccacatttttcttttcaaaccgagttcccatcgcagtcaagaaaaaggtagagaagcaaaatgaaattctagaccaagtttttccayttaccaggaattgatttaaaaaaaaagtgctaatttctcatgcctccatctctgctacatcccttggaaataaatgcgtgtagttccttgcagggtgtgtcttctgggtaggacgctcgttcctaaatgccttcagtcatgtatgtgttgtcgtcttaataacatttgtcttacggtctattcacctttttctttaacatggtcaatcatgtaaggttatgttctgttgtcatttatcttcagttttcttattttctaggaacttcctgtagaaaagcccccaaaacaaaacaaacctta

SEQ ID NO: 193845 - DNA, 601 bp, Human
gggactacaggtgcccgccaccatgcccggctaattttttgtatttttagtagagatggggtttcaccgtgttagccaggatggtctcgatctcctgaccttatgatccgcccgtctcggcctcctgcagtgctgggattacaggtgtgagccaccgtgcctggtgtttttgggttctttaatgcttcttttagagccacatttttcttttcaaaccgagttcccatcgcagtcaagaaaaaggtagagaagcaaaatgaaattctagaccaagtttttccacttaccaggaattgatttaaaaaaaaagtgctaatttctcatgcctccatctctgctacatcccttggaaataaatgcgtgtagttccttgcagggtgtgtcttctgggtaggacgctcgttcctaaatgccttcagtcatgtatgtgttgtcgtcttaataacatttgtcttacggtctattcacctttttctttaacatggtcaatcatgtaaggttatgttctgttgtcatttatcttcagttttcttattttctaggaacttcctgtagaaaagcccccaaaacaaaacaaaccttaattgactaaaaagtattg

SEQ ID NO: 193846 - DNA, 601 bp, Human; identical to SEQ ID NO: 193819

SEQ ID NO: 193847 - DNA, 601 bp, Human; identical to SEQ ID NO: 193820

SEQ ID NO: 193848 - DNA, 601 bp, Human; identical to SEQ ID NO: 193821

SEQ ID NO: 193849 - DNA, 601 bp, Human; identical to SEQ ID NO: 193822

SEQ ID NO: 193850 - DNA, 601 bp, Human; identical to SEQ ID NO: 193823

SEQ ID NO: 193851 - DNA, 601 bp, Human; identical to SEQ ID NO: 193824

SEQ ID NO: 193852 - DNA, 601 bp, Human; identical to SEQ ID NO: 193825

SEQ ID NO: 193853 - DNA, 601 bp, Human; identical to SEQ ID NO: 193826

SEQ ID NO: 193854 - DNA, 601 bp, Human; identical to SEQ ID NO: 193827

SEQ ID NO: 193855 - DNA, 601 bp, Human; identical to SEQ ID NO: 193828

SEQ ID NO: 193856 - DNA, 601 bp, Human; identical to SEQ ID NO: 193829

SEQ ID NO: 193857 - DNA, 601 bp, Human; identical to SEQ ID NO: 193830

SEQ ID NO: 193858 - DNA, 601 bp, Human; identical to SEQ ID NO: 193831

SEQ ID NO: 193859 - DNA, 601 bp, Human; identical to SEQ ID NO: 193832

SEQ ID NO: 193860 - DNA, 601 bp, Human; identical to SEQ ID NO: 193833

SEQ ID NO: 193861 - DNA, 601 bp, Human; identical to SEQ ID NO: 193834

SEQ ID NO: 193862 - DNA, 601 bp, Human; identical to SEQ ID NO: 193835

SEQ ID NO: 193863 - DNA, 601 bp, Human; identical to SEQ ID NO: 193836

SEQ ID NO: 193864 - DNA, 601 bp, Human; identical to SEQ ID NO: 193837

SEQ ID NO: 193865 - DNA, 601 bp, Human; identical to SEQ ID NO: 193838

SEQ ID NO: 193866 - DNA, 601 bp, Human; identical to SEQ ID NO: 193839

SEQ ID NO: 193867 - DNA, 601 bp, Human; identical to SEQ ID NO: 193840

SEQ ID NO: 193868 - DNA, 601 bp, Human; identical to SEQ ID NO: 193841

SEQ ID NO: 193869 - DNA, 601 bp, Human; identical to SEQ ID NO: 193842

SEQ ID NO: 193870 - DNA, 601 bp, Human; identical to SEQ ID NO: 193843

SEQ ID NO: 193871 - DNA, 601 bp, Human; identical to SEQ ID NO: 193844

SEQ ID NO: 193872 - DNA, 601 bp, Human; identical to SEQ ID NO: 193845

SEQ ID NO: 193873 - DNA, 601 bp, Human
tggaaagaatatgagctctcactagggctaactctgcttgttcttccagtctgagctgacacagcagaaaggtgggggagggggggcggggtgggcgggggcgggggcggtgggcggaggtggcgagaaaagtccagttaaagccccatctcgtcttcccaactcccgttttggttggctcagggcacgccatcctctcaaagacttgtttcagagggagggggtgcgggtgggaaaggaatttggctccttcagttttccatgatcttgctcaacccagacataaatttggccaataaayctaactctggaactcgacttcaacatggcattttagaccaggcttggagttgaagccagggtgatggaggccaaacccctcaaagaagcaaaggctgaattcacttttatttaggtaatgcttttgctttcttttccagaagcctattttttgtcccacggtgtctcatttcttaatgacagaaccgaaagccagaacccacggctccctacatcttaaactgaatgtctcaccagcacagaggagacctacccgaaccccggtatctatgctggggaccagcccatcaaacctcattcc

SEQ ID NO: 193874 - DNA, 601 bp, Human
cttcaagactacaggccgctgcacagctcagaggcagccaggcctgcctgcctctccacatcaggagagcttcctgtcatgtagaaaatgaggtttggcgcatggacctgaaagctggggtgaacacccctccttcacaccctcttggtcctctttctctgaccaaaccactagcctaagccaggcttgtatgcaagactgtgtagaaaaagggacagaagtgagtgtgaaaataagagagtgtggccctctccactttggggccgcttcactccttttcctactgcccctaaaacagagygccttcagattatgggttcttatgtcatggagtgatagcatctggcagtgtttgccaaaggccttactgcaggttagcccaggtccaggcatgagccccagtgactagcgagaaagccaggaatggctgaatgcagtgctggagcccctgcgggaaagagctgagtcccagccccttgtctgtctctaaccctgctgccacatcttgggcaagtgacttcccactcagggcctcagtatcctcattctaaaactaggaccttgactgtgatgatggctatgggttccttccagctttaac

SEQ ID NO: 193875 - DNA, 601 bp, Human
cctgcagcacaaccagaagtccccagctgccctctggaagcacatctctcctctcctgctgaaagatctgagacacatctgcctatgaaagaaagccagggggccctcatgctctcttccttatcagctttggtggtatatggttttccttctctccttcggatgcagaacttcctagttactgcactcaccccatccaaccacaccctctctcgatctctgctttctgttggcaccacgtgaggactgtgctgttggaagcgggccacttctgcaccatgttcttcaagactacaggccrctgcacagctcagaggcagccaggcctgcctgcctctccacatcaggagagcttcctgtcatgtagaaaatgaggtttggcgcatggacctgaaagctggggtgaacacccctccttcacaccctcttggtcctctttctctgaccaaaccactagcctaagccaggcttgtatgcaagactgtgtagaaaaagggacagaagtgagtgtgaaaataagagagtgtggccctctccactttggggccgcttcactccttttcctactgcccctaaaacagagcgccttcagattatgggt

SEQ ID NO: 193876 - DNA, 601 bp, Human
gcatcccagaaggaggagctgccacggcctccaggatgtattagaatgggtctcagcacttcctgcagcacaaccagaagtccccagctgccctctggaagcacatctctcctctcctgctgaaagatctgagacacatctgcctatgaaagaaagccagggggccctcatgctctcttccttatcagctttggtggtatatggttttccttctctccttcggatgcagaacttcctagttactgcactcaccccatccaaccacaccctctctcgatctctgctttctgttggcaccacrtgaggactgtgctgttggaagcgggccacttctgcaccatgttcttcaagactacaggccgctgcacagctcagaggcagccaggcctgcctgcctctccacatcaggagagcttcctgtcatgtagaaaatgaggtttggcgcatggacctgaaagctggggtgaacacccctccttcacaccctcttggtcctctttctctgaccaaaccactagcctaagccaggcttgtatgcaagactgtgtagaaaaagggacagaagtgagtgtgaaaataagagagtgtggccctctccact

SEQ ID NO: 193877 - DNA, 601 bp, Human
tgctcctggattcactgggcttctctttggcctaaggctactatatattaatgtactacttaggccaggcatggtggctcacgcctgtaatcccagcactttgggaggccaaggaggttggatcacaaggtcaggagttcgagaccagcctggccaacatggtaaaaccctgtctctactaaaaataaaaaatcagccaggcatggtggtgtgtgcctgtaatcccagctgctcgggaagctgaggcaggagaatcacttgaacctgggaggcggaggttgcagtgagccaagatcgtgcyactacattcccccctgggcaatagtgtgacaaaaaaaaaaaaaaaagtatatatttaatatggtagccactagccaatgtggctatttaaataaatattaaataaaatgaaaaattcagctcctcagtcactctagccatatttcaaggacttcgtggccacatatggacattgcagacctgcaacgcttccatcattgcagaaagtcctggtcagtgctggcctgacggcactgacttgtgcctgggtatggatgaaaatactgaggcccagtctagaatgttctgcagtccccctcct

SEQ ID NO: 193878 - DNA, 601 bp, Human
caaacacagagagtgtcatgatgcaagcccagctgctacagacccagaggcatcttagggtgagaaatactccatgctgcacaattgcacaacgcatgtaccctgcccaagctcaaccactttctccaaacctgcccttttgccacggctgttctcttccagtagagtctgaagggttctgactccaccttgcttgctggtcacagcaatggatggatccaggagacctgcctgcctaaaatctaaaccccccgcccccggacctcttagccacaccccggtgctattaacagcctgttcytgggctggtgttagtttatcactctatctcacttgacctaataatcaattgtaagagaaaactaggtgacccagatattgtgccttagcttacaaaaatcgaagaaacagaggcatccttgaaattcacagtccaggaagagtgtcgggctttgccaggccacccagacctggggagattctcccatctccttttctagacagaagataagatgaggacgcctagaatctctctacaaagaatgaaaaagggagctgaatttgttctgggtttcattctagtcccccctgtggaatttaa

SEQ ID NO: 193879 - DNA, 601 bp, Human
gcaaacacagagagtgtcatgatgcaagcccagctgctacagacccagaggcatcttagggtgagaaatactccatgctgcacaattgcacaacgcatgtaccctgcccaagctcaaccactttctccaaacctgcccttttgccacggctgttctcttccagtagagtctgaagggttctgactccaccttgcttgctggtcacagcaatggatggatccaggagacctgcctgcctaaaatctaaaccccccgcccccggacctcttagccacaccccggtgctattaacagcctgttyctgggctggtgttagtttatcactctatctcacttgacctaataatcaattgtaagagaaaactaggtgacccagatattgtgccttagcttacaaaaatcgaagaaacagaggcatccttgaaattcacagtccaggaagagtgtcgggctttgccaggccacccagacctggggagattctcccatctccttttctagacagaagataagatgaggacgcctagaatctctctacaaagaatgaaaaagggagctgaatttgttctgggtttcattctagtcccccctgtggaattta

SEQ ID NO: 193880 - DNA, 601 bp, Human
gctctggaacctgtttgacaaacaggtcaatatctccatgtggccagcagagggcgtgggagactgacacccacacagcatgggcacacttctagggactggaagcgttttttgttttttttttttgagacagagtctccttctgtcgcccaggctggagtgcagtggcgcgatctcggctcactgtaagctccgcctcctgggtttacgccattctcctgcctcatcctcccgagtagctgggactacaggcgcccgccaccatgcccggctaattttttgtatttttagtagagatggkgtttcaccgtgttagccaggatggtctcgatctcctgacctcgtgatccgcccgccttggcctcccaaagagctgggattacaggcgtgagccaccaagcccggcctggaagtgtttttaaaatctggaatttggaattgagagcggtggctcatatctctaatcccagcactttgggaggccaaggtgagtggattgcctgagcccaggagttcgagaccagcctggacaacatagtgaaaccccgtctctacaaaaaaaacacaaaaattagctgggcatagaggcgtgcgcctctag

SEQ ID NO: 193881 - DNA, 601 bp, Human
tggaaggctttgcgttttagataaaacaagaaggaacaagtagactggctactctggagctatttcatcaagagaaaatgaactgaggttgcagaagggatctaggcaggatacccgggaggacttcctggtgaagattgttctgcacgtgaacagcaaaagaactcaacagtctgctctggaacctgtttgacaaacaggtcaatatctccatgtggccagcagagggcgtgggagactgacacccacacagcatgggcacacttctagggactggaagcgttttttgttttttttttttgagacagagtctccttctgtcgcccaggctggagtgcagtggcgcgatctcggctcactgtaagctccgcctcctgggtttacgccattctcctgcctcatcctcccgagtagctgggactacaggcgcccgccaccatgcccggctaattttttgtatttttagtagagatggggtttcaccgtgttagccaggatggtctcgatctcctgacctcgtgatccgcccgccttggcctcccaaagagctgggattacaggcgtgagccaccaagcccggcctggaagtgtttttaaaatc

SEQ ID NO: 193882 - DNA, 601 bp, Human
ctctatcagaccctgctgtgacgactcatcaatagggtgacatctctggtaggtggaatgcaggattctagggattagttaaaagggtcatgttctggggtaaattgacttttcttggttgtagcgcaagtgagattggcaggaggaagggagaagcatggctggtttggggactttgtacaaattgaaaggctggggctccgttatctagtaacacaggcctcacgccaaggctcagatcttggagaagagggagtagggagagggagtgctaaccattgcacagaagggcttttgggcmcgtcttatggagggactggagccgtgccactcaacctcagcatcaccacgcattttaatcctcaaaaagtagttgactactgtagggggaggggcagacaggatatggtggctactgaaagcctggagggggttcagattggagaagcctggaccccttcctcaatcaagattgtaactggataaagtgagggcaggtgggggagtgggctggctgctgaccagcgcatgcgtctatgcgtctccttcagtgggctgccccagcctggcctggagagccaacacattgtcacctcttcaa

SEQ ID NO: 193883 - DNA, 601 bp, Human
actcctgagcccaagtgatcttcctgcctcagcctctggagtagctgggattacaggcgtgagccactgtgcctggcttatagtcccgttttaaatattacccatttgagttcccccaacgtgaaactctgcagggattctcaagagagttatgatccaataataatgatgatggtaataataataacagaaggaggcatgatttgtggtgttatcatgtagtagacaccactcaacgtttggtaggcagtaggtactgttctaagtgctttacaaagaccaatcactcactcctcattcwccattttacacaagggtctggaggcacagagacattaaatggtgagtaacaggacacagctagtaagtggcagagccaagatttgccccagtgtggcctggctcttacatttagattattggtgcccttaaagcagcatcagggtcacgtgtccaccccggagtccaccccaggtctaccaatcagaaactgcaggggtggggcccagccatcagccatgccctccagggataggatgcccttggaaatctaagaaccattgcccaaaggagagcctggctgtgaagggacatgaactga

SEQ ID NO: 193884 - DNA, 601 bp, Human
atccccagagagttgagggcactagacccgacccttgggtttctggtgtccccatttcacggaaagacccagggaaaatgtgaatttaggcagcctacccttggcaagctccttcaatccctttctttccttttttttttttcagacatggggtcccgttatgttgcccaggttggtctaaaactcctgagcccaagtgatcttcctgcctcagcctctggagtagctgggattacaggcgtgagccactgtgcctggcttatagtcccgttttaaatattacccatttgagttcccccarcgtgaaactctgcagggattctcaagagagttatgatccaataataatgatgatggtaataataataacagaaggaggcatgatttgtggtgttatcatgtagtagacaccactcaacgtttggtaggcagtaggtactgttctaagtgctttacaaagaccaatcactcactcctcattcaccattttacacaagggtctggaggcacagagacattaaatggtgagtaacaggacacagctagtaagtggcagagccaagatttgccccagtgtggcctggctcttacatttagatta

SEQ ID NO: 193885 - DNA, 601 bp, Human; identical to SEQ ID NO: 31761

SEQ ID NO: 193886 - DNA, 601 bp, Human; identical to SEQ ID NO: 31762

SEQ ID NO: 193887 - DNA, 601 bp, Human; identical to SEQ ID NO: 31763

SEQ ID NO: 193888 - DNA, 601 bp, Human; identical to SEQ ID NO: 31764

SEQ ID NO: 193889 - DNA, 601 bp, Human; identical to SEQ ID NO: 31765

SEQ ID NO: 193890 - DNA, 601 bp, Human; identical to SEQ ID NO: 31766

SEQ ID NO: 193891 - DNA, 601 bp, Human; identical to SEQ ID NO: 31767

SEQ ID NO: 193892 - DNA, 601 bp, Human; identical to SEQ ID NO: 31768

SEQ ID NO: 193893 - DNA, 601 bp, Human; identical to SEQ ID NO: 31769

SEQ ID NO: 193894 - DNA, 601 bp, Human; identical to SEQ ID NO: 31770

SEQ ID NO: 193895 - DNA, 601 bp, Human; identical to SEQ ID NO: 31780

SEQ ID NO: 193896 - DNA, 601 bp, Human; identical to SEQ ID NO: 124767

SEQ ID NO: 193897 - DNA, 601 bp, Human; identical to SEQ ID NO: 124766

SEQ ID NO: 193898 - DNA, 601 bp, Human; identical to SEQ ID NO: 124765

SEQ ID NO: 193899 - DNA, 601 bp, Human; identical to SEQ ID NO: 124764

SEQ ID NO: 193900 - DNA, 601 bp, Human; identical to SEQ ID NO: 124763

SEQ ID NO: 193901 - DNA, 601 bp, Human
cccaccccaggagagaaatagcttaaacatactgatctcgtggatgatattggacttttaagatgggtgaagggaatcgaaacctctggtcacagtcgcctgaaagaacatcccactgtgacactatgttatcagtggaagcactcacgagtttatgaccatctcggctccagctgaggaaaaaaaaggggtaatttagcacatattctaagtatatcataccactctcatgaataaactgtgtaagtcacacacattgctgcaactgcacaggtcaacaatgtttttggttttgttccaygtatactcaaatccataagcttttccaactaggcaattaataagaaggttttcatgacattttactatctagtaatggaagctcataatatttcaagataaaactataaagtgactcagtgaaataagagattaaaacatcttagaagagtctaaaaaatcagctgcgctttaagagttgatatatttgaactttctgaagtcatctcagaagtagcaccatcatggtataaacaaaacaaaaaaatgataagtatctgttatttaaaataattttaaaagaactgagaaagaattaatt

SEQ ID NO: 193902 - DNA, 601 bp, Human; identical to SEQ ID NO: 31781

SEQ ID NO: 193903 - DNA, 601 bp, Human; identical to SEQ ID NO: 31782

SEQ ID NO: 193904 - DNA, 601 bp, Human; identical to SEQ ID NO: 31783

SEQ ID NO: 193905 - DNA, 601 bp, Human; identical to SEQ ID NO: 31784

SEQ ID NO: 193906 - DNA, 601 bp, Human; identical to SEQ ID NO: 31785

SEQ ID NO: 193907 - DNA, 601 bp, Human; identical to SEQ ID NO: 31786

SEQ ID NO: 193908 - DNA, 601 bp, Human; identical to SEQ ID NO: 31787

SEQ ID NO: 193909 - DNA, 601 bp, Human; identical to SEQ ID NO: 31788

SEQ ID NO: 193910 - DNA, 601 bp, Human; identical to SEQ ID NO: 31789

SEQ ID NO: 193911 - DNA, 601 bp, Human; identical to SEQ ID NO: 31790

SEQ ID NO: 193912 - DNA, 601 bp, Human; identical to SEQ ID NO: 31791

SEQ ID NO: 193913 - DNA, 601 bp, Human; identical to SEQ ID NO: 31792

SEQ ID NO: 193914 - DNA, 601 bp, Human
ctgtcacccaggctacagtgaaacctggatgcaatcagagtggtgcaattatagctcactgcagcctcaaactcctgggctcaaaagatcctcccacttcagcctcctgagtagctgagaccacaagtgtgcgccatcacaccctaattgtttttatttttatttttagtagagacaaggtcttgctatgttgcccaggctggtctcaaactccttggctcaagtgatcatcccatgtcagtctcccaagtgctgagattacagcataagccactattcctggcccctatcttttaatttaaaaaaaaaaaaaaatctgcctccttaaagtctagagtgaaaatctaatatctctggctacaatgttcctctcccaggatcccaaaacaacccatttgcaaaccacctcccttttcttggtgagaattaaatccactctactggtgctcgcagtcacagcaatttctttcactctctgggagacacacagcatggcgagtcaggaatgggacaaacactctgctttcagaaaatgagggctcttagggagacgtcaatagttgaagggctccatcattactactatctgggctttgcttag

SEQ ID NO: 193915 - DNA, 601 bp, Human
caaactccttcagtggctctggtgagattaaactgctttcagttcacctcattcaccacactccattccccatcctgccccaattcctactcattgttcagatctctgcaaacacttaatttcctccaagaagtctgaccatcaaaaaggccccactgatgagttcacaaggcaacccatatttcccccactcaatgacttaaaagtacctaaagtcactagtaaacaatcaagatgttagtcaaattaatgaataaatgaatgagttcctttttaacatgatctgatagacttaaacccttgtgatcctattgtcttccagaaatgactttaagaaccacttgtgtcattactggctcttggggaagctccatctcattcaggactcgagcctcatgaacattttttttctcacagtccccttcagcatagcacagaaggaacacaggttctagaggtttcctgacctagactcaaattttggctcctctcaagttaattgtacaagctctttattattattattattttcagagacagggtctcactctgtcacccaggctacagtgaaacctggatgcaatcagagtggtgcaattat

SEQ ID NO: 193916 - DNA, 601 bp, Human
aggcgtgagccactgcgcccagcctctatgtttgttttttaaagagacagggtttcactctgttgcccaggctagagtgcagtggtgcaatcatagcttactgtaacctcaaactccccaggtcaagtgatcctcccacctcagcctctcaagtagctaggactacaggtgcacaccaccatgtctggctaatttttaaatttttgtatagataaatctcgttccattgctcaagatgaacattcttacttttatcatttcaacatgtatctacaaacatctcattacatacaaaacattcttttccactaagcctttaaaccgcatggattacctcgtatttatctttgtctcccccaggatacttagcacaatgttttacacgaagtacatgctccagtacagaactgttaatactgtgttctcagcgtggtctgaccaacccagaggagaagagttaacagctcctcatcataggatcagaggtttggaggctgtttgaaggcaaaattgtaatgtatttttccaagtagacaccccacagcatttatcagattcttaagtttagagatctccaaaataataaacaccacagttctag

SEQ ID NO: 193917 - DNA, 601 bp, Human
ctggagttcagtggcacaatctccgctcactgcaatctccacctcctggattcaagcaattatcctgcctcagcctccagagtagctgggattacaggcacatgccaccaggcccagttaatctttgtattttcagtagagacagggtttcattatgttagccaggctggtcttgaactcctgacctcaggtgattcacccttctcagcctcccaaagtgctggtacaggcgtgagccactgcgcccagcctctatgtttgttttttaaagagacagggtttcactctgttgcccaggctrgagtgcagtggtgcaatcatagcttactgtaacctcaaactccccaggtcaagtgatcctcccacctcagcctctcaagtagctaggactacaggtgcacaccaccatgtctggctaatttttaaatttttgtatagataaatctcgttccattgctcaagatgaacattcttacttttatcatttcaacatgtatctacaaacatctcattacatacaaaacattcttttccactaagcctttaaaccgcatggattacctcgtatttatctttgtctcccccaggatacttagcacaa

SEQ ID NO: 193918 - DNA, 601 bp, Human
cctatataaagcatatattgggcaccaaaaaatttgttattcctttcttctacctgaatgattattcttttacctgaaaaattattttattgggcaccaaaaaaattattattcctttttctcacctgaatgatgaatgattgaaacagaccactaactagtctgtctccttgctgaccccctaaagtatctgctctccactgccaggataatcttcctacagggcagctctgatcatgtcattcttcctttttttttttttttgagacagggtcttgctctgtcgcccagactgcagtgsagtggcaggatcttggctcactgcaacttccacctcccaggcccaagcgatcttctcccatcctagcctcctgagaagctgggactacagacgtggtcgccaccacaactggctaattttttgtctttttggtagagatggggtttcaccacgttgcctaggctgattgcaaactcaagcgatctgcctgccccggcctcccaaagtgctaggattacagccgtgagccactgcacccttttattcatgggggatgtgcgatggctgtaatataagagcagtgcgtgcccatccccccat

SEQ ID NO: 193919 - DNA, 601 bp, Human
ctttaagtgaaataacctatataaagcatatattgggcaccaaaaaatttgttattcctttcttctacctgaatgattattcttttacctgaaaaattattttattgggcaccaaaaaaattattattcctttttctcacctgaatgatgaatgattgaaacagaccactaactagtctgtctccttgctgaccccctaaagtatctgctctccactgccaggataatcttcctacagggcagctctgatcatgtcattcttcctttttttttttttttgagacagggtcttgctctgtcrcccagactgcagtgcagtggcaggatcttggctcactgcaacttccacctcccaggcccaagcgatcttctcccatcctagcctcctgagaagctgggactacagacgtggtcgccaccacaactggctaattttttgtctttttggtagagatggggtttcaccacgttgcctaggctgattgcaaactcaagcgatctgcctgccccggcctcccaaagtgctaggattacagccgtgagccactgcacccttttattcatgggggatgtgcgatggctgtaatataagagcagtgcg

SEQ ID NO: 193920 - DNA, 601 bp, Human
cttaaattggtccattcctttccaaacctctgatgactttaagtgaaataacctatataaagcatatattgggcaccaaaaaatttgttattcctttcttctacctgaatgattattcttttacctgaaaaattattttattgggcaccaaaaaaattattattcctttttctcacctgaatgatgaatgattgaaacagaccactaactagtctgtctccttgctgaccccctaaagtatctgctctccactgccaggataatcttcctacagggcagctctgatcatgtcattcttcctttttttttttttttgagacagggtcttgctctgtcgcccagactgcagtgcagtggcaggatcttggctcactgcaacttccacctcccaggcccaagcgatcttctcccatcctagcctcctgagaagctgggactacagacgtggtcgccaccacaactggctaattttttgtctttttggtagagatggggtttcaccacgttgcctaggctgattgcaaactcaagcgatctgcctgccccggcctcccaaagtgctaggattacagccgtgagccactgcacccttttattcatg

SEQ ID NO: 193921 - DNA, 601 bp, Human
gtctcaagcaatcctcccaccccggtttcacaagtggctggaattacaggggtaagccactgcacccagctatctctcccgttcttagaatccttcaggaaaggaaatcccccagccttcctgttctaatctctcttaaattggtccattcctttccaaacctctgatgactttaagtgaaataacctatataaagcatatattgggcaccaaaaaatttgttattcctttcttctacctgaatgattattcttttacctgaaaaattattttattgggcaccaaaaaaattattattcctttttctcacctgaatgatgaatgattgaaacagaccactaactagtctgtctccttgctgaccccctaaagtatctgctctccactgccaggataatcttcctacagggcagctctgatcatgtcattcttcctttttttttttttttgagacagggtcttgctctgtcgcccagactgcagtgcagtggcaggatcttggctcactgcaacttccacctcccaggcccaagcgatcttctcccatcctagcctcctgagaagctgggactacagacgtggtcgccaccacaactggcta

SEQ ID NO: 193922 - DNA, 601 bp, Human
gaagtggtgtgatcacggatcactgcagccttgacctcccagtctcaagcaatcctcccaccccggtttcacaagtggctggaattacaggggtaagccactgcacccagctatctctcccgttcttagaatccttcaggaaaggaaatcccccagccttcctgttctaatctctcttaaattggtccattcctttccaaacctctgatgactttaagtgaaataacctatataaagcatatattgggcaccaaaaaatttgttattcctttcttctacctgaatgattattcttttacckgaaaaattattttattgggcaccaaaaaaattattattcctttttctcacctgaatgatgaatgattgaaacagaccactaactagtctgtctccttgctgaccccctaaagtatctgctctccactgccaggataatcttcctacagggcagctctgatcatgtcattcttcctttttttttttttttgagacagggtcttgctctgtcgcccagactgcagtgcagtggcaggatcttggctcactgcaacttccacctcccaggcccaagcgatcttctcccatcctagcctcctga

SEQ ID NO: 193923 - DNA, 601 bp, Human
gagttaaactgaaatgtgtgtgagcccaaacttcatggtctttttcccatcctgttgtggaaacccaggcacatcacatttgattaagtgtttaagctgatggccgggcgcggtggctcactcaattccagcactttgggaggccaaggtgggcggatcacgaggtcatgagatcgagaccatcctggccaacatagtgaaagcccgtctctactaaaaatactaaaaattagctgggcatggtggcgcatgtctgtggtcccagctatttgggaggctgaggcaggagaatcgcttgaamctgggaggtggaagttgcagtaagccaagatcgtgccactgcactccagcctgggcgacaaagcgagactccgtctcaaaaaaaaaaaagtgtttaagctgatgttggtgattattctagaacacctccatgctctccacacccccatcccagaacatttcactctcccaggccactcaaaaaaataaacataaaaataaacaaacaagcaaagcaaacaaacacaccccacagtttggtagacaagagaaccaatgagcaaggggcactgtgtgaagtcatatagctggtcagtgatag

SEQ ID NO: 193924 - DNA, 601 bp, Human
gaaagggaaagagaaggaaggcagagaagtggggagacaggagggaagactacatgcatatgagcatcacagaaatagaaggaaggaaatatacctttttttcccccctctggtattttgtgccaggtattgtcttatttagtcctcacaacaatccttaaatgtggatgttatcatccttcttttatggaagaggaaagtagaaaacaggaaagggatgcaataattggcccaaaggtcacacaacttgtaaatgataaaatcaagagttaaactgaaatgtgtgtgagcccaaacttcrtggtctttttcccatcctgttgtggaaacccaggcacatcacatttgattaagtgtttaagctgatggccgggcgcggtggctcactcaattccagcactttgggaggccaaggtgggcggatcacgaggtcatgagatcgagaccatcctggccaacatagtgaaagcccgtctctactaaaaatactaaaaattagctgggcatggtggcgcatgtctgtggtcccagctatttgggaggctgaggcaggagaatcgcttgaacctgggaggtggaagttgcagtaagccaagatcgt

SEQ ID NO: 193925 - DNA, 601 bp, Human
gaggtcattctcagcagggattcactgactgcttaagctggatgagcgaccagggtgtgaccgtgtaagcatccggcaccaacagtccataggaactgtgtcgaaacacctttcccgtgtatgtgccatttcaaggtctgtgaaactagtacagcccactgtagcaacgggagtgagggtgttacactttgtgctggtgaaagggaaagagaaggaaggcagagaagtggggagacaggagggaagactacatgcatatgagcatcacagaaatagaaggaaggaaatatacctttttttyccccctctggtattttgtgccaggtattgtcttatttagtcctcacaacaatccttaaatgtggatgttatcatccttcttttatggaagaggaaagtagaaaacaggaaagggatgcaataattggcccaaaggtcacacaacttgtaaatgataaaatcaagagttaaactgaaatgtgtgtgagcccaaacttcatggtctttttcccatcctgttgtggaaacccaggcacatcacatttgattaagtgtttaagctgatggccgggcgcggtggctcactcaattccagcacttt

SEQ ID NO: 193926 - DNA, 601 bp, Human
gacactgcactccagcctgggtgacagagaaccctgtctcaaaaaaaaaaaacgatcttcagaagccttccctggttaagccttccaatatctcctcacttttattctcagtgtctccttaataccctgatactctgtgtttcacactgataaaaatggtggccctgtcgcctggggaacaagagcaacgcttttgctttggatattaactgaccatttttgcatctctgtgcatggaatggttatgggtcatgaagattttgaaaaaagaaagtgactttagcgagggggaggggtataragcaaagaatcatgtcaattagttttgatgttgctttgtacatgccctgatgcctttctccgatctcttatccccccagtttgcacaggaaggtcccaagagagacagatgtccttaagacagaacctaagtctacactaagcaaagggtgaaccactggcacagtatagcatgctcacattccaccagccccttgcccatgtgaccctcgcccagtgtctcccagggtagcaacagtcagaggtcattctcagcagggattcactgactgcttaagctggatgagcgaccagggtgtga

SEQ ID NO: 193927 - DNA, 601 bp, Human
aaggcagtggtcctgatggtgccagaccacaggggatcccagaaggactgcccatgtcagcctggtcacccctagacatgttgcagccgtaggtttcagtttccccttagccctgctcacctgcacgtacagcgtggtatggactccccatccctatttccatttgcacctgactcttagggccccaaagccatggctaccactgggggtgcctttctcttcctcctgctttctctctctcctgcttccatccgaattcaagatcctcagaaaggccaggcacagtggctcacaactgcartcccagcattttgggaggccaaagcaggacgatcgcttgagcccagaagtttgaggccagcctgggaaacatagactccatctttacaaaaaacacaaaaattagctgggtgtggtggcatgtacctgtagtcccagctacttgggaggctgaaataggaggctcaactgagccatgattgagacactgcactccagcctgggtgacagagaaccctgtctcaaaaaaaaaaaacgatcttcagaagccttccctggttaagccttccaatatctcctcacttttattctcagtgtctcc

SEQ ID NO: 193928 - DNA, 601 bp, Human
atggggggaatgggaagaaggcagtggtcctgatggtgccagaccacaggggatcccagaaggactgcccatgtcagcctggtcacccctagacatgttgcagccgtaggtttcagtttccccttagccctgctcacctgcacgtacagcgtggtatggactccccatccctatttccatttgcacctgactcttagggccccaaagccatggctaccactgggggtgcctttctcttcctcctgctttctctctctcctgcttccatccgaattcaagatcctcagaaaggccaggcacrgtggctcacaactgcaatcccagcattttgggaggccaaagcaggacgatcgcttgagcccagaagtttgaggccagcctgggaaacatagactccatctttacaaaaaacacaaaaattagctgggtgtggtggcatgtacctgtagtcccagctacttgggaggctgaaataggaggctcaactgagccatgattgagacactgcactccagcctgggtgacagagaaccctgtctcaaaaaaaaaaaacgatcttcagaagccttccctggttaagccttccaatatctcctcactt

SEQ ID NO: 193929 - DNA, 601 bp, Human
aatggtaagacttctattttcccagggaggaatgagccatgaaaagacggggggggggggtgctctctaatgttaggccccatagctccatggcctccccctggtctctgctcctgagtgtaggaacctcttgcccctctagagtacagtccccacaatgctgcccactgggcagcctgcccctttaaggcactgacccctccaaaccctggccttggctattcttagcccaggttgatccaggtggccacggtcctctgcctacagccatgcagttcccaagctgggagcctccattctycctggtagcaggccagaaggatatcctgctccagggtcagtcaaggacactgaacccagccggaagaccaaggattctactttagccaggtcaaaggagaaaccctactcaggatgcaacgccttaagagagaactgaaggctgggtgcagtggctcatgcctgtaatcccagcactttgggaggccgaggtgggcagactgaggtcaggagttcgagaccagcctgggcaacatggtgaaaccccgtctccaccaaaaatacaaaaattagctggtgtggtggtgggtgcctgtaacac

SEQ ID NO: 193930 - DNA, 601 bp, Human
ttccccaagcaggctgttctctgcgttccagcaggctgagggcactcaggcaaagagaatgccacagaaggagcctcaggcagaagagcttcacaagagccctctcccaaatgcccccaggccttctggcaggccccccagggtggccggtcattccctaaatcaggaaggtgtaaagaagccgtggggtccccacagaccagggtaggaaaggaaagggacaccggttttcaagcagttccagtctttcaatccagagaaaaacagaaaaatgaaacacccctaaacatctgatactcayttacacaggggtgtgagaggtcaaggtgttagtccctcccagggccatttgcattaaaaagcagaatctaaggaggggagcacccaacccaacaggccctggaaatggtaagacttctattttcccagggaggaatgagccatgaaaagacggggggggggggtgctctctaatgttaggccccatagctccatggcctccccctggtctctgctcctgagtgtaggaacctcttgcccctctagagtacagtccccacaatgctgcccactgggcagcctgcccctttaaggcactgac

SEQ ID NO: 193931 - DNA, 601 bp, Human
gattgtcaccactgtcacctccagcctcagttcagcttccttagctcatgcccttgggaatccagttctgcaggattcattcctgtgtgggtggggaaaactccctggaggatgccagcctgttcagcagagtccataaagcaagtcccagctgttcccatccagccagggcaccaaagtgaggaaacaacataacaacaaggctctgctctgcctggagggctcatcagagagaggacaggagaggccacggcagaggagctgcctccgcaggtcttctgcactgggctcggcggggccrggctaacccatccaggtctgcaaggagcaaggaggcagtgtggaggcgtacttcaaacgagggcccagccccattccaaggggatgaggatgtacgtcggggtaactgcagaggcactggactgaccagagagcactgaataatgccagtgagaccatcctccagaaggaagacatccttgctgggctgacactggctttttgagcaagcgtctccaatttgttcaattataatgattgttagggtgctttctggtagcacctttctcagatgtccaaaaggttctctctggtcttgaag

SEQ ID NO: 193932 - DNA, 601 bp, Human
ccccacttccccaattcagttctctctctgtcaggctctacattagaaattgctctagggccaggcgtggtggctcatgtctgtaatcccaaggactttgggaagccgaggcggggggattgcttgagcccagggttcaagaccatccctatggggggaaaaaaaattagctgggtgtggtggcatggacctatagtcccagctactgggaagggttaagtggatggatcgtttggacctgggagtttgaggctacagtgagccgtgatcgtgccattgcactccagtctgagtgacagaraccctgtctcaaattaaattaaattaaatttaaatttaaattaagattgctccattcccttagtcttcaagggctactagggattctgtataaaaacaaatagccatgtcggtcccttgaaagaggaagggtagatcagggcctgcgtctctgctactctgcagcccatccagggagagatggctggggccaatgccactatgtcacacaactctagggggcaccccacacattgtattctatgtgaatgatacccccgaccacaaaaatgaaaaccatgtgaatggtgcctcctggagt

SEQ ID NO: 193933 - DNA, 601 bp, Human
cagggcatcatactccatctgcagggcttcggccatcgctagctctttgcggctgatgcccactgactccagggacttccagtgttccccattgccctgagtcgaagacatggtgaggatgggggacacaggcaacaaagtctctacttcctgccaacgtcagttctggagggttgtgacatggtgtctgggcgcctgcaggtgaggggtaaaaatatcaatcagtcacaaagagagatttactaatcatccataataatccaatttaggtgatattatctgggccagtgcctgcttcttygttgtgtacaactaatggaatgtacaggaagatggaggaaaaaagggataccaagacaactttacctatttattatatccaactatccatccattcatctctacatgcctcatctctgcgccctaatccctatactcacctctgtcatttgtgccccaaaaagagagagaggcacctttttttttttttttttgagatggagtctcgctgtgtcacccaggctggaatgcaatggtgcgatctcggctcactgcaacctccacctcccaggttcaagtgattctcctgcctcagcctccc

SEQ ID NO: 193934 - DNA, 601 bp, Human; identical to SEQ ID NO: 25563

SEQ ID NO: 193935 - DNA, 601 bp, Human; identical to SEQ ID NO: 25564

SEQ ID NO: 193936 - DNA, 601 bp, Human; identical to SEQ ID NO: 25565

SEQ ID NO: 193937 - DNA, 601 bp, Human; identical to SEQ ID NO: 25566

SEQ ID NO: 193938 - DNA, 601 bp, Human; identical to SEQ ID NO: 25567

SEQ ID NO: 193939 - DNA, 601 bp, Human; identical to SEQ ID NO: 25568

SEQ ID NO: 193940 - DNA, 601 bp, Human; identical to SEQ ID NO: 25569

SEQ ID NO: 193941 - DNA, 601 bp, Human; identical to SEQ ID NO: 25570

SEQ ID NO: 193942 - DNA, 601 bp, Human; identical to SEQ ID NO: 25571

SEQ ID NO: 193943 - DNA, 599 bp, Human
ctatatataaagggaaaagcacagtctcctctccatagtctacaggaactgagggaagaagggagaggatgagaagccctccaactagttaaactctttaagggagacaagatcaaaaaataaagtattattaaaattaacaactaacatttaattttttttttttttgagacagaatttcgctcttgttgcccaggctggagtgcaatggcacgatctcagctcactacaacctccacctcccgggttcaagcgattctcctgcctcagcctccctagtagctgggattacaggcatgcrccaccatgcccggctattttgtattttttttagtagagacgaggtttctccatgttggtcaggctggtcttgaactccctgcctcaggtgatccgcccgcctcggcctcccaaagcgctgggattacaagcataagccaccgcgcctggtcaacaactaaaatttatatgttttttatggtttacaaagagcctttatagatacttctcattggatcctcatgacaacttgagaagtggtaattatacttggctcctttaagagtcagggaagtggaggccaggcgtggtggctcacg

SEQ ID NO: 193944 - DNA, 601 bp, Human; identical to SEQ ID NO: 25572

SEQ ID NO: 193945 - DNA, 601 bp, Human; identical to SEQ ID NO: 25573

SEQ ID NO: 193946 - DNA, 601 bp, Human; identical to SEQ ID NO: 25574

SEQ ID NO: 193947 - DNA, 601 bp, Human; identical to SEQ ID NO: 25575

SEQ ID NO: 193948 - DNA, 601 bp, Human; identical to SEQ ID NO: 25576

SEQ ID NO: 193949 - DNA, 601 bp, Human; identical to SEQ ID NO: 25577

SEQ ID NO: 193950 - DNA, 601 bp, Human; identical to SEQ ID NO: 25578

SEQ ID NO: 193951 - DNA, 601 bp, Human; identical to SEQ ID NO: 25579

SEQ ID NO: 193952 - DNA, 601 bp, Human; identical to SEQ ID NO: 25580

SEQ ID NO: 193953 - DNA, 601 bp, Human; identical to SEQ ID NO: 25581

SEQ ID NO: 193954 - DNA, 601 bp, Human; identical to SEQ ID NO: 25582

SEQ ID NO: 193955 - DNA, 601 bp, Human; identical to SEQ ID NO: 25583

SEQ ID NO: 193956 - DNA, 601 bp, Human; identical to SEQ ID NO: 25584

SEQ ID NO: 193957 - DNA, 601 bp, Human; identical to SEQ ID NO: 25585

SEQ ID NO: 193958 - DNA, 601 bp, Human; identical to SEQ ID NO: 25586

SEQ ID NO: 193959 - DNA, 601 bp, Human; identical to SEQ ID NO: 25587

SEQ ID NO: 193960 - DNA, 601 bp, Human; identical to SEQ ID NO: 24933

SEQ ID NO: 193961 - DNA, 601 bp, Human; identical to SEQ ID NO: 24934

SEQ ID NO: 193962 - DNA, 601 bp, Human; identical to SEQ ID NO: 24935

SEQ ID NO: 193963 - DNA, 601 bp, Human; identical to SEQ ID NO: 24936

SEQ ID NO: 193964 - DNA, 601 bp, Human; identical to SEQ ID NO: 24937

SEQ ID NO: 193965 - DNA, 601 bp, Human; identical to SEQ ID NO: 24938

SEQ ID NO: 193966 - DNA, 601 bp, Human; identical to SEQ ID NO: 24939

SEQ ID NO: 193967 - DNA, 601 bp, Human; identical to SEQ ID NO: 24940

SEQ ID NO: 193968 - DNA, 601 bp, Human; identical to SEQ ID NO: 24941

SEQ ID NO: 193969 - DNA, 601 bp, Human; identical to SEQ ID NO: 24942

SEQ ID NO: 193970 - DNA, 601 bp, Human; identical to SEQ ID NO: 24943

SEQ ID NO: 193971 - DNA, 601 bp, Human; identical to SEQ ID NO: 24944

SEQ ID NO: 193972 - DNA, 601 bp, Human; identical to SEQ ID NO: 24945

SEQ ID NO: 193973 - DNA, 601 bp, Human; identical to SEQ ID NO: 24946

SEQ ID NO: 193974 - DNA, 601 bp, Human; identical to SEQ ID NO: 24947

SEQ ID NO: 193975 - DNA, 601 bp, Human; identical to SEQ ID NO: 24948

SEQ ID NO: 193976 - DNA, 601 bp, Human; identical to SEQ ID NO: 24949

SEQ ID NO: 193977 - DNA, 601 bp, Human; identical to SEQ ID NO: 24950

SEQ ID NO: 193978 - DNA, 601 bp, Human; identical to SEQ ID NO: 24951

SEQ ID NO: 193979 - DNA, 601 bp, Human; identical to SEQ ID NO: 24952

SEQ ID NO: 193980 - DNA, 601 bp, Human; identical to SEQ ID NO: 24953

SEQ ID NO: 193981 - DNA, 601 bp, Human; identical to SEQ ID NO: 24954

SEQ ID NO: 193982 - DNA, 601 bp, Human; identical to SEQ ID NO: 24955

SEQ ID NO: 193983 - DNA, 601 bp, Human; identical to SEQ ID NO: 24956

SEQ ID NO: 193984 - DNA, 601 bp, Human; identical to SEQ ID NO: 24957

SEQ ID NO: 193985 - DNA, 601 bp, Human; identical to SEQ ID NO: 24958

SEQ ID NO: 193986 - DNA, 601 bp, Human; identical to SEQ ID NO: 24959

SEQ ID NO: 193987 - DNA, 601 bp, Human; identical to SEQ ID NO: 24960

SEQ ID NO: 193988 - DNA, 601 bp, Human; identical to SEQ ID NO: 24961

SEQ ID NO: 193989 - DNA, 601 bp, Human; identical to SEQ ID NO: 24962

SEQ ID NO: 193990 - DNA, 601 bp, Human; identical to SEQ ID NO: 24963

SEQ ID NO: 193991 - DNA, 601 bp, Human; identical to SEQ ID NO: 24964

SEQ ID NO: 193992 - DNA, 601 bp, Human
ggcaaaggtattgccaactagagtaaagcactgactgcatgagtttacacttggcctatacagttccacagaccagaatgtacacacccttgtgagaagagtcaagatcattaacataaacacaccacagtaagcatctgcgttggcaagagtgtaatatatggatcagattaactggagtatggggaaagtgtaagtcttccgtaaacattgaaaatgtaactaaactaaaaaatactttcaaatacataatgtgaaagttacccatacttctattttccccttagaaataaatcttaayatcccttactccaggtgattattgcagagtaagcagctaccagtgtcacgacctaaactgttaaatcccaaactttatttgggagatccgctggtttgtttcttcccagctctttagcagagaataatctagaagtgagtaaattctcagaatttcccaagaggaaaatgagcattcactggaaaaatacaaggaatacgcgcaaaacttataactattttggataatcttcaaacccacttagccaccagccatcctgttgttccaagttaacattaagatcaatctttcgaatcaaat

SEQ ID NO: 193993 - DNA, 601 bp, Human
tcactacaacctcagcctctcaggttcaagcaattctcctgcctcagcctgctgagtagctgggattacaggcacatgccaccacgcctggctaattttttttatttttagtagagacgagggtttcaccatgttggccaggctggtcttgaactcctgacctcaagtgttccgcccaccttggcctcccaaagtgctaggattacaggcgtgagccaccctgcctgaaccccagaccttctgctttttaatccccctctgaagtgtgagtagataaccaagggcattagttacacaaggaaaacttctaacatgaaagagaagaaacctaaacaaatgaaaagacaaaagccgcttgggaaattcaatctgtgcaggaaggaaaaaaagttgctccaaaaaatcattaagcttcttagggagaaaggaaaagacactgacactataaaacaaaaaccagaaagaaatagacacacaaaccacacacatacaaatatatatgtatatattcaggcaaccaaaaaaatagagattttgattttaaatattcatgattacagtcatgaaaaacttatttttggcccagtcaaaaatagccaat

SEQ ID NO: 193994 - DNA, 601 bp, Human
gcatcatatcggctcactacaacctcagcctctcaggttcaagcaattctcctgcctcagcctgctgagtagctgggattacaggcacatgccaccacgcctggctaattttttttatttttagtagagacgagggtttcaccatgttggccaggctggtcttgaactcctgacctcaagtgttccgcccaccttggcctcccaaagtgctaggattacaggcgtgagccaccctgcctgaaccccagaccttctgctttttaatccccctctgaagtgtgagtagataaccaagggcatwagttacacaaggaaaacttctaacatgaaagagaagaaacctaaacaaatgaaaagacaaaagccgcttgggaaattcaatctgtgcaggaaggaaaaaaagttgctccaaaaaatcattaagcttcttagggagaaaggaaaagacactgacactataaaacaaaaaccagaaagaaatagacacacaaaccacacacatacaaatatatatgtatatattcaggcaaccaaaaaaatagagattttgattttaaatattcatgattacagtcatgaaaaacttatttttggcccagtc

SEQ ID NO: 193995 - DNA, 601 bp, Human
aagctcatccacatcttcagcatttttttttttttttgagacagagtctccctgtgttgccaggctggagtgcagtggcatcatatcggctcactacaacctcagcctctcaggttcaagcaattctcctgcctcagcctgctgagtagctgggattacaggcacatgccaccacgcctggctaattttttttatttttagtagagacgagggtttcaccatgttggccaggctggtcttgaactcctgacctcaagtgttccgcccaccttggcctcccaaagtgctaggattacaggcrtgagccaccctgcctgaaccccagaccttctgctttttaatccccctctgaagtgtgagtagataaccaagggcattagttacacaaggaaaacttctaacatgaaagagaagaaacctaaacaaatgaaaagacaaaagccgcttgggaaattcaatctgtgcaggaaggaaaaaaagttgctccaaaaaatcattaagcttcttagggagaaaggaaaagacactgacactataaaacaaaaaccagaaagaaatagacacacaaaccacacacatacaaatatatatgtatatattc

SEQ ID NO: 193996 - DNA, 601 bp, Human
ttccccaaataaaaagcccagccagattccccctaccatgaattccccagtcgacaagctcatccacatcttcagcatttttttttttttttgagacagagtctccctgtgttgccaggctggagtgcagtggcatcatatcggctcactacaacctcagcctctcaggttcaagcaattctcctgcctcagcctgctgagtagctgggattacaggcacatgccaccacgcctggctaattttttttatttttagtagagacgagggtttcaccatgttggccaggctggtcttgaactyctgacctcaagtgttccgcccaccttggcctcccaaagtgctaggattacaggcgtgagccaccctgcctgaaccccagaccttctgctttttaatccccctctgaagtgtgagtagataaccaagggcattagttacacaaggaaaacttctaacatgaaagagaagaaacctaaacaaatgaaaagacaaaagccgcttgggaaattcaatctgtgcaggaaggaaaaaaagttgctccaaaaaatcattaagcttcttagggagaaaggaaaagacactgacactataaaacaaaaa

SEQ ID NO: 193997 - DNA, 601 bp, Human
tctgtcaatctctggggaaaagaatggaaaaggcttctctgaggactctcaccagcccaagaggtaacgaccacagaggttccccaaataaaaagcccagccagattccccctaccatgaattccccagtcgacaagctcatccacatcttcagcatttttttttttttttgagacagagtctccctgtgttgccaggctggagtgcagtggcatcatatcggctcactacaacctcagcctctcaggttcaagcaattctcctgcctcagcctgctgagtagctgggattacaggcacaygccaccacgcctggctaattttttttatttttagtagagacgagggtttcaccatgttggccaggctggtcttgaactcctgacctcaagtgttccgcccaccttggcctcccaaagtgctaggattacaggcgtgagccaccctgcctgaaccccagaccttctgctttttaatccccctctgaagtgtgagtagataaccaagggcattagttacacaaggaaaacttctaacatgaaagagaagaaacctaaacaaatgaaaagacaaaagccgcttgggaaattcaatctgtgcag

SEQ ID NO: 193998 - DNA, 601 bp, Human
aagctgcacttcactgaaaggtaaaacattcagaggtcaagatggcagaaagagtcatcctacacaaagtgaattcaagaaacaggaacaataggccaggcggtggctcacacctgtaatctcagcactttgggaggccaaggcaggcagatcacctgaggccaggagttcgaggccagcctggccaacatggtgaaaccctgtctctactaaaaatacaaaaattagctgggtgtggtggcgtgcacctgtaatcccagctactcgggaggctgacgcaggagaatcacttgaacccagragctgagatcatgccactgcactccagtctgggtgacagagcgagactgtctccacccccgccaaaaaaaagaaaagaaagaaagaaagaaacaggaacaagggctctatgccagtaatctacgtaccacccaacctaagatataggttttgccccctatgacaactatgatcaattggtagtgtacacttagagttgtatatgaaggcatctgaggtccaaactcggctcagcggcccagcctgatccgaaaatgtttcctgtgggtagaggaaggggaaaacagcaacacactgctat

SEQ ID NO: 193999 - DNA, 601 bp, Human
gtcatcctccaaagataaagtaattgttgcacccactccattgtcacaatcgccagcactcctgttttctgtattgccaatgcatagctgccatcatgggaagatcgagctttgctttttctgcacagataagatggcttaggaacaattatcctcctacttttgtggaaactgactcttgtcatcatgtgtgtaaccataaagaatgttgatgttacaaagcaactgggagagcatgctggaagttcacagcccattaagggagcctgaggaatgactcaactgatgaaatgacgttggraaagtcgtgatcatccacaaacggcagggtacatcagcccagccagaaacaggaacttggtgcacattccaaggagggcacaagtggaaagggaagtaagggtgctgctgctggtaaggcagttgtgtgataaactggcctccagaaggaaataatgataacttccattgaggccacatggccatcaatgacaccaatcccatctttcagattaaaataatattggacttaatagaagctgcacttcactgaaaggtaaaacattcagaggtcaagatggcagaaagagtcatcctacac

SEQ ID NO: 194000 - DNA, 601 bp, Human
cagtgaagaatatttctaaataatacaagaaacaatacacttgagaaaacttaaattgaatgctctatatttcaatccatatatagacaagtgatgtgaaagtctaatcaagaatttagagaatttagattgttgagtacaacttgggtaattgtgaccaaatgtctcttttttttttttttttttttttttttgagacggagtcttgctctgttgcccaggctggagtgcagtggtgcgatctcagctaactgcaacctctgctacctgagttcaagagattctcctgcctcagcctccygagtagctggaattacaggcacgtgccaccaggcccacctaatttttgtatttttagtaaagatggggtttcaccatattggccaggctggtcttgaactcctgacttcaagtgatccacctgcctcagccttccaaagtgctaggattacagccatgagccaccactcttggcccaaatatcattttttcttaactataaagtgtccaaaattgtctggaaaattcattcagtatattaagtacttgcttggtactatgctttccctaggaaagaacttctgtgaagacccagtacatt

SEQ ID NO: 194001 - DNA, 601 bp, Human
tatttttaatttcttctttgtaagcttcagtattgtttacatcttctaacaaggaatatataaaactctacaaaatgacaatttttttttactgatggcaaggagagtccaaggagcacaccaggtgtctgagaacctcggtggcacccaaagatcaaacttttgcctgggggaagcaagatggtgtgtcaacagctctgagcctaaaaaatgtcttctggctaggactccagaacttatgaacaagaattatttcatgcaatgcttctataactggtttaagtatgtgacaaagacactsacaatccttaaaaaaattcaaaagcatgtatacctaaatttacatgtctgacagcattcaaacccagttaaattgtatttctgtttccctgcatggttgaaggatcaagcatttttatcacccaagcaggaaaatgaagaaatcaactgccttctacaaatcaaaaataaccctaatagtaaaaactaactttgttgcatgcttaaatcatattggcagaaaaatgaaactttaaatcactcttgtaagaaaaaaagccagtttcatttttggggcagtcatgtggaaatcccacaagtc

SEQ ID NO: 194002 - DNA, 601 bp, Human
ggttttagggttatttttaatttcttctttgtaagcttcagtattgtttacatcttctaacaaggaatatataaaactctacaaaatgacaatttttttttactgatggcaaggagagtccaaggagcacaccaggtgtctgagaacctcggtggcacccaaagatcaaacttttgcctgggggaagcaagatggtgtgtcaacagctctgagcctaaaaaatgtcttctggctaggactccagaacttatgaacaagaattatttcatgcaatgcttctataactggtttaagtatgtgwcaaagacactgacaatccttaaaaaaattcaaaagcatgtatacctaaatttacatgtctgacagcattcaaacccagttaaattgtatttctgtttccctgcatggttgaaggatcaagcatttttatcacccaagcaggaaaatgaagaaatcaactgccttctacaaatcaaaaataaccctaatagtaaaaactaactttgttgcatgcttaaatcatattggcagaaaaatgaaactttaaatcactcttgtaagaaaaaaagccagtttcatttttggggcagtcatgtggaaa

SEQ ID NO: 194003 - DNA, 601 bp, Human
gtggtggctcacacctgtaatcctagaactttgggaggccgaggtgggagaatcacttgaggccaggagttcaagaccaacctggccaacatagcaaggcctcatcgctgcttaattttcgtttcaatgagctggatgcagtcgtatgcatctgcaatcctagctactcaggaggctgaagccagaggctgaagctcaaaccttctatttaagcccaggagttcaaggctgcagtaagctatggtgatggcaccactgtgctccagcctaagcaacagagcaagactctgtctctaaaacaaaaaaaaagaaaaaaaaaaatctaagtgtccaacaactggggagtggctcaaaataccaccgtatgctaacatgacagaattacccaaagaaaattatgcatggactaattacaacgtcataaagtaactacctgtgtataaataaagattgtagaatttggagttacataaacagttgtaacataatgctccttaattattttctagaacattgctaaagatttattaaaagtcagctggtaatagagatgactggaaggggattcacaaagattctctctggaatggttttagggtta

SEQ ID NO: 194004 - DNA, 601 bp, Human
ttgctagtgagttattttatgaccttctaaaactgatgaataaaagctagaaatcagtcaggtgtggtggctcacacctgtaatcctagaactttgggaggccgaggtgggagaatcacttgaggccaggagttcaagaccaacctggccaacatagcaaggcctcatcgctgcttaattttcgtttcaatgagctggatgcagtcgtatgcatctgcaatcctagctactcaggaggctgaagccagaggctgaagctcaaaccttctatttaagcccaggagttcaaggctgcagtaakctatggtgatggcaccactgtgctccagcctaagcaacagagcaagactctgtctctaaaacaaaaaaaaagaaaaaaaaaaatctaagtgtccaacaactggggagtggctcaaaataccaccgtatgctaacatgacagaattacccaaagaaaattatgcatggactaattacaacgtcataaagtaactacctgtgtataaataaagattgtagaatttggagttacataaacagttgtaacataatgctccttaattattttctagaacattgctaaagatttattaaaagtcag

SEQ ID NO: 194005 - DNA, 601 bp, Human
tggaaacttcacattgctagtgagttattttatgaccttctaaaactgatgaataaaagctagaaatcagtcaggtgtggtggctcacacctgtaatcctagaactttgggaggccgaggtgggagaatcacttgaggccaggagttcaagaccaacctggccaacatagcaaggcctcatcgctgcttaattttcgtttcaatgagctggatgcagtcgtatgcatctgcaatcctagctactcaggaggctgaagccagaggctgaagctcaaaccttctatttaagcccaggagttcraggctgcagtaagctatggtgatggcaccactgtgctccagcctaagcaacagagcaagactctgtctctaaaacaaaaaaaaagaaaaaaaaaaatctaagtgtccaacaactggggagtggctcaaaataccaccgtatgctaacatgacagaattacccaaagaaaattatgcatggactaattacaacgtcataaagtaactacctgtgtataaataaagattgtagaatttggagttacataaacagttgtaacataatgctccttaattattttctagaacattgctaaagatt

SEQ ID NO: 194006 - DNA, 601 bp, Human
catggcctcaagcattctggctcttcttgtcctcacataacagagacactgtaattctaaaaggtcaaaaaagagaaaaaatggaaacttcacattgctagtgagttattttatgaccttctaaaactgatgaataaaagctagaaatcagtcaggtgtggtggctcacacctgtaatcctagaactttgggaggccgaggtgggagaatcacttgaggccaggagttcaagaccaacctggccaacatagcaaggcctcatcgctgcttaattttcgtttcaatgagctggatgcagtcrtatgcatctgcaatcctagctactcaggaggctgaagccagaggctgaagctcaaaccttctatttaagcccaggagttcaaggctgcagtaagctatggtgatggcaccactgtgctccagcctaagcaacagagcaagactctgtctctaaaacaaaaaaaaagaaaaaaaaaaatctaagtgtccaacaactggggagtggctcaaaataccaccgtatgctaacatgacagaattacccaaagaaaattatgcatggactaattacaacgtcataaagtaactacctgtgtataaa

SEQ ID NO: 194007 - DNA, 601 bp, Human
tcctccgaaatgttatatttgcttaaaacagtataaatccactttccctacttccctacacatacactcatgtagaatttattttagatttcattcattccacaaagtccaaggaaaattccacagacactacattaaatttaccgtgagtctaagcaagccattatcttctatgaggctctcttttctcatctataaaatgggcataatatacttgccctttgccaaatagaacaagccatctccttgttcatgactgtgtataaaacactctcagagaagctcaaagtcctttacaagyattaggccatgaatctttctcaagtgaactgttaattatgtgtcattatagtttgttgaatagatgcaaaacctgaagcacaggaaaataattccagttaatagttaacttagaaatccatgcaaggtaatgaaacaatatgtataaaaacccctgtgactcatgtttgcctacgtaacaaaccttcacatgtacccccaaacctaaaataaaagaaaaaagaaatccacccaaggctttaaacattagaccatgatatctagaaagatgacaaaggggctgggcgcagtggctcatgcc

SEQ ID NO: 194008 - DNA, 601 bp, Human
atgtcccaaagggttcatgtagactgtatactccctcttgtatgtaatttattttaaaaataataactagagtagttcaaccatatctgtattctgatacacattctgagaaatgtccagctatgcctaacctttgttcatcgtgtagccctctcctgagtcctgattttcaaaaatatttttcccaacttattgctgactgaatttacttaccagactttgtgtggcgtcttttcaacacttggaaaatctgtttatccctgtcttccctgattatttatttaattctctttaagaactstagcgaatttgtctgacatggttaccctctttcaaagggaaagactctcctccgaaatgttatatttgcttaaaacagtataaatccactttccctacttccctacacatacactcatgtagaatttattttagatttcattcattccacaaagtccaaggaaaattccacagacactacattaaatttaccgtgagtctaagcaagccattatcttctatgaggctctcttttctcatctataaaatgggcataatatacttgccctttgccaaatagaacaagccatctccttgttca

SEQ ID NO: 194009 - DNA, 601 bp, Human
aaatgcattctttatttctctgccattttgcatagacttgagatcaactgtttagctttttcatgtcccaaagggttcatgtagactgtatactccctcttgtatgtaatttattttaaaaataataactagagtagttcaaccatatctgtattctgatacacattctgagaaatgtccagctatgcctaacctttgttcatcgtgtagccctctcctgagtcctgattttcaaaaatatttttcccaacttattgctgactgaatttacttaccagactttgtgtggcgtcttttcaatacttggaaaatctgtttatccctgtcttccctgattatttatttaattctctttaagaactctagcgaatttgtctgacatggttaccctctttcaaagggaaagactctcctccgaaatgttatatttgcttaaaacagtataaatccactttccctacttccctacacatacactcatgtagaatttattttagatttcattcattccacaaagtccaaggaaaattccacagacactacattaaatttaccgtgagtctaagcaagccattatcttctatgaggctctcttttctca

SEQ ID NO: 194010 - DNA, 601 bp, Human
agcccagccctaaatgcattctttatttctctgccattttgcatagacttgagatcaactgtttagctttttcatgtcccaaagggttcatgtagactgtatactccctcttgtatgtaatttattttaaaaataataactagagtagttcaaccatatctgtattctgatacacattctgagaaatgtccagctatgcctaacctttgttcatcgtgtagccctctcctgagtcctgattttcaaaaatatttttcccaacttattgctgactgaatttacttaccagactttgtgtggsgtcttttcaacacttggaaaatctgtttatccctgtcttccctgattatttatttaattctctttaagaactctagcgaatttgtctgacatggttaccctctttcaaagggaaagactctcctccgaaatgttatatttgcttaaaacagtataaatccactttccctacttccctacacatacactcatgtagaatttattttagatttcattcattccacaaagtccaaggaaaattccacagacactacattaaatttaccgtgagtctaagcaagccattatcttctatgaggct

SEQ ID NO: 194011 - DNA, 601 bp, Human
actccagcctgggcaacagagtgacaccttgtctcaaaaaaaaaaaaaaaaaaaaaaaagtctttttgcataaattaggaaaaagtgtctcttcttttaaaaactttacttctatcttcctaaaacctgttgcagtaaataagcaaatccactgggtctacaatataaatgacatctcagaattttgtagtgtataacctgcacattatatatagcagttctgggcataggcagggaaaataagatggatgctgagaggagtcaggagtcagggatggggatagagtgtctaggagtcccsggtccttaggagacaaagaataccttttgctatagagctgcgctgttcaatatgacagccacttgccaccaatagctaatgagcacttgaaatgaagccagtgcgaatggcgaaccacattttttattttaataaatatgaatttaaaatgtaaaacttaagcagtaaataattttttttccattaatcacaactttgttgtttggtagaactacatttcactctatctgctgcattacaaaagatgtcctgtactgtatttctcctgagttatttctagtatctcaataattttatatg

SEQ ID NO: 194012 - DNA, 601 bp, Human
ccattgagccagactggatcacatgctaacccctgagccaatcccttggtcaagtggagggactgctcggattggccaaggctgaatcacatgatcatccctgggtagtgtcaactccacccaaaccacatgaattggacagagtagctgcccaaaggaagaaagtctgggcagacaaataatcagtccactacagcacagtcacttgtcaggaaggccccagataaccaaaagggcacttgagagagctttgaagtcagacagaactggttttaaaggtcagctttgacatttactagcygtatgacctcaggtaagtaatgtaacttctcagtaactcaggttcctcattgtaaaatagtacctacctcctatagatattgtgggaggattaaatgaaataatttacataaattgctaagcacaatgcttgacacaaagtaagtgatcaatcaatggcagctattattatcaaaataacaataatgacaattagtattatcagaacaaaggtaccatatgaagggtgatctgtgactccatgaaagagagggcaaggtcagcatttggataaatcagccctgggtcatgtatcattaag

SEQ ID NO: 194013 - DNA, 601 bp, Human
aatcccagaggaagagctccccctttcctaaatgccagcagaagagtcccattgagccagactggatcacatgctaacccctgagccaatcccttggtcaagtggagggactgctcggattggccaaggctgaatcacatgatcatccctgggtagtgtcaactccacccaaaccacatgaattggacagagtagctgcccaaaggaagaaagtctgggcagacaaataatcagtccactacagcacagtcacttgtcaggaaggccccagataaccaaaagggcacttgagagagctttkaagtcagacagaactggttttaaaggtcagctttgacatttactagctgtatgacctcaggtaagtaatgtaacttctcagtaactcaggttcctcattgtaaaatagtacctacctcctatagatattgtgggaggattaaatgaaataatttacataaattgctaagcacaatgcttgacacaaagtaagtgatcaatcaatggcagctattattatcaaaataacaataatgacaattagtattatcagaacaaaggtaccatatgaagggtgatctgtgactccatgaaagagagg

SEQ ID NO: 194014 - DNA, 601 bp, Human
agagtaggttgacgagtaatttttccgatgtctatgaagaacagatttctctaatgttccactcatggcaaaatccttttcccacccagatccatttgtgggctatgccatagggcaggatggaggggcgggggctgttggtgaggaggtgttgggtgtggcacctcctttcactagggcagggcttactgacctaaaagggacacagcaagctgaacatggtgcagagtctacagggatgagaggcctgcaaggcaccaagtaggcacgaaggccaaaaaagtagtggatgaccaagggsagacagacaatagcatagggaatccaagacaaaaatactcatcttctgaaaacccggtataagcagggttctttcaaatgcacataattagatttaagcaaacaacaacaaaaggaacacattggctcacataatcgagaagtcctggcacagctgactcctgcacttcaaacaatgctgagtgtgctctcaccaccgtgcagtgctgcttctcactgcacggtcccattctcttgtattgcggcttcctccatggagcagggaaaaatgaccaccagtagctccaggttacatcgctcc

SEQ ID NO: 194015 - DNA, 601 bp, Human
ctttctttaactgttttaattactccttctcaccttttacaatcactccaataaagttttcatcctgtcatttacaagatcatcctgcccctcttctttttgttctttctcttgcattcttccacctgcatactccttagggtcattcctcaatcctaaataaatgtaatcatgtccaattcttttttttttttttttttgagacagagtctcgctctgttgcccaggctggagtgcagtgacacaatctcagcttactgcaacctcctccacctcccaggttcaaacaattctcctgccycagcatcccgagtagctgggaccacaggcatgcaccaccatgcccagctaacttttgtagttttagtagagacaggatttcaccatgttgaccaggctgatcttgaactcctgacctcaggtgatccacctgcctaggcccccccaaagcgctggtattataggcgtgagccaccgagcctggcctaatcatgtccaatttaatctgagttcccttttcctttcctaccacttgttttccaggactcaagcaagcaaatgtaccaggtcttttcatatccccatgtatctgctcgagttg

SEQ ID NO: 194016 - DNA, 601 bp, Human
tgtcctgtctcattcctctgcccttctccctgcttccacataactactctgtcctgaaaatccttccacctcttcttctattatctcttctctctaaagcccgtagtcttattatgagctttctttaactgttttaattactccttctcaccttttacaatcactccaataaagttttcatcctgtcatttacaagatcatcctgcccctcttctttttgttctttctcttgcattcttccacctgcatactccttagggtcattcctcaatcctaaataaatgtaatcatgtccaattcttttttttttttttttttgagacagagtctcgctctgttgcccaggctggagtgcagtgacacaatctcagcttactgcaacctcctccacctcccaggttcaaacaattctcctgccccagcatcccgagtagctgggaccacaggcatgcaccaccatgcccagctaacttttgtagttttagtagagacaggatttcaccatgttgaccaggctgatcttgaactcctgacctcaggtgatccacctgcctaggcccccccaaagcgctggtattataggcgtgagccaccgagcctg

SEQ ID NO: 194017 - DNA, 601 bp, Human
agtctataaaacacagattgggaaacatctgaggcttacataatgtaagtcatttttactatcatgaaatacgtaagttatcttactttttattcataaggcagtaaaacggctaagtaacttgattcatacctagtatgtagctgtcgtctcctggcatcctagcagcagctgtcctgtctcattcctctgcccttctccctgcttccacataactactctgtcctgaaaatccttccacctcttcttctattatctcttctctctaaagcccgtagtcttattatgagctttctttaaytgttttaattactccttctcaccttttacaatcactccaataaagttttcatcctgtcatttacaagatcatcctgcccctcttctttttgttctttctcttgcattcttccacctgcatactccttagggtcattcctcaatcctaaataaatgtaatcatgtccaattcttttttttttttttttttgagacagagtctcgctctgttgcccaggctggagtgcagtgacacaatctcagcttactgcaacctcctccacctcccaggttcaaacaattctcctgccccagcatcccg

SEQ ID NO: 194018 - DNA, 601 bp, Human
catgttcctcagaacactaggagctgtgggatgataacatgtgcttatattagaccataatctcataaatgtaggaacactgggtgactttattctactctaggaccagtggccagcagagtactcaaaacatactaccatagcacacatttactgcatgcttgttgaatgaatgaacaaatgaatgaatggacaagtatatttgggaaaagctgggttaaacaacatcaaattggttccttgtatgcatttctcaggggctttaataggtgaatcatatagaatgcagcgcttcccaacytcatttgatcatagaacttactctatttcccctgaacctcgttaacatctcccagagttgtagtctataaaacacagattgggaaacatctgaggcttacataatgtaagtcatttttactatcatgaaatacgtaagttatcttactttttattcataaggcagtaaaacggctaagtaacttgattcatacctagtatgtagctgtcgtctcctggcatcctagcagcagctgtcctgtctcattcctctgcccttctccctgcttccacataactactctgtcctgaaaatccttcc

SEQ ID NO: 194019 - DNA, 601 bp, Human
tcagatcctaagatctggtttttacaaagacgaagaagcaaggcaagctaaaatggaagagagaaaagaccaactgattctgagaggaaaatactaaagcagaaaaaacatttcactagataacagaacgcagttcacagcctggactctgaaaacagcctaaaatggaagctttgctctgctccttattagttgtataaacaccgacaattacctctctgagcttgcttcctgatttataaaatagggtaataattatgacttcacagagttgtaagaattaaataagcaaatatacatraagtgcttagtatggcacatggattatagtaattactcagcattagtgatgatgatgatagtggtagtggtggtggtgctgctgatccttaagtcaatcctgctattgttgattaaattggcaaaggccatagtatctcactgagtctgttgagtctgcttaattttttttttaattttcaagcatttcaagttgtcccttcttaccaagaaagaaatgagcacagaaccagaacctagagccagaagagctgggttctgtccctggttctgcaactaactagctgggtgatcttgggtg

SEQ ID NO: 194020 - DNA, 601 bp, Human
aatgtaagagaaataacagcctttattataaaaagaagaggggtgggatgatattgtaaatgacaagatcaaaactttattggggtgactgcaaaaggggaggaggagtaattaaaatggtttcagaaagctcataataagactatgggttttacagagaagaaatagtagaagcaaatattggatgaatgctacctgacatagaataaacaaatcagatcctaagatctggtttttacaaagacgaagaagcaaggcaagctaaaatggaagagagaaaagaccaactgattctgagagraaaatactaaagcagaaaaaacatttcactagataacagaacgcagttcacagcctggactctgaaaacagcctaaaatggaagctttgctctgctccttattagttgtataaacaccgacaattacctctctgagcttgcttcctgatttataaaatagggtaataattatgacttcacagagttgtaagaattaaataagcaaatatacataaagtgcttagtatggcacatggattatagtaattactcagcattagtgatgatgatgatagtggtagtggtggtggtgctgctgat

SEQ ID NO: 194021 - DNA, 601 bp, Human
ttcattaaaaaacataaatcagtctatgtcatcagccctgctaaaatcctccaacgcctacccaatgcacttaaactaaaacccatactccttaacctagtatatgacctacttctctaaccgcatctagtaccactccccaatggcccactatgattcaaccacaccagccttcttcctattcttcaaacactgcaaactcatggctggggtcttggcacataatgttctctctacctggaagagtgctccattttctttctccctcctccccacccatttctctcttgcagttttcttyttataactcaaattttagtttaaattcacttccacaaaaaaagaccttcctttgactacccagtctaaagtagacagccagttattctcactatgttatcctgttttaattctttccatggtacttatctctgtgtgacacttttcttgattatgtgttgtttttcttgtgcactctccccactggttgtaagtttcacaggaaaggaacctgttctgtgcattcaccactgggtcctcagctcctaaagcagttccttcacatattattcattaaatactcagattgaattggacatga

SEQ ID NO: 194022 - DNA, 601 bp, Human
tccttataatcatttttccatgcatcagtaaatacattcattaaaaaacataaatcagtctatgtcatcagccctgctaaaatcctccaacgcctacccaatgcacttaaactaaaacccatactccttaacctagtatatgacctacttctctaaccgcatctagtaccactccccaatggcccactatgattcaaccacaccagccttcttcctattcttcaaacactgcaaactcatggctggggtcttggcacataatgttctctctacctggaagagtgctccattttctttctcyctcctccccacccatttctctcttgcagttttcttcttataactcaaattttagtttaaattcacttccacaaaaaaagaccttcctttgactacccagtctaaagtagacagccagttattctcactatgttatcctgttttaattctttccatggtacttatctctgtgtgacacttttcttgattatgtgttgtttttcttgtgcactctccccactggttgtaagtttcacaggaaaggaacctgttctgtgcattcaccactgggtcctcagctcctaaagcagttccttcacat

SEQ ID NO: 194023 - DNA, 601 bp, Human
gcatgttctttggactgtacccctaaatatttcctgaacctattcaagattctcattcttcactactctcccatgagtgcaatagattgattggaataatggccccaatttttcatatctccttgtatcttttcacacctgtctgaattcctgttctttggcaatgccctcccacactgactatggatatacctatgtaacttactttgaccaatgggacagtagcaaacttgacacaagctgagtccttaaaacgtgtgcgtttgtttctacttcctctcttgcttctttgcgatcaccrtgagaatccaactgtccagcctgagggtaagcccaaactagcctactagagggatgtaatgtacatatggaggagagcagagttgatccagacatctcagctgagaccatccctatactagttgacagccagctggcccctcaaacatatcagagaacccaggcaatattgcagagctgcctacctaacccacagtggaccacagacacatgggcaagcccagttaagatcaaccaagcccagccaagatcagcagaattacccagacatcctatactcatgagcaaaaataaatcctaa

SEQ ID NO: 194024 - DNA, 601 bp, Human
cccaaagacctatggcttcacaaaggaagtaattacctttggagattccaacttcatctgatttaagccctgcttcttgacttcatgatctttctgctaaccctgagctgaaatgtctcagattactataactaagaattactaagaccctggcaggtgtcctttcagtattatttctgccaaatcagaaggctgtacatggcagagtgggaaaactgtagttttcagttcacagcacaaattatacaagtagacactaatattttaaactagtgaaatagaaaagcacattcaaagcacratgtgagtcttatcagttacgcatagactagaagacttcagggtgactggctgatggatttcagtagatcccagccaaggcatgcatcctggaattccagctgagccatctataggctgataactccaaaatctacatctttagctttgacattctccagaacctcagattgctgtatccaactgcaaccctaacatctttatttaaatatctagcaggtatctcaaacacaacaccacttaacacagagctctagatagtcccctaaattttgctcttcatccagtatccaagtaaatg

SEQ ID NO: 194025 - DNA, 601 bp, Human
gaacacagtcaattagccttgagtcttccacaggagacacaggtcacactgcagactgatacactctctctggatatgtccaacacagtatcagcagaaatgtccagaagcactggaagttctatcagttagcttttgattagaacaaaaacaaaacccactccataattagtggtgtacaaataataaaaacatattgtttctcatgattctgcaggtcagttgggctttcctggcctggatatctagggtggcctcattcacgcttctggcaattataagctatcagccagggcacacrtggcttcttgaacaggacaacttgggcttgctcctacagtcctcagggtcctaagtgcagtaagagagagcacgcacccagtacacagcacattgcatgtctctgaatgctttacatttatttgctcttgtttcactggcaaaagcaagtcacaagcccagcgtcagtacgggaggtgactactcaaggtgagcagacactgggaggggaatgatgcaggcctttttgcaaacaatccagcccacagaataatcaattttaggttttctggtttgggactaaagtatctggcatgggcct

SEQ ID NO: 194026 - DNA, 601 bp, Human
cacctgtaatcccagctactcgggaggctgtggcacaagaatcacttgaacacgggaggtagagagtgcagtgagccgagatcacgccactgcactccagcctgcgtaacaagagtgatactccatctcaaaacaagaaaaattatttttacggatttatcatttttatcttgtctacctacagagagaaattgagacatgtttcaataaaaaaaaatgcaggaacaaaatttaaccaaggaagaatgagatttttgcacggcaaactacaaaacattgtagaaataaatttaaaaagacytaaataaatggaaagacatcccacattcgtggatgaaagacatgatattgttaaaatggcaatgcttcccaaatggatctacagattcaatgaattctctattaaaatcccaacaaccttttctgcagaactggacaaggtgattctaaaacccatatagtaaaattaatagacaaaactatcttgaaaaaaaaaaaagaacaaaattggaggactcacactcccaattttaaaatttactctaatggcatagcaatcaaaactgtgtagtactccataaggatagatatatagatcaac

SEQ ID NO: 194027 - DNA, 601 bp, Human
ctctattaaaaatacaaaattatcccggcatggtggcacacacctgtaatcccagctactcgggaggctgtggcacaagaatcacttgaacacgggaggtagagagtgcagtgagccgagatcacgccactgcactccagcctgcgtaacaagagtgatactccatctcaaaacaagaaaaattatttttacggatttatcatttttatcttgtctacctacagagagaaattgagacatgtttcaataaaaaaaaatgcaggaacaaaatttaaccaaggaagaatgagatttttgcacrgcaaactacaaaacattgtagaaataaatttaaaaagacctaaataaatggaaagacatcccacattcgtggatgaaagacatgatattgttaaaatggcaatgcttcccaaatggatctacagattcaatgaattctctattaaaatcccaacaaccttttctgcagaactggacaaggtgattctaaaacccatatagtaaaattaatagacaaaactatcttgaaaaaaaaaaaagaacaaaattggaggactcacactcccaattttaaaatttactctaatggcatagcaatcaa

SEQ ID NO: 194028 - DNA, 601 bp, Human
aaatagctgaagagctacattaaaaacatttactttgggccaagcaccgtggctcatgcctgtaatcccagcactttgggaggcagaggagggtagatcacttgaggtcaggagtttgagaccggcctgaccagcatggtgaaacccatctctattaaaaatacaaaattatcccggcatggtggcacacacctgtaatcccagctactcgggaggctgtggcacaagaatcacttgaacacgggaggtagagagtgcagtgagccgagatcacgccactgcactccagcctgcgtaacargagtgatactccatctcaaaacaagaaaaattatttttacggatttatcatttttatcttgtctacctacagagagaaattgagacatgtttcaataaaaaaaaatgcaggaacaaaatttaaccaaggaagaatgagatttttgcacggcaaactacaaaacattgtagaaataaatttaaaaagacctaaataaatggaaagacatcccacattcgtggatgaaagacatgatattgttaaaatggcaatgcttcccaaatggatctacagattcaatgaattctctattaaaatccc

SEQ ID NO: 194029 - DNA, 601 bp, Human
gactagaaatctagtatcctcattccccgacttctaggaaaaaagtctggctacattaaaatagctgaagagctacattaaaaacatttactttgggccaagcaccgtggctcatgcctgtaatcccagcactttgggaggcagaggagggtagatcacttgaggtcaggagtttgagaccggcctgaccagcatggtgaaacccatctctattaaaaatacaaaattatcccggcatggtggcacacacctgtaatcccagctactcgggaggctgtggcacaagaatcacttgaacacrggaggtagagagtgcagtgagccgagatcacgccactgcactccagcctgcgtaacaagagtgatactccatctcaaaacaagaaaaattatttttacggatttatcatttttatcttgtctacctacagagagaaattgagacatgtttcaataaaaaaaaatgcaggaacaaaatttaaccaaggaagaatgagatttttgcacggcaaactacaaaacattgtagaaataaatttaaaaagacctaaataaatggaaagacatcccacattcgtggatgaaagacatgatattgtta

SEQ ID NO: 194030 - DNA, 601 bp, Human
agactagaaatctagtatcctcattccccgacttctaggaaaaaagtctggctacattaaaatagctgaagagctacattaaaaacatttactttgggccaagcaccgtggctcatgcctgtaatcccagcactttgggaggcagaggagggtagatcacttgaggtcaggagtttgagaccggcctgaccagcatggtgaaacccatctctattaaaaatacaaaattatcccggcatggtggcacacacctgtaatcccagctactcgggaggctgtggcacaagaatcacttgaacaygggaggtagagagtgcagtgagccgagatcacgccactgcactccagcctgcgtaacaagagtgatactccatctcaaaacaagaaaaattatttttacggatttatcatttttatcttgtctacctacagagagaaattgagacatgtttcaataaaaaaaaatgcaggaacaaaatttaaccaaggaagaatgagatttttgcacggcaaactacaaaacattgtagaaataaatttaaaaagacctaaataaatggaaagacatcccacattcgtggatgaaagacatgatattgtt

SEQ ID NO: 194031 - DNA, 601 bp, Human
ttataaatgaataaataaaagctaagatgatatagccaaaattataaacataataataacacctttgagactagaaatctagtatcctcattccccgacttctaggaaaaaagtctggctacattaaaatagctgaagagctacattaaaaacatttactttgggccaagcaccgtggctcatgcctgtaatcccagcactttgggaggcagaggagggtagatcacttgaggtcaggagtttgagaccggcctgaccagcatggtgaaacccatctctattaaaaatacaaaattatccyggcatggtggcacacacctgtaatcccagctactcgggaggctgtggcacaagaatcacttgaacacgggaggtagagagtgcagtgagccgagatcacgccactgcactccagcctgcgtaacaagagtgatactccatctcaaaacaagaaaaattatttttacggatttatcatttttatcttgtctacctacagagagaaattgagacatgtttcaataaaaaaaaatgcaggaacaaaatttaaccaaggaagaatgagatttttgcacggcaaactacaaaacattgtagaaat

SEQ ID NO: 194032 - DNA, 601 bp, Human
ttactattactattaatcgctaaaacattaaaatggacagagtagatggcactttgacaggtacaattttataaatgaataaataaaagctaagatgatatagccaaaattataaacataataataacacctttgagactagaaatctagtatcctcattccccgacttctaggaaaaaagtctggctacattaaaatagctgaagagctacattaaaaacatttactttgggccaagcaccgtggctcatgcctgtaatcccagcactttgggaggcagaggagggtagatcacttgagrtcaggagtttgagaccggcctgaccagcatggtgaaacccatctctattaaaaatacaaaattatcccggcatggtggcacacacctgtaatcccagctactcgggaggctgtggcacaagaatcacttgaacacgggaggtagagagtgcagtgagccgagatcacgccactgcactccagcctgcgtaacaagagtgatactccatctcaaaacaagaaaaattatttttacggatttatcatttttatcttgtctacctacagagagaaattgagacatgtttcaataaaaaaaaat

SEQ ID NO: 194033 - DNA, 601 bp, Human
acacgtgtatacacacatacacatacacacacaaacacacatacacaaaaaaatcacacagtcctttaaagcttcaccccacccagtatttaatttcattaagtaagtttatacacagaaaacacttagaatagttacctggcacatagatgccatttaagtgcttgctatcagtattactgttttaacttaatcttcatagcattactattactattaatcgctaaaacattaaaatggacagagtagatggcactttgacaggtacaattttataaatgaataaataaaagctaagatratatagccaaaattataaacataataataacacctttgagactagaaatctagtatcctcattccccgacttctaggaaaaaagtctggctacattaaaatagctgaagagctacattaaaaacatttactttgggccaagcaccgtggctcatgcctgtaatcccagcactttgggaggcagaggagggtagatcacttgaggtcaggagtttgagaccggcctgaccagcatggtgaaacccatctctattaaaaatacaaaattatcccggcatggtggcacacacctgtaatccca

SEQ ID NO: 194034 - DNA, 601 bp, Human
caaacttctcaattgagaggtgaaataattaaagcccaaacaggcagagttgagagatatcacctccctccctttgttcattaatacagttattaatatcttaatctttaaaaattaggccgagcacagtggctcacgcctgtaaccccagcacttccggaggccgaggcgggagtatcacgaggtgaggatattcagaccatcctggccaacatggtgaaaccccatctctactaaaaatacaaaaatttgctgggtgtggtggtgcgtgtctgtaatcccagctactcaggaggctgargcaggagaatcgctttaaccagggagtcggaggttgcagtgagccgagatcgcgccacggcactgcagcctggcaacacaacgagagtccttctccaggaaaaaaaaaaaaaaaattaaacattgactataactattgtttgagaactctagattaaaattatgagttttccaaatgtcatccaaaaagacttcacgtacacgtgtatacacacatacacatacacacacaaacacacatacacaaaaaaatcacacagtcctttaaagcttcaccccacccagtatttaatttcattaa

SEQ ID NO: 194035 - DNA, 601 bp, Human
acatccttcttctcaaataccacacacaggacagagagatatcatatctaagccattagacagctgactatgagagctaggcactctaagattagagatcattggattcaaacttctcaattgagaggtgaaataattaaagcccaaacaggcagagttgagagatatcacctccctccctttgttcattaatacagttattaatatcttaatctttaaaaattaggccgagcacagtggctcacgcctgtaaccccagcacttccggaggccgaggcgggagtatcacgaggtgaggatrttcagaccatcctggccaacatggtgaaaccccatctctactaaaaatacaaaaatttgctgggtgtggtggtgcgtgtctgtaatcccagctactcaggaggctgaggcaggagaatcgctttaaccagggagtcggaggttgcagtgagccgagatcgcgccacggcactgcagcctggcaacacaacgagagtccttctccaggaaaaaaaaaaaaaaaattaaacattgactataactattgtttgagaactctagattaaaattatgagttttccaaatgtcatccaaaaagact

SEQ ID NO: 194036 - DNA, 601 bp, Human
attaccatgtgatcagtgctagaccacagatggttacaagcttcaactctgcctggagataagaggtggagagatcactcttaggtgggaattgaacaatgagaacagttggacacagggcggggaacaacgcacactggggcctgttgggggttggggatctggtgggggaatagaattaggagaaacacctaatgtaaatgacaagttgatgggtgcagcaaaccaacatgacacatgtatacctatgtaacaaacctgcatgttgtgcacatgtaccctagaacttaaagtataattaaaaaaaaaaaaaaaagaggtagagagataaccagcaaaggtgatgcctgggctgggctaaaaagctgagtaagttggtagatggcaaggcaaaggcacatcccaggccaagggctcagtgttgtgaaatacaagatgagtatgaagaaatacaaaaagtaagaaacagcttatattaatttaaatatatccattttaatactccttcctctccccacactcaatccacatatacacgtttctactatttaaaagaaactaaaaccctgtattactccattttcacactgctgataaagac

SEQ ID NO: 194037 - DNA, 601 bp, Human
aagatactcataccctagtaaaagggacagacacaacagaagctaacaatttcattaccatgtgatcagtgctagaccacagatggttacaagcttcaactctgcctggagataagaggtggagagatcactcttaggtgggaattgaacaatgagaacagttggacacagggcggggaacaacgcacactggggcctgttgggggttggggatctggtgggggaatagaattaggagaaacacctaatgtaaatgacaagttgatgggtgcagcaaaccaacatgacacatgtatacctrtgtaacaaacctgcatgttgtgcacatgtaccctagaacttaaagtataattaaaaaaaaaaaaaaaagaggtagagagataaccagcaaaggtgatgcctgggctgggctaaaaagctgagtaagttggtagatggcaaggcaaaggcacatcccaggccaagggctcagtgttgtgaaatacaagatgagtatgaagaaatacaaaaagtaagaaacagcttatattaatttaaatatatccattttaatactccttcctctccccacactcaatccacatatacacgtttctactat

SEQ ID NO: 194038 - DNA, 601 bp, Human
tgaacacctgctaaatgccagatatgttatcaaaataaaacataaaacatggccattaagatactcataccctagtaaaagggacagacacaacagaagctaacaatttcattaccatgtgatcagtgctagaccacagatggttacaagcttcaactctgcctggagataagaggtggagagatcactcttaggtgggaattgaacaatgagaacagttggacacagggcggggaacaacgcacactggggcctgttgggggttggggatctggtgggggaatagaattaggagaaacamctaatgtaaatgacaagttgatgggtgcagcaaaccaacatgacacatgtatacctatgtaacaaacctgcatgttgtgcacatgtaccctagaacttaaagtataattaaaaaaaaaaaaaaaagaggtagagagataaccagcaaaggtgatgcctgggctgggctaaaaagctgagtaagttggtagatggcaaggcaaaggcacatcccaggccaagggctcagtgttgtgaaatacaagatgagtatgaagaaatacaaaaagtaagaaacagcttatattaatttaaatatatc

SEQ ID NO: 194039 - DNA, 601 bp, Human
tgtcacctgatgtccagtatcttatttcactcattatttttactggaaattctggccaaaaaccctgattttagtggaaggaacttaaacaggtaagtctgcttaacctggctgtaaatcttagctttgccatttatttgctgcataactttacacaagttacttaattccttagagactgctttcttatctgtaaaatgaggatgatgatgataccaactctaaaggattgtcatgagaagtaagagaaatgcacataaaattccttacacgcagcaaacactcaggaaagcaattggtyagttggtcattgcctcatctttattctgtattggttcacatttacacactcaacaactgctaactgaacacctgctaaatgccagatatgttatcaaaataaaacataaaacatggccattaagatactcataccctagtaaaagggacagacacaacagaagctaacaatttcattaccatgtgatcagtgctagaccacagatggttacaagcttcaactctgcctggagataagaggtggagagatcactcttaggtgggaattgaacaatgagaacagttggacacagggcgggga

SEQ ID NO: 194040 - DNA, 601 bp, Human
tttagcccccaaatgtaattattctacgtagcttgatctagaaacccacttgttcctcattttactactgtgttaaacagaaaattcaaccactgagagggcaggcctgtaccttttgatatattaaaagacccaatttttaatctatttcctgagactgctggagaagacataagcaatggttctttaaacatcatcccgaagatcttttttttcctgatgtcacctgatgtccagtatcttatttcactcattatttttactggaaattctggccaaaaaccctgattttagtggaagkaacttaaacaggtaagtctgcttaacctggctgtaaatcttagctttgccatttatttgctgcataactttacacaagttacttaattccttagagactgctttcttatctgtaaaatgaggatgatgatgataccaactctaaaggattgtcatgagaagtaagagaaatgcacataaaattccttacacgcagcaaacactcaggaaagcaattggtcagttggtcattgcctcatctttattctgtattggttcacatttacacactcaacaactgctaactgaacacctgctaaat

SEQ ID NO: 194041 - DNA, 601 bp, Human
aattagcaaagtcttggaatcataagttaacaaacaacttacaggatccttttttctcagagatgcccctgatgatgaattctgtcctatgcaggaagttctttttttctgagggggaccagaagctcagagatactatctccaatgtgtgaagtgatggtatttcaaccaagctctcatgctcttgtctctttaatatgacaagtttttatctaccattattctaaattttctattaatatataaagtgagcctcatgatgtaaaggaacactctctgcccttaactgacaaagcaactraggaccaaacttacaaactctgtgggtcttgtgatatctgtaagattaatggggctgaggctgatgagctctaatgttgtctttagcccccaaatgtaattattctacgtagcttgatctagaaacccacttgttcctcattttactactgtgttaaacagaaaattcaaccactgagagggcaggcctgtaccttttgatatattaaaagacccaatttttaatctatttcctgagactgctggagaagacataagcaatggttctttaaacatcatcccgaagatcttttttttcctg

SEQ ID NO: 194042 - DNA, 601 bp, Human
atcagtgggcaaatctgaaagaaaactcttatttcaaaagccacacagataaggagggaccattgtatattcatttgcatcttaaattagcaaagtcttggaatcataagttaacaaacaacttacaggatccttttttctcagagatgcccctgatgatgaattctgtcctatgcaggaagttctttttttctgagggggaccagaagctcagagatactatctccaatgtgtgaagtgatggtatttcaaccaagctctcatgctcttgtctctttaatatgacaagtttttatctacyattattctaaattttctattaatatataaagtgagcctcatgatgtaaaggaacactctctgcccttaactgacaaagcaactgaggaccaaacttacaaactctgtgggtcttgtgatatctgtaagattaatggggctgaggctgatgagctctaatgttgtctttagcccccaaatgtaattattctacgtagcttgatctagaaacccacttgttcctcattttactactgtgttaaacagaaaattcaaccactgagagggcaggcctgtaccttttgatatattaaaagaccca

SEQ ID NO: 194043 - DNA, 601 bp, Human
gcttgctggtatttacttcagaagccaaatctcaaaggtaacagaagcgtctacttcagatctttcaccatgtgtagttcctcctactatcagtgggcaaatctgaaagaaaactcttatttcaaaagccacacagataaggagggaccattgtatattcatttgcatcttaaattagcaaagtcttggaatcataagttaacaaacaacttacaggatccttttttctcagagatgcccctgatgatgaattctgtcctatgcaggaagttctttttttctgagggggaccagaagctcrgagatactatctccaatgtgtgaagtgatggtatttcaaccaagctctcatgctcttgtctctttaatatgacaagtttttatctaccattattctaaattttctattaatatataaagtgagcctcatgatgtaaaggaacactctctgcccttaactgacaaagcaactgaggaccaaacttacaaactctgtgggtcttgtgatatctgtaagattaatggggctgaggctgatgagctctaatgttgtctttagcccccaaatgtaattattctacgtagcttgatctagaaaccc

SEQ ID NO: 194044 - DNA, 601 bp, Human
acccagaacactgcctgaaatatattgggtattcggtaagtatttatcggatgacaatgatttcactttatctagcttgctggtatttacttcagaagccaaatctcaaaggtaacagaagcgtctacttcagatctttcaccatgtgtagttcctcctactatcagtgggcaaatctgaaagaaaactcttatttcaaaagccacacagataaggagggaccattgtatattcatttgcatcttaaattagcaaagtcttggaatcataagttaacaaacaacttacaggatcctttttyctcagagatgcccctgatgatgaattctgtcctatgcaggaagttctttttttctgagggggaccagaagctcagagatactatctccaatgtgtgaagtgatggtatttcaaccaagctctcatgctcttgtctctttaatatgacaagtttttatctaccattattctaaattttctattaatatataaagtgagcctcatgatgtaaaggaacactctctgcccttaactgacaaagcaactgaggaccaaacttacaaactctgtgggtcttgtgatatctgtaagattaatgggg

SEQ ID NO: 194045 - DNA, 601 bp, Human
cgtcaattttcttccttccctcaaatgtttcctcttcttcactcaaccatctttttaccattttcagttcatgagctaatttgtccacagaaataatttgagacattcatgattatttattctgacatttattgcacagtcatgatgtattaggaaccatgcatgaggcactaaggtggttaacaaagatgaacaagaaatgatctttgttctagagaagaatgggaaaagagtaccttaaaaacaacgcatgacattacaatctattaaggactttaaaagtggtaatgtgcagtgtctkgctacattggtaaaataagtcaatgtccaatttcttccagtgctgtgtgaaattctgaaaatcaaatttacttatataagcaatatggacccacaacaaaataaattaatgtttgtgtacatgttacacgtatacataaatctcaattccattacatatcaatttctcaaaagcatatttccaagtcttcttttccctctgagtattctgtcttacacaagccacacaaaataaaatataatatttggcctgatctagcacccagaacactgcctgaaatatattgggtattcggtaagt

SEQ ID NO: 194046 - DNA, 601 bp, Human
ctcttatcctcgtcaattttcttccttccctcaaatgtttcctcttcttcactcaaccatctttttaccattttcagttcatgagctaatttgtccacagaaataatttgagacattcatgattatttattctgacatttattgcacagtcatgatgtattaggaaccatgcatgaggcactaaggtggttaacaaagatgaacaagaaatgatctttgttctagagaagaatgggaaaagagtaccttaaaaacaacgcatgacattacaatctattaaggactttaaaagtggtaatgygcagtgtcttgctacattggtaaaataagtcaatgtccaatttcttccagtgctgtgtgaaattctgaaaatcaaatttacttatataagcaatatggacccacaacaaaataaattaatgtttgtgtacatgttacacgtatacataaatctcaattccattacatatcaatttctcaaaagcatatttccaagtcttcttttccctctgagtattctgtcttacacaagccacacaaaataaaatataatatttggcctgatctagcacccagaacactgcctgaaatatattgggta

SEQ ID NO: 194047 - DNA, 601 bp, Human
tcattcttgtttcattcatctcttatcctcgtcaattttcttccttccctcaaatgtttcctcttcttcactcaaccatctttttaccattttcagttcatgagctaatttgtccacagaaataatttgagacattcatgattatttattctgacatttattgcacagtcatgatgtattaggaaccatgcatgaggcactaaggtggttaacaaagatgaacaagaaatgatctttgttctagagaagaatgggaaaagagtaccttaaaaacaacgcatgacattacaatctattaagractttaaaagtggtaatgtgcagtgtcttgctacattggtaaaataagtcaatgtccaatttcttccagtgctgtgtgaaattctgaaaatcaaatttacttatataagcaatatggacccacaacaaaataaattaatgtttgtgtacatgttacacgtatacataaatctcaattccattacatatcaatttctcaaaagcatatttccaagtcttcttttccctctgagtattctgtcttacacaagccacacaaaataaaatataatatttggcctgatctagcacccagaacact

SEQ ID NO: 194048 - DNA, 601 bp, Human
cagaagtttaccaggacatataatatatgatagcattcttgaccacctcattcttgtttcattcatctcttatcctcgtcaattttcttccttccctcaaatgtttcctcttcttcactcaaccatctttttaccattttcagttcatgagctaatttgtccacagaaataatttgagacattcatgattatttattctgacatttattgcacagtcatgatgtattaggaaccatgcatgaggcactaaggtggttaacaaagatgaacaagaaatgatctttgttctagagaagaatgkgaaaagagtaccttaaaaacaacgcatgacattacaatctattaaggactttaaaagtggtaatgtgcagtgtcttgctacattggtaaaataagtcaatgtccaatttcttccagtgctgtgtgaaattctgaaaatcaaatttacttatataagcaatatggacccacaacaaaataaattaatgtttgtgtacatgttacacgtatacataaatctcaattccattacatatcaatttctcaaaagcatatttccaagtcttcttttccctctgagtattctgtcttacacaagcca

SEQ ID NO: 194049 - DNA, 601 bp, Human
gccagccattacatacctgatccctaacaggaaaaaaaaaactgttaaaaacactaatttgatagaaaacattctcatagatgatttgtaacaaataaaaattatcaactatactcaaaaagtatcatggatgtatgtcataatctaactactgtttggaaagtgtctaatgacattgtcatatgtcccatctctgaggaagtaaattgataatgaactttcctgttctttgctctattcatcattgtcattatctggtccacttataatatgtagtgctgctgtttctgttttttttttwaaatacctgtaaattcactgacactcttctcatgggtctatgtcacctccccttgaattggagtaggcttatgactcctttgactaatacagtatagtagaaatgtcttgagactaggacataaaagcccaagtagccctgcttgatttttttggacgtctagctctttgaatattctccctcttggaacccagccaccatactgagaaaagctcactgcaaggagagaaatcacatacagttctattgcagaattactgctgagcccagccttcaaatcatctcagcctagaagccaga

SEQ ID NO: 194050 - DNA, 601 bp, Human
attaaaataagaaaataggccaggtgcggtgacttacgcctgtaatcccaccacttgggaggctgaggtgggcagatcactttaggccaggagttcgagaccagcctggccaacatggcaaaaccctatctctactgaaaatacagtcgtgttggcatgcacctatagtcccagctacttgggaggctaaggcatgcaaatagcttgaacccgggaggcagaggttgcagtgagccaagatcgtgcgactgcacttcagcctgggtgttggagtaagactctgtctcaaaaaaaaaaaaaragagagagagaaaataataatttttaaaaaaatagctggtgactagaacagcctatcctagtcaatatgacttttcatactattttaagtcaagagaacagaggtgctaaatgggaaagaaaatcagagacaaaagaaaacaaaagtgactgtgagttaccaaatgatattatggaatggactatagtaaataagaaaaaaagggccctgataacagagtggggaaaggatggactatttataagagcaagcaaagagtgattagaggttgttgaaattctcatcttattaggttaagtc

SEQ ID NO: 194051 - DNA, 601 bp, Human
agcttttttttttgtttttttttgagacggagtctcgctctgtcgcccagactggagtgcagtggcgcaatctcggctcatggcaagctccacctcccgggttcacgccattctcctgcctcagcctcccgagtagctgggactacaggcgcccgccactacgcccggttaatttttttgtatttttagtagagacagggtttcaccgtgttagccaggatggtctcgatctcctgacctcgtgatccacccgtcgcggcctcccaaagtgctgggattacaggcgtgagccaccgcgccrggccacaaacatcttttttaaataaaactcgactgcaacataaaccccttttctatctcattggagttgaacacaagagtactattccctttgccttggcggctaactgctaaaattctgaacattttaacacattgtctttgaacactaatattctgaggtagacaacagaaactgtcactgtatcaccggtgagaaacacaaaccaccaaagttatactgtctatccagcgttgcaaatctgaatatctgactaatactcagtttcacagtccagcaattttagccaacagttcttaa

SEQ ID NO: 194052 - DNA, 601 bp, Human
aaaagtaaacatcattgtcctgagaggtcaatctaataaccttttgataagatcagtgaaatccggaggaataagcagaccataggggaatccaggagtatccctatggaattactattcacacagaaaaataataaaaaatcattatcattatcattattaagcttttactacttggcactgtcccaatcactaagcactttcaatgtattgaatcacttcattctctcaacaaccttctgaagtatgtactagtactgtctacactttacacatcacaaggtaagaataagagccaggytttaatttaggcaatacaattgcagggcctacactcttcactacactatacaacttctctagtggaaaggaaggtggaatggaaggaaaaagtttaatgaggtgtcacttccagtctcctagtttaggagactgctaagtgcaattggattcaatctccagatttcaacagagatagcctatgactttcagggcatcattaagagccacaacaaactcttaatacgaaaattgaagggagatgtcccctctgagaaagaaaataataggtttgatgttctaaattttaaaatgaagatga

SEQ ID NO: 194053 - DNA, 601 bp, Human
gatttataataagttagtaaaatttagccaattttaaaaaacaaaataattccaaaggaaaacaaaaaattgtttagaaaaggaaaaataatcacaggtatgctacagagttctgctacaaataacaactacaccgtcataatcaggtaaacaatagtgataatcttactaccaatataaatacattgggtgtgagagcaggaagtatgctcccgtgtgggtgggggagtactttatgaaagagagctatttcctccatggtagtaggaggagaaggaggaaaaggtagcagaggagaagraggaggaaaccaataaataatatctacaattgaaaaagcaagaagtagcaatgtaaagcatgtttagagactgtcaagagacaaaatgacaacaaatttagtaaaagtgacttttactcacaattcatgagtcagggtagcctctactctgtaaaatagaatgagagctcccactgggccagggcagaaccatggattttataaggtgggaacaaggaaacagaataataggaaaaaaaaaaagctgattagtaacatcaagttacttcaggttactttttttggtaaagattaaaacag

SEQ ID NO: 194054 - DNA, 601 bp, Human
agaataaagacgtttttcaaatatgcgcaaggctttaacaattttctcttatccacctttctcaaaaagctacttggggatgtagccaaaataccaaaacaaagcaggaaaccaaaaaagcaaaaaccacaagaatttaggaaacaaacattccaacataagaaagaggtaaagggaccccctcccccaatagatgatgaagggaaatcccaaaatgaatgacactgagcagctggccaagagtacaaccagtccggattggatcaagtaaggaggttcttccaaagaattcttctaggaracaaaactgaatgtatggggagaagatttataataagttagtaaaatttagccaattttaaaaaacaaaataattccaaaggaaaacaaaaaattgtttagaaaaggaaaaataatcacaggtatgctacagagttctgctacaaataacaactacaccgtcataatcaggtaaacaatagtgataatcttactaccaatataaatacattgggtgtgagagcaggaagtatgctcccgtgtgggtgggggagtactttatgaaagagagctatttcctccatggtagtaggaggagaag

SEQ ID NO: 194055 - DNA, 601 bp, Human
gaaagcaaagaaaacagaatgagaaaacaatcaaagaaaatttttaggaaaatttcttcaaactgaaggttattttcagattgaaatactaccaaattaaggcaactcttgtaaaatttcacaactatggggataagccaaatattaagcaagcttaaatgtaagtttcattgaaagcatcaaaattcagaatggtaatcatcaagggtaatgccagagagtagaagacaatgaagaaaaactcagaaagaaagtgatttctaatcaaaaattctatactcagccaaagtgccaatgaagygacaggagaataaagacgtttttcaaatatgcgcaaggctttaacaattttctcttatccacctttctcaaaaagctacttggggatgtagccaaaataccaaaacaaagcaggaaaccaaaaaagcaaaaaccacaagaatttaggaaacaaacattccaacataagaaagaggtaaagggaccccctcccccaatagatgatgaagggaaatcccaaaatgaatgacactgagcagctggccaagagtacaaccagtccggattggatcaagtaaggaggttcttccaaagaattctt

SEQ ID NO: 194056 - DNA, 601 bp, Human
aagccaaggatcaccccagacaattgaggaaaaattataatatgaatctaaggtcaaagaacaaatgcaaaaaaagggcaagttggaagaaacaaaagttgtacagaaaaaaagaaaatgttaaaaaaaaactcaacaaaatcaaagaattaagggaaatacatgcatgaaacaaggtcaagacacagccaaaataagaaatagagccaaaaaaacaggagctactagaaatcaaaaataaaatgacagaacttaaaaactcaatggaaaagttagaacataaaattgagaaactctcccaaaaaaaaaaaaaattaagacgcagaaaacataatggaattacagaactcactcagaaagttcagcatctaaaaaccagaagttccagaaagagaaagcaaagaaaacagaatgagaaaacaatcaaagaaaatttttaggaaaatttcttcaaactgaaggttattttcagattgaaatactaccaaattaaggcaactcttgtaaaatttcacaactatggggataagccaaatattaagcaagcttaaatgtaagtttcattgaaagcatcaaaattcagaatggtaatcatcaaggg

SEQ ID NO: 194057 - DNA, 601 bp, Human
aaatgagagaaagccaaggatcaccccagacaattgaggaaaaattataatatgaatctaaggtcaaagaacaaatgcaaaaaaagggcaagttggaagaaacaaaagttgtacagaaaaaaagaaaatgttaaaaaaaaactcaacaaaatcaaagaattaagggaaatacatgcatgaaacaaggtcaagacacagccaaaataagaaatagagccaaaaaaacaggagctactagaaatcaaaaataaaatgacagaacttaaaaactcaatggaaaagttagaacataaaattgagraactctcccaaaaaaaaaaaaaattaagacgcagaaaacataatggaattacagaactcactcagaaagttcagcatctaaaaaccagaagttccagaaagagaaagcaaagaaaacagaatgagaaaacaatcaaagaaaatttttaggaaaatttcttcaaactgaaggttattttcagattgaaatactaccaaattaaggcaactcttgtaaaatttcacaactatggggataagccaaatattaagcaagcttaaatgtaagtttcattgaaagcatcaaaattcagaatggtaa

SEQ ID NO: 194058 - DNA, 601 bp, Human
cttttttttttttttttttttaaagacaaggtctggctatgttgcccaggccggactcaaattcctgggcataagtgaacttcctgcctcagcctccccaagtagctgaaactacaggtgcacatgaccacgcccagctcaactgactttttaaagtcccactctgataaatgagagaaagccaaggatcaccccagacaattgaggaaaaattataatatgaatctaaggtcaaagaacaaatgcaaaaaaagggcaagttggaagaaacaaaagttgtacagaaaaaaagaaaatgttaaaaaaaaactcaacaaaatcaaagaattaagggaaatacatgcatgaaacaaggtcaagacacagccaaaataagaaatagagccaaaaaaacaggagctactagaaatcaaaaataaaatgacagaacttaaaaactcaatggaaaagttagaacataaaattgagaaactctcccaaaaaaaaaaaaaattaagacgcagaaaacataatggaattacagaactcactcagaaagttcagcatctaaaaaccagaagttccagaaagagaaagcaaagaaaacagaatgagaaaacaa

SEQ ID NO: 194059 - DNA, 601 bp, Human
gactataaaacacagggtctctatcctgggagagactaagtgcagctgcagctgggaataccacactgaaaaggaggagcttaagtgaaactgtacaagtgtccatatcaatgatgaggctagtcagctctcttctcccatctggctccaggacatcaggactggactaagggaaaagtcttgaagacacagacatagaagtgtccccaaaaaaatggcacagccagactaccctatagttaagcccacagtcagcaaggcccactaccatgcatgaagcttccaattgacactttttttkttttttttttttaaagacaaggtctggctatgttgcccaggccggactcaaattcctgggcataagtgaacttcctgcctcagcctccccaagtagctgaaactacaggtgcacatgaccacgcccagctcaactgactttttaaagtcccactctgataaatgagagaaagccaaggatcaccccagacaattgaggaaaaattataatatgaatctaaggtcaaagaacaaatgcaaaaaaagggcaagttggaagaaacaaaagttgtacagaaaaaaagaaaatgttaaaaaaaaa

SEQ ID NO: 194060 - DNA, 601 bp, Human
ttcggaagactataaaacacagggtctctatcctgggagagactaagtgcagctgcagctgggaataccacactgaaaaggaggagcttaagtgaaactgtacaagtgtccatatcaatgatgaggctagtcagctctcttctcccatctggctccaggacatcaggactggactaagggaaaagtcttgaagacacagacatagaagtgtccccaaaaaaatggcacagccagactaccctatagttaagcccacagtcagcaaggcccactaccatgcatgaagcttccaattgacacttttttttttttttttttttaaagacaaggtctggctatgttgcccaggccggactcaaattcctgggcataagtgaacttcctgcctcagcctccccaagtagctgaaactacaggtgcacatgaccacgcccagctcaactgactttttaaagtcccactctgataaatgagagaaagccaaggatcaccccagacaattgaggaaaaattataatatgaatctaaggtcaaagaacaaatgcaaaaaaagggcaagttggaagaaacaaaagttgtacagaaaaaaagaaaatgttaa

SEQ ID NO: 194061 - DNA, 601 bp, Human
aatagaaaacaaaaaaggaaacaacaatagaattttggaaactggaaaacaaataaatatgtgccaggtcccaccaaggggaaggctggaaacaacccaatttcttctgcaaaacatccaaatagctcaagaatcagaagaatatggtatctctagaagttgtgatggagaaggaattaaagcagaagaattgttggcaaatcagtttaataaagagagtccccgatcctctccacttccatgccatagatctaggtgactaaccctcctcaaccctggaagaaaactagaggtttatttyggaagactataaaacacagggtctctatcctgggagagactaagtgcagctgcagctgggaataccacactgaaaaggaggagcttaagtgaaactgtacaagtgtccatatcaatgatgaggctagtcagctctcttctcccatctggctccaggacatcaggactggactaagggaaaagtcttgaagacacagacatagaagtgtccccaaaaaaatggcacagccagactaccctatagttaagcccacagtcagcaaggcccactaccatgcatgaagcttccaattgacacttt

SEQ ID NO: 194062 - DNA, 601 bp, Human
ttaagttgaaaggaatcttagtcaccatctatctccctcaagaaactgaagttcagaaaagttaaatggcttactcaaggtcacacaagccaagactagaaaaaagtctcctagttcctacttacgggctttccctatccttctatcccatacaactaaagttcaccactgttgttataattcattggccaatgggaagtcctggccaagaaatctactaaagttcagagagatacaaatgaaggaaaagtctcctcatgtagacttccagccaaagatagagtgttgaatgcacacttcrcattggctccttcctgaaattccattaaaaacagttacattgttgttgttaaggaactgactctcaaggaaatagaaaacaaaaaaggaaacaacaatagaattttggaaactggaaaacaaataaatatgtgccaggtcccaccaaggggaaggctggaaacaacccaatttcttctgcaaaacatccaaatagctcaagaatcagaagaatatggtatctctagaagttgtgatggagaaggaattaaagcagaagaattgttggcaaatcagtttaataaagagagtccccgatcct

SEQ ID NO: 194063 - DNA, 601 bp, Human
tgcagtgagcaaagatcacgccattgtgctacagtctgagtgacagggcaagactctgtctcaaaaaaacaaaaaaaacaaaacaaaaaaaaaacaccttatctgacatatgtgtgattactactcttatacagaatcacaccatttaagttgaaaggaatcttagtcaccatctatctccctcaagaaactgaagttcagaaaagttaaatggcttactcaaggtcacacaagccaagactagaaaaaagtctcctagttcctacttacgggctttccctatccttctatcccatacaaytaaagttcaccactgttgttataattcattggccaatgggaagtcctggccaagaaatctactaaagttcagagagatacaaatgaaggaaaagtctcctcatgtagacttccagccaaagatagagtgttgaatgcacacttcgcattggctccttcctgaaattccattaaaaacagttacattgttgttgttaaggaactgactctcaaggaaatagaaaacaaaaaaggaaacaacaatagaattttggaaactggaaaacaaataaatatgtgccaggtcccaccaaggggaagg

SEQ ID NO: 194064 - DNA, 601 bp, Human
aatacaaaaactagctgggtgaggtggcgggtgcctgtagtcccagctacttgggaggctgaggcaggagaatcgtttgaaccggggaggcagaagctgcagtgagcaaagatcacgccattgtgctacagtctgagtgacagggcaagactctgtctcaaaaaaacaaaaaaaacaaaacaaaaaaaaaacaccttatctgacatatgtgtgattactactcttatacagaatcacaccatttaagttgaaaggaatcttagtcaccatctatctccctcaagaaactgaagttcagaamagttaaatggcttactcaaggtcacacaagccaagactagaaaaaagtctcctagttcctacttacgggctttccctatccttctatcccatacaactaaagttcaccactgttgttataattcattggccaatgggaagtcctggccaagaaatctactaaagttcagagagatacaaatgaaggaaaagtctcctcatgtagacttccagccaaagatagagtgttgaatgcacacttcgcattggctccttcctgaaattccattaaaaacagttacattgttgttgttaaggaact

SEQ ID NO: 194065 - DNA, 601 bp, Human
atgtgcggtggctcatgcctgtaatcctagcactttgggagaccaaggcaggaggatcacttgaggtcaggggttcaagaccagcctggtggaaatggtgaaactccatctctattaaaaatacaaaaactagctgggtgaggtggcgggtgcctgtagtcccagctacttgggaggctgaggcaggagaatcgtttgaaccggggaggcagaagctgcagtgagcaaagatcacgccattgtgctacagtctgagtgacagggcaagactctgtctcaaaaaaacaaaaaaaacaaaacaaaaaaaaaacaccttatctgacatatgtgtgattactactcttatacagaatcacaccatttaagttgaaaggaatcttagtcaccatctatctccctcaagaaactgaagttcagaaaagttaaatggcttactcaaggtcacacaagccaagactagaaaaaagtctcctagttcctacttacgggctttccctatccttctatcccatacaactaaagttcaccactgttgttataattcattggccaatgggaagtcctggccaagaaatctactaaagttcagagagatacaaat

SEQ ID NO: 194066 - DNA, 601 bp, Human
aatgtcctggggaaaaaaaatcaccttatctgtccatgtgcggtggctcatgcctgtaatcctagcactttgggagaccaaggcaggaggatcacttgaggtcaggggttcaagaccagcctggtggaaatggtgaaactccatctctattaaaaatacaaaaactagctgggtgaggtggcgggtgcctgtagtcccagctacttgggaggctgaggcaggagaatcgtttgaaccggggaggcagaagctgcagtgagcaaagatcacgccattgtgctacagtctgagtgacagggcragactctgtctcaaaaaaacaaaaaaaacaaaacaaaaaaaaaacaccttatctgacatatgtgtgattactactcttatacagaatcacaccatttaagttgaaaggaatcttagtcaccatctatctccctcaagaaactgaagttcagaaaagttaaatggcttactcaaggtcacacaagccaagactagaaaaaagtctcctagttcctacttacgggctttccctatccttctatcccatacaactaaagttcaccactgttgttataattcattggccaatgggaagtcctgg

SEQ ID NO: 194067 - DNA, 601 bp, Human
acttatatgcagttctagaagcaaaaggtctcaacatcaggggcagaaaaaacattcatgttgaatgtcctggggaaaaaaaatcaccttatctgtccatgtgcggtggctcatgcctgtaatcctagcactttgggagaccaaggcaggaggatcacttgaggtcaggggttcaagaccagcctggtggaaatggtgaaactccatctctattaaaaatacaaaaactagctgggtgaggtggcgggtgcctgtagtcccagctacttgggaggctgaggcaggagaatcgtttgaaccrgggaggcagaagctgcagtgagcaaagatcacgccattgtgctacagtctgagtgacagggcaagactctgtctcaaaaaaacaaaaaaaacaaaacaaaaaaaaaacaccttatctgacatatgtgtgattactactcttatacagaatcacaccatttaagttgaaaggaatcttagtcaccatctatctccctcaagaaactgaagttcagaaaagttaaatggcttactcaaggtcacacaagccaagactagaaaaaagtctcctagttcctacttacgggctttccctatcctt

SEQ ID NO: 194068 - DNA, 601 bp, Human
aggtttaaatgagatatgggcaagaactgactatgaaaatactacgcaaatgtttatcatttttaattccacggctatttgcctcgctcagaacattatgaccccacatctggaccatgagagtagcttcccaattggtcttcatttcctcaagttcttgcctgcttttattcaaactacctatccatcactcccattggatcaatcttcaaagattcagcattgccatttcactcatcagaaatcctgaatgcctccccacgacctgcagagtaaagctaaaattccttagtctgacackagagactgtccacattctggctgcagcctaccagtccatctttacttccaccacactccaatcaaaatagtcttccaaatctccggagattcccctcacagcattcattccctggcctagtggactctctgctttccacctgtgaagatataccagctcaaaattcccctccttgatgtagtctctcctaatggctcctattaattaaaagccttccaactcctgggccataatttctatcactcatcatagagctaatcatattctgctatgtctacagcaattaatgtacgtattttt

SEQ ID NO: 194069 - DNA, 601 bp, Human
ataaggttcctttacaacagcttctctctgaacatcagttccttcatttgtaaagtatggaaggaaagaccacaaggtcagtgtgaggtttaaatgagatatgggcaagaactgactatgaaaatactacgcaaatgtttatcatttttaattccacggctatttgcctcgctcagaacattatgaccccacatctggaccatgagagtagcttcccaattggtcttcatttcctcaagttcttgcctgcttttattcaaactacctatccatcactcccattggatcaatcttcaaagaktcagcattgccatttcactcatcagaaatcctgaatgcctccccacgacctgcagagtaaagctaaaattccttagtctgacacgagagactgtccacattctggctgcagcctaccagtccatctttacttccaccacactccaatcaaaatagtcttccaaatctccggagattcccctcacagcattcattccctggcctagtggactctctgctttccacctgtgaagatataccagctcaaaattcccctccttgatgtagtctctcctaatggctcctattaattaaaagcctt

SEQ ID NO: 194070 - DNA, 601 bp, Human
tgattggtcatcatccaatcaggcccctccattttctataaggttcctttacaacagcttctctctgaacatcagttccttcatttgtaaagtatggaaggaaagaccacaaggtcagtgtgaggtttaaatgagatatgggcaagaactgactatgaaaatactacgcaaatgtttatcatttttaattccacggctatttgcctcgctcagaacattatgaccccacatctggaccatgagagtagcttcccaattggtcttcatttcctcaagttcttgcctgcttttattcaaactrcctatccatcactcccattggatcaatcttcaaagattcagcattgccatttcactcatcagaaatcctgaatgcctccccacgacctgcagagtaaagctaaaattccttagtctgacacgagagactgtccacattctggctgcagcctaccagtccatctttacttccaccacactccaatcaaaatagtcttccaaatctccggagattcccctcacagcattcattccctggcctagtggactctctgctttccacctgtgaagatataccagctcaaaattcccctccttgatg

SEQ ID NO: 194071 - DNA, 601 bp, Human
ttcacaaaacagatgaccttacagacacagccaactcatgaacaaaatgaattagcatggtggtggatatgattcatactccagctctgataaggatgtaatctcaatgaagcatcctagttaccagtgccacagggatgttctctggtgtctacactaccatgctccagagttctcttccctatggctcctgtctccaccacaagagaaatggaaacctaccagtcatagttaacctgctcagggcagagtccacctggataagaaagtctcagccctttaactccagactattcatacstagactgagccttttaaaattcaacacaatttaactatctgaaaacccaaagacattcaaaaaaggcttgaagattcatatttgagacaagttgaattaacaacagcctctccttctcttgcctccactatgcctttaaagaagtaactgtggctgggcacagtggctcacgcctgttatcccagcactttgggcagatcactttaggtgaggagttcaagagcagcctggccaacatagcaaaacctcatctttactaaaataacaaaaattagctgggcatggtggcgcatgcctgta

SEQ ID NO: 194072 - DNA, 601 bp, Human
gctgatttacactggcatttgaattgcttcaggatcttggttcacaaaacagatgaccttacagacacagccaactcatgaacaaaatgaattagcatggtggtggatatgattcatactccagctctgataaggatgtaatctcaatgaagcatcctagttaccagtgccacagggatgttctctggtgtctacactaccatgctccagagttctcttccctatggctcctgtctccaccacaagagaaatggaaacctaccagtcatagttaacctgctcagggcagagtccacctggmtaagaaagtctcagccctttaactccagactattcatacctagactgagccttttaaaattcaacacaatttaactatctgaaaacccaaagacattcaaaaaaggcttgaagattcatatttgagacaagttgaattaacaacagcctctccttctcttgcctccactatgcctttaaagaagtaactgtggctgggcacagtggctcacgcctgttatcccagcactttgggcagatcactttaggtgaggagttcaagagcagcctggccaacatagcaaaacctcatctttactaa

SEQ ID NO: 194073 - DNA, 601 bp, Human
ccacccacaagccaggagtgtgctaaccacacatttgtctgtgccacgtgctcaccggccaggttttttagtgagctgctttctccctgctgccatcgaagaaactttgtagtagctgtttatcattaaaaaaatgaatgtttaaaaactctgctttaggtcaacttcgataacgtgttgagtccaccaaatcaccaaccagttttaagtaacttctacttaataaagaagaaatattcatataaagtaatggacttggatacaatttatatttgctaaagaagactttgatacataatargcggtttacaggagagagccatatgtacaatgcaccttacaaattccatgaggatctaaaagtaatgtaatctaatagattaattcataggttaattataataaacctataattaacagatttgttaatttctatccatactctgaaattcatctttcaagtccaaatgataataaatcattacttcattaacccaaagcattttcaataagattggagaggcaggcaatattataaaatcgttatctacatagaaagcagaaaagtaaatcgtgattgtctcttacctctgctcgaccc

SEQ ID NO: 194074 - DNA, 601 bp, Human
aaaaaaaaaaaaaaaaaactaaaccaggatcaccaacagtccactgaaaccaattgcataacagcatatggttagccatgggcaacccagcccctggtcatttcctggaaaccaaggatatttctagcagagaaggcagtatgtggcagtactagcaaatgccacacccaacatgtcagaagcaaaagaaccagaggtgattgcacattcaaggcctcatctagcagtggaaggagaagctaaagccacccacaagccaggagtgtgctaaccacacatttgtctgtgccacgtgctcacyggccaggttttttagtgagctgctttctccctgctgccatcgaagaaactttgtagtagctgtttatcattaaaaaaatgaatgtttaaaaactctgctttaggtcaacttcgataacgtgttgagtccaccaaatcaccaaccagttttaagtaacttctacttaataaagaagaaatattcatataaagtaatggacttggatacaatttatatttgctaaagaagactttgatacataataggcggtttacaggagagagccatatgtacaatgcaccttacaaattccatgaggat

SEQ ID NO: 194075 - DNA, 601 bp, Human
cagcctggcaacagagcaagacactgtctcaaaaaaaaaaaaaaaaaaaaactaaaccaggatcaccaacagtccactgaaaccaattgcataacagcatatggttagccatgggcaacccagcccctggtcatttcctggaaaccaaggatatttctagcagagaaggcagtatgtggcagtactagcaaatgccacacccaacatgtcagaagcaaaagaaccagaggtgattgcacattcaaggcctcatctagcagtggaaggagaagctaaagccacccacaagccaggagtgtgytaaccacacatttgtctgtgccacgtgctcaccggccaggttttttagtgagctgctttctccctgctgccatcgaagaaactttgtagtagctgtttatcattaaaaaaatgaatgtttaaaaactctgctttaggtcaacttcgataacgtgttgagtccaccaaatcaccaaccagttttaagtaacttctacttaataaagaagaaatattcatataaagtaatggacttggatacaatttatatttgctaaagaagactttgatacataataggcggtttacaggagagagccat

SEQ ID NO: 194076 - DNA, 601 bp, Human
gagatggaggttactgtgagccgagatcgcatcactgcactccagcctggcaacagagcaagacactgtctcaaaaaaaaaaaaaaaaaaaaactaaaccaggatcaccaacagtccactgaaaccaattgcataacagcatatggttagccatgggcaacccagcccctggtcatttcctggaaaccaaggatatttctagcagagaaggcagtatgtggcagtactagcaaatgccacacccaacatgtcagaagcaaaagaaccagaggtgattgcacattcaaggcctcatctagcrgtggaaggagaagctaaagccacccacaagccaggagtgtgctaaccacacatttgtctgtgccacgtgctcaccggccaggttttttagtgagctgctttctccctgctgccatcgaagaaactttgtagtagctgtttatcattaaaaaaatgaatgtttaaaaactctgctttaggtcaacttcgataacgtgttgagtccaccaaatcaccaaccagttttaagtaacttctacttaataaagaagaaatattcatataaagtaatggacttggatacaatttatatttgctaaag

SEQ ID NO: 194077 - DNA, 601 bp, Human
atcacagagaaatcagtgggagaaaaaaaatacaactaaatcaacgtctgaggaagatattctagaaaaaaaacagaatgaaaactaaaccagggccgggtgcagtggctcatgcctgtaattctagcagtttgggaggcccaggtgggtggatcacttgaggtcaggggttcaagaccagcctggccaatatggtgaaaccccatctctactaaaaatccaaaaattagccgagtgcggtggcatgcacctgtaaatcccagctactcgggaagctgcggcagaagaattgcttgaaccrggagatggaggttactgtgagccgagatcgcatcactgcactccagcctggcaacagagcaagacactgtctcaaaaaaaaaaaaaaaaaaaaactaaaccaggatcaccaacagtccactgaaaccaattgcataacagcatatggttagccatgggcaacccagcccctggtcatttcctggaaaccaaggatatttctagcagagaaggcagtatgtggcagtactagcaaatgccacacccaacatgtcagaagcaaaagaaccagaggtgattgcacattcaaggcctcatctag

SEQ ID NO: 194078 - DNA, 601 bp, Human
aatatttctgcacacatagacatgtacagatacacacacatacacacacacaggttttgtaactaagagttttgaggttttggttttcagcattttggggacttaaggataaaggagtatgctcctaaattacatgaacctgcagaataccacaggtcacaatgacgagccacagcagaaattaagagttgaggaccatcatgaaacacaatgccattctatctaaattgggggaaaccaaatcacagagaaatcagtgggagaaaaaaaatacaactaaatcaacgtctgaggaagataytctagaaaaaaaacagaatgaaaactaaaccagggccgggtgcagtggctcatgcctgtaattctagcagtttgggaggcccaggtgggtggatcacttgaggtcaggggttcaagaccagcctggccaatatggtgaaaccccatctctactaaaaatccaaaaattagccgagtgcggtggcatgcacctgtaaatcccagctactcgggaagctgcggcagaagaattgcttgaaccgggagatggaggttactgtgagccgagatcgcatcactgcactccagcctggcaacagag

SEQ ID NO: 194079 - DNA, 601 bp, Human
cctacattgacaagagtcaactatatattaaaatcaaattataacaaattattaccatacagcaaaaatgtgtaaatgtttcctttaaaatctgttttaggtttcaaaataattcacatttctggtaacagttcttgtctaaaacacttctggatttttaaattttttagatttaacaaagcaaatatagcacatatatcatatgttacataatagtcccagcagggactagggcagctccacataattaaatacattaatatttctgcacacatagacatgtacagatacacacacatayacacacacaggttttgtaactaagagttttgaggttttggttttcagcattttggggacttaaggataaaggagtatgctcctaaattacatgaacctgcagaataccacaggtcacaatgacgagccacagcagaaattaagagttgaggaccatcatgaaacacaatgccattctatctaaattgggggaaaccaaatcacagagaaatcagtgggagaaaaaaaatacaactaaatcaacgtctgaggaagatattctagaaaaaaaacagaatgaaaactaaaccagggccgggtg

SEQ ID NO: 194080 - DNA, 601 bp, Human
ccacgaccggccctcacattcttttccgaatcacagcttccagggatagggagatggaaatcagaagattgatccacggcaaacagtgaactgagcacattagcacaaacatggaagaaacatagcaacaaggtgttgctggccatgcctagaagccagggagagctgttggggaattcagcccagcactgtcagaacttttgttattttaagaagccagattcttacaaagtttctttttttttctttttttttcttttttttttactactgacaattattttactatgagaggcaaacraatctgtgaccacatttcaaggcataggtcacaagtatgccagtgaatgttggtccatgagagaagaaaccagaagggatcaaaacgcccagctcatcagaggagtgggggtgaaggcaggaattaagtaacaggactaggctctctagcccaggcagcagcagccagaaaggaggtggattctgccaggaagtgttagaggctgggtttttctgtgttgtgactacctcctcattctgtcctttctggttctcagggtggctgaggctgctccaaggcaagatggtgagcgaggttctg

SEQ ID NO: 194081 - DNA, 601 bp, Human
cctcacctcaagtgatccacccacctcagcttccgaaagtgctaggattacaggcatgagccaccacgaccggccctcacattcttttccgaatcacagcttccagggatagggagatggaaatcagaagattgatccacggcaaacagtgaactgagcacattagcacaaacatggaagaaacatagcaacaaggtgttgctggccatgcctagaagccagggagagctgttggggaattcagcccagcactgtcagaacttttgttattttaagaagccagattcttacaaagtttctytttttttctttttttttcttttttttttactactgacaattattttactatgagaggcaaacgaatctgtgaccacatttcaaggcataggtcacaagtatgccagtgaatgttggtccatgagagaagaaaccagaagggatcaaaacgcccagctcatcagaggagtgggggtgaaggcaggaattaagtaacaggactaggctctctagcccaggcagcagcagccagaaaggaggtggattctgccaggaagtgttagaggctgggtttttctgtgttgtgactacctcctcattc

SEQ ID NO: 194082 - DNA, 601 bp, Human
gccaggctgatctcaaactcctcacctcaagtgatccacccacctcagcttccgaaagtgctaggattacaggcatgagccaccacgaccggccctcacattcttttccgaatcacagcttccagggatagggagatggaaatcagaagattgatccacggcaaacagtgaactgagcacattagcacaaacatggaagaaacatagcaacaaggtgttgctggccatgcctagaagccagggagagctgttggggaattcagcccagcactgtcagaacttttgttattttaagaagccrgattcttacaaagtttctttttttttctttttttttcttttttttttactactgacaattattttactatgagaggcaaacgaatctgtgaccacatttcaaggcataggtcacaagtatgccagtgaatgttggtccatgagagaagaaaccagaagggatcaaaacgcccagctcatcagaggagtgggggtgaaggcaggaattaagtaacaggactaggctctctagcccaggcagcagcagccagaaaggaggtggattctgccaggaagtgttagaggctgggtttttctgtgt

SEQ ID NO: 194083 - DNA, 601 bp, Human
atgttggccaggctgatctcaaactcctcacctcaagtgatccacccacctcagcttccgaaagtgctaggattacaggcatgagccaccacgaccggccctcacattcttttccgaatcacagcttccagggatagggagatggaaatcagaagattgatccacggcaaacagtgaactgagcacattagcacaaacatggaagaaacatagcaacaaggtgttgctggccatgcctagaagccagggagagctgttggggaattcagcccagcactgtcagaacttttgttattttaaraagccagattcttacaaagtttctttttttttctttttttttcttttttttttactactgacaattattttactatgagaggcaaacgaatctgtgaccacatttcaaggcataggtcacaagtatgccagtgaatgttggtccatgagagaagaaaccagaagggatcaaaacgcccagctcatcagaggagtgggggtgaaggcaggaattaagtaacaggactaggctctctagcccaggcagcagcagccagaaaggaggtggattctgccaggaagtgttagaggctgggttttt

SEQ ID NO: 194084 - DNA, 601 bp, Human
ccaccacacccagctaatttttttgtatgtttagtagagacggggtttcaccatgttggccaggctgatctcaaactcctcacctcaagtgatccacccacctcagcttccgaaagtgctaggattacaggcatgagccaccacgaccggccctcacattcttttccgaatcacagcttccagggatagggagatggaaatcagaagattgatccacggcaaacagtgaactgagcacattagcacaaacatggaagaaacatagcaacaaggtgttgctggccatgcctagaagccaggsagagctgttggggaattcagcccagcactgtcagaacttttgttattttaagaagccagattcttacaaagtttctttttttttctttttttttcttttttttttactactgacaattattttactatgagaggcaaacgaatctgtgaccacatttcaaggcataggtcacaagtatgccagtgaatgttggtccatgagagaagaaaccagaagggatcaaaacgcccagctcatcagaggagtgggggtgaaggcaggaattaagtaacaggactaggctctctagcccaggcagca

SEQ ID NO: 194085 - DNA, 601 bp, Human
tggaggaattatgcacatcctctgggactctactaggataagattcttggaagcttatgcctggccccatgtgtcttttccctttactgattttgttttgtatcgtttcgctgtaataaatctagttgtgagtatgactcaatgctgagtcctgtgagctgtcatagtgaatcactgaatgtacaggtggagttgggaaccctggcacaacgagtttccccattccttcaactttgtaagttatttgccagcttccatgctggggcagtacaacagacaaaaagccaaccaaattaagagmtccaaagtccaattctaaaaattcctgatttcttagctaatgatagttgcaaatttacatactacttcaattttttaaattcaacatctcaacctatagaaatcaattcctcattttctctctcactattatttgtagatctttttcctgatcaaactccagtgctgctcttccttggttcccacctcattatcccatggagcctccactgaaacattgggtggtctgtcccctgtgtcatttagccccgtgactagaaagcaacatcacttatgaaacctccagtgtcctttgctctgt

SEQ ID NO: 194086 - DNA, 601 bp, Human
cttggtacactaggcataggacacctgtgtgatcagcctccaacaaaaaccttgggcaccaagtctctaatagcacatttcacaattgtcacaattggatgctggaggaattatgcacatcctctgggactctactaggataagattcttggaagcttatgcctggccccatgtgtcttttccctttactgattttgttttgtatcgtttcgctgtaataaatctagttgtgagtatgactcaatgctgagtcctgtgagctgtcatagtgaatcactgaatgtacaggtggagttgggawccctggcacaacgagtttccccattccttcaactttgtaagttatttgccagcttccatgctggggcagtacaacagacaaaaagccaaccaaattaagagatccaaagtccaattctaaaaattcctgatttcttagctaatgatagttgcaaatttacatactacttcaattttttaaattcaacatctcaacctatagaaatcaattcctcattttctctctcactattatttgtagatctttttcctgatcaaactccagtgctgctcttccttggttcccacctcattatcccat

SEQ ID NO: 194087 - DNA, 601 bp, Human
aaatgtttaaactatagattggagaaaattattttataaagtccaatgagagagtggtagatccaggacaaaaaccctctcaagtgttaattctcttccatcacaaagaaaatttttttaaagaagttataactgaaagtaacaaacaaaaatatccatgaaacttttaaaatgttatctgtattatggggtgctaactttaagatgtttagatttttttttcaaattttcattggaatatcaagattatttcaaagataggctttgaagaaatatacctgcaatttctggaaggtgtgcrcaatctcttgtaagctgtatgttgtgcaggtttttaatttttctaagccttagttctgcattttgaaattaagtctaacaagacttaatacagaattgttttgagaaataagagaaataatgcatgtaaagtacttagcacagtggttaatttgtagttagtgctcaataggttgtatcatttttactactaatgtgcagaaaagagttaacacagcaggcttgaggctgctgtcccaagaaaggcctgtttacaaggctgatccttgcctggcatctgggaacttggactttgggaggg

SEQ ID NO: 194088 - DNA, 601 bp, Human
cttgcttgctctcatcatggaatacaccaggtcccctttgccttccaccatgattgtaagtttcctaaggccccatcagaagcagatgctggcaccatgctatttgtacaggctgcagaacagtgagctaaataaacctcttttatttataaattacccagcctcaagtatttctttatagcaatacgaatggactaatacacagctaaaaagaaaagaaaagaaaaatacctctcctatactctctcagcacttctgacaccaaatatgtggcagggagtggggtttccacaacagccarctctccaattcttggcacacaccaattgagtgtcctacaatttaactcaattctgacactaactgctcagaattaagacagaccccacagaccaaaggatcactcccagaacactgccctctgcttcagatgtcaatcacaagtagtggatccccaggttaccacaactcctgtctgacttggctacatatggaggttcccacaaccccctccttgggttcaagaatttgctggaacagctcacagaacccagggaaagtgtacttactattatcaacttattacaaggatattttaaag

SEQ ID NO: 194089 - DNA, 601 bp, Human
taaggaccgcttgagggctccttggtcaagcggtaacgccagtgtctgggaaggcacccattacttagcagactgcaaaagggagtctcctttccttggaggagtcagggaacattctgctccaccagcttcttgtgggaggctggatattatccaggcctgcctgcagtcatccggaggcctaaacccctccctgtggtgctgtgcttcaatggtcacgctccttgtccactttcatgctcctcctgtactcctggttcctctttgaagttcgtagtagatagcagtagaagaaatagtraaagtcttaaagtctttgatctttcttataagtgcagagaagaaaatgctgacgtgtgcagagaagaaaacgctgacgtatgctgccttctctctctctctctgcttcagctacctaaaagggaagggccccctatactgtaatcacgtgatttgcttcaccttgtcaatcacttagaagattcaccttccttaccctgcccccttgtcttatatgcaataaatatcagcaagcccagccattcggggccactactggtctccgtgtcttgatggtagtggtcccccaggcccagctgct

SEQ ID NO: 194090 - DNA, 601 bp, Human
cctaggtaaaatattaaagtttcaagcatctcgtaacaagagaatgctcaattttggtacaaccagattaaataagagaggcactgtgggtggaggattacctaggtgccaaggcaagagactgaaggcacaaagtatttcagtataataaagaaagtagttagaataagaatagtcataatacaaattagatatagagaggaccatgaagaattatcagtcattattataaacattattaatcattagcttttaatattactctttgttgcattactaatataacctaggaataaccagygggtatagggtcaggtgctgaagggacattgtgagaagtgacctagaaggcaagaggtgaaccttctgtcatgcccgcataaggaccgcttgagggctccttggtcaagcggtaacgccagtgtctgggaaggcacccattacttagcagactgcaaaagggagtctcctttccttggaggagtcagggaacattctgctccaccagcttcttgtgggaggctggatattatccaggcctgcctgcagtcatccggaggcctaaacccctccctgtggtgctgtgcttcaatggtcacgc

SEQ ID NO: 194091 - DNA, 601 bp, Human
ctgacaactgttttaatacaaaataataaaaaattaagctagaaggggaggaaacgagagagatggtaaacagtaacaagtgattttttttttttcttgagatggagtcttgccctgtcacccaggtgggagcggaatggcgtgatctcagctctctgaaacctctgcctcccaggttcaaacgattctcttgactcagcctcccgagtagttgggattacaggtgcccgccaccatgcccagctaatttttgtatttctagtagagacggggtttcaccatgttggctaggctggtctcraactcctgacctcatgatccgcccaactcggcctcccaaagtgctgggattacaggcgtgagataccgcgcccagccagtaataagtgatttttactcatcctagtgaaccatgctacaataatttctttggtggggagggacaccttcagctcctaatgataaccatgacaatgaaagtaggagaatagactacactgatttttaagtttgtggactcttacgtgaagtcattgtatggactcttacatgaaatcattgagtagtcatgagatagctggcattttatagtatgtaacaa

SEQ ID NO: 194092 - DNA, 601 bp, Human
gccaagtggccttccccaatctctacgccccaggaaaaaaaaaaaaacaaaaaactgtatacaggtctatactcttgccaccaaggattcctccactcataatttggtctctttttaaactgtcttccagtgtaaatgctatcatccctatcttcaaaataaacactttctagaaactattaattacaaggaagtaatttcaaagatttctaagaattcctcagcccagtagttcatagcataaaaggagaaatacaactcaagttacacaaattgtgatgtcaaatgtagttcttttttaaaaaaaatgcaagaagttacatacatttcaaattaagacaattttttttcaaggtagacaggtaggagaagaggggtgggtagaaacactatgtttatttcaactacaatgccattttccaaatattctaggaatcattctttttgtaattgccttcagttcctatgtcacagtcttgaatatgttcagtggaaaaatagctaaataaaactttgcttaaaactcaactttctgatatcactaaaaattgctgacggacaagttttatgactaaattaaattaagtaataccatttctga

SEQ ID NO: 194093 - DNA, 601 bp, Human
ttgctgagtaacacaagtgtttctaagctcctttctgcatataattttctacacgtacctgaccagcatcaacctatggctaacagttggtgtgtctgaaatagttttagaaacaactcaaaatgtagtatcactttcttaaattgtcatgtgatttcttttgacagttgataactttgtttataataatgtccacatctagtttgggggagagattaatactaataaatactgaattaaaacatacccttgttttagattttttttaagagatagtcttgctatgttgcccaggctagaygtaaactcttggacaacatagcaagactctgtccctgaaaaaaaatttctgggtgtgatcctctgacctcagcctcctgagtaactgggattataagtgctagccactatgcccagctgtttctaaatttaaataatgcaccacttcaaaaaataaaatggaacaaaattatgtggggagtaactctcacaatgtgagatctttatattaaagatctttttgcttactttaaatatttactgatcatcaccattgtaattactaccaacaaaaacttttttaaaaggctaatgggtgcga

SEQ ID NO: 194094 - DNA, 601 bp, Human
gtccagtgaagttgagagtcccgtgggcaagtgcaaacaacggtggcacacaaggtaagaacgccaggtctcaagagacccccttcatagcacagcagaggtagcataacaaagtatgtcattatgaacccacagaggtagaactatagcttaatcagattgtaagcttaatgaggccagaaccattcatcttttaattactccatccctagcactgggtacacactcactaaatctttgttgtacaagtgatgaagaaagtaaaacaaatgagctgagtcccatattacaaataaaagayacttctaccaggaaattataaacatattcctctcaaaggcacaaaatttatattttacaatcttatgagtaaggaattacacctatccatgtgactttcgtagtcgcaaataaaattaacagcaatgcctatgtgattgcttggaataaagatagaataagaaacatgtcatctaactaggtaatggggaaaaattcctttccaataatctattaaaaatcattttgcaatttcacctcagtctcttgcttactcgtttaattttatttaacaaacaatattgcacatattttgtagtat

SEQ ID NO: 194095 - DNA, 601 bp, Human
cagaaatattttttttctgctggtctctcttttctgcacaattctaatttacttaaatgcacagggttcctaacacctcacaggggtacagtgcggaaaaaaacaaacataaatgaaccactggtaaaagaacacccgttgcaaggtttgttatctatacagccaaagaagggaaggaggaaggaaacatatgaatagaggtggtcagtgaagttactgtttaaggaagtccccctttgtgggaagtagaacagtgtggtttaacagtacactcgcccgaaagataagacatcttggttcrcctcctcagatgggatgtcacttcagagaacactgtcccctagtttcttcacttgtaaaatagtccgtgggcaaatctgtgggttgtttacagttatactttatggggcactgaagacaacagaacaatgcaagtatgtatacaaaacactgatatttctgtgggatctgtgctatgtaaaatgtaagaacaggaggaaaccttgaaatcctctaggcacaactgccccatattacacttggaaacccaatgtccagtgaagttgagagtcccgtgggcaagtgcaaacaacggtggcac

SEQ ID NO: 194096 - DNA, 601 bp, Human
gaatttgaacccagataatctggcacaagagtccatcctcttagtctctcactccctaacttcacagaaattctgtaaactcagagatggacctagaccacagctaaagtttcctacaactaagaaggaacagaatacagctgataagctgattctagaacttcaagaaatatattatctcatccagtgaattttggtcttgtttcctgcagatattttcatcagaacacctatcattagaaagtgattgtgaagtctgaaaataaaaaaatcactctgaggttcaaaaaaaattttttttattatatctgatcattagcatcaagctgctcatcattttccaagaaaattcaaagttttactatttatccttatattgtactacaatcagtcctagtcaggataagttaacccaaaaatgagcttactttactattttctaaagtgttaaactaaattacaaatatattgcagtaaatgtccaggagtcttcaactgtgacagtttctctgctgttgagatagacaatgaacgtgaataaattcatctttgagtcacttgtgagttttctttaagaagaatcacttaaagtatatatgaa

SEQ ID NO: 194097 - DNA, 601 bp, Human
aaagacacaatgggcaacaatgcaacctaccttatgtatataataataacagctgcttacatgcacttacctaccaggacctatcctagccactttatctatactgatccatttacccctcaaaaacacctatgagggaagtattattattctccccagtttaaaggtgagacacagagagattaagtaatttgtcctaggtcatgcaattaataagtaacagatttagaatttgaacccagataatctggcacaagagtccatcctcttagtctctcactccctaacttcacagaaattytgtaaactcagagatggacctagaccacagctaaagtttcctacaactaagaaggaacagaatacagctgataagctgattctagaacttcaagaaatatattatctcatccagtgaattttggtcttgtttcctgcagatattttcatcagaacacctatcattagaaagtgattgtgaagtctgaaaataaaaaaatcactctgaggttcaaaaaaaatttttttaattatatctgatcattagcatcaagctgctcatcattttccaagaaaattcaaagttttactatttatcctt

SEQ ID NO: 194098 - DNA, 601 bp, Human
tccaccagttaccagaactccaaaacataaccagactaccagcaccacagatcaatttaaagagtgaatcacctgtgattagtgacctaataacacaatgacacaattacactcattgcaaatgcattgatatctgggaaaaaacagaggcaagagcaaagactgaaacatgtaaagacacaatgggcaacaatgcaacctaccttatgtatataataataacagctgcttacatgcacttacctaccaggacctatcctagccactttatctatactgatccatttacccctcaaaaacwcctatgagggaagtattattattctccccagtttaaaggtgagacacagagagattaagtaatttgtcctaggtcatgcaattaataagtaacagatttagaatttgaacccagataatctggcacaagagtccatcctcttagtctctcactccctaacttcacagaaattctgtaaactcagagatggacctagaccacagctaaagtttcctacaactaagaaggaacagaatacagctgataagctgattctagaacttcaagaaatatattatctcatccagtgaattttggtct

SEQ ID NO: 194099 - DNA, 601 bp, Human
aaacacatgaacctacccgaggtatgcatttccaccagttaccagaactccaaaacataaccagactaccagcaccacagatcaatttaaagagtgaatcacctgtgattagtgacctaataacacaatgacacaattacactcattgcaaatgcattgatatctgggaaaaaacagaggcaagagcaaagactgaaacatgtaaagacacaatgggcaacaatgcaacctaccttatgtatataataataacagctgcttacatgcacttacctaccaggacctatcctagccactttayctatactgatccatttacccctcaaaaacacctatgagggaagtattattattctccccagtttaaaggtgagacacagagagattaagtaatttgtcctaggtcatgcaattaataagtaacagatttagaatttgaacccagataatctggcacaagagtccatcctcttagtctctcactccctaacttcacagaaattctgtaaactcagagatggacctagaccacagctaaagtttcctacaactaagaaggaacagaatacagctgataagctgattctagaacttcaagaaa

SEQ ID NO: 194100 - DNA, 601 bp, Human
caacatatcatggggaaaaaaacctattcacaagagtagctaaaactataaaataggaatacatttaacaagaaaagtataggacttcaaaaacaacaactgtttaactctattcagggaaataaaattaacagattaaagtagagacacaccactttgtttttcaaaggaagaacttagagaacataaaccaattgtaaacatgcttgtttattagctgttttacagtggaaatgtttgagagtatttcactgtcagagtttgcagaaattgtcagatattagaacaaatgaaatgttaygtgctctacagaggcagatccagattttgagggatctgaagcttaaacactttggaggagaaatctttgtcaattaaaaattaaaaataaaactaaaatgcaaaatcataaatgcaaaagctctggggcccttccagaggccttaggaagggctatggaattgaaagagcctaaagcttacttttctttaactccatagcagacccacctctgttgtcataaaaatgtaaagttggtcagactcggtagcttatgcctgtaatcttggcactttgggaggctgaggcaggaggatccctt

SEQ ID NO: 194101 - DNA, 601 bp, Human
tgaatttgcccagctctctggcctcctcccctcccatgcccaccccattccacctcagttcctttccctctctgctgttctttgagcaataaagcatttcccacctccctggggtcctttgtactcttggcttctccgtggcctgccctgctcttcctaagttctctattccctacctacagaaacagcaggcaaggccccatctctctcatgcggctttacttttctcatggcagggggatatttactggtatctgtacgttgtctgcatctcccctttagaaggtaaattccaggacarcagggcatttaccttctatactattgtgtccacagagcctacaacagtacttggcacaaagtaggtgcttaaaatatttttgtcaaatgaacagattcaagtaaaaaagaattgggggtggtggctaagaaattcaagtagagatgtctgtgggtgccttccaagttagataggctgggtttgaattcaattatcccaccgtggtagtcactatgaattataaatctagatttctctatttctaaatttgtatttcggtcaattcagaaaatttaaggttactgggtagatatattcctc

SEQ ID NO: 194102 - DNA, 601 bp, Human
aatgaatttgcccagctctctggcctcctcccctcccatgcccaccccattccacctcagttcctttccctctctgctgttctttgagcaataaagcatttcccacctccctggggtcctttgtactcttggcttctccgtggcctgccctgctcttcctaagttctctattccctacctacagaaacagcaggcaaggccccatctctctcatgcggctttacttttctcatggcagggggatatttactggtatctgtacgttgtctgcatctcccctttagaaggtaaattccaggasagcagggcatttaccttctatactattgtgtccacagagcctacaacagtacttggcacaaagtaggtgcttaaaatatttttgtcaaatgaacagattcaagtaaaaaagaattgggggtggtggctaagaaattcaagtagagatgtctgtgggtgccttccaagttagataggctgggtttgaattcaattatcccaccgtggtagtcactatgaattataaatctagatttctctatttctaaatttgtatttcggtcaattcagaaaatttaaggttactgggtagatatattcc

SEQ ID NO: 194103 - DNA, 601 bp, Human
gcttctaactgccagttcatgtttcactgtgccctggcgtggcaacatacatgaattagcaacatcttgtctctcccatctcaaaaccctccaaaatctgcctgttacttaaaaaacaaaaacaaaacaaacaaaaaaatgaatttgcccagctctctggcctcctcccctcccatgcccaccccattccacctcagttcctttccctctctgctgttctttgagcaataaagcatttcccacctccctggggtcctttgtactcttggcttctccgtggcctgccctgctcttcctaagktctctattccctacctacagaaacagcaggcaaggccccatctctctcatgcggctttacttttctcatggcagggggatatttactggtatctgtacgttgtctgcatctcccctttagaaggtaaattccaggacagcagggcatttaccttctatactattgtgtccacagagcctacaacagtacttggcacaaagtaggtgcttaaaatatttttgtcaaatgaacagattcaagtaaaaaagaattgggggtggtggctaagaaattcaagtagagatgtctgtgggtgccttc

SEQ ID NO: 194104 - DNA, 601 bp, Human
aaaacatatgtctacacaaaaacttgtacatgaatattcatatcggttctatttccagtagccaaaaggtggaaacaacccaaatatccaccaacagatgaatgaataaacaaaatgtggtctacccatgcaatggagccatgaaaaggaacaaagtactaatatatgctacaacttgaatgaaccttgaaaacgttatgcttagtggaaaaaaccagacacaaaagtaacatattgtatgattctacttatacaaagtatccagaatagtcaaatccatatagacaagaagtagattagtgttgccaggggctgggaggaaaaggaaatggggactgacttcttaagggggacagtttctgtttgggttgatgaaaaagttatggaactagatagtggtgatttttaaacgacattataaatgtacttaatgttactgaattgtacactctaaaatggttacaagagtaaattttatgttatgtgtatttttccacaataagaaaaaagagatattaagagagttagacaagccacaaagtacaaagcacacacagatgagcttcattcagaatatatatattttttataccttttaaaa

SEQ ID NO: 194105 - DNA, 601 bp, Human
agtctgagacagggtgtctggggctctggaaataaagaaccaatatttccaccggagacacaaagagcaggcctcagcatttcaaatgaaggctttttagcagagaaaagttactgagaattcatagtaggggttcatgaagctacactgagatgtctaaaataagcagtcataattcatcagaatttgaaagaacagccactttgggctaactcagagaaacttgcaagcacagaggcactcgctttacaggcagcacagacacagggaggagctgagtatccatgggaatctgtacaaygcaaggagccattattagaaaccaccacatatcaagtcctgtgcaggcactgggggaaggaggatacaatgataagcagacaggatctccttctcaatttgctttcctatatttgcatttggtcaatgtgcagaaaacagttaacatagcaggcctgacactgctattcttagccaggcttacttgcctttctagattggcccttgactggcatctggaaacttgaatctggggagggtcccatgatttctagcagtgatgagtgccacaaggggtcttaacggtttatacaaacaaaat

SEQ ID NO: 194106 - DNA, 601 bp, Human
taagagcaaggacacgggctctcagaggagcatgacagacagccagaaggaggctaaggaaggggacgggaagcagaatgttatgagtctggtgaggtaggaggcatgttccagcctccacctggagagacaagctggggaaagactgtggagggatctccatgccagaggaggggaggagaaatcattccctttctccccagagaaccaacagcccagtcagtggttcctcagctcacaaaggcagggagagtcacaggggaagccccaggctgccagattccaaagtactgtggcttattttttttttttttttttttttgagacagagtctcgctctgtcgcccaggctggagtgcagtggcgggatctcggctcactgcaagctctgcctcccgggttcacgccattctcctgcctcagcctcccgagtagctgggactacaggcgcccgtactgtggcttattttaaggtggacaggtttccacctaccacactggaacttctttcaaacaattatcttcagtttttcatttttaaataaataaacgtgtaaaggcatatggggtagagagtaagaaattttatttactcaaatca

SEQ ID NO: 194107 - DNA, 601 bp, Human
atattggcagaagtcttgtatggaacataaggcaaagctgctaaagggatctgactctggtgggagatgtcccttcttgcttttctgtctttcttccttcctccagcttgcaattcagacaagatggctggagccatctttggcaaaaacaaaagataagctaggactatggagaggaaagacaggatccaggatccctggattgtatccaccatagcagttctagacagcccacttccagtttttggtttggtttttccacactgagaaaaagaagaaactttatcttgtttaaactatyacttagggattgtgtgtggtacatagcataacccaatcctaactgatacagaggctgctgtattcacccaagaagaggtaatggtggtttggatcatggtggtggcacagatgggaggagaaagagcaggactgagatatatttagaaggtggaaccaatagaacctgttgagagtccagacaagagagggtgaagagagggataagttgagacagactctcaggttcctggcacaagcaactgggtagaccatggtaccaattactgaactagagattacaggggtgggggacatcttg

SEQ ID NO: 194108 - DNA, 601 bp, Human
caggttccaggtgggctaactaggcataaaaccatcctccaggctaaagaagtaccccaggaaagggacactgtagacattcatgtccagctaccctgcatttcccatcaggacagggttgctagccaacctggtactggaatcccattagctagaagctctcaaaatagccccaactccttttccctgtcatatctttacaatttaccaatttactactctttgtccaacataatatataagctttcaacccttacaacttccctgggtctttattttcctggtgaaggctcccacgtayatgtaaaaattactaaataaaaattctatgcttttctcctgttaatctctcttttggtggtctaatttaaaaggccccagctggaaaaactaagataggcaaggggaaaaaatatatttttttctctccttcacacaatagaagtatatttaaatttaagaaaaaagaaaaaactaaactaaaaaaggccacagagcccttctgtttctaatcccagaagccagtcttgattttcactgtgcaaaatgtatattcaaaggtaccaaggagatgataaagaaagtaatgttttccattgtc

SEQ ID NO: 194109 - DNA, 601 bp, Human
attccggtgaatataaagattaatatatgtttgatccttctataaacacacaatttggtagcccaaaaaatatcacaaagctatccagaggcagtgcagtacaatggttcagagctctgggaatcaggctgcatgggctggggtcccagctctgccacatgctcactctgcaaccttgggcaaagtactcaacctctctgttctttagtttcatcatctgtaaaatgggaatagtaactgtatctgcctcaaacagttcacaggattaaagttaatacttaaaaagcatataagaccatgyttggcacatggtaagcacccaaaaatatgctacttcggcatatggattgagttaaaggcacttaaaaaaaacagcacatgcaagaagggcactgtgaccttccttgttcttcttgaaagcatgagattaactcccatgaaaaaggtgccctccttataccaggaggacgaaagacattcattcttatcaccagagatggggagctgaggctgagggaaagctgtacaaaccttgttatactagtccttatcttgctacttttccacaattaactgtcctagtcctgaagtgaattcttat

SEQ ID NO: 194110 - DNA, 601 bp, Human
tttacccttcgaggctgttattttagttctatcttacagtatgaaaccaatactgagccagccagtgactagattagcacttcctttttacgttaggaacaattgatctctggtaactcacagcatttaacacacgatagcagggagcatctttggtcaaaaattcctcttcaaagcacaagagtaatgttacaaagacatattttgccggtttgtcaggctgtcttgacggctaagtcatattccggtgaatataaagattaatatatgtttgatccttctataaacacacaatttggtmgcccaaaaaatatcacaaagctatccagaggcagtgcagtacaatggttcagagctctgggaatcaggctgcatgggctggggtcccagctctgccacatgctcactctgcaaccttgggcaaagtactcaacctctctgttctttagtttcatcatctgtaaaatgggaatagtaactgtatctgcctcaaacagttcacaggattaaagttaatacttaaaaagcatataagaccatgtttggcacatggtaagcacccaaaaatatgctacttcggcatatggattgagttaaaggc

SEQ ID NO: 194111 - DNA, 601 bp, Human
tgactatgtcttataaaagccatgaatgagatgtttcctcaggtcatgacaaatatcggttttctaaaattacaggaggccgtaatagaaacgaccagtgtctaccaacatccactcttttcaaacagaaaaagaaattaacctttcctcatgggtcttacaattctgtttttaaaatgacggttgatgcttcatgtgactccactatttttacccttcgaggctgttattttagttctatcttacagtatgaaaccaatactgagccagccagtgactagattagcacttcctttttacrttaggaacaattgatctctggtaactcacagcatttaacacacgatagcagggagcatctttggtcaaaaattcctcttcaaagcacaagagtaatgttacaaagacatattttgccggtttgtcaggctgtcttgacggctaagtcatattccggtgaatataaagattaatatatgtttgatccttctataaacacacaatttggtagcccaaaaaatatcacaaagctatccagaggcagtgcagtacaatggttcagagctctgggaatcaggctgcatgggctggggtcccagct

SEQ ID NO: 194112 - DNA, 601 bp, Human
gcctacacttcattagctattaaatgggatgaataatagcaccagaacttcatatgattgcagtaagaattcgaagagtcaattcatgtaaagcttttggaagaacgctgacaaacagtttaagtgcttgatcaatttagctactaatattatttttgaaaagcatactagcccttaggaaacctaaaagcgagagccactagttttgattaagaaacgatcctcacacctaccttctagactccaagaaagatcttctgagagttgatgctgaatttgactatgtcttataaaagccataaatgagatgtttcctcaggtcatgacaaatatcggttttctaaaattacaggaggccgtaatagaaacgaccagtgtctaccaacatccactcttttcaaacagaaaaagaaattaacctttcctcatgggtcttacaattctgtttttaaaatgacggttgatgcttcatgtgactccactatttttacccttcgaggctgttattttagttctatcttacagtatgaaaccaatactgagccagccagtgactagattagcacttcctttttacgttaggaacaattgatctctggta

SEQ ID NO: 194113 - DNA, 601 bp, Human
gctgggggctccctgacttctgcagatgaatactgaaccatctgtagaagaaatgatgtggtttctgcaagacaatgggagtagaagggatttgttatagataatgaggtgggaggaagtgtgactagggttacttggttgggtaatgggtacacggggttcactgtactattctgtctactgttcagtaagttgtaaatattctatgataaaaggttaaaaaacacttctcaaatattttttaaagcctgatcaaagttgtaactgaatctacttacaaactttttttttgagaatagaraaagagcccatcataaaccagtaaaagcagagatggcacatttcttaattgctactaataaagcttttgctgtcctttgtggtaaagtgcacactgggctcagaacaggaagcaagccttagaaacaacaacaatcccgatgtttatacaactgctcgtacaggtcgtgtgtgcacagctccttgcattcatcaatcttaaagtgctccataattaattacagaaccagtgactctgccaaagtaatgagtcatttagcatctgcaatttactgttgggtaaatggggcactgagttaaa

SEQ ID NO: 194114 - DNA, 601 bp, Human
tttttgtgggtttaatgcgggccaatcactgcttttactacagtttctacaggaatattcattcaactggtgttgcaaataaccaacttacagcaaacttttgtaatacaacccatcaactgtgaacattctgtagataaaattatttttaaaacaatttcttccactgactgagtgcttgatgatattaaggaagttctgttgatatttaagagtgtggtgatggcactaagattctgcttaagctgggggctccctgacttctgcagatgaatactgaaccatctgtagaagaaatgaygtggtttctgcaagacaatgggagtagaagggatttgttatagataatgaggtgggaggaagtgtgactagggttacttggttgggtaatgggtacacggggttcactgtactattctgtctactgttcagtaagttgtaaatattctatgataaaaggttaaaaaacacttctcaaatattttttaaagcctgatcaaagttgtaactgaatctacttacaaactttttttttgagaatagaaaaagagcccatcataaaccagtaaaagcagagatggcacatttcttaattgctact

SEQ ID NO: 194115 - DNA, 601 bp, Human
aggcactctctacaacaaatttcaatttatcattacacattagcaaaaccctcttactctccatgtgtctgctaaaatgatcttcccaggttcacttggaattttactgagaggcaaatttctctgactccaggatttcagaccaatgtgatgtcagaaacctctttagcaagaaccaaagaaatatgggatagatttcctacctacaaagcatttataatcgaggtaggaaataagtcatggacagcattttgacgccctagcaagacgaatcaaagttcccaaagttatttaaaatttsaggcaagaaatagaaagataatcatagagcattatctgtggatcacaactggatccagagtgccaaagagcctcaagtgcaagagacaatggtgatttgattgttaaaggaaaaaagactggatattgctgtctcctgagactaataagaagtgactagaaacaggctggcaaatgtaaatgatgggaaaactacaaaaatgttaccctaaatataaaatcagaagttattaggaaagtttaaaactgatgaagaacttgtaaagttgactgactttcagagacatgtatgtgaataata

SEQ ID NO: 194116 - DNA, 601 bp, Human
atagacaatggatttttatggcaacatttggcttctggagatagatctcccacctggacacattttcagcctagaatggtgcatggggaaatgtctcactaggaaataagaatttacgtgaaactcagtgttggcatttgggatctgaatctggcagcaaagatgcaaaatgatcagattccatgtggtgaatggaaatatactaaatcatagtatctgatttaacccatattcaaataataaagaataataggtaagatttataatagcactgtgtgcctggtgctgtcctatggtttaygcatatcaacttgtttaagccttccaatgaccactataccatgttacctctccaaaaatagcaagagcaaaaacacctgtgggaaactgacactaggtgacagcaacagaaaggactcccactttgcagatctgtgagggacaacagtccctggccatatctagtatatgaaatatctaccatctgtttagcactcggagctaagcatcatgggaagtagggtgctaactaccaccacaaacattaatatttagatttgaaagcaataacatgtaaatacttcatttgtcttaagtactt

SEQ ID NO: 194117 - DNA, 601 bp, Human
gtttcaatacattttactgaaaagatacagaaaatgcagaaatagacaatggatttttatggcaacatttggcttctggagatagatctcccacctggacacattttcagcctagaatggtgcatggggaaatgtctcactaggaaataagaatttacgtgaaactcagtgttggcatttgggatctgaatctggcagcaaagatgcaaaatgatcagattccatgtggtgaatggaaatatactaaatcatagtatctgatttaacccatattcaaataataaagaataataggtaagayttataatagcactgtgtgcctggtgctgtcctatggtttacgcatatcaacttgtttaagccttccaatgaccactataccatgttacctctccaaaaatagcaagagcaaaaacacctgtgggaaactgacactaggtgacagcaacagaaaggactcccactttgcagatctgtgagggacaacagtccctggccatatctagtatatgaaatatctaccatctgtttagcactcggagctaagcatcatgggaagtagggtgctaactaccaccacaaacattaatatttagatttg

SEQ ID NO: 194118 - DNA, 601 bp, Human
cctaagtttcatgtaatagacttctgaattcaaggaatgccaaaattaataaattcaatccaaagattacaaattcccttggagcaaggactatgctagcgatctctgattgccacatttttcctcccctttctggggagttggctcagctagattgcacttccttatctgccatgcacttaagtgaggccataagactgagttctagccaaggggggcatggaaagaagtgacataacattacttcccatcctctaaaacctttcacactatccttcctgttccatccccttccttgtcrccctactggactcaaaagatccactgaaagattgtggggactgaaaaacaatgaagccattaaatggaagaggtctgggtccctgaaacaccatgtagaaggcagttatatataatgtaaggaagaaagaaactttctattgtggtaaggcaggagtttcagggtattgtaagctatagcagttagctatcttaaagaatatattctagattaagagtactccacacctcagctactcaatgcctcagattttttattgataaagagacatgctgaactaaatcagtgtttcccaaagag

SEQ ID NO: 194119 - DNA, 601 bp, Human
ttacaatacattgtgtaaaaataaatgtatacagatctcttactgcctaagtttcatgtaatagacttctgaattcaaggaatgccaaaattaataaattcaatccaaagattacaaattcccttggagcaaggactatgctagcgatctctgattgccacatttttcctcccctttctggggagttggctcagctagattgcacttccttatctgccatgcacttaagtgaggccataagactgagttctagccaaggggggcatggaaagaagtgacataacattacttcccatcctcyaaaacctttcacactatccttcctgttccatccccttccttgtcgccctactggactcaaaagatccactgaaagattgtggggactgaaaaacaatgaagccattaaatggaagaggtctgggtccctgaaacaccatgtagaaggcagttatatataatgtaaggaagaaagaaactttctattgtggtaaggcaggagtttcagggtattgtaagctatagcagttagctatcttaaagaatatattctagattaagagtactccacacctcagctactcaatgcctcagatttttt

SEQ ID NO: 194120 - DNA, 601 bp, Human
ctaaaagtgatttaaatggtttaattcttaacattagtaggaattacaatacattgtgtaaaaataaatgtatacagatctcttactgcctaagtttcatgtaatagacttctgaattcaaggaatgccaaaattaataaattcaatccaaagattacaaattcccttggagcaaggactatgctagcgatctctgattgccacatttttcctcccctttctggggagttggctcagctagattgcacttccttatctgccatgcacttaagtgaggccataagactgagttctagccaaggggggcatggaaagaagtgacataacattacttcccatcctctaaaacctttcacactatccttcctgttccatccccttccttgtcgccctactggactcaaaagatccactgaaagattgtggggactgaaaaacaatgaagccattaaatggaagaggtctgggtccctgaaacaccatgtagaaggcagttatatataatgtaaggaagaaagaaactttctattgtggtaaggcaggagtttcagggtattgtaagctatagcagttagctatcttaaagaatatattctagatt

SEQ ID NO: 194121 - DNA, 601 bp, Human
tggcaaccctcttcacaactctcctttgtggccccagagctaaaacctatcaccagatgtgttttattacggttgaaagcaaaacttactaacctatgtgttttgaattaagtctaaaagtgatttaaatggtttaattcttaacattagtaggaattacaatacattgtgtaaaaataaatgtatacagatctcttactgcctaagtttcatgtaatagacttctgaattcaaggaatgccaaaattaataaattcaatccaaagattacaaattcccttggagcaaggactatgctagygatctctgattgccacatttttcctcccctttctggggagttggctcagctagattgcacttccttatctgccatgcacttaagtgaggccataagactgagttctagccaaggggggcatggaaagaagtgacataacattacttcccatcctctaaaacctttcacactatccttcctgttccatccccttccttgtcgccctactggactcaaaagatccactgaaagattgtggggactgaaaaacaatgaagccattaaatggaagaggtctgggtccctgaaacaccatgtaga

SEQ ID NO: 194122 - DNA, 601 bp, Human
gcatgctatcccatgcactttctccccgagcccactttaactcctgacatgccagctttttaaagcttttccacagtggggccctttaggaataaaagctttaggaaatgatttctgagcagttaccgtagaaggaactcacagtttctcctccatttagactattctttagaatttcttcagtaagaaaatacttcatgattcatggcatatgctatatgctattgttaatattgtggcccatctgggtggagttgctcatgcctgtaatcccagcactttaggaggccaaggcaggcasatcacttgaggtcagaagtttgagaccagcctgcccaacatgggaaaaccccatctctactaaagatacaaaaaaattacccaggcttggtggcaaatacctgtaatcccagctactctggaggctgaggcatgagaatctcttgaactcaggaggtggaggttgcagtgagccaagatcgcaccactgccctccagcctaggtgacagagcgagactccatctcaaaaaaaaaaaaaaattgtggcccaaggggaaatatccaaggtcattacttttttttgtgttatatttcctttct

SEQ ID NO: 194123 - DNA, 601 bp, Human
tctagccacatctgaaggtaaccctgggaggttaggcagggctgcggaaaaaaaggattggaagggctgggcaccgtggttcactcctgtaatcccagcactttgagaggccaaggagggtgtatcatgaggtcaggagttcaagaccagcctggccaacatggtgaaaccccatctctactaaaaatacaaaaattagccagacatggtggtgcgcacctgtagtcccagctacctgggaggctgaggcaggagaatagcttgaacctgggaggcagaggttgcagtgagccgagatagygccactgcattccagcctgggcaacagagtgagactctgtctcaaaaaaaaaaaaaaagaaaaaagaaaaagaaaagaattggaagggataaaggattcaccatagggaacagagagttactgagtgaggcatgctatcccatgcactttctccccgagcccactttaactcctgacatgccagctttttaaagcttttccacagtggggccctttaggaataaaagctttaggaaatgatttctgagcagttaccgtagaaggaactcacagtttctcctccatttagactattcttta

SEQ ID NO: 194124 - DNA, 601 bp, Human
tgtttgagtgacaattgaacaaccaggtgaaagttaaaatatgggtccagaactcagaaatgcttagcactgtctttatagataaagacaattctgctgcagaaatgcttagcgccatctttataaagacaattctgcttttcacaacacatatacagtatatatagtggcagcttattctagccacatctgaaggtaaccctgggaggttaggcagggctgcggaaaaaaaggattggaagggctgggcaccgtggttcactcctgtaatcccagcactttgagaggccaaggagggtgkatcatgaggtcaggagttcaagaccagcctggccaacatggtgaaaccccatctctactaaaaatacaaaaattagccagacatggtggtgcgcacctgtagtcccagctacctgggaggctgaggcaggagaatagcttgaacctgggaggcagaggttgcagtgagccgagatagtgccactgcattccagcctgggcaacagagtgagactctgtctcaaaaaaaaaaaaaaagaaaaaagaaaaagaaaagaattggaagggataaaggattcaccatagggaacagagagttact

SEQ ID NO: 194125 - DNA, 601 bp, Human
atgtttgagtgacaattgaacaaccaggtgaaagttaaaatatgggtccagaactcagaaatgcttagcactgtctttatagataaagacaattctgctgcagaaatgcttagcgccatctttataaagacaattctgcttttcacaacacatatacagtatatatagtggcagcttattctagccacatctgaaggtaaccctgggaggttaggcagggctgcggaaaaaaaggattggaagggctgggcaccgtggttcactcctgtaatcccagcactttgagaggccaaggagggtrtatcatgaggtcaggagttcaagaccagcctggccaacatggtgaaaccccatctctactaaaaatacaaaaattagccagacatggtggtgcgcacctgtagtcccagctacctgggaggctgaggcaggagaatagcttgaacctgggaggcagaggttgcagtgagccgagatagtgccactgcattccagcctgggcaacagagtgagactctgtctcaaaaaaaaaaaaaaagaaaaaagaaaaagaaaagaattggaagggataaaggattcaccatagggaacagagagttac

SEQ ID NO: 194126 - DNA, 601 bp, Human
aacaaagtgctgagtatttagggaacagaaagaaattcactgtggttgaagctcagggtgctttaggaggcttgtagggaatgacaccaaagaggctgtctgaggccacattaggaagatgcttctgcaccagccttacaagtttggatttattctgagcagttttacatggagaatcaggagtgcagtactgcggtgtgtttttaaaaatataatgattaacggcaggtgaagagtgagtgttgacagggaggctggctgggcaactgccgtaatagttcaggtgagagatgaagttctraaccaagtcagtggcagtaaagtaagaaaagcaaagacaccagataatttagaaggcagagttcacaaaactttgtgaccacttagatatggggattaagagtagagaaggactgaggggggctaacggattttgagtttgagtgaccaggaaacacggacaccatgaatcatgagaaggaacacagaaggacaatcaggtgcgaggaggcagggctgggaaatgtttgagtgacaattgaacaaccaggtgaaagttaaaatatgggtccagaactcagaaatgcttagcactgtcttt

SEQ ID NO: 194127 - DNA, 598 bp, Human
tgttctatactgagatcgagcccagtcgccaagctttgccatcgcgtgccaggtctgactctaccaggatccccacttgttgcaccaacctaacaatatttggactgactttctccaaatatcttgttatgaaactagcagatacaggttcacatgtaagttgatcactcattcttttatttattctgccagcaaatactatgggacaccaacccaactgggcaacaagcaccatgctgagtgctggagtttcaaagttatgaaaggagggttgagggtctcttcaagaggatttcayaatatgatgggtggaaggggaagagggatgattcacagtctagtaatgatcaagcaatgttctcttgtggtatcctacagagtggggcagtgatggggccacaagaagatggggaagattcaggaaggaagtgatattttgattttatttttaaaggataagtatgagttttcctacagagataatggagagagtttcaggctgcaaaacaacaaagtgctgagtatttagggaacagaaagaaattcactgtggttgaagctcagggtgctttaggaggcttgtagggaatgacaccaa

SEQ ID NO: 194128 - DNA, 601 bp, Human
gctggagtggagtgcagtggtgcaatcatggctcactgcaacctctgcctcctggtttcaagcaattatcctgccttagccccccaagtagctgggattccaggcgtgtgccaccacgctcagctaaattttgtatttttagtagagacagggtttcatcatgttggccgggctggtctcaaactcctgacctcaggtaatccacccacctcggcctcccaaagtgctgggattacaggcgtgagcactacgtataaaaaagatgctaagagagcacagagaacaatggcttacatttcaraagaggaatggcaggaagagaaatctcagtgaaatgaacagtagatgcaaagaaaaaacacattccacctgacctcagtttcctcatctgtaaaatgggaataataatagtatctatttcctaggtttgttatgagaattaaatgagttaatatttgcaaagtgcttagaagaatgtctggcccatctgcatgtatttagtaaataactgtctagctctaggagcagcaggccatggtctgctttcaaaacacccatatctccatgtaccacctggcctggcttctaaaagcagctgtca

SEQ ID NO: 194129 - DNA, 601 bp, Human
tgcaccctcagttttcatttctttaccacccactccctccttaaccacttgcatctgcctcccacctcatagcctgctaaggctgttatcgaaaacattactgatgatcaaaccaaacggtcttctctgaattgtaagccaccttctgagatttgcaagtgctgacactcttctgcgcccttagtggccctgactttgggttgtcctggttttccttttctcccttcccttcagtttctcacaggacaacacctgtcatgtgtcaacaactgtgtgaagaatgacaaaaagacaataggamaagctcatttcctgagcttgtagccgcagaattgggccaggtgcttttaatcctcacagctgctctgcaaggtaaggattactacacccattttactgacaaagaaactaaaattaagtaatgtgcccaagtttacttgtggaacagactgacatagcaactatcatgtaatgacgtgggtagtatatatatatatatatttttttttttttttttttttttttttttttcaagacagagtcttgctgtgtcacccaggctggagtggagtgcagtggtgcaatcatggctcactgcaac

SEQ ID NO: 194130 - DNA, 601 bp, Human
cctgcctacagacgcattcagggctctcctatccaaaccgggaagcatgcttttcacctgctgctactctaacccttctcctctgttcctaaaagagaagacagtgcaccctcagttttcatttctttaccacccactccctccttaaccacttgcatctgcctcccacctcatagcctgctaaggctgttatcgaaaacattactgatgatcaaaccaaacggtcttctctgaattgtaagccaccttctgagatttgcaagtgctgacactcttctgcgcccttagtggccctgacttygggttgtcctggttttccttttctcccttcccttcagtttctcacaggacaacacctgtcatgtgtcaacaactgtgtgaagaatgacaaaaagacaataggacaagctcatttcctgagcttgtagccgcagaattgggccaggtgcttttaatcctcacagctgctctgcaaggtaaggattactacacccattttactgacaaagaaactaaaattaagtaatgtgcccaagtttacttgtggaacagactgacatagcaactatcatgtaatgacgtgggtagtatatatatatat

SEQ ID NO: 194131 - DNA, 601 bp, Human
ggctgtcatctccccagtgcatatttatatcccccaacatatgcacacactagaaccccacacccccttgacacttgatatggtccggctctgtgtccccacccaaatctcatctcagcattgtaatccctacaatccccatgtgttgagggcaggacctagtgggaggtgattggatcatggccgcagtttcccacatgctgttcttgtgacagtgagtgagttctcaggagatctgatggttttataaggggctctttcccttttactcatttctgctcgctctctctctcttgcctgmcgccatgtaagatgtgcctctttcctttttgccatgattgtaagtttcctgaggcctccccagtcattcagaactgagtcaattaaacctcttttctttataaattgcccagtctttggtatgtctttatagcagtgtgagaatggactaatacaacagttttgtcagtccccagttccgtccacacctttccctattcccttcatgcctggctatggaaggtcacacacacaatcctaactgccatctctatgcccagccaggctttcgctgctgctcatcagcccttgtgtagtgaag

SEQ ID NO: 194132 - DNA, 601 bp, Human
caattaactaacagcccatcaagactccctgctccaaaatcatccacacctttaagcatagttatcccacacttgggaatttatcctagggaaaaatctaaaagaagacaaagcagtatgtgcaaagataatataatgcagccactaaaaattattacaaacacaatgtagaaataaaaaatatttgctgaataatattaacagatgaattccacacaaaagttgcataaagactaaggttactttttcttcattggtaggtattcatatgacaaagaatagaagaaaaagtagagaaatkaagaacatcgtatttgagatgccagccatcccttggccttagtctctgaaaattcttttatctaatgttctgaaaccccagctctagccacaagctttggggtccccaccccactcccaggaacctgctctgcatcctcattgtcaccacaggacttccacacctgcctcattcacctgggccatcagcacctcccatctgactaaaggactggctgtcatctccccagtgcatatttatatcccccaacatatgcacacactagaaccccacacccccttgacacttgatatggtccgg

SEQ ID NO: 194133 - DNA, 601 bp, Human
gattacttgaggccagcagttcgagaccagcctggccaacatggcaaaacccccatctctattaaaaatacaaaaattagccaggtgtggtgctgtgcgcctgtaatcccagctactcaggaggctgaggcatgagaatcacttgaacacaggaggcagaggttgtagtgagctgagactgggccactgtacctcaggcctgggtgacacagtaagactctatttcaaaaaaatacataactccagaacagaaaaactccctttcattgctacctgcccctgccagatacacaatttgttyaacttcttcatgttcttgatgatagtccccaaaaagaaagcgtcaaagaccaagccaagcaaaattccatttactcaatcacacatgcaacttccagccagctctgttttccccttcactggggtaaatgcctccagtagaggcagcacacagaattgagagttatgtgaggtggacttaaaatattcacagaaagcttccattcagagtctattattaaatattctaattttcttccccatttgcctgccctccctgcctgctgtagatctgcctgcagcaattaactaacagcccatc

SEQ ID NO: 194134 - DNA, 601 bp, Human
catcaataaacccctttctgtatttcttctgttaaaagaaaaaaaggagaaacattagaatcataagacataaaaaaattaacagtaatattgttaaggaaattttgctctgattcaaaatattgcaatttctttaaaattatctaaatcatgtttcccactaactgctaaaattattcaaaatactaacactgtgattattgtaatcaaaattattaaatcctttaatttatcaagatgaaactgttctgtcctgcccccccaaaaaaactccagaatgggtcaggtgccgtggctcatmcctgtaatcccagcactttgagaggccaaggcgggtggattacttgaggccagcagttcgagaccagcctggccaacatggcaaaacccccatctctattaaaaatacaaaaattagccaggtgtggtgctgtgcgcctgtaatcccagctactcaggaggctgaggcatgagaatcacttgaacacaggaggcagaggttgtagtgagctgagactgggccactgtacctcaggcctgggtgacacagtaagactctatttcaaaaaaatacataactccagaacagaaaaactccctt

SEQ ID NO: 194135 - DNA, 601 bp, Human; identical to SEQ ID NO: 26693

SEQ ID NO: 194136 - DNA, 601 bp, Human; identical to SEQ ID NO: 26694

SEQ ID NO: 194137 - DNA, 601 bp, Human; identical to SEQ ID NO: 26695

SEQ ID NO: 194138 - DNA, 601 bp, Human; identical to SEQ ID NO: 26696

SEQ ID NO: 194139 - DNA, 601 bp, Human; identical to SEQ ID NO: 26697

SEQ ID NO: 194140 - DNA, 601 bp, Human; identical to SEQ ID NO: 26698

SEQ ID NO: 194141 - DNA, 601 bp, Human; identical to SEQ ID NO: 26699

SEQ ID NO: 194142 - DNA, 601 bp, Human; identical to SEQ ID NO: 26700

SEQ ID NO: 194143 - DNA, 601 bp, Human; identical to SEQ ID NO: 26701

SEQ ID NO: 194144 - DNA, 601 bp, Human; identical to SEQ ID NO: 26702

SEQ ID NO: 194145 - DNA, 601 bp, Human; identical to SEQ ID NO: 26703

SEQ ID NO: 194146 - DNA, 601 bp, Human; identical to SEQ ID NO: 26704

SEQ ID NO: 194147 - DNA, 601 bp, Human; identical to SEQ ID NO: 26705

SEQ ID NO: 194148 - DNA, 601 bp, Human; identical to SEQ ID NO: 26706

SEQ ID NO: 194149 - DNA, 601 bp, Human; identical to SEQ ID NO: 26707

SEQ ID NO: 194150 - DNA, 601 bp, Human; identical to SEQ ID NO: 26708

SEQ ID NO: 194151 - DNA, 601 bp, Human; identical to SEQ ID NO: 26709

SEQ ID NO: 194152 - DNA, 601 bp, Human; identical to SEQ ID NO: 26710

SEQ ID NO: 194153 - DNA, 601 bp, Human; identical to SEQ ID NO: 26711

SEQ ID NO: 194154 - DNA, 601 bp, Human; identical to SEQ ID NO: 26712

SEQ ID NO: 194155 - DNA, 601 bp, Human; identical to SEQ ID NO: 26713

SEQ ID NO: 194156 - DNA, 601 bp, Human; identical to SEQ ID NO: 26714

SEQ ID NO: 194157 - DNA, 601 bp, Human; identical to SEQ ID NO: 26715

SEQ ID NO: 194158 - DNA, 601 bp, Human; identical to SEQ ID NO: 26716

SEQ ID NO: 194159 - DNA, 601 bp, Human; identical to SEQ ID NO: 26717

SEQ ID NO: 194160 - DNA, 601 bp, Human; identical to SEQ ID NO: 26718

SEQ ID NO: 194161 - DNA, 601 bp, Human; identical to SEQ ID NO: 26719

SEQ ID NO: 194162 - DNA, 601 bp, Human; identical to SEQ ID NO: 26720

SEQ ID NO: 194163 - DNA, 601 bp, Human; identical to SEQ ID NO: 26721

SEQ ID NO: 194164 - DNA, 601 bp, Human; identical to SEQ ID NO: 26722

SEQ ID NO: 194165 - DNA, 601 bp, Human; identical to SEQ ID NO: 26723

SEQ ID NO: 194166 - DNA, 601 bp, Human; identical to SEQ ID NO: 26724

SEQ ID NO: 194167 - DNA, 601 bp, Human; identical to SEQ ID NO: 26725

SEQ ID NO: 194168 - DNA, 601 bp, Human; identical to SEQ ID NO: 26726

SEQ ID NO: 194169 - DNA, 601 bp, Human; identical to SEQ ID NO: 26727

SEQ ID NO: 194170 - DNA, 601 bp, Human; identical to SEQ ID NO: 26728

SEQ ID NO: 194171 - DNA, 601 bp, Human; identical to SEQ ID NO: 26729

SEQ ID NO: 194172 - DNA, 601 bp, Human; identical to SEQ ID NO: 26730

SEQ ID NO: 194173 - DNA, 601 bp, Human; identical to SEQ ID NO: 26731

SEQ ID NO: 194174 - DNA, 601 bp, Human; identical to SEQ ID NO: 26732

SEQ ID NO: 194175 - DNA, 601 bp, Human; identical to SEQ ID NO: 26733

SEQ ID NO: 194176 - DNA, 601 bp, Human; identical to SEQ ID NO: 26734

SEQ ID NO: 194177 - DNA, 601 bp, Human; identical to SEQ ID NO: 26735

SEQ ID NO: 194178 - DNA, 601 bp, Human; identical to SEQ ID NO: 26736

SEQ ID NO: 194179 - DNA, 601 bp, Human; identical to SEQ ID NO: 26737

SEQ ID NO: 194180 - DNA, 601 bp, Human; identical to SEQ ID NO: 26738

SEQ ID NO: 194181 - DNA, 601 bp, Human; identical to SEQ ID NO: 26739

SEQ ID NO: 194182 - DNA, 601 bp, Human; identical to SEQ ID NO: 26740

SEQ ID NO: 194183 - DNA, 601 bp, Human
gtatttttcttccaaaacaaactgaaaaatataggctctttggcaacatttttggaagtacaacataaacttatcacaataatttttaaactgcagacaactaaagggaaggaagaaaagcactactatatatacatacatatttgaggtcacctcctcctgatgctagagactatcaactgctcaaaagaaggaaaacaaaataaagatttcagtccccacacttagctgcgaatagctaacaaagggaattaacatgcggtcaataacaagaggctactaaaaactctgacaggttagkaagttttcatttcagtttcaaattcaaattcatactgtaaagtggtgatgaacacatcccatccgcaggtacttaacctccatacaaataagaactacctctcatatgggcaaaaagatcaaaattctacagaagaatctgatggctaaatggctaatttgcaaaacacaatgccctgtacattttgaggacatcctaaaacatgtgtaaacttttcagaattcagtttaccaaagttatcaaacttaaaaatgattaaaatttatttgctactgcaaagaattcaaccaatttctccaa

SEQ ID NO: 194184 - DNA, 601 bp, Human
tccttagctagcaatctcaggccaaactcccaacaagctcatctctgctgtcttattcaaatataaaccatcatggtttcaagcagtaacagcactcgcctatttcacacagctgacgcctcttaggccgtcaggaatttaaatcaccttcttgcccacaaagtatttttcttccaaaacaaactgaaaaatataggctctttggcaacatttttggaagtacaacataaacttatcacaataatttttaaactgcagacaactaaagggaaggaagaaaagcactactatatatacatayatatttgaggtcacctcctcctgatgctagagactatcaactgctcaaaagaaggaaaacaaaataaagatttcagtccccacacttagctgcgaatagctaacaaagggaattaacatgcggtcaataacaagaggctactaaaaactctgacaggttaggaagttttcatttcagtttcaaattcaaattcatactgtaaagtggtgatgaacacatcccatccgcaggtacttaacctccatacaaataagaactacctctcatatgggcaaaaagatcaaaattctacagaagaat

SEQ ID NO: 194185 - DNA, 601 bp, Human
ttctgcggtgccaagccctggggtttcaagaagaaagcaaaaaatgatttcctttccttaaccaaaacactacattttacttggggcgcagcagtctttactgctgcactcccatctcctccacccttcttttctgggcagttcattagcatacgactcaatgaggctaacttcttaatccagtacatattaaaagatcttgtcatcttgtcaataaggcacttccctctctacctatttcatattgcaaccaccaaagtccctactcctctgcactgtttttcaaaagcacctgccaccrttgaacttgttcgtctgtctcccatagcagaaacaaggacaaagacttctgttttattctgcgggaggccccagtacctagaactgtgcccagtacatagaagatgctcatgaataagtaaacagatgcaaatcactgaaagctacttttcggtaactgagtaaacaagtactattttaattattatacttaaaacctttgcacataaaagtgcacagtcattctttctaccacaaattaaacagaaattatctcatcttgtttttgaacaggcttttccggataatgcacagcgcattt

SEQ ID NO: 194186 - DNA, 601 bp, Human
ttgcttaactcactgctaccaaatgacaacttgtctctgtgttaccagtacccagcacgcatggtgcccgggactgcatgcacacatctcaagcagtttctgaagacacagaggagaaacactgccttagtcattcatgtttggttacaagatctactgaaatacctgcctccaaacagcagcagactgtctcttcagagacttctgcggtgccaagccctggggtttcaagaagaaagcaaaaaatgatttcctttccttaaccaaaacactacattttacttggggcgcagcagtcttyactgctgcactcccatctcctccacccttcttttctgggcagttcattagcatacgactcaatgaggctaacttcttaatccagtacatattaaaagatcttgtcatcttgtcaataaggcacttccctctctacctatttcatattgcaaccaccaaagtccctactcctctgcactgtttttcaaaagcacctgccaccgttgaacttgttcgtctgtctcccatagcagaaacaaggacaaagacttctgttttattctgcgggaggccccagtacctagaactgtgcccagtacat

SEQ ID NO: 194187 - DNA, 601 bp, Human
agcctggacaacagagcaagaccctgcctcaaaaaaaaaaaaaaaaaaaaggcaacaaaccctacaatggctggctatgctcaccaccacgaccacagcagcaacccaaacccagccctagtcagtgaagatttaaaaaccctttaacaaaggccaggtgtggtggctcccacctgtaatcccagtactttgggaggccgaggcgagcggatcatctgaggtcaggagttcgagaccagcctgaccaacacggagaaacccgtctctactaagaatacaaaattagccgggcatggtggcrcatgcctgtaatctcagctactcaggaggctgaggcaggagaatctcttgaacccaggaggcggaagttgcagtgagccgagatctcgccattgcactccagcctgggcaacaagagcgaaactctgtctcaaaaaacaaacaaacaaaaaactaacaaacacacttcaatggtcccccgtcaccttctgcagaatacacattcctaccaattcaggccctgtctacttccccatactcattcccactcatgctcttctgcataaccttcctctggacctcagtttcatcatccacaaac

SEQ ID NO: 194188 - DNA, 601 bp, Human
gtcccaattcaggaggctgaggcaggaggagaatcgcttgagcacaggaggcagaggttgcagtaagctgaaataacaccactgcactcccgcctgggagacagagtgagactgtctcaaaacaaaaagaaaaaaaaaaaaatgaggctggacacagtggttgatgcctctggtcccagctacttgagtggctgagacagaagcaacactcaagcccaggagttggaggcctggcggctgcagtgagctatcactgcgccactgaactccagcctggacaacagagcaagaccctgcctcaaaaaaaaaaaaaaaaaaaaggcaacaaaccctacaatggctggctatgctcaccaccacgaccacagcagcaacccaaacccagccctagtcagtgaagatttaaaaaccctttaacaaaggccaggtgtggtggctcccacctgtaatcccagtactttgggaggccgaggcgagcggatcatctgaggtcaggagttcgagaccagcctgaccaacacggagaaacccgtctctactaagaatacaaaattagccgggcatggtggcacatgcctgtaatctcagctactcaggaggc

SEQ ID NO: 194189 - DNA, 601 bp, Human
cctagaacaagacagacacacactgaacagcctggtttcaaatcctacccctatcacagatcacctgaagctcaggagtttcagaccagcctgggcaacatggggaaacctcgtctctacaaaaacaacaaaaaaaacaaaattagccaggcatggtggtgtgaacctgtagtcccaattcaggaggctgaggcaggaggagaatcgcttgagcacaggaggcagaggttgcagtaagctgaaataacaccactgcactcccgcctgggagacagagtgagactgtctcaaaacaaaaagaaaaaaaaaaaaatgaggctggacacagtggttgatgcctctggtcccagctacttgagtggctgagacagaagcaacactcaagcccaggagttggaggcctggcggctgcagtgagctatcactgcgccactgaactccagcctggacaacagagcaagaccctgcctcaaaaaaaaaaaaaaaaaaaaggcaacaaaccctacaatggctggctatgctcaccaccacgaccacagcagcaacccaaacccagccctagtcagtgaagatttaaaaaccctttaacaaaggccaggtg

SEQ ID NO: 194190 - DNA, 601 bp, Human
caagtgatcctcccaccttagcctctcaaagtgctgggattataggacagaggcaccatgcccagcccggcatgtgctgtttaatacaatttttgttaacaagatgacaaggcagttaagttaaacccaacacggtattctggaaaaaaaaaaaagtgctaaatcaaggatagaaaaaaaataatgaatttacacaataaaaaagaaaataattttgactaaagaaccaaccaacccagaactcaatgcctagaacaagacagacacacactgaacagcctggtttcaaatcctacccctrtcacagatcacctgaagctcaggagtttcagaccagcctgggcaacatggggaaacctcgtctctacaaaaacaacaaaaaaaacaaaattagccaggcatggtggtgtgaacctgtagtcccaattcaggaggctgaggcaggaggagaatcgcttgagcacaggaggcagaggttgcagtaagctgaaataacaccactgcactcccgcctgggagacagagtgagactgtctcaaaacaaaaagaaaaaaaaaaaaatgaggctggacacagtggttgatgcctctggtcccagcta

SEQ ID NO: 194191 - DNA, 601 bp, Human
ggacatgagccaaagaggttcaccttcccatggaatggtacctgttgcaacttaacagagtccattgataaaatgattcactcaattttcatttaagtgaaggctgtgcttttttaaagagacacacagtctcactctgttacccaggctagagtgcagtggcaggatcatagctcactgcagtctcaaactcctagcctcaagtgatcctcccaccttagcctctcaaagtgctgggattataggacagaggcaccatgcccagcccggcatgtgctgtttaatacaatttttgttaacragatgacaaggcagttaagttaaacccaacacggtattctggaaaaaaaaaaaagtgctaaatcaaggatagaaaaaaaataatgaatttacacaataaaaaagaaaataattttgactaaagaaccaaccaacccagaactcaatgcctagaacaagacagacacacactgaacagcctggtttcaaatcctacccctatcacagatcacctgaagctcaggagtttcagaccagcctgggcaacatggggaaacctcgtctctacaaaaacaacaaaaaaaacaaaattagccaggca

SEQ ID NO: 194192 - DNA, 601 bp, Human
taataaaactaaaaaaaagttatcattttttttgagacaggatctcagtcaccaaggctgcagtgtagtgatgcaatcctggctcactgcagcctcaacttactgggctcaagcaatcctcccatctcagcctcctgagtagctgggacaacaggcgcaggccaccatgcccagctaattttattttttgtagagatagggtctggctaagttgcccaggctgagtcccaaactcctggcctcaagagatcctcccacctcagcctaccaaagtgttgggattacaggtgtgagtcaacaygcctggcctatacaatttcaaaatctaatctaaatgcatttaaagtaacagctaaatgcacagcttaaaaaggtccttaaatgtaaaataatacaggtgtggttacgaagttccttaaactcagatgtgggaaatacacctgagggcctcgctaaacggttgttccagctgaaaactggccaatgttcattcttcagtacctgagcaaagcccaaaccactgaatcacatagctttagggtaaaaccaacaacaaaaaaacccctctatatttaacaaaaacagttctaattatgatcta

SEQ ID NO: 194193 - DNA, 601 bp, Human
tggtgaaaccccatctctactaaaaatacaaaattagctgagcgtggtggtgcacgcctgtaatccccgctactcaggaggctgaggcagaagaatcacttgaacccaggaggcggaggttgcagcgagcggagatcatgccactgcactccagcctgggcaacaagagtgaaactccatctaaaaaaaaaaataaaataaaataaaattatcttattggcactaaaataaccagacttcagaataacattaattctaatttgccttattttttataatacattcggcaacacaaacatayattaatgatagcccaaccattttagagtaagtcaaagcatttactggtgtttacactttcaaattaacttatgggattattttctaattgcatttgtttattccgtatcttccattacttctacactgaggatgtattgcttgtgtaaaaaccttgtgtaatatactcagtattattccacttttaaagatgattatttctatattggtagaattagatgacattgtaactgaatattaagggtgtgttctagggcatttacttcttaaatagaagaacttgatattaataaaactaaaa

SEQ ID NO: 194194 - DNA, 601 bp, Human
aaaagtaaccctcaatccacaaaacaaaatcttccacttgatcactgacaactacagactgttaggagagtgtcaaaattacctgacttcaccccaggggtgttaaagcatggagagcaaaacgattgctttccataaaagatctgtagtgtcaatgtctgaggcactgttcatgtcggaagtaatttctttacgtgctcaaatacatacacaagaaatgagccatcagctagacgctgaaatgcatttaactttgattctaattatttattgaaaaatggcttggctgttgctcaccaaytgaattttaaactccaataaacaaagtccactttggcttacctgtgatctgccatctgaatgtttttatcccctataaattaaaaagagttgtaataattatattcataagcaaaaatgtttgttcaatatactttttaaacaacggttatctgtgggatggagtccactagaagggacaggagggaactttctagagtgatgaaaatgttctagatcttgactgaggttacctgagtatatacacttgttaaagcttattaaactatacacttcagatctgtgcatttcatcacacaca

SEQ ID NO: 194195 - DNA, 601 bp, Human
agtttttaaagatgcctggacacacctccctcacaaaaaataaacatcaaataatatacacaactaaaagtaaccctcaatccacaaaacaaaatcttccacttgatcactgacaactacagactgttaggagagtgtcaaaattacctgacttcaccccaggggtgttaaagcatggagagcaaaacgattgctttccataaaagatctgtagtgtcaatgtctgaggcactgttcatgtcggaagtaatttctttacgtgctcaaatacatacacaagaaatgagccatcagctagackctgaaatgcatttaactttgattctaattatttattgaaaaatggcttggctgttgctcaccaactgaattttaaactccaataaacaaagtccactttggcttacctgtgatctgccatctgaatgtttttatcccctataaattaaaaagagttgtaataattatattcataagcaaaaatgtttgttcaatatactttttaaacaacggttatctgtgggatggagtccactagaagggacaggagggaactttctagagtgatgaaaatgttctagatcttgactgaggttacctg

SEQ ID NO: 194196 - DNA, 601 bp, Human
gtggctcatgcctataatcccagcactttgggaggccaaggtgggcagatcacctgaggtcaggagctggagatcagcctggccaacatggcaaatccctgtctctactaaaaatacaaaaacaaaacaaaacaaaacaaacaaaaaaacacgtgcagcaaatcaccatggcacatgtatacctatgtaacaaacctgaacactcagcacatctactccagaacgtacagtgaaataaataaaactacaaaaaactagccgggagtggtggcgtgcacctgcaattccagctactcaggargctgaggcaggagaatcacttgaacccgggaggcggaagttgcactccagcctggatgacagagcaagagtctgtctcaaaaaataaaaataaaaaataaatgtccccttcttgtcgtaatagccctggcagtcctgactggggaaaccagctggaaggtggggcctcctgggagaccaagccctgacccaattatagatggaagcccagtaacagctcatccctttaaaaaaaaaaaaaaaaaaattgccatgcatggtggtgcatgcctatagttccaactactctggaggctgaggt

SEQ ID NO: 194197 - DNA, 601 bp, Human
cctgcctcggcctcccaaagtgctaggattacaggtgtgagctaccatgcctggctaattatacaattttaaattagtttaatttttgaagctttccaactgaagtaaaatgacaaaggatttttttttttaattatactttaagttttagggtacaaatgcacaacgtgcaggtttgttacatacgtatgcatgtgccatgttggtgtgctgcacccattaactcgtcatttagacaaaggatgttaaacaaactggaccctagtgtgcccccaacagtccttcaatcattcacaccaaytacacccagccctctgccggcacttttcctgcaatatggctaatatggaaccacttctagtcccacataaacctgatcccactcaagcagttcctctcacagaatgccaccccaccaacccagtttctaaagcgagaaaactagaaaccattactcattctcattcttgccactcccactcagtatcaccccatcccatcaatctagtctgcaaaaaaaataacatcaaaacaccttgcccactaagtaatctctgagaagcttctaaatgggcaaagcaaactctgaatgtcaccttct

SEQ ID NO: 194198 - DNA, 601 bp, Human
cttaacattctagaactactgctagtagtagatgaaaaaaagggaaaagcagaaagaatttaacaaaatggtagactcccactgccatttttaccccttttctgcactggtcattcattcattcatttattgtgacaggatctcactctgttgcccaggctgcagtgcactggtgcgatctcggctcactgtagcctcaactttctgggctcaaatgatactcccacctcagcatcctgaatagttggactacaggggcacatcaccatgcccagctaatttttttgcatcctgtagagtwggggtttgaccatgttgcccaggctggtctcgaactcctgagctcaagcaatctgcctgcctcggcctcccaaagtgctaggattacaggtgtgagctaccatgcctggctaattatacaattttaaattagtttaatttttgaagctttccaactgaagtaaaatgacaaaggatttttttttttaattatactttaagttttagggtacaaatgcacaacgtgcaggtttgttacatacgtatgcatgtgccatgttggtgtgctgcacccattaactcgtcatttagacaaaggatg

SEQ ID NO: 194199 - DNA, 601 bp, Human
gcttaacattctagaactactgctagtagtagatgaaaaaaagggaaaagcagaaagaatttaacaaaatggtagactcccactgccatttttaccccttttctgcactggtcattcattcattcatttattgtgacaggatctcactctgttgcccaggctgcagtgcactggtgcgatctcggctcactgtagcctcaactttctgggctcaaatgatactcccacctcagcatcctgaatagttggactacaggggcacatcaccatgcccagctaatttttttgcatcctgtagagwaggggtttgaccatgttgcccaggctggtctcgaactcctgagctcaagcaatctgcctgcctcggcctcccaaagtgctaggattacaggtgtgagctaccatgcctggctaattatacaattttaaattagtttaatttttgaagctttccaactgaagtaaaatgacaaaggatttttttttttaattatactttaagttttagggtacaaatgcacaacgtgcaggtttgttacatacgtatgcatgtgccatgttggtgtgctgcacccattaactcgtcatttagacaaaggat

SEQ ID NO: 194200 - DNA, 601 bp, Human
ctaaaggtccttagtttaagcaaagactctcaaataatgcttaacattctagaactactgctagtagtagatgaaaaaaagggaaaagcagaaagaatttaacaaaatggtagactcccactgccatttttaccccttttctgcactggtcattcattcattcatttattgtgacaggatctcactctgttgcccaggctgcagtgcactggtgcgatctcggctcactgtagcctcaactttctgggctcaaatgatactcccacctcagcatcctgaatagttggactacaggggcacrtcaccatgcccagctaatttttttgcatcctgtagagtaggggtttgaccatgttgcccaggctggtctcgaactcctgagctcaagcaatctgcctgcctcggcctcccaaagtgctaggattacaggtgtgagctaccatgcctggctaattatacaattttaaattagtttaatttttgaagctttccaactgaagtaaaatgacaaaggatttttttttttaattatactttaagttttagggtacaaatgcacaacgtgcaggtttgttacatacgtatgcatgtgccatgttgg

SEQ ID NO: 194201 - DNA, 601 bp, Human
atacagccacactgtgttcctctctctgtgtagggttcaatacattacgcgagatactcagcactttattataaaataggctttgtggaagatgattttgcctgactgcaggctaatgttagcgttctgagcttgtttaaggtagtctagactaagctatgtttggcaggttagatgcgttcttaccctagatgttgtcaacttataatgggtttatcggaacctaacaccttcgtaagctgaaaactatctgtatattaaattaacagagctccctaccttgtcaaagagaggctggtayagcgctgcatactttctttccaagtcatgtacctcttcatagaacttggcttctatgtgagcacatctcacctgaagttgtttcaatgcattaattcttctttttactgctttaggtaaactaaaaaagggagtaagaaatacaacatcctcatgcctgcaaaataaagcagcatgcttttcaattttattaaaataaatttaggttaacatggaatcaacatccttactatgaacaagacctcttaaaaattaagaaaaggacaataccccaacaggaaaaaaaggatacaggaggaag

SEQ ID NO: 194202 - DNA, 601 bp, Human
attttagggttcaaagaaaaatattaaatgattccctgggtaaacctggatgtttcacctaaagatgtaaaataaagacagtccccgatttccaatggttcagctaaagattttcaacttcctgatggtgcagaagccatcacactttgggcaccaatacagccacactgtgttcctctctctgtgtagggttcaatacattacgcgagatactcagcactttattataaaataggctttgtggaagatgattttgcctgactgcaggctaatgttagcgttctgagcttgtttaaggtastctagactaagctatgtttggcaggttagatgcgttcttaccctagatgttgtcaacttataatgggtttatcggaacctaacaccttcgtaagctgaaaactatctgtatattaaattaacagagctccctaccttgtcaaagagaggctggtatagcgctgcatactttctttccaagtcatgtacctcttcatagaacttggcttctatgtgagcacatctcacctgaagttgtttcaatgcattaattcttctttttactgctttaggtaaactaaaaaagggagtaagaaataca

SEQ ID NO: 194203 - DNA, 601 bp, Human
tctttgtggactgaccctgtctgatgccaaccagaaggtcaagtcagtactcaccataggctgtccagggtcagaaaatttcactttaatatcctgcaggtgtttcaagattggttcatcatattcctaatcaaaaagagaaaaaaaattccaacaggcttttaaaaaaacaacacatctctcccgaagagtcatggttgcagaggctcccagatgttgcataactagccctattggaattctgtccttgtcaaagtaataactaccaggaagaaacccagacttattcaccaactccctrtcatagagaagcagcaccaaggtgtcccctttccctagtgtggagcaacggtggctgccactgccagcaaagggcagtgccactgacacccgcctgcctgcaatactggggcaagggccttcactgctttcctgccaccagctgccactgcacacagagatcagaaatgctaccaaccaagactgttggtcctcagcctctctgaggagaaagagcagaagcctggaagtcagaagagaaggctagatcggctacggccttggcagccagcttccccacctgtggcaataaagttgtgca

SEQ ID NO: 194204 - DNA, 601 bp, Human
atgcggtactcagtctaactcttggagagcagtctcgcccagggctgcccagcagatgagtggctgggtgtgggttttgtgggtttcttgcccctggctccaagttcttccatctttgtggactgaccctgtctgatgccaaccagaaggtcaagtcagtactcaccataggctgtccagggtcagaaaatttcactttaatatcctgcaggtgtttcaagattggttcatcatattcctaatcaaaaagagaaaaaaaattccaacaggcttttaaaaaaacaacacatctctcccgaasagtcatggttgcagaggctcccagatgttgcataactagccctattggaattctgtccttgtcaaagtaataactaccaggaagaaacccagacttattcaccaactccctgtcatagagaagcagcaccaaggtgtcccctttccctagtgtggagcaacggtggctgccactgccagcaaagggcagtgccactgacacccgcctgcctgcaatactggggcaagggccttcactgctttcctgccaccagctgccactgcacacagagatcagaaatgctaccaaccaagactgttg

SEQ ID NO: 194205 - DNA, 601 bp, Human
aaaaagtagaagagacagatacaggtacatccactgcccacccctgctgctgccccaggcattacttgcagcacttgcagtgaagaaatcccactcctagtggccctcatccattagcccaggccccagtgctgagatggggaggaaggaagatactggtgactggccccaggcccctaccaccatcacccacacccaagatccctaacccacagcccgtcatgcagcatttgtctccaagacctgaaactgaaagccaccagtcagtcagtcatgtgtcgctggaaatgctattgcaccrgaatggaacccattagctacagccaggctaacgggttacgaacagtgctccctgggagaaccaggctgggatgagacagtctggcaaggccatttgaagatgagcatatggttcctcagataaaagtaagggctgacctagtcaagcttatcttaccaactggtaggctgatccatgccactaacattactaatgcaatgatatgccatggcaagcatattgtaaagacgtgtttcaggacaaatcaaagagcaggaaaacatttttcagtcttatttgcgcttttttttttagggtaaa

SEQ ID NO: 194206 - DNA, 601 bp, Human
agggaaaaaaagttaattgcgtctggatgaatcacaggtaagaaagaagtacaaagaaaaaacgcacagaaacttaaagcaccgcacgctcacaccatggggaagagaatgcacaccaacgagggcaaactaggcagacgtgcccaggcggctcctgggggccctgtgataaagtctaaacagaagtgatgcaagcccaggaagaaggacctgctataacccacatgggggaaggaagatggggtatcccctctggagggcagcccccagctggtgagcaggcatcactcccagctcccasggccccacctagagagggacacctgaatgtcaccttccatagtggaaaacagacaggaaaaagtagaagagacagatacaggtacatccactgcccacccctgctgctgccccaggcattacttgcagcacttgcagtgaagaaatcccactcctagtggccctcatccattagcccaggccccagtgctgagatggggaggaaggaagatactggtgactggccccaggcccctaccaccatcacccacacccaagatccctaacccacagcccgtcatgcagcatttgtctccaagac

SEQ ID NO: 194207 - DNA, 601 bp, Human
atgaaaagtggcttgaaaataagactgcttcattcacacacgcactacagccaggtaagccataaatatgctaaccatgctcaatcttacaagcaactaaagaaatgcaaaattaggcagggcctgagtggctcatgtctgtaatcccaactgaacgacctttgggccttctaaagcttcatcttctttgactggtaagtacactgaaaggaatctaaactaaggaaaccatcaaacatttaatttaacacaaatttgggttcaagtatgctgatcataatgcaacaatttacaatggggkaggtggtgcatgtaggggaatgttaaactgttttatagccaatggctgcagtaacaactattcccccagccaagcctgtgtgatgtggcagcagggtgacactgtgcacacaccatgtggtgtggcaggagccgtgtggcacacgtgtgcactgtgtatccaggtaggcaagcgctcaagggaagggaatgaggcatgctgcaaaaacaccagtcaagactcattttgaagtttcatttatctttataacttaaaatgcattagacgcttcataataattttacaaaggaaaaagagtat

SEQ ID NO: 194208 - DNA, 601 bp, Human
cccatctctgcctacactgctaggcaactcgcggaagctactcaatgtctccgtgctttagtttcctcatctctacactggaaataactctctccctctctaggagctgccttggtggttaatctgtatcacttagagccgcgtttataggcaaggctggctaaatgtcagctgtttccattttcattgtaatggtaaaaccatcaacggggggggaaattaagaggactaaaaaaaatatacagcaaaaaaagtttatacattcaaacaaaccacttgcacaaaggagaagtgaaaaaayaactttcaaagaaaggtggaggaggaggcggggcatgagggcttaggaagtcaggatcagggagacagtctagtcggtttctagaagggatgacagcaggatctggctaggagctctccactggccttggcaagagcaaaggaagcgggtagggcactgcagatgaaccacacaaacgaaaggccagtcacctgcctggcaaaaatcacaaggaaaggaagaggcagctacagggaatcagcatcaaataaaatgcctatttctctcccaaccctccacggcttaaaaaaaaaaaaaaaa

SEQ ID NO: 194209 - DNA, 601 bp, Human
tgaggttaaaaaaaccaacgatggactggcgggaaatatctgttcagttcatgagtaaggggcatgttccccctccaatgcctcctcaccaataggcgtcaagctctcctaagaaatcctagcttctcttagctgctcccagcccttgcttcctggaaggagggaaggtgactaggggaaagtaaggggaccagcagtccatcctcctcctgtccttttccgctcagcctaagccccagcccccaccctgctgggggaagccagggtctctactctgtgctgtgcagtgaaagcagtgacycacagcttttctcccgggaggtgggtgggagaaaaggacaaatctctacaaggacagaaagctcatccctcacttacaaagcacgctacagacctggaagagacgtgagcacaccgggaaaaaggatgcaaacatgaacgcaggcatagaacaaccaacagcagcaacaaggcattcatgctcacgagtaacaaaacacatgaacaccaaaatgagatgcctttctttggggcaaaatgtacaaaaatatgtagacccggccaggattttggggtactgagcacactcatgtactgtcaa

SEQ ID NO: 194210 - DNA, 601 bp, Human
ttcagtacgttaattttagagttgtgcaaccatcataccctaaaagttttagaatctaaaaaaaaaaacacttaaaaattcccttgagtccattatcaactccatttttatcctaaaaattatttttaaatcagttttaagagaacttcctacacaaagtgattccagaaattaaagcctcccttcttcacgctgaattcacagacaatctccagtatgcccaacccaagtgtctaaaaggaatcttccaaaaaaaggaaatgtaatatctaaatttatgactgctctcattccccaaacygtatgtatttgcatcttctaggttcaaagtctaattgcagaaaataggcaccacaattaaaataatggactgaactctgaagggcagcttgataaataagggtgctaagctcagagacaaaatcaaaaaatcaatcactcagactggagaagagatccgccctgtggccccacatacaaacaaacactcactgattatctgcagcaggggctggcatctcttcacttcaaattatgttttagttcatggaaactaaagagaatatggatattttaacactgacaagttgcttgaccttca

SEQ ID NO: 194211 - DNA, 601 bp, Human
ccttttcaatcttcactgggctctcctctctgagtctcccttcccattaagcgaccacaaccctggcagcacttgctgtttgctgctgagacatgaatgttgggtgcgtaaacaccacccatgagtgaggcagagttcccaagcctcggtgtgccagcatcacccaggggttttagacatgggttaggagcatggctgggtgtctaaatgctggagcagcatgctccccagggcactctggcccaagtcatgaatagtacaaggactctgaacactcatacttctggactggctttgcagytttaaggacaaaggagctggactcactagctaatgcctccttcacttcacaccacaggagtccattttgtctgttccttcactaccccattacctattccgcagccatcctcaatttttttcaaagcacttaccatttggtattatgtgtttgattactttaaaagtggctttactgatgggatttacataccattaaaaggcatacactctaaatgtacaactttatgactttcagtacgttaattttagagttgtgcaaccatcataccctaaaagttttagaatctaaaaaaaaaaa

SEQ ID NO: 194212 - DNA, 601 bp, Human
accaccatgtccagctaatttattattttatcttttgagacggagtcttgctctgtcgcccaatggaatacggtggtgcaatctcagctcactgcaacctcctcctctcgggttcaagtgattctcctgcttgagcctcctgagtagctgagattacaggcgctgccaccgtgcccaactaattttttttttttttggtattttaagcagaaacggggtttcaccatgttgaccagactggtcttgaactcctgacctctggtgatccacccaccttggcctcccacagtgctggtattaygggcgtgaaccaccatgttcggctggctaatttatttggttttaattttttgtggagatggggttgtgctatgttgcccaggctggtctcaaactcctggactcgtgcagtcctcccacctcagcctcccaaagcattaagatcactggcatacccagtccacacacagccaggactggactttttttaacaagtagacaagtagacattcactcaggagagacttcaacaggaaaataagactattaacaacaaatcttaccagtgattctccatccccggatgctagaaaaagaaaag

SEQ ID NO: 194213 - DNA, 601 bp, Human
aaatggattttttttttttaagagacagggtcttattctatcacccaggttggagggcagtggtgcaatcacagctcactccagcctcaagctcctgggccccagcgaccctggaactacacagtgcaccaccatgtccagctaatttattattttatcttttgagacggagtcttgctctgtcgcccaatggaatacggtggtgcaatctcagctcactgcaacctcctcctctcgggttcaagtgattctcctgcttgagcctcctgagtagctgagattacaggcgctgccaccgtgyccaactaattttttttttttttggtattttaagcagaaacggggtttcaccatgttgaccagactggtcttgaactcctgacctctggtgatccacccaccttggcctcccacagtgctggtattacgggcgtgaaccaccatgttcggctggctaatttatttggttttaattttttgtggagatggggttgtgctatgttgcccaggctggtctcaaactcctggactcgtgcagtcctcccacctcagcctcccaaagcattaagatcactggcatacccagtccacacacagccag

SEQ ID NO: 194214 - DNA, 601 bp, Human
tgctcaaaggtgaacctccaccattagtcaattgtcttgaatcagtttctcctacatccaaatacatcattggtcagactaaaaatcaagtttcaaacatgagacttacaccaaaagcaaaaccaccttatcactactggttgcataacaagggtagtgcatgaaaatgcagcttcatttatcaacatttcccgttttgttgagctcacaccatgtattgcttagagccaacttcggtggaacttagaagggccctactgtgctggtgtggagttcacacagtgtgcacagcctcctggcrccacgcagcagccaggatgagatgtggccacagtgcagcgcccttccgctctaaggaccctaactggcatcaggcagggaaaggcttctcaatattcttccatttcacgtcagatccaacgagcctccagcaggctccagggcctattccaaggctctaaggacagcattttgcccttaaggggctgtgcacaggggctgctccagatgcatcacccacctgggcagagcaggagctgccacgtgcagagaagacaagaccagggttcccacattcacctcctcctccaacaactttcta

SEQ ID NO: 194215 - DNA, 601 bp, Human
taaattttctacaaggctgatcgaaccagcagcataatgttattggatacaggaatctgggtatcattttacatctcatacaaagggaaaagaaaccttagtagaaatatattaaaactttggtgtttaatctttaaagtgatcaataaggtgctcaaaggtgaacctccaccattagtcaattgtcttgaatcagtttctcctacatccaaatacatcattggtcagactaaaaatcaagtttcaaacatgagacttacaccaaaagcaaaaccaccttatcactactggttgcataacragggtagtgcatgaaaatgcagcttcatttatcaacatttcccgttttgttgagctcacaccatgtattgcttagagccaacttcggtggaacttagaagggccctactgtgctggtgtggagttcacacagtgtgcacagcctcctggcgccacgcagcagccaggatgagatgtggccacagtgcagcgcccttccgctctaaggaccctaactggcatcaggcagggaaaggcttctcaatattcttccatttcacgtcagatccaacgagcctccagcaggctccagggcctattc

SEQ ID NO: 194216 - DNA, 601 bp, Human
caagcagagaaagccaaagaaacaacttcagggaggtaagtggcactgcataaacctgtctcttacctcctcttctccttcttcaccttcttcaaactggagaaacacagaaaaacatttttaggtttacaaaacatgacagcagcctgcccaagacaccagtcccatcaagtgactcactgaccaagcctaagaggagcagaaagtccagccacgctgcctgctgggcctcgcttgcctgaggagccatttgcttgtgtgcagcgcattttaaaagcatgccaggaaattgaaagtcacrcaaaacaaggaataggataggaagctggtcagccagggtgtaccctggacacagctgggaacctggcaccacagctctgccctggctgttctcacaccgaggagcaggcacacaggaaaagatttttgtaaaccgatgaatttgttttccttaaattttctacaaggctgatcgaaccagcagcataatgttattggatacaggaatctgggtatcattttacatctcatacaaagggaaaagaaaccttagtagaaatatattaaaactttggtgtttaatctttaaagtgatcaataa

SEQ ID NO: 194217 - DNA, 601 bp, Human
aaacggccacaatttctcatgatacaaaagggctgcaagatactgaactcggggtgaacaacttcaacactagatcatactttcaaaatgggcagaagcatgattttcacttctatcagactgctcccaatactaaaacctcccttccttccttgttttcttttgcttgcacagactctaacactgcccatctctctggaaggtgcatgtgacagggacagcaggcttggccttatcctggccacacatgccgggccgtctctgaacttcattcacaccattagccggaacatgtttttastcccttctcccccaaccaacataaccgtttatcaaaggtttcatggggtgttagcatgtgtaatccaccacatcatgttctctgtaatggctggtgagaatgctcttttagaaacctgggacgtgaaaggagactcaaggttctccaaggtgacagagaaagcagaacaaacaacagaggggaggaaaagagaagctgaggcacagaatacagggagggggagatacaagtgcaacaaggacagaggcagctgtgcgcggagtctgaggaggtggccctgccaattgaccccagtccttg

SEQ ID NO: 194218 - DNA, 601 bp, Human
ggaaacggccacaatttctcatgatacaaaagggctgcaagatactgaactcggggtgaacaacttcaacactagatcatactttcaaaatgggcagaagcatgattttcacttctatcagactgctcccaatactaaaacctcccttccttccttgttttcttttgcttgcacagactctaacactgcccatctctctggaaggtgcatgtgacagggacagcaggcttggccttatcctggccacacatgccgggccgtctctgaacttcattcacaccattagccggaacatgttttyagtcccttctcccccaaccaacataaccgtttatcaaaggtttcatggggtgttagcatgtgtaatccaccacatcatgttctctgtaatggctggtgagaatgctcttttagaaacctgggacgtgaaaggagactcaaggttctccaaggtgacagagaaagcagaacaaacaacagaggggaggaaaagagaagctgaggcacagaatacagggagggggagatacaagtgcaacaaggacagaggcagctgtgcgcggagtctgaggaggtggccctgccaattgaccccagtcct

SEQ ID NO: 194219 - DNA, 601 bp, Human
ctacaactggttcttgcttcattcaactagcaccaacctcacaacagtactttttactgctgacaccaaaacagatgccagttcatgtttcagataaaaaatgctggcacagtaaaagctgttacccctctgtgtacctattggtctgcacaaaacatgaattcaaaaagtatagatattcaacagacacgtgttggtaatgacagtgggccaatttcaactgccagtgtgtgttctgagcacagctgggacagcccagtgtgttatgctctctgcaaggactgcttgcttatggtggccygtgtgtgccaccgtgcagactgctgaccatccagggccctcttactggaaagcagtaccatcagcaatgaaaattacacccaagttacatctttgctacttggttagcaagaaacactgggctcagaaagcagggaccaaatctaggtttggttcgttgattttaaaagtacatgtaacagacacctatgtcaaacctgtgacacagtgagtgtacctggacagcaactccctctttattcaaagtcaaaacaatgcattgtataaagtatagatcagaagtttggaagttaggtatgaa

SEQ ID NO: 194220 - DNA, 601 bp, Human
cccatgaaagcagcctacatgaggaagacagggaggcggtggcgctaagacctcaaggacgtctggtctatgggctgccaggatcatgctgatgttctgtgacgagacccttaaaaacggagtgcctacttatcctggcatgcagaggccctgctatggttgtggggttcctcatggcacctcttgtccccacctctctgctttctcccactacatcccgagtgccacgagtgaacaggtctcgtcacgggcaagagcctctgtctacttacggcctcctgtcagcattccaggacaggayagagctacagggactgaagaaagtggagtgggaaacagcttccaggcttactgacactcactttcatctacaactggttcttgcttcattcaactagcaccaacctcacaacagtactttttactgctgacaccaaaacagatgccagttcatgtttcagataaaaaatgctggcacagtaaaagctgttacccctctgtgtacctattggtctgcacaaaacatgaattcaaaaagtatagatattcaacagacacgtgttggtaatgacagtgggccaatttcaactgccagtgtgtg

SEQ ID NO: 194221 - DNA, 601 bp, Human
tcccatgaaagcagcctacatgaggaagacagggaggcggtggcgctaagacctcaaggacgtctggtctatgggctgccaggatcatgctgatgttctgtgacgagacccttaaaaacggagtgcctacttatcctggcatgcagaggccctgctatggttgtggggttcctcatggcacctcttgtccccacctctctgctttctcccactacatcccgagtgccacgagtgaacaggtctcgtcacgggcaagagcctctgtctacttacggcctcctgtcagcattccaggacaggrcagagctacagggactgaagaaagtggagtgggaaacagcttccaggcttactgacactcactttcatctacaactggttcttgcttcattcaactagcaccaacctcacaacagtactttttactgctgacaccaaaacagatgccagttcatgtttcagataaaaaatgctggcacagtaaaagctgttacccctctgtgtacctattggtctgcacaaaacatgaattcaaaaagtatagatattcaacagacacgtgttggtaatgacagtgggccaatttcaactgccagtgtgt

SEQ ID NO: 194222 - DNA, 601 bp, Human
agattatcaagggaggaggagttggcattttaaaaggtaccaactaataggaaaaaaatctcatctctcatgggaccatttaaaaggtggggtttgaacagataacactcgacctgagaaaggcaacaaagacatgccgctgaaacacactcgaccatagctgcgctggcgaagaagccccaagtgcccagagccctatggctgaagaggcagcagcctcagtgggacactcctcgggggttgctgctgttgcaccctgcccttctcttccagggaggcatactgaaatacggataggtgrcacgcatcgaggattctcttcaaaagagctggtggcatgggaggggtggcgtgggaggagtgggtgagggtacaggtggaataagagtggctaagttcttcagacatgcggggacaacaggaattaatggcagctagacataattttaaacatacagccatattctgaaacctggccctggaaaacaaaatcgttccaagagctgcatccgccctatgtaccatcagtttcccatgaaagcagcctacatgaggaagacagggaggcggtggcgctaagacctcaaggacgtctggtcta

SEQ ID NO: 194223 - DNA, 601 bp, Human
cgagaatgtagtattcatctgtcctaaataaaaccaatatcctgggtgaagactgctagagggaatagagtccgcatagaacactctctcaagaccggtgtcatgacccagtgccttgctggaggggagtaggccatgcacctgactctgggaagagctgcctcccccgtgccttgagggcacagccccctctgggaaggaaggcagcatgtggcccacccctgccaggctttggtgctcacacagcacactggagcttctgcaagtgactgacaggagttttagaagtgaattttacatrtgagagacaccaattgtttttagcttgtgacacatgccgaaaaaaaaaaaactacacctaaactcccaaactgaagcgtcctttatctcatgtcacaaattttaatgatggttgagtcattaatcaatgctaagattatcaagggaggaggagttggcattttaaaaggtaccaactaataggaaaaaaatctcatctctcatgggaccatttaaaaggtggggtttgaacagataacactcgacctgagaaaggcaacaaagacatgccgctgaaacacactcgaccatagctgcgctg

SEQ ID NO: 194224 - DNA, 601 bp, Human
agagaaaggagggactggggcccccacgggctacagatcatcctcttatgcacaaaccacccacggagtcgggattctcccttcctgactcggggagacgagggtctgcgggcgaagagctgccggggggacatggctctgggcttgggccaaagccgctctgcagggatgcgccggggcgcgcggggcccggccgccatggtgcagctggaggggcctcgggtccgcggagcccggaacccacccgggcagcccggttcctcccgagccggtaccgcgggttccagtccgcccctccctktctctcaggaggcctggcccctacactcaccatctcctggcctccagagagcctggcgtttcacttctggatctcccggtgcctgcgggtcacacggcctacggctagcaggggacacagagccgcggggacaggaagtggagctctgtcgggacaaaggccccgctagatcccggaagccgtcttctcctctccagacatgtgcctgattggacagtccccgcccctactcctctgattggatagggcctcacgccccgccccctcaggccctgagtgacaggagctgtaatcagacaa

SEQ ID NO: 194225 - DNA, 601 bp, Human
tgaggcaggagaattgcttgaacccgggaggcagaggttgcagtgagccgagatcgcgccactgcactccagcctgggggacagagcgagactccatctcaaaaataataataattaaatagcaggcaatccgactgaggtggctctagtgccctgggttcttaggttaaaaaaaaaaatctaactcagatgcgtttcttgcaaatgactatcttgcagaaacaaaattcaggcttcgtcaaccacaaacctctaattaacttctgattacaggaccagaaaatttcagcctagatagctsaaatcaggagatgacgtaactgtaccgaactaatgaatgaatgtggtttgcttcctcatgcacctgataaaagcctttccttcaaggccggctggtgggacctccaaacccaaaaaacatggttgggtcctctgccattcatgaatcgctctttgctcaaataaaactctttcacatttttgcaaggactccctcgagagaaaggagggactggggcccccacgggctacagatcatcctcttatgcacaaaccacccacggagtcgggattctcccttcctgactcggggagacgaggg

SEQ ID NO: 194226 - DNA, 601 bp, Human
caccctgtcaagtttccaaagtggaacctcaaaccaaagacattctggtaaggtgtctgtgcctagggaaaataaaaaggaggagaggcacaaagactttttacaatagcgtcaggggatgattctctgctttcctgtcacgtggaatgattacaaacagaaaacaaatctcttaaaaagtgccgtccaggctgggcgcagtggctcacgactgtaatcccagcactttgggaggccaaggcaggcggatcacatgaggtcaggagttcaagaccagcctggccaacatggtgaaaccccrtctctactaaaaatacaaaaattagccgggcgtggtggtgcaggactgtaatctcagctactcgggaggctgaggcaggagaattgcttgaacccgggaggcagaggttgcagtgagccgagatcgcgccactgcactccagcctgggggacagagcgagactccatctcaaaaataataataattaaatagcaggcaatccgactgaggtggctctagtgccctgggttcttaggttaaaaaaaaaaatctaactcagatgcgtttcttgcaaatgactatcttgcagaaacaaaattc

SEQ ID NO: 194227 - DNA, 601 bp, Human
ctgaaactgaggaaaaagtccagagggtggctgagagcaaatcaccctgtcaagtttccaaagtggaacctcaaaccaaagacattctggtaaggtgtctgtgcctagggaaaataaaaaggaggagaggcacaaagactttttacaatagcgtcaggggatgattctctgctttcctgtcacgtggaatgattacaaacagaaaacaaatctcttaaaaagtgccgtccaggctgggcgcagtggctcacgactgtaatcccagcactttgggaggccaaggcaggcggatcacatgagrtcaggagttcaagaccagcctggccaacatggtgaaaccccgtctctactaaaaatacaaaaattagccgggcgtggtggtgcaggactgtaatctcagctactcgggaggctgaggcaggagaattgcttgaacccgggaggcagaggttgcagtgagccgagatcgcgccactgcactccagcctgggggacagagcgagactccatctcaaaaataataataattaaatagcaggcaatccgactgaggtggctctagtgccctgggttcttaggttaaaaaaaaaaatctaactca

SEQ ID NO: 194228 - DNA, 601 bp, Human
cactagatgctccagcagacatggccatggtgggcatcctgtgttatccctggacaatactgaaactgaggaaaaagtccagagggtggctgagagcaaatcaccctgtcaagtttccaaagtggaacctcaaaccaaagacattctggtaaggtgtctgtgcctagggaaaataaaaaggaggagaggcacaaagactttttacaatagcgtcaggggatgattctctgctttcctgtcacgtggaatgattacaaacagaaaacaaatctcttaaaaagtgccgtccaggctgggcgcrgtggctcacgactgtaatcccagcactttgggaggccaaggcaggcggatcacatgaggtcaggagttcaagaccagcctggccaacatggtgaaaccccgtctctactaaaaatacaaaaattagccgggcgtggtggtgcaggactgtaatctcagctactcgggaggctgaggcaggagaattgcttgaacccgggaggcagaggttgcagtgagccgagatcgcgccactgcactccagcctgggggacagagcgagactccatctcaaaaataataataattaaatagcaggcaa

SEQ ID NO: 194229 - DNA, 601 bp, Human
tgctccctggagaggccacacttcatacctcaggctgtcctctgagaaataacccagggcctgaaattcactagatgctccagcagacatggccatggtgggcatcctgtgttatccctggacaatactgaaactgaggaaaaagtccagagggtggctgagagcaaatcaccctgtcaagtttccaaagtggaacctcaaaccaaagacattctggtaaggtgtctgtgcctagggaaaataaaaaggaggagaggcacaaagactttttacaatagcgtcaggggatgattctctgctwtcctgtcacgtggaatgattacaaacagaaaacaaatctcttaaaaagtgccgtccaggctgggcgcagtggctcacgactgtaatcccagcactttgggaggccaaggcaggcggatcacatgaggtcaggagttcaagaccagcctggccaacatggtgaaaccccgtctctactaaaaatacaaaaattagccgggcgtggtggtgcaggactgtaatctcagctactcgggaggctgaggcaggagaattgcttgaacccgggaggcagaggttgcagtgagccgagatcgcgcca

SEQ ID NO: 194230 - DNA, 601 bp, Human
tctcagcccagggcatccagctgctccctggagaggccacacttcatacctcaggctgtcctctgagaaataacccagggcctgaaattcactagatgctccagcagacatggccatggtgggcatcctgtgttatccctggacaatactgaaactgaggaaaaagtccagagggtggctgagagcaaatcaccctgtcaagtttccaaagtggaacctcaaaccaaagacattctggtaaggtgtctgtgcctagggaaaataaaaaggaggagaggcacaaagactttttacaatagcrtcaggggatgattctctgctttcctgtcacgtggaatgattacaaacagaaaacaaatctcttaaaaagtgccgtccaggctgggcgcagtggctcacgactgtaatcccagcactttgggaggccaaggcaggcggatcacatgaggtcaggagttcaagaccagcctggccaacatggtgaaaccccgtctctactaaaaatacaaaaattagccgggcgtggtggtgcaggactgtaatctcagctactcgggaggctgaggcaggagaattgcttgaacccgggaggcagaggttg

SEQ ID NO: 194231 - DNA, 601 bp, Human
tttgtaagtattttcttacctttcaagctctactgataaaatgtaaatttacaattaaaaatccaacgttgcagtaagtgaataaattatttcaaggagacacagagagtggcagtgccgactggaacacagacacagctaatgacttgtgtcaagtcaggctattctattccttgggagattctcccacctccatcctgttcaccgaagtgctcaccggccacccccgatgatacactgcactgtgccccgctgagtgtcccaggtgaattttgctttacaggttttgcaccatctcacrgggtggagtttttcttgctctttgaaacattctgtctcccttcacaaatctgagagtccaaagggcagaaatgatttcggtcttttccctctgacagtggcatgtgattggctgatcagccatgtgtctccaaggattgaaagttgggttgggtgaagacaatcttaatgtcctaagtggttacctctttagaggaagagtagaccaggagatttctctcagcccagggcatccagctgctccctggagaggccacacttcatacctcaggctgtcctctgagaaataacccagggcctg

SEQ ID NO: 194232 - DNA, 601 bp, Human
tacactaacactaacgatagctgataactgaaaaaaaaaaaaaatcacaaaaaagtctcataatgttttaataaagtttacgaatttgtgttggaccacattcaaagcccaggccagcatgtggcccaggcctgtgggttggacaagcttgagccaggccttcgattgctttcttttgcagactcagtattagccttagcttggaatgactgttcttgggcttcaacttcccaatcagggttatccacttaggtttaaataagaaaatacccagtgttggaaacatccaacaaaatcactsaaacagtttacagaagaaaaggaaactgtaagcacttacactttcacctccacagaaaaagcaaaattatttattgctttcagacaatgaacttgtcatttaactatttccataacaaatcatatagtaaacaatcacatgtgaacacttttagaagtgctaagttccatctcctacaacttagcattaagctcagacatctagagaacaggatataaaacagagatactcacgacaacaaattcatcctgcaaaaagagctcatgttctgatgaatctatgtaatttaccaagtaatct

SEQ ID NO: 194233 - DNA, 601 bp, Human
cttccatggttgctgtgagcagtctggggcacccgcaggggaggctcctcaggaagcactagctaggccaggggtgtccgatcttggcttccctgggccacacataaaatacactaacactaacgatagctgataactgaaaaaaaaaaaaaatcacaaaaaagtctcataatgttttaataaagtttacgaatttgtgttggaccacattcaaagcccaggccagcatgtggcccaggcctgtgggttggacaagcttgagccaggccttcgattgctttcttttgcagactcagtattrgccttagcttggaatgactgttcttgggcttcaacttcccaatcagggttatccacttaggtttaaataagaaaatacccagtgttggaaacatccaacaaaatcactcaaacagtttacagaagaaaaggaaactgtaagcacttacactttcacctccacagaaaaagcaaaattatttattgctttcagacaatgaacttgtcatttaactatttccataacaaatcatatagtaaacaatcacatgtgaacacttttagaagtgctaagttccatctcctacaacttagcattaag

SEQ ID NO: 194234 - DNA, 601 bp, Human
aaatttattttatttgacgaagtctagaaacagccccaggataataacgattccatacccagcaagtcctccccagcttccttccatcccaactctaactgcatctgcctgtgggtccccagtgctcccgggctctgcagcttctctctgtagaaaggctccttccatggttgctgtgagcagtctggggcacccgcaggggaggctcctcaggaagcactagctaggccaggggtgtccgatcttggcttccctgggccacacataaaatacactaacactaacgatagctgataactgaaaaaaaaaaaaaatcacaaaaaagtctcataatgttttaataaagtttacgaatttgtgttggaccacattcaaagcccaggccagcatgtggcccaggcctgtgggttggacaagcttgagccaggccttcgattgctttcttttgcagactcagtattagccttagcttggaatgactgttcttgggcttcaacttcccaatcagggttatccacttaggtttaaataagaaaatacccagtgttggaaacatccaacaaaatcactcaaacagtttacagaagaaaaggaaactgta

SEQ ID NO: 194235 - DNA, 601 bp, Human
gccctctatggccatgagatccatgatagttgctaccttctccctgttgcaatccttctttagagttcaataacttcctatctaaagctaaatttattttatttgacgaagtctagaaacagccccaggataataacgattccatacccagcaagtcctccccagcttccttccatcccaactctaactgcatctgcctgtgggtccccagtgctcccgggctctgcagcttctctctgtagaaaggctccttccatggttgctgtgagcagtctggggcacccgcaggggaggctcctcrggaagcactagctaggccaggggtgtccgatcttggcttccctgggccacacataaaatacactaacactaacgatagctgataactgaaaaaaaaaaaaaatcacaaaaaagtctcataatgttttaataaagtttacgaatttgtgttggaccacattcaaagcccaggccagcatgtggcccaggcctgtgggttggacaagcttgagccaggccttcgattgctttcttttgcagactcagtattagccttagcttggaatgactgttcttgggcttcaacttcccaatcagggtt

SEQ ID NO: 194236 - DNA, 601 bp, Human
tgccctctatggccatgagatccatgatagttgctaccttctccctgttgcaatccttctttagagttcaataacttcctatctaaagctaaatttattttatttgacgaagtctagaaacagccccaggataataacgattccatacccagcaagtcctccccagcttccttccatcccaactctaactgcatctgcctgtgggtccccagtgctcccgggctctgcagcttctctctgtagaaaggctccttccatggttgctgtgagcagtctggggcacccgcaggggaggctcctyaggaagcactagctaggccaggggtgtccgatcttggcttccctgggccacacataaaatacactaacactaacgatagctgataactgaaaaaaaaaaaaaatcacaaaaaagtctcataatgttttaataaagtttacgaatttgtgttggaccacattcaaagcccaggccagcatgtggcccaggcctgtgggttggacaagcttgagccaggccttcgattgctttcttttgcagactcagtattagccttagcttggaatgactgttcttgggcttcaacttcccaatcagggt

SEQ ID NO: 194237 - DNA, 601 bp, Human
gttcctggtgaccctgcacagatgccctctatggccatgagatccatgatagttgctaccttctccctgttgcaatccttctttagagttcaataacttcctatctaaagctaaatttattttatttgacgaagtctagaaacagccccaggataataacgattccatacccagcaagtcctccccagcttccttccatcccaactctaactgcatctgcctgtgggtccccagtgctcccgggctctgcagcttctctctgtagaaaggctccttccatggttgctgtgagcagtctggsgcacccgcaggggaggctcctcaggaagcactagctaggccaggggtgtccgatcttggcttccctgggccacacataaaatacactaacactaacgatagctgataactgaaaaaaaaaaaaaatcacaaaaaagtctcataatgttttaataaagtttacgaatttgtgttggaccacattcaaagcccaggccagcatgtggcccaggcctgtgggttggacaagcttgagccaggccttcgattgctttcttttgcagactcagtattagccttagcttggaatgactgttcttgg

SEQ ID NO: 194238 - DNA, 601 bp, Human
caaaccctgggtgactcatttctcttattctacaacagaagcacagatggaccgttttgtcagcctgagccccgtctgcacagtgcactcctgaatgtccaaaagactccaggtgctggtgagagagttcctggtgaccctgcacagatgccctctatggccatgagatccatgatagttgctaccttctccctgttgcaatccttctttagagttcaataacttcctatctaaagctaaatttattttatttgacgaagtctagaaacagccccaggataataacgattccatacccagsaagtcctccccagcttccttccatcccaactctaactgcatctgcctgtgggtccccagtgctcccgggctctgcagcttctctctgtagaaaggctccttccatggttgctgtgagcagtctggggcacccgcaggggaggctcctcaggaagcactagctaggccaggggtgtccgatcttggcttccctgggccacacataaaatacactaacactaacgatagctgataactgaaaaaaaaaaaaaatcacaaaaaagtctcataatgttttaataaagtttacgaatttgtgttg

SEQ ID NO: 194239 - DNA, 601 bp, Human
gaaaaaaaagtagttgaaacaaacttactatggagaaacaccacaagtagagaagtaaaggtttccaaattctaaacacatgacatttcaggagcaaaagtggacacaacccctgacctgagatgcatttacctgagcaccagccatttctttctctttctcctgcttctctgggatttcctcttaggaaagattctctggacaaatcacacctgcatcgtgagaatatgcctttaaaggtgttagcacaaccccttcacctgctaccaccacaaccatcaacagaaagaccaagaaatamagaaaaagtccacgcttttctgttctttataaaagagattcaggaacagtaaacttctacatggagatcaaaatgtgactttctctcttcctgctctcaggttccctctcctgctaaacaacagcaattctgcttcagcaattggagtataagctgcactgagctggcctctgaaacctaggcaaagaaggccctgtgacctccctttggaaccaaggctgagctcaactcgtacaaatgcatctgaaaccccccatcactgattctggccacaccttagaatcccatgatgcatgtgac

SEQ ID NO: 194240 - DNA, 601 bp, Human
ccttcattattataagaaaaaaaagtagttgaaacaaacttactatggagaaacaccacaagtagagaagtaaaggtttccaaattctaaacacatgacatttcaggagcaaaagtggacacaacccctgacctgagatgcatttacctgagcaccagccatttctttctctttctcctgcttctctgggatttcctcttaggaaagattctctggacaaatcacacctgcatcgtgagaatatgcctttaaaggtgttagcacaaccccttcacctgctaccaccacaaccatcaacagraagaccaagaaatacagaaaaagtccacgcttttctgttctttataaaagagattcaggaacagtaaacttctacatggagatcaaaatgtgactttctctcttcctgctctcaggttccctctcctgctaaacaacagcaattctgcttcagcaattggagtataagctgcactgagctggcctctgaaacctaggcaaagaaggccctgtgacctccctttggaaccaaggctgagctcaactcgtacaaatgcatctgaaaccccccatcactgattctggccacaccttagaatcc

SEQ ID NO: 194241 - DNA, 601 bp, Human
aagaagtcaaggtgaagataacagagagacggctttggtatatagaaaacaaatattttcagagacccttcattattataagaaaaaaaagtagttgaaacaaacttactatggagaaacaccacaagtagagaagtaaaggtttccaaattctaaacacatgacatttcaggagcaaaagtggacacaacccctgacctgagatgcatttacctgagcaccagccatttctttctctttctcctgcttctctgggatttcctcttaggaaagattctctggacaaatcacacctgcatcrtgagaatatgcctttaaaggtgttagcacaaccccttcacctgctaccaccacaaccatcaacagaaagaccaagaaatacagaaaaagtccacgcttttctgttctttataaaagagattcaggaacagtaaacttctacatggagatcaaaatgtgactttctctcttcctgctctcaggttccctctcctgctaaacaacagcaattctgcttcagcaattggagtataagctgcactgagctggcctctgaaacctaggcaaagaaggccctgtgacctccctttggaaccaaggc

SEQ ID NO: 194242 - DNA, 601 bp, Human
ttttttagtagagatggggtttcaccatgttggtcaggctggtctcgaactcctggccccaagcgatctgcccacctaggcctcccaaagtgttgggattataggcgtgagccaccatgcccagcagtaatctctaatagtgtattaaaagagtctttctttagcattctaaaaagcaagtgtcttttcatttttctcttttccagaatgctttgagttattctgagcgataaatgtcatctggtttaaatgtttattttcttagtcctgttctgcatgcagcttatggagcatccagatraaacctaaagagtgcacatttcccttctttgctgatatccaaaaacccaccccatcctcaagaggaatcctgggtatccacaagttcagtgccacgaagtgaactttttaatactgcaggtcataaagtcatggtaagaattcttcatggcatataagaagtcaaggtgaagataacagagagacggctttggtatatagaaaacaaatattttcagagacccttcattattataagaaaaaaaagtagttgaaacaaacttactatggagaaacaccacaagtagagaagtaaaggttt

SEQ ID NO: 194243 - DNA, 601 bp, Human
tcttagcagaagaatactctctaactctgaggaaagagaattgcctgagagccacataagcagtgtatatacaatacttttctggttgataacaagtataacattaagggcatcaacaaaggcatgtccatttttgagtgctacatttacgtcacatgaataagctgtgtatatttcgcaggcagaaaagtcatggtgagttagaagctgcctctccaattttcatgtgtccaataaactagtgtgcagattttgcttcaggaaatcggaggtcaaggctgagtttccgaatttctaacgygctcaccagtgatgccagtcctttgggcccaaggacaatattttgtcaaaaatcctgtaagtggcaagcttgggtttatcccagtttttctaaaccataaagagagatgagattcttcatcttctaaagcaaggcatatgcaaaaagaatctaagaagcaaaacctttcagattaaatgtgattatttatgcacattaattagtaaatctcctcaaggtacttaaaagagaaaaaaataaactccacaatggaaaatctgtcagggagctctttaaacaactgaataaaactaatatcaa

SEQ ID NO: 194244 - DNA, 601 bp, Human
ggagaacaagtttctgtagttctccaacatcacatccctgtacaaattctgctgagcgaggtccaggcatttccactcctccagggagaattctatggccacatccctgaacgtcaacagagtctgaagaagaaacaacaacaataacaaatacttgattcaaggtgaaatgagcgagtgaagagaactggttctgacttacacaagtgactgaaattatacaataaggtaattcttagcagaagaatactctctaactctgaggaaagagaattgcctgagagccacataagcagtgtayatacaatacttttctggttgataacaagtataacattaagggcatcaacaaaggcatgtccatttttgagtgctacatttacgtcacatgaataagctgtgtatatttcgcaggcagaaaagtcatggtgagttagaagctgcctctccaattttcatgtgtccaataaactagtgtgcagattttgcttcaggaaatcggaggtcaaggctgagtttccgaatttctaacgcgctcaccagtgatgccagtcctttgggcccaaggacaatattttgtcaaaaatcctgtaagtggcaa

SEQ ID NO: 194245 - DNA, 601 bp, Human
ttccccatgtttttcttaaaagcagggatctgaaactcattcatgcaacgcagaaactcccaaaaaacattccgcagaggaacgaaaggaactctttagggcataggaggaactacgtattgaagttatcctcaccaacggagaacaagtttctgtagttctccaacatcacatccctgtacaaattctgctgagcgaggtccaggcatttccactcctccagggagaattctatggccacatccctgaacgtcaacagagtctgaagaagaaacaacaacaataacaaatacttgattcraggtgaaatgagcgagtgaagagaactggttctgacttacacaagtgactgaaattatacaataaggtaattcttagcagaagaatactctctaactctgaggaaagagaattgcctgagagccacataagcagtgtatatacaatacttttctggttgataacaagtataacattaagggcatcaacaaaggcatgtccatttttgagtgctacatttacgtcacatgaataagctgtgtatatttcgcaggcagaaaagtcatggtgagttagaagctgcctctccaattttcatgtg

SEQ ID NO: 194246 - DNA, 601 bp, Human
ttcagtaagtattttaaatctgtgggttcttagtttcaccactcagtactgctgacataaaaaattggtggtggaaatttgactttaagttgtgggcaacaatatttcatgccactgaatttctggaattgtcactagagtgaaagatacagatcagctgaaaaaaaaggaaggtttatgtcaagatgaaccacattttgaagatttttttttttttacatcaactattccccatgtttttcttaaaagcagggatctgaaactcattcatgcaacgcagaaactcccaaaaaacattccrcagaggaacgaaaggaactctttagggcataggaggaactacgtattgaagttatcctcaccaacggagaacaagtttctgtagttctccaacatcacatccctgtacaaattctgctgagcgaggtccaggcatttccactcctccagggagaattctatggccacatccctgaacgtcaacagagtctgaagaagaaacaacaacaataacaaatacttgattcaaggtgaaatgagcgagtgaagagaactggttctgacttacacaagtgactgaaattatacaataaggtaattc

SEQ ID NO: 194247 - DNA, 601 bp, Human
ttatcaaccttgtactgtgcttagtagagtgaacattatataagattctagaaaattaatcccaaaattatgcttcctgacatcacctttagaatattcagtaagtattttaaatctgtgggttcttagtttcaccactcagtactgctgacataaaaaattggtggtggaaatttgactttaagttgtgggcaacaatatttcatgccactgaatttctggaattgtcactagagtgaaagatacagatcagctgaaaaaaaaggaaggtttatgtcaagatgaaccacattttgaagatttttttttttttacatcaactattccccatgtttttcttaaaagcagggatctgaaactcattcatgcaacgcagaaactcccaaaaaacattccgcagaggaacgaaaggaactctttagggcataggaggaactacgtattgaagttatcctcaccaacggagaacaagtttctgtagttctccaacatcacatccctgtacaaattctgctgagcgaggtccaggcatttccactcctccagggagaattctatggccacatccctgaacgtcaacagagtctgaagaagaaacaac

SEQ ID NO: 194248 - DNA, 601 bp, Human
cctagggtacagcaagagaaagacacccaggctctcagaaaccatctccactagggcagagcttctcaaaccacattttaaggtctggcttcctcctcgacctctggacctctcacctgggttacctgcttcgttcattcccacccacctggatgtccgtctgctgcctcctgtctcttcacattccagggctcttttcgttgctccaggcaggtgatcaggcctggcttacagacagtgagacctgttttattagaaaaaagtgacattactcttgctgaaattctccaattatcaaccktgtactgtgcttagtagagtgaacattatataagattctagaaaattaatcccaaaattatgcttcctgacatcacctttagaatattcagtaagtattttaaatctgtgggttcttagtttcaccactcagtactgctgacataaaaaattggtggtggaaatttgactttaagttgtgggcaacaatatttcatgccactgaatttctggaattgtcactagagtgaaagatacagatcagctgaaaaaaaaggaaggtttatgtcaagatgaaccacattttgaagatttttttttt

SEQ ID NO: 194249 - DNA, 601 bp, Human
gacgctcctagggtacagcaagagaaagacacccaggctctcagaaaccatctccactagggcagagcttctcaaaccacattttaaggtctggcttcctcctcgacctctggacctctcacctgggttacctgcttcgttcattcccacccacctggatgtccgtctgctgcctcctgtctcttcacattccagggctcttttcgttgctccaggcaggtgatcaggcctggcttacagacagtgagacctgttttattagaaaaaagtgacattactcttgctgaaattctccaattaycaaccttgtactgtgcttagtagagtgaacattatataagattctagaaaattaatcccaaaattatgcttcctgacatcacctttagaatattcagtaagtattttaaatctgtgggttcttagtttcaccactcagtactgctgacataaaaaattggtggtggaaatttgactttaagttgtgggcaacaatatttcatgccactgaatttctggaattgtcactagagtgaaagatacagatcagctgaaaaaaaaggaaggtttatgtcaagatgaaccacattttgaagatttt

SEQ ID NO: 194250 - DNA, 601 bp, Human
gaaccaatcaccatcaccacgcctctcgcacacttcagacatgatgcaaaggaaatcaaaaaacatttaacagagttcctcaaaaacaggcaggtacaggcatgttcccaaaagcagtggcggagcacgccatgagaccacacaggcccttactcgtcaggaggaggactctgatttttactgtaacctttataaaggaagatcactaaacaggaagcagagtctatacaaaatttgagagaatgagacagaagacgctcctagggtacagcaagagaaagacacccaggctctcagaaascatctccactagggcagagcttctcaaaccacattttaaggtctggcttcctcctcgacctctggacctctcacctgggttacctgcttcgttcattcccacccacctggatgtccgtctgctgcctcctgtctcttcacattccagggctcttttcgttgctccaggcaggtgatcaggcctggcttacagacagtgagacctgttttattagaaaaaagtgacattactcttgctgaaattctccaattatcaaccttgtactgtgcttagtagagtgaacattatataagattctag

SEQ ID NO: 194251 - DNA, 601 bp, Human
agcagaaagcatacaacatctgtttacgggacttctgggatttctgaaccaatcaccatcaccacgcctctcgcacacttcagacatgatgcaaaggaaatcaaaaaacatttaacagagttcctcaaaaacaggcaggtacaggcatgttcccaaaagcagtggcggagcacgccatgagaccacacaggcccttactcgtcaggaggaggactctgatttttactgtaacctttataaaggaagatcactaaacaggaagcagagtctatacaaaatttgagagaatgagacagaagaygctcctagggtacagcaagagaaagacacccaggctctcagaaaccatctccactagggcagagcttctcaaaccacattttaaggtctggcttcctcctcgacctctggacctctcacctgggttacctgcttcgttcattcccacccacctggatgtccgtctgctgcctcctgtctcttcacattccagggctcttttcgttgctccaggcaggtgatcaggcctggcttacagacagtgagacctgttttattagaaaaaagtgacattactcttgctgaaattctccaattatca

SEQ ID NO: 194252 - DNA, 601 bp, Human
gtaggatacgaaatcataaagcagaaagcatacaacatctgtttacgggacttctgggatttctgaaccaatcaccatcaccacgcctctcgcacacttcagacatgatgcaaaggaaatcaaaaaacatttaacagagttcctcaaaaacaggcaggtacaggcatgttcccaaaagcagtggcggagcacgccatgagaccacacaggcccttactcgtcaggaggaggactctgatttttactgtaacctttataaaggaagatcactaaacaggaagcagagtctatacaaaatttragagaatgagacagaagacgctcctagggtacagcaagagaaagacacccaggctctcagaaaccatctccactagggcagagcttctcaaaccacattttaaggtctggcttcctcctcgacctctggacctctcacctgggttacctgcttcgttcattcccacccacctggatgtccgtctgctgcctcctgtctcttcacattccagggctcttttcgttgctccaggcaggtgatcaggcctggcttacagacagtgagacctgttttattagaaaaaagtgacattactcttgc

SEQ ID NO: 194253 - DNA, 601 bp, Human
tgtgtatataataactgaagggaataaaagcagcatcttgaagaattatctgctccctcatgttcactgcagcattattcacaattgtcaagatataaagacaagctaaacgtttgcggatgctgaatggataaagaaaatgtgatataaatagacaatagaatattactcagccataaaaaaggaatgaaatcctgtcattcaaccacgtggatgaccctgaaggacatcctgctaaataaactcagccaggccccaaagacagagactgcacgttccccctcagacgtggaatctgtcstggctgaactcacaggagcagaggacaatggcagttgccagggcctggagttggggaaaatgagctgttgttcaaaaggtacaaactttcagttgtaagatgagtaagtttggggaatctaatgagtagcttcacgaatactattaataatcttttgtatgcttaaagtttgccaacggtagacattaactgttctcactacaagaaaaggtaattacgtgaagtgatagatttgttccttgaagtgattgcactaattatttcacaacgtatacacatatcaaattattacattgtaca

SEQ ID NO: 194254 - DNA, 601 bp, Human
aagaggcataatattttctgttttcaagtgacattttaggactacagtagtaagaacaggatggtatgcgaacagagaggaaaactgccgcagagaccaatgggacagaacagagagcccagaattaaactcacgcatatccacttaactaatctttcacaagttcacgaagaagatacaatacagacagtatagtctcttcaacacttggtcctggagaaacagaatacccgcaatcaaaataatgaaatagcccatttttcttacaccatactcaaaaattaacttgaaatcaagcctwaaatgtaaaacatgtatccttaaaaactctgagagaaaacctctgatattggtcttggcaatcattttttagacacgacaccaaaagtacagcaacaaaagtaaatataaacaaaatggagtacattaagctaaaaagcttgtgacaccaaagacaatttacaatcaaacttttggatactaggatggctaatatcaaaaataagtaacatattagggctgtgcaaaagtaattgtggtttttgccttctaaatagtaagaaatactcttacttttgcgccaatctactaacaatgttga

SEQ ID NO: 194255 - DNA, 601 bp, Human
ggagggggttgtaaaattctgctaaagaccaagactatagattcaataaacttcttatcaaattccagtggcctttttcacagtaatgaaaatagaattctaaaatttatatggaattacaatagacttggcatagccaaagcaatctataggaaaaagaacaaggcaagaggcataatattttctgttttcaagtgacattttaggactacagtagtaagaacaggatggtatgcgaacagagaggaaaactgccgcagagaccaatgggacagaacagagagcccagaattaaactcaygcatatccacttaactaatctttcacaagttcacgaagaagatacaatacagacagtatagtctcttcaacacttggtcctggagaaacagaatacccgcaatcaaaataatgaaatagcccatttttcttacaccatactcaaaaattaacttgaaatcaagccttaaatgtaaaacatgtatccttaaaaactctgagagaaaacctctgatattggtcttggcaatcattttttagacacgacaccaaaagtacagcaacaaaagtaaatataaacaaaatggagtacattaagcta

SEQ ID NO: 194256 - DNA, 601 bp, Human
ttaattctagcatattgttctgcatattagaatttgaaattagagataaatttgaaatggaacaaaagagaaagtgaaaatgtacaggacagtgacatagaaaaatggtgacataggtggaccctgggttatatattccccgacagcaacaaaaatgtgtcagtcttcttgtacagaaatgcctttccaagagaatcaggcaccacggctcatgcctataatcccaactattcaggacctcggggtgagaggctcacttcaggccagaagttcagaaccagcctgggtgacacagagagayctcatctcacaaaaatgcctttaatagagcttagtaatccagggagggggttgtaaaattctgctaaagaccaagactatagattcaataaacttcttatcaaattccagtggcctttttcacagtaatgaaaatagaattctaaaatttatatggaattacaatagacttggcatagccaaagcaatctataggaaaaagaacaaggcaagaggcataatattttctgttttcaagtgacattttaggactacagtagtaagaacaggatggtatgcgaacagagaggaaaactgccgc

SEQ ID NO: 194257 - DNA, 601 bp, Human
ctctactgagaacattttaatgactaagagatactaaaggtaatttttattatatgtttactataccgatgctattcttatgcaaatttaaaatgctgccatccaacttttagaagcaaggaatagccttatatttctaaataaagagaaaaatataaattatgtaaaatatggtgagagtcactgatatataaaataaacatctgggaataaatcatattattatttatatacaggttgaagaaataggataatttaatcaatgtggagtgcttgccgggtgcagtggttcacgcctgtratcctgacactttgggaggccaaggcaggcagatcacctgaggtcgggagttcgaggccagcctgaccaacatggacaaaccccatctctactaaaaatacaaaaaattagccaggcgtggtggtgcatgcctgtgtgtaaatcccagctactcaggaggctgaggcagaagaattgcttgaacctgggaggtggaggttgcagtgccgagatcgcgccattgcactccagcctgggtaacaagagcaaaactctatctcaaaacaaacaaacaaacaaacaaatagtgcttactaaata

SEQ ID NO: 194258 - DNA, 601 bp, Human
agcagtaacatttcacagaaaatgcactacaatcattatgaaaagactctactgagaacattttaatgactaagagatactaaaggtaatttttattatatgtttactataccgatgctattcttatgcaaatttaaaatgctgccatccaacttttagaagcaaggaatagccttatatttctaaataaagagaaaaatataaattatgtaaaatatggtgagagtcactgatatataaaataaacatctgggaataaatcatattattatttatatacaggttgaagaaataggataayttaatcaatgtggagtgcttgccgggtgcagtggttcacgcctgtaatcctgacactttgggaggccaaggcaggcagatcacctgaggtcgggagttcgaggccagcctgaccaacatggacaaaccccatctctactaaaaatacaaaaaattagccaggcgtggtggtgcatgcctgtgtgtaaatcccagctactcaggaggctgaggcagaagaattgcttgaacctgggaggtggaggttgcagtgccgagatcgcgccattgcactccagcctgggtaacaagagcaaaactc

SEQ ID NO: 194259 - DNA, 601 bp, Human
atgctcaaattacttatctatagagaaatgcaaaacaaaatcacaattaagatatttcctcacacctattagaatggccacagtaaaaaaaaaaaatccagacctgtcaaggatgtgaagacattgaaaaccacgtaacctgctggtaggaaagaaaggatgcagccacgatgaaagatagcataggccgggcacactggttcacaccagctcacacctggaaccccagcacttcgggagaccgaggcgggtggatcacttgagcccaggagtccgagaccagcctgggcaacatggcaaraccctgtctctattaaaaacacaaaagttagctgggtgtggcggtgtgcccctgtagttccaggtcctcaggaggctgaagtgggaagaaggctcgagcccaggaagcagaggttgcagtgagctgagatggcaccactgcactacagcctgggtgatagagtgaaactctgtgtaaaaaaaaaaaaaaaagcataaattttcttaaaaaaattaaaaatggaattatatgatccagcaatcccatttctagatctatatcaaaagtatacaaagcaactcaggacttagaagagatatt

SEQ ID NO: 194260 - DNA, 601 bp, Human
aaaaaaaaaaaaaaaagaataaaactcttagaagaaaatataggacagcaaatgcataagcaacaaaagaacagaaaaactgaactacatcaaacttcaaactttctgcaaatcaaagaaaacaatgagtgaagtgaaaataccacctaagaaatgggtaaaaatcacacatttgataggagtgtatccttatattcagagtatataaggaacttttacaactaaacaacaaaaattaaataatttgatttaaaaatagatgaaggactaactgaaatctctccaaaaaagatatggaaaygcccaacaagccttgaatgaatgctcaaattacttatctatagagaaatgcaaaacaaaatcacaattaagatatttcctcacacctattagaatggccacagtaaaaaaaaaaaatccagacctgtcaaggatgtgaagacattgaaaaccacgtaacctgctggtaggaaagaaaggatgcagccacgatgaaagatagcataggccgggcacactggttcacaccagctcacacctggaaccccagcacttcgggagaccgaggcgggtggatcacttgagcccaggagtccgagac

SEQ ID NO: 194261 - DNA, 601 bp, Human
aaaaatagaataggctgggtgtggtggctcacgcctataatcccagcactttgggaggccgaggcgggtggatcacgaggtcaggagatcgagaccatcctggccaacacggtgaaaccccatctctactaaaaaaaaaaaatacaaaaaatgagccgggcgtggtggcgggcgcctgtagtcccagctactcaggaggctgaggcaggagaatggcgtgaacccaggaggcagagcttgcagtgagcagagatcgcaccactgcactccagcctgggcgacagagcaagactccatctcaaaaaaaaaaaaaaaaaaaagaataaaactcttagaagaaaatataggacagcaaatgcataagcaacaaaagaacagaaaaactgaactacatcaaacttcaaactttctgcaaatcaaagaaaacaatgagtgaagtgaaaataccacctaagaaatgggtaaaaatcacacatttgataggagtgtatccttatattcagagtatataaggaacttttacaactaaacaacaaaaattaaataatttgatttaaaaatagatgaaggactaactgaaatctctccaaaaaagatatgg

SEQ ID NO: 194262 - DNA, 601 bp, Human
aaaaatgtatggaaattaaaacccttgaacatacacattcttgctcaatggtcagataatttagttttttaaagatgtcaatactgcccacactaatgtacacattcaatgtaatctctatcaaattcccaaagctactttttgattttttaatcctaaaattagtttaagaacaataactagtcaaaattctttaaaaagaacaaagaggcattacactttctgattttaaaacatataaagagctacgaaaataaaaacaatgtggtactgacacaaagacagataactaaatgatgaracaaagcagagagcccagaaataaacccttgtggataaaatcaagtaattttccacaaggtatccatgaccacacaatggagaaaagaatcctttcaacaaatgttaaaaaccagatatctacatggaaaaatgaagtggtatcttttccttgcaccatatacaaaaatattttaaatgaaaaacataaaaatagaataggctgggtgtggtggctcacgcctataatcccagcactttgggaggccgaggcgggtggatcacgaggtcaggagatcgagaccatcctggccaacacggt

SEQ ID NO: 194263 - DNA, 601 bp, Human
tggattaagaacaatatgctagctacaaaagactctagccttaaatagtaaaataggctgaaagtgaaaataaaaaaaaattccatgcaattagtaaccacaatcaggtggggtggttatccttatattagacacaatatactgtaagtcagaactgtcacaggagataaagattaatagcatgtaatggcaaaatgcgtacattaaccaggaacctgtaactgtttatctgtctatatttatatctaacatcagggctcccagatatataaagcaaatatggagagaagtgaagcaagaygtacacagcaatacaataattatcaactctaagaccccatttgcaatacagaatagaaaattacacagaagatcaataagaaagcttgggcaacattacagaccaaatcaatttaacagacatgcatagaactctccagtccaaagaagcagaatatacaatattctcaaatacacatagtgcattgtgttacaacaaataacaactcttaaagatgaaagtctcatgacatgttttctaaccaaaatgtaataaaactagaaatcaaaagcaaaagtaaaactggcaatgccaaaaatg

SEQ ID NO: 194264 - DNA, 601 bp, Human
atgatgctagacagcattataaaaccatatgaaaatataaaactctgttaaaggtatataagcagatatataatactttactatcataatgatggtgtaaaaaattcaaaattctgctataatatctgaaaaaatatctgcataaatctttgctaccagacacaaaatatataataatttgttacattaacagcacactggagggtgttacagtttttgtattcaatgaagttgtgagattaaaatctgtatttataattttaaggtgttttatgtactctccatttttcaaggtgatccmaaagaaaatacctatacaaggtctgcaaaacacaatgagaaaagaatgaaagcttgtccacacaaaatcaacaaaacaaacgatgaagacagtcaaagaggaaatgagggataacatatctacaagaaacacagaaaacagtaacaatcaagatggtgatagtaacttcatttccttcagaaattattttaaatataaattaacctacttattgaacagaaataaaatagctgaatggattaagaacaatatgctagctacaaaagactctagccttaaatagtaaaataggctgaaagt

SEQ ID NO: 194265 - DNA, 601 bp, Human
ggcaggaggattgcttgaggtcaggagttaggaattagcatggtcaacagagcaagacccaatctctacaaaatacagaaaaaatactcaaaagacttcatcgtattaaaaaagacaatgatgctagacagcattataaaaccatatgaaaatataaaactctgttaaaggtatataagcagatatataatactttactatcataatgatggtgtaaaaaattcaaaattctgctataatatctgaaaaaatatctgcataaatctttgctaccagacacaaaatatataataatttgttrcattaacagcacactggagggtgttacagtttttgtattcaatgaagttgtgagattaaaatctgtatttataattttaaggtgttttatgtactctccatttttcaaggtgatccaaaagaaaatacctatacaaggtctgcaaaacacaatgagaaaagaatgaaagcttgtccacacaaaatcaacaaaacaaacgatgaagacagtcaaagaggaaatgagggataacatatctacaagaaacacagaaaacagtaacaatcaagatggtgatagtaacttcatttccttcagaaa

SEQ ID NO: 194266 - DNA, 601 bp, Human
attcatgaaagaagtcttacaaaaaatacatagcagaaaagcagtagaggtattatttgaagaaaaaaaggttgttaactttccaaatttcagtatgataaaaatgttactaaccaagaacacttgatctagaataatttcacttcaaaagaacagggggaaaataaagactttccaaaataaataaaaagatgagggtgttcaccaccactagtacagttctacaagaaatgctaaaggttgggtaggcatggtggctgatgcccataatgccagctttgggtgggccaaggcaggaggrttgcttgaggtcaggagttaggaattagcatggtcaacagagcaagacccaatctctacaaaatacagaaaaaatactcaaaagacttcatcgtattaaaaaagacaatgatgctagacagcattataaaaccatatgaaaatataaaactctgttaaaggtatataagcagatatataatactttactatcataatgatggtgtaaaaaattcaaaattctgctataatatctgaaaaaatatctgcataaatctttgctaccagacacaaaatatataataatttgttacattaacag

SEQ ID NO: 194267 - DNA, 601 bp, Human
aacaacacatttgagcatgctcttgttcaaaggttgaaatacttaatattgcaaagatgttcacgctgtccaatgcaatctacaaactccaggcaatctctttcagattttgaatcctctttttgcagaaataaaagcaacaacctaaaaatcctaagacatctcaaggggctgtaaagcacccaacaattttcaaacagaggaacaatgttggaggtatcacactgtctgatttcaaaacacattacaaggcgaccgtaattaaaacagtttggtactggtataaaggcagacaaatagmccaataaaacagaatgtagcacagatttaaaaataaaacacagaaaaaactgtaaaacaaatataatagctaaagtatgggatttattgaacactatgatctaaactaacatattcatgaaagaagtcttacaaaaaatacatagcagaaaagcagtagaggtattatttgaagaaaaaaaggttgttaactttccaaatttcagtatgataaaaatgttactaaccaagaacacttgatctagaataatttcacttcaaaagaacagggggaaaataaagactttccaaaataaataaa

SEQ ID NO: 194268 - DNA, 601 bp, Human
aagtcttctgcattactatatatgaccaaaatgaaatgaacctggaaataacaaagaaaaacaaaaaaaatcacaaatatatggaaattaaacaacacatttgagcatgctcttgttcaaaggttgaaatacttaatattgcaaagatgttcacgctgtccaatgcaatctacaaactccaggcaatctctttcagattttgaatcctctttttgcagaaataaaagcaacaacctaaaaatcctaagacatctcaaggggctgtaaagcacccaacaattttcaaacagaggaacaatgytggaggtatcacactgtctgatttcaaaacacattacaaggcgaccgtaattaaaacagtttggtactggtataaaggcagacaaatagaccaataaaacagaatgtagcacagatttaaaaataaaacacagaaaaaactgtaaaacaaatataatagctaaagtatgggatttattgaacactatgatctaaactaacatattcatgaaagaagtcttacaaaaaatacatagcagaaaagcagtagaggtattatttgaagaaaaaaaggttgttaactttccaaatttcagtatga

SEQ ID NO: 194269 - DNA, 601 bp, Human; identical to SEQ ID NO: 37558

SEQ ID NO: 194270 - DNA, 601 bp, Human; identical to SEQ ID NO: 37559

SEQ ID NO: 194271 - DNA, 601 bp, Human; identical to SEQ ID NO: 37560

SEQ ID NO: 194272 - DNA, 601 bp, Human; identical to SEQ ID NO: 37561

SEQ ID NO: 194273 - DNA, 601 bp, Human; identical to SEQ ID NO: 37562

SEQ ID NO: 194274 - DNA, 601 bp, Human; identical to SEQ ID NO: 37563

SEQ ID NO: 194275 - DNA, 601 bp, Human; identical to SEQ ID NO: 37564

SEQ ID NO: 194276 - DNA, 601 bp, Human; identical to SEQ ID NO: 37565

SEQ ID NO: 194277 - DNA, 601 bp, Human; identical to SEQ ID NO: 37566

SEQ ID NO: 194278 - DNA, 601 bp, Human; identical to SEQ ID NO: 37567

SEQ ID NO: 194279 - DNA, 601 bp, Human; identical to SEQ ID NO: 37568

SEQ ID NO: 194280 - DNA, 601 bp, Human; identical to SEQ ID NO: 37569

SEQ ID NO: 194281 - DNA, 601 bp, Human; identical to SEQ ID NO: 37570

SEQ ID NO: 194282 - DNA, 601 bp, Human; identical to SEQ ID NO: 37571

SEQ ID NO: 194283 - DNA, 601 bp, Human; identical to SEQ ID NO: 37572

SEQ ID NO: 194284 - DNA, 601 bp, Human; identical to SEQ ID NO: 37573

SEQ ID NO: 194285 - DNA, 601 bp, Human; identical to SEQ ID NO: 37574

SEQ ID NO: 194286 - DNA, 601 bp, Human; identical to SEQ ID NO: 37575

SEQ ID NO: 194287 - DNA, 601 bp, Human; identical to SEQ ID NO: 37576

SEQ ID NO: 194288 - DNA, 601 bp, Human; identical to SEQ ID NO: 37577

SEQ ID NO: 194289 - DNA, 601 bp, Human; identical to SEQ ID NO: 37578

SEQ ID NO: 194290 - DNA, 601 bp, Human; identical to SEQ ID NO: 37579

SEQ ID NO: 194291 - DNA, 601 bp, Human; identical to SEQ ID NO: 37580

SEQ ID NO: 194292 - DNA, 601 bp, Human; identical to SEQ ID NO: 37581

SEQ ID NO: 194293 - DNA, 601 bp, Human; identical to SEQ ID NO: 37582

SEQ ID NO: 194294 - DNA, 601 bp, Human; identical to SEQ ID NO: 37583

SEQ ID NO: 194295 - DNA, 601 bp, Human; identical to SEQ ID NO: 37584

SEQ ID NO: 194296 - DNA, 601 bp, Human; identical to SEQ ID NO: 37585

SEQ ID NO: 194297 - DNA, 601 bp, Human; identical to SEQ ID NO: 37586

SEQ ID NO: 194298 - DNA, 601 bp, Human; identical to SEQ ID NO: 37587

SEQ ID NO: 194299 - DNA, 601 bp, Human; identical to SEQ ID NO: 37588

SEQ ID NO: 194300 - DNA, 601 bp, Human; identical to SEQ ID NO: 37589

SEQ ID NO: 194301 - DNA, 601 bp, Human; identical to SEQ ID NO: 37590

SEQ ID NO: 194302 - DNA, 601 bp, Human; identical to SEQ ID NO: 37591

SEQ ID NO: 194303 - DNA, 601 bp, Human; identical to SEQ ID NO: 37592

SEQ ID NO: 194304 - DNA, 601 bp, Human; identical to SEQ ID NO: 37593

SEQ ID NO: 194305 - DNA, 601 bp, Human; identical to SEQ ID NO: 37594

SEQ ID NO: 194306 - DNA, 601 bp, Human; identical to SEQ ID NO: 37595

SEQ ID NO: 194307 - DNA, 601 bp, Human; identical to SEQ ID NO: 37596

SEQ ID NO: 194308 - DNA, 601 bp, Human; identical to SEQ ID NO: 37597

SEQ ID NO: 194309 - DNA, 601 bp, Human; identical to SEQ ID NO: 37598

SEQ ID NO: 194310 - DNA, 601 bp, Human; identical to SEQ ID NO: 37599

SEQ ID NO: 194311 - DNA, 601 bp, Human; identical to SEQ ID NO: 37600

SEQ ID NO: 194312 - DNA, 601 bp, Human; identical to SEQ ID NO: 117066

SEQ ID NO: 194313 - DNA, 601 bp, Human; identical to SEQ ID NO: 117067

SEQ ID NO: 194314 - DNA, 601 bp, Human; identical to SEQ ID NO: 117068

SEQ ID NO: 194315 - DNA, 601 bp, Human; identical to SEQ ID NO: 117069

SEQ ID NO: 194316 - DNA, 601 bp, Human; identical to SEQ ID NO: 117070

SEQ ID NO: 194317 - DNA, 601 bp, Human; identical to SEQ ID NO: 117071

SEQ ID NO: 194318 - DNA, 601 bp, Human; identical to SEQ ID NO: 117072

SEQ ID NO: 194319 - DNA, 601 bp, Human; identical to SEQ ID NO: 23165

SEQ ID NO: 194320 - DNA, 601 bp, Human; identical to SEQ ID NO: 23166

SEQ ID NO: 194321 - DNA, 601 bp, Human; identical to SEQ ID NO: 23167

SEQ ID NO: 194322 - DNA, 601 bp, Human; identical to SEQ ID NO: 23168

SEQ ID NO: 194323 - DNA, 601 bp, Human; identical to SEQ ID NO: 23169

SEQ ID NO: 194324 - DNA, 601 bp, Human; identical to SEQ ID NO: 23170

SEQ ID NO: 194325 - DNA, 601 bp, Human; identical to SEQ ID NO: 23171

SEQ ID NO: 194326 - DNA, 601 bp, Human; identical to SEQ ID NO: 23172

SEQ ID NO: 194327 - DNA, 601 bp, Human; identical to SEQ ID NO: 23173

SEQ ID NO: 194328 - DNA, 601 bp, Human; identical to SEQ ID NO: 23174

SEQ ID NO: 194329 - DNA, 601 bp, Human; identical to SEQ ID NO: 23175

SEQ ID NO: 194330 - DNA, 601 bp, Human; identical to SEQ ID NO: 23176

SEQ ID NO: 194331 - DNA, 601 bp, Human; identical to SEQ ID NO: 23177

SEQ ID NO: 194332 - DNA, 601 bp, Human; identical to SEQ ID NO: 23178

SEQ ID NO: 194333 - DNA, 601 bp, Human; identical to SEQ ID NO: 23179

SEQ ID NO: 194334 - DNA, 601 bp, Human; identical to SEQ ID NO: 23180

SEQ ID NO: 194335 - DNA, 601 bp, Human; identical to SEQ ID NO: 23181

SEQ ID NO: 194336 - DNA, 601 bp, Human; identical to SEQ ID NO: 23182

SEQ ID NO: 194337 - DNA, 601 bp, Human; identical to SEQ ID NO: 23183

SEQ ID NO: 194338 - DNA, 601 bp, Human; identical to SEQ ID NO: 23184

SEQ ID NO: 194339 - DNA, 601 bp, Human; identical to SEQ ID NO: 23185

SEQ ID NO: 194340 - DNA, 601 bp, Human; identical to SEQ ID NO: 23186

SEQ ID NO: 194341 - DNA, 601 bp, Human; identical to SEQ ID NO: 23187

SEQ ID NO: 194342 - DNA, 601 bp, Human; identical to SEQ ID NO: 23188

SEQ ID NO: 194343 - DNA, 601 bp, Human; identical to SEQ ID NO: 23189

SEQ ID NO: 194344 - DNA, 601 bp, Human; identical to SEQ ID NO: 23190

SEQ ID NO: 194345 - DNA, 601 bp, Human; identical to SEQ ID NO: 23191

SEQ ID NO: 194346 - DNA, 601 bp, Human; identical to SEQ ID NO: 23192

SEQ ID NO: 194347 - DNA, 601 bp, Human; identical to SEQ ID NO: 23193

SEQ ID NO: 194348 - DNA, 601 bp, Human; identical to SEQ ID NO: 23194

SEQ ID NO: 194349 - DNA, 601 bp, Human; identical to SEQ ID NO: 23195

SEQ ID NO: 194350 - DNA, 601 bp, Human; identical to SEQ ID NO: 23196

SEQ ID NO: 194351 - DNA, 601 bp, Human; identical to SEQ ID NO: 23197

SEQ ID NO: 194352 - DNA, 601 bp, Human; identical to SEQ ID NO: 23198

SEQ ID NO: 194353 - DNA, 601 bp, Human; identical to SEQ ID NO: 23199

SEQ ID NO: 194354 - DNA, 601 bp, Human; identical to SEQ ID NO: 23200

SEQ ID NO: 194355 - DNA, 601 bp, Human; identical to SEQ ID NO: 23201

SEQ ID NO: 194356 - DNA, 601 bp, Human; identical to SEQ ID NO: 23202

SEQ ID NO: 194357 - DNA, 601 bp, Human
tcaatgtgaggcccaggccaattgcttccttgactcctctcatcactaccaccattgtgtccttgaagagattattattagcagtaatgtagggacagggtctcactatgttgtctaagctggtctcaaactcacaggttcaagggactctcccactttggcctcccaaagtgctgggattataggtgtgagccaccacccttagcctataggggtgattatttttccttgtgatggctgtaagggaagcagaggaaaaggagacgtcaccctcttgggaatttttgaagcacagagtcaytctttcaaagtacaagaaagttttcctgggcatcccgagaacactggcctgcatgaggttgaaattatctctgcagtgttgtggtgcctatgtgatttgaagccattaacctctctgtggctcagtttttccctctatagaatgaggatactgttcattttaaaggagactctaagtttacatagatacatgaaatgctgtgagtaaatttgtgcaccaatttgcaagtgccaggcacaaagtctttaataaacactacttggctaccatgtgcccagcactgtcctatgtgctggggat

SEQ ID NO: 194358 - DNA, 601 bp, Human
agtgtcgctcgtttgtctgcagatcggcctttgtgaggaccccaggagactcaggtctgattcctcattaccccttttgcttgtttcagcagataacactgaggcacctgtaaccaagattgaacttctgccgtcctactccacggctacactgatagatgagcccactgaggtggatgacccctggaacctacccactcttcaggactcggggatcaagtggtcaggtaaaagtgaggccagctgagacattcaggagggaaacttcctgtggttcacggtgtcatcatcctcctgtccstcccccttttcattgttctgattcccttgaagcaagggtcctggctagggatgtcaccctctcatctttttttttttagacggagtcttgctctgtcacccaggctggagtgcagtggtgcgatattggctcactgcaagctctgccccgtgggttcaagcagttatcctgcctcagcctcctgagtagctgggattacaggctaatttttgtatttttaatagagatggggtttcaccatgttggccaggctggtctcgaactcctgacctcgtgatccaccctcctcgaccttccaaa

SEQ ID NO: 194359 - DNA, 601 bp, Human
ttaccccttttgcttgtttcagcagataacactgaggcacctgtaaccaagattgaacttctgccgtcctactccacggctacactgatagatgagcccactgaggtggatgacccctggaacctacccactcttcaggactcggggatcaagtggtcaggtaaaagtgaggccagctgagacattcaggagggaaacttcctgtggttcacggtgtcatcatcctcctgtccctcccccttttcattgttctgattcccttgaagcaagggtcctggctagggatgtcaccctctcatctttttttttttagacggagtcttgctctgtcacccaggctggagtgcagtggtgcgatattggctcactgcaagctctgccccgtgggttcaagcagttatcctgcctcagcctcctgagtagctgggattacaggctaatttttgtatttttaatagagatggggtttcaccatgttggccaggctggtctcgaactcctgacctcgtgatccaccctcctcgaccttccaaagtgctgagattacaggcatgagccacagcacccggccaccctcccatctttgaggtagagtcaaagc

SEQ ID NO: 194360 - DNA, 601 bp, Human
ggagatgctgtggatacagtgatgaacagaaaaggcccctcttctcagagagctttcagaggggtcccctcaccaaaatgtgggcatatttctagtaaaagaaaatatgcagccagacagctggatgcaagcaatcactgtttcatttccaaatgtatgtagggcagaaggtctgtctgtgaactagacagcaaggaggaaaaaggagattggggtgtggggtggggaggagaggtaggaaggaaagagctgggagggggaagatgagaaccattttaaaagccagtggagtaaacagcasttaaggatgtagcatcccaggatgtatgatgccccaagccctccataaattgaggctgattgctgctgtgcagctgcattctagaaaatactctgtgctgtttggaacgtgacagccattatctccgaccctgcacttagcaggtggctagtgctgtcaactgcctcactcagtgacactgtggctcagctgagcatggagcctggtttttctgtcgcagaccacattgaacccctcctcccaaacgcaaatcctttagaggcactttaccaggggtttcagctaaatggaccacagcgg

SEQ ID NO: 194361 - DNA, 601 bp, Human
ctccccccatcccacccccctgcagagagagacaccaaagggaagattctctgtttcttccaagggattgggagattgattttacttctcggatttctctactttttcgtgtgctccctggatattcttagtagcgccttccagctggttggaggtaagaatgaaagggtgagaggtctgcgggtgaggggcattatcttgaaatgtggttccgagagtaaaactcagcaagccctctccagctgcagcctcctggagtgttttaggactggaaccgacctcagatcatttatgaagtctrtgctttccgttatagaagagaaaactgaggcctatacaaagggctatgacttggcccaggtggcttaggccaggagctggggctagactattccaagctatccgccagttgagtttgtccacaaaccccaggcaggaagttgtctgacatacagacttagctgaggaattcctatatcctccacaccagagagaattctggaatgagaaagagtgccctttcaaatatgggcccttgctgggggaaggacagggccccttctctgggctggaggaatctgcatccattgtacttaccttc

SEQ ID NO: 194362 - DNA, 601 bp, Human
gtgatgtcagaaacaaacaagcagcactccgtctactgggtgcaggcattttcgggggccctctatcaaacattctttcccagagccctcccatttacggagagatcatgaaccagccctgagactcacagcctgtgattagcagagtaagattcagtctcagatctgggtgacacaaaggaccatggatttctgcaacccttggtgcctttcttgggaacccatctgtgtgacttgggagagttggggaggtgggcattcatgggagagcatgaggggcaaacacttcctggacattgcttttttttttttttttttttgagacagagtttcactcttgttgcccgggctggagtgcattggcgtgatctcagctcaccgcgacctccacctcccggcttcaagcgattcttctgcctcagcctcctgagtagctgggattacaggcatgcaccaccatgcctggctaatttttgtatttttagtagagacggggtttctccgtgttggtcaggctggtctgcaactactgacctcagttgttccgcccgtcctccgcctcccgaagtgctgggattacaggtgtgagccaccgtgcctg

SEQ ID NO: 194363 - DNA, 601 bp, Human
tacggagagatcatgaaccagccctgagactcacagcctgtgattagcagagtaagattcagtctcagatctgggtgacacaaaggaccatggatttctgcaacccttggtgcctttcttgggaacccatctgtgtgacttgggagagttggggaggtgggcattcatgggagagcatgaggggcaaacacttcctggacattgcttttttttttttttttttttgagacagagtttcactcttgttgcccgggctggagtgcattggcgtgatctcagctcaccgcgacctccacctccyggcttcaagcgattcttctgcctcagcctcctgagtagctgggattacaggcatgcaccaccatgcctggctaatttttgtatttttagtagagacggggtttctccgtgttggtcaggctggtctgcaactactgacctcagttgttccgcccgtcctccgcctcccgaagtgctgggattacaggtgtgagccaccgtgcctggcctcctgaacattgcttctgggctccctggtccatgggagcatcagctaggggctttgctgtctggttatctcagacaaatcacctgcatcctc

SEQ ID NO: 194364 - DNA, 601 bp, Human
catggtgtcctcttcatgtgagtcggggcacccatgagcccacctgcattccagacactctcctgtctatctgagggtgggaaggacgggggaggaattcactctgaatatgtccaggccttgccaccattgtcttggtatcttgccccagctacaatgtgtttccctcttgatccaaggcaacttcctgtttccatttcgatggcaggatctggaaatagaccctgctgctggagttctcagctctgaattctctagtactgtactttccagacctgtagccactagccacatgtggcartttaattttgttgaaccttaattgatttaaaattaaaatataacattcagttcctcagttgtactagttacatttcaagtgttaaagagccacatgtggctggctggcagctaccctattgagaagtagagacatagaacatttccttcactgcagaaagttagttctctgggacagggccactctcagtgctaagaagaaagacaacttaatcacatcacaaattgctctgggacaaccgagcttgggagatggcacactaaacttgtacctgtctgataattgctgcagctacgttgg

SEQ ID NO: 194365 - DNA, 601 bp, Human
ctttctaagcttgctaatggtacttttccatcctctagtgctcactgttcgggctgccatccccattatcatgggggccaacattggaacgtcaatcaccaacactattgttgcgctcatgcaggtgggagatcggagtgagttcagaaggtaagaggctcaaaaccagcctttgcgacatcagctctattgttcttggccacgctgttgtaactgcttttaaccagccaaagatgacatgcttatcaggttcattcctggagttcctagaagtaaccacagggaggtatggctagggttrgatcacatactcaccagctgattagactcagctccctgatcggcagagcagggataatactatctatcactactgagttgttgtaggattaaatatacaacccagcaggtgagtgttcagagcacccagcacattgagttcactaaataaatgcaaactctagctagaaacttagccgctgggtggcggaattgaagcaaggccagttagaagagtaggatttattgggactgggcgtggtggctcatgcctgtaatcccagcactctgggaggcccaggcgggtggatcgcctgaggtc

SEQ ID NO: 194366 - DNA, 601 bp, Human
ctagggttggatcacatactcaccagctgattagactcagctccctgatcggcagagcagggataatactatctatcactactgagttgttgtaggattaaatatacaacccagcaggtgagtgttcagagcacccagcacattgagttcactaaataaatgcaaactctagctagaaacttagccgctgggtggcggaattgaagcaaggccagttagaagagtaggatttattgggactgggcgtggtggctcatgcctgtaatcccagcactctgggaggcccaggcgggtggatcgyctgaggtcaggagcctggccaacatggtgaaaccccatctcttctaaaaatacaaaaattagccggccgtggttgccagcgtctgtaatcccagctactctggaggctgaggcaggagaatcgcttgaacccgggaggcggaggttgcagtgagtcgagatcgtgccactgcactccagcctgggtgacagagtgagactccatctaaaaaaaaaaaaaaaaataaataaatactgttttgtttggtcataattataacttatttaaacttccactttcggtcagctcaacccatgccac

SEQ ID NO: 194367 - DNA, 601 bp, Human
agttcactaaataaatgcaaactctagctagaaacttagccgctgggtggcggaattgaagcaaggccagttagaagagtaggatttattgggactgggcgtggtggctcatgcctgtaatcccagcactctgggaggcccaggcgggtggatcgcctgaggtcaggagcctggccaacatggtgaaaccccatctcttctaaaaatacaaaaattagccggccgtggttgccagcgtctgtaatcccagctactctggaggctgaggcaggagaatcgcttgaacccgggaggcggaggttgcagtgagtcgagatcgtgccactgcactccagcctgggtgacagagtgagactccatctaaaaaaaaaaaaaaaaataaataaatactgttttgtttggtcataattataacttatttaaacttccactttcggtcagctcaacccatgccaccttttctttgttcttcacttacaagttaataaaaaacaaaacctagtttctgcgtatgcagaaactctgaaactagagcaggtagaatgctggaaactcttttctttcaaaaaggttaatgtgaaaattaagtgtttcttagcct

SEQ ID NO: 194368 - DNA, 601 bp, Human
agagtaggatttattgggactgggcgtggtggctcatgcctgtaatcccagcactctgggaggcccaggcgggtggatcgcctgaggtcaggagcctggccaacatggtgaaaccccatctcttctaaaaatacaaaaattagccggccgtggttgccagcgtctgtaatcccagctactctggaggctgaggcaggagaatcgcttgaacccgggaggcggaggttgcagtgagtcgagatcgtgccactgcactccagcctgggtgacagagtgagactccatctaaaaaaaaaaaaawaaataaataaatactgttttgtttggtcataattataacttatttaaacttccactttcggtcagctcaacccatgccaccttttctttgttcttcacttacaagttaataaaaaacaaaacctagtttctgcgtatgcagaaactctgaaactagagcaggtagaatgctggaaactcttttctttcaaaaaggttaatgtgaaaattaagtgtttcttagcctcttctagctagttttttttttttttcagtttttttttaaaaggtaagctgtttcattgaagacataaaaatccag

SEQ ID NO: 194369 - DNA, 601 bp, Human
tttaagttaaatttttttattgatacaaaatatttttacacctttctgggaaacatgtgatattttgttacattcatagaatgtgtagtgatcaaatcagggtatttgaggtgcccaccgctttggggatttatgatttctatgtgtttggaacaattgaaaactccagcatagagggctttggttgccttcatactggtccccacctttccaaaagaaggtagccttcaatatacatgatacaaaagtgcccttgatgcaattcttcgaaacagtgattgctgagctaattattccagcygtaacatgcttgctggcccgcagcttcttcatctggccaatgggaatatagataccagccactttggggatcgatatgagagaacaaaaatgagattgtgtacatgtgcacacttccataggtgacacctagcagagggtggcagatgatacaggtaatgacccacctcacatggtgcccacttgcttagtgactaatctggctgtcggggtttccctcccatagagcttttgcaggagccactgtccatgacttcttcaactggctgtccgtgttggtgctcttgcccgtggaggtggc

SEQ ID NO: 194370 - DNA, 601 bp, Human
actgcacctccccttccctctgttggacggatggcatccaaaactggaccatgaagaatgtgacctacaaggagaacatcgccaaatgtgagtggagctcagtggattggccactatgacaggtgttgtctgggggtgacctatttatccgtgtgaagtcccagtaagtgaaggaaaggacagtaggagtcaccaagcacctgccctacatcaagcagtgagcaacatgctttcacagcagaggaaactatggcttaggaactgaggtgacaggcctgaggtcccacagcaagggcagaaytggaacttgaagtccatttcctttgccagctccacaccacctcagaaaagctcaacagattctagaggattccctctacatgctttgttcagattcctttagtcaataactctaggggccaggcatggtgtctcaaggctataatcccagcactttggggaggccgagatgggctggtcacttgaagccaggagtttgagaccagcctggccaacatggtgaaaccctgtttctactaaaaataatacaaaaaaagtaggcatggtggctcaagcctataattccagccaagattgcacc

SEQ ID NO: 194371 - DNA, 601 bp, Human
aggaactgaggtgacaggcctgaggtcccacagcaagggcagaactggaacttgaagtccatttcctttgccagctccacaccacctcagaaaagctcaacagattctagaggattccctctacatgctttgttcagattcctttagtcaataactctaggggccaggcatggtgtctcaaggctataatcccagcactttggggaggccgagatgggctggtcacttgaagccaggagtttgagaccagcctggccaacatggtgaaaccctgtttctactaaaaataatacaaaaaaaktaggcatggtggctcaagcctataattccagccaagattgcaccactacactccagcctgggcaacagggagatagtctgtctcaaaataaaataactttagggagacgacaacccgatttgaaggaagatgtgggacccacatagaacagatgtattcactcaattagtccctactgtacagcaggccccatttcagggcactggggctgtagctcttgaacgggcagtgagcttgcatgatgctctgattattaagaagctgtaatgttttttccaacccagccatccttcgttattc

SEQ ID NO: 194372 - DNA, 601 bp, Human
tctcaaaataaaataactttagggagacgacaacccgatttgaaggaagatgtgggacccacatagaacagatgtattcactcaattagtccctactgtacagcaggccccatttcagggcactggggctgtagctcttgaacgggcagtgagcttgcatgatgctctgattattaagaagctgtaatgttttttccaacccagccatccttcgttattctaattactccttacatatacttttgtatatctctgcttctctcttctcaccctcccaccacattaattctgagcactataycttaatactctaggtatgattaccccaaagaatcaagttaacttaccacctcccacattctaggcactatacattcattcatataaccatgttttgctgggattatctgggggatgcagaaggggctttataattagcaatgccccttactttgacttgcccatcgaatccctcaaagcatacttatcattagtaaaaaaaaaaaattagaccatcgacagcatggtctttagagacagaactgggctgagtctacccctgaacagttgtgtgatttttaaagccatcacttcatcttcc

SEQ ID NO: 194373 - DNA, 601 bp, Human
tctcaccctcccaccacattaattctgagcactatatcttaatactctaggtatgattaccccaaagaatcaagttaacttaccacctcccacattctaggcactatacattcattcatataaccatgttttgctgggattatctgggggatgcagaaggggctttataattagcaatgccccttactttgacttgcccatcgaatccctcaaagcatacttatcattagtaaaaaaaaaaaattagaccatcgacagcatggtctttagagacagaactgggctgagtctacccctgaayagttgtgtgatttttaaagccatcacttcatcttccagcctcatgcgatcccactgattatgacatagtttcagtggtgccccttgctgcgaaggaggctgagaagggctgtcttgatttggggctgccatctgttaaactaacaaccaggaatctgtttgtaggaaagacaggatctgggggaataaataacaatctgtagccgtggtggctccatgccctcctgacaagattctttgtggtctttcaggccagcatatctttgtgaatttccacctcccggatcttgctgtgggcacc

SEQ ID NO: 194374 - DNA, 601 bp, Human
atcttgctgtgggcaccatcttgctcatactctccctgctggtcctctgtggttgcctgatcatgattgtcaagatcctgggctctgtgctcaaggggcaggtcgccactgtcatcaagaagaccatcaacactggtaggtacactgccctcacttgtaggccttgagggatggtcactgcatggggtgtgggggtcctttagattcccatctagcaatggcctctgcatggagtttctctctcagattggatcagcaccagaagtgaggatgtcattcacctggaaatgttcttggcatcctgggtggggtctagggagcaggcccaagtttccattgcatcttggcaaggtcctgagcaggagttcatatctagagagctgtgagtcaggccttccttcttagcgggtttcctgtatgctcagagctttactggctctgtcaagaccccttagaaaaaggaccccaggtgtctgccctcgcccccacctcccttcactcttgtaaaggaaatgtgatgcataaatacatcagcatctagaggtggccaatgagactgctggctaagaggatttcctgccaagtagggtgtcctggccaa

SEQ ID NO: 194375 - DNA, 601 bp, Human
atcagcatctagaggtggccaatgagactgctggctaagaggatttcctgccaagtagggtgtcctggccaatgagagctcgctaagccaatgacatcatcacttcatgaaagctcagtgaaatatagccaagaaaattcgccccccaccccagattgtcttggggaacagagcaactctgggtgcttctgggaaatgcagggcctgatccggtgctagttgggtggaggactcagttggcaggcatgttccaagctgctacagtttcttgatgctctttaaggcagaaatgaaggttgarggtcaaatgtgggtgctgacaggagaccagggcaggcgaggaagcatgctctcagcactttctggaaggagagtggttacttgggtgggttcactctttctaacctgacctccagggaatctgtgtttttgttttcataacacttacctgtatccttggtttttccatctgaatatgcggagcaaaagacaatggggaatgaaactggattctaaaactctactctgtaatctgagaccatatatgggatgatgtacaacctcacccctaagcccagcccctaccccaggccaccaggcc

SEQ ID NO: 194376 - DNA, 601 bp, Human
cagattgtcttggggaacagagcaactctgggtgcttctgggaaatgcagggcctgatccggtgctagttgggtggaggactcagttggcaggcatgttccaagctgctacagtttcttgatgctctttaaggcagaaatgaaggttgaaggtcaaatgtgggtgctgacaggagaccagggcaggcgaggaagcatgctctcagcactttctggaaggagagtggttacttgggtgggttcactctttctaacctgacctccagggaatctgtgtttttgttttcataacacttacctgyatccttggtttttccatctgaatatgcggagcaaaagacaatggggaatgaaactggattctaaaactctactctgtaatctgagaccatatatgggatgatgtacaacctcacccctaagcccagcccctaccccaggccaccaggccataccttccccggagaggccatgacatctcttccttctgtcttccagatttcccctttccctttgcatggttgactggctacctggccatcctcgtcggggcaggcatgaccttcatcgtacagagcagctctgtgttcacgtcggccttg

SEQ ID NO: 194377 - DNA, 601 bp, Human
ctgtactatccaaaatatggaactaatatgtggaggggaagccacgggtaaagttttcaggaccttgatatgagaacaatcaaaactatcagttctgagagaagcagtaagaccctcataactggtggttgtttcagcaaaagtggggtggccccttgatatagatgtggaaaaggtacttaggaagcacagacaccacctcccatctcctcactgcctcctatggggaactttacaattaggagaactccttggcatggaccatctatgttactttgtgcaagacctttgggatttgaaattatttatttatttttattttatttttttgagacagagtctcgcactgtagcccaggctggagtgcagtgatacaatctccactcactgcaacctccacctcccaggttcaagtgattttcctgcctcagcctcccgagcagctgggattacaggcacctgccaccacacctggctgattttttgtatttttagtagagacggggtttccctatgttggccaggctggtcttgaactctggacctcatgatgtgcttgccttggcctcccaaagtgctgggattacaggcgtgagccact

SEQ ID NO: 194378 - DNA, 601 bp, Human
gttttcaggaccttgatatgagaacaatcaaaactatcagttctgagagaagcagtaagaccctcataactggtggttgtttcagcaaaagtggggtggccccttgatatagatgtggaaaaggtacttaggaagcacagacaccacctcccatctcctcactgcctcctatggggaactttacaattaggagaactccttggcatggaccatctatgttactttgtgcaagacctttgggatttgaatttatttatttatttttattttatttttttgagacagagtctcgcactgtagyccaggctggagtgcagtgatacaatctccactcactgcaacctccacctcccaggttcaagtgattttcctgcctcagcctcccgagcagctgggattacaggcacctgccaccacacctggctgattttttgtatttttagtagagacggggtttccctatgttggccaggctggtcttgaactctggacctcatgatgtgcttgccttggcctcccaaagtgctgggattacaggcgtgagccactgcacccagccggggatttgaattcttatctcaccatttacatactaagtgac

SEQ ID NO: 194379 - DNA, 601 bp, Human
acctcccatctcctcactgcctcctatggggaactttacaattaggagaactccttggcatggaccatctatgttactttgtgcaagacctttgggatttgaatttatttatttatttttattttatttttttgagacagagtctcgcactgtagcccaggctggagtgcagtgatacaatctccactcactgcaacctccacctcccaggttcaagtgattttcctgcctcagcctcccgagcagctgggattacaggcacctgccaccacacctggctgattttttgtatttttagtasagacggggtttccctatgttggccaggctggtcttgaactctggacctcatgatgtgcttgccttggcctcccaaagtgctgggattacaggcgtgagccactgcacccagccggggatttgaattcttatctcaccatttacatactaagtgacctttggcaagtgatctaacctgagcgtcaattccctcatctgaaagatggaggacataacccctatctcattaggattattataaagatctgatgaggcaaagccatctgtgcaacagaaatagaaattcaggcatctaatataa

SEQ ID NO: 194380 - DNA, 601 bp, Human; identical to SEQ ID NO: 28302

SEQ ID NO: 194381 - DNA, 601 bp, Human; identical to SEQ ID NO: 28303

SEQ ID NO: 194382 - DNA, 601 bp, Human; identical to SEQ ID NO: 28304

SEQ ID NO: 194383 - DNA, 601 bp, Human; identical to SEQ ID NO: 28305

SEQ ID NO: 194384 - DNA, 601 bp, Human; identical to SEQ ID NO: 28306

SEQ ID NO: 194385 - DNA, 601 bp, Human; identical to SEQ ID NO: 28307

SEQ ID NO: 194386 - DNA, 601 bp, Human; identical to SEQ ID NO: 28308

SEQ ID NO: 194387 - DNA, 601 bp, Human; identical to SEQ ID NO: 28309

SEQ ID NO: 194388 - DNA, 601 bp, Human; identical to SEQ ID NO: 28310

SEQ ID NO: 194389 - DNA, 601 bp, Human; identical to SEQ ID NO: 28311

SEQ ID NO: 194390 - DNA, 601 bp, Human; identical to SEQ ID NO: 28312

SEQ ID NO: 194391 - DNA, 601 bp, Human; identical to SEQ ID NO: 28313

SEQ ID NO: 194392 - DNA, 601 bp, Human; identical to SEQ ID NO: 28314

SEQ ID NO: 194393 - DNA, 601 bp, Human; identical to SEQ ID NO: 28315

SEQ ID NO: 194394 - DNA, 601 bp, Human; identical to SEQ ID NO: 28316

SEQ ID NO: 194395 - DNA, 601 bp, Human; identical to SEQ ID NO: 28317

SEQ ID NO: 194396 - DNA, 601 bp, Human; identical to SEQ ID NO: 28318

SEQ ID NO: 194397 - DNA, 601 bp, Human; identical to SEQ ID NO: 28319

SEQ ID NO: 194398 - DNA, 601 bp, Human; identical to SEQ ID NO: 28320

SEQ ID NO: 194399 - DNA, 601 bp, Human; identical to SEQ ID NO: 28321

SEQ ID NO: 194400 - DNA, 601 bp, Human; identical to SEQ ID NO: 28322

SEQ ID NO: 194401 - DNA, 601 bp, Human; identical to SEQ ID NO: 28323

SEQ ID NO: 194402 - DNA, 601 bp, Human; identical to SEQ ID NO: 28324

SEQ ID NO: 194403 - DNA, 601 bp, Human; identical to SEQ ID NO: 28325

SEQ ID NO: 194404 - DNA, 601 bp, Human; identical to SEQ ID NO: 28326

SEQ ID NO: 194405 - DNA, 601 bp, Human; identical to SEQ ID NO: 28327

SEQ ID NO: 194406 - DNA, 601 bp, Human; identical to SEQ ID NO: 28328

SEQ ID NO: 194407 - DNA, 601 bp, Human; identical to SEQ ID NO: 28329

SEQ ID NO: 194408 - DNA, 601 bp, Human; identical to SEQ ID NO: 28330

SEQ ID NO: 194409 - DNA, 601 bp, Human; identical to SEQ ID NO: 28331

SEQ ID NO: 194410 - DNA, 601 bp, Human; identical to SEQ ID NO: 28332

SEQ ID NO: 194411 - DNA, 601 bp, Human; identical to SEQ ID NO: 28333

SEQ ID NO: 194412 - DNA, 601 bp, Human; identical to SEQ ID NO: 28334

SEQ ID NO: 194413 - DNA, 601 bp, Human; identical to SEQ ID NO: 28335

SEQ ID NO: 194414 - DNA, 601 bp, Human; identical to SEQ ID NO: 28336

SEQ ID NO: 194415 - DNA, 601 bp, Human; identical to SEQ ID NO: 28337

SEQ ID NO: 194416 - DNA, 601 bp, Human; identical to SEQ ID NO: 28338

SEQ ID NO: 194417 - DNA, 601 bp, Human; identical to SEQ ID NO: 28339

SEQ ID NO: 194418 - DNA, 601 bp, Human; identical to SEQ ID NO: 28340

SEQ ID NO: 194419 - DNA, 601 bp, Human; identical to SEQ ID NO: 28341

SEQ ID NO: 194420 - DNA, 601 bp, Human; identical to SEQ ID NO: 28342

SEQ ID NO: 194421 - DNA, 601 bp, Human; identical to SEQ ID NO: 28343

SEQ ID NO: 194422 - DNA, 601 bp, Human; identical to SEQ ID NO: 28344

SEQ ID NO: 194423 - DNA, 601 bp, Human; identical to SEQ ID NO: 28345

SEQ ID NO: 194424 - DNA, 601 bp, Human; identical to SEQ ID NO: 28346

SEQ ID NO: 194425 - DNA, 601 bp, Human; identical to SEQ ID NO: 28347

SEQ ID NO: 194426 - DNA, 601 bp, Human; identical to SEQ ID NO: 28348

SEQ ID NO: 194427 - DNA, 601 bp, Human; identical to SEQ ID NO: 40546

SEQ ID NO: 194428 - DNA, 601 bp, Human
ggagccttgggggtctgtgatctgaatgcctgatctcattccaactggaggtgaagaggaaggtggaggaagtggggaagggccactgaatctttctaaatcttctctcagttctgtcctatgggtttgggagtatgtggctcattcgaggccacatgggcatgtgttcttggggtatgaccacatcggctcctaaagaagatgctctctgcgtgtgtgtgtgtagagtgcaattgtagacaagcatatgactgtgaatgtttgtcagcagccatctatgaactagttctgcgcctgtgaragaaggaacctgaatacgagaaaatatctgccatcggctgttttcccaaagttattctagccaccaaggcctccgccgtgtcccagcctctgtccccaggcctagtgcctctccatcagcctggatcagggcaaattccctgcccccaactcttcccaccagggccggacctgaaggccaaggcctccgggtatgtgctcaggactcctggcccagagaaggtttttccctttctgcgtctttgcttccccttccgctttggggttcaggaaccccgattctctggaagaagagaaggcc

SEQ ID NO: 194429 - DNA, 601 bp, Human
cggatccggagtttgggggcgaggcgccggagtccctgccctgagtacagggaggctctctgcgtcgctgagaaacgtcggatctccaacccgacatgtctcctgtggcccaggcggcccgccctggactcgggcaaggaattcaggaggccaaagagcggacccagagtctggaggggagaatggtgaagtcttgggttgcaacagaagagggctcggtgggggctctttcgtaaaaacgcggtctccgcacccaaaggacactgcggagccgccttaatcgtcgttcttttagcacatytggggaaaggaaggcccaagctggggtagggacgcttgcagcccgggagggtttctctcaccaactctttccgcaacccggtccagacccggccagcagagactggaggcggcttccccgccccgcactccctcggcttggcccaggctcagctgcccggggcaccttccttgccgagaggcaattggactctgccgggagtgggcccagaagttgaggcccaggaagaggcctccgagcttcccccttttgttaggtgtagttacacacgtgaaagaacagctttcgccccgacctcca

SEQ ID NO: 194430 - DNA, 601 bp, Human
gggcccctaggcggcaccccaggggctccaacctggcccgcgcctccccagaccttggcgctgagagcgctgcttttgcgggtgggtggacggagaggtaacaatctgctttcaacaaaaacctgtcgccaccgaatcgaaagcgaaagggaagggagaagaggggcagcttcccgcagcggccccgcgtctcgggacaggtagactaggaccagtacgcgccggctgcagctccggcggtcggatccggagtttgggggcgaggcgccggagtccctgccctgagtacagggaggctctytgcgtcgctgagaaacgtcggatctccaacccgacatgtctcctgtggcccaggcggcccgccctggactcgggcaaggaattcaggaggccaaagagcggacccagagtctggaggggagaatggtgaagtcttgggttgcaacagaagagggctcggtgggggctctttcgtaaaaacgcggtctccgcacccaaaggacactgcggagccgccttaatcgtcgttcttttagcacatctggggaaaggaaggcccaagctggggtagggacgcttgcagcccgggagggtttctctc

SEQ ID NO: 194431 - DNA, 601 bp, Human
gttgtcccgggtttactccgcacccctctactgggtgaggaaggagcatcttgaatggagatgggggtgtccccggtttatacatctgcagagaagaggtgtgccgggctgcacctctggaggccgcggtaactgatattagagaagaccccggttgcagctgggaaggctcactggctggaaagaggtgcctcctccttccagcaaagggccctgtttggaagggctgcttctcacctgtctagtggcaccacaggacggtcggcttccactcgaattcccccggacggtatcatcacakagccgggtcctcgcagtgttggtttcccaatccgatgactgtcacctcggtgaggacctgtgctgatggccggagaaccctgcgctgcgggcgcacatggccaggtggcgcctggcaggcgacgtccgggtgcaggacggcgctcttaccgccccaccccaaaccgttgcctgggcctaggtccttcggcttcctgaacaggggtttggggggctaaggacgctgaggctccgggggcaggaagttctctctggttaagcgttctctcttctctccggcatacactcccctacccaccca

SEQ ID NO: 194432 - DNA, 601 bp, Human
ccccggtccccacgtgtgccgcgctggacatcagtgtcatggtccaaacctcccacagcttcccagccttctctgttgtggccttcagagccctggagagccagttgttctgctctgacctgggtcaccaggtcctgtccctctacgaggtgcgtggggccaacatccatgctgggcctccagttcagaatgaaaatccactcttaaagaatctgctttaagaatccgatgaagcaagcactggctccctctctgcccccaatgtgcagcggcgccagtgcccagcagccttgaccaagcsgtcccgagtacaagcggcgccttcaccgggaaagataggtacttggcagccggtggcccctcttaccccgcccgtatctcccagtgaccccctcctcaccaaaacggcaccctgggagccgcggagcgccacggtgacccttccaactgcctctggagtccaaatccgaaccggtccgcggccctgagtaccaccctacacaccccagccttggctcctcagagccttgcctctgcgtggctcttcctcgccgctgagccacaactcccttccattcctctctttcctcggcgctggctg

SEQ ID NO: 194433 - DNA, 601 bp, Human
gacctctagccggctttgtgtcctgtgatggctccccactcaggacctgtgttagcctccagggaagccttttccacccaccttaccccagtttctcctggacaaaaatgcgtgtgggggtgaggagggaagacaaagggggtgaaggtgggcccagactgctaccagcacagaaactccaagagggtctttggaaattgtcaacactcctgcatttcatacagctaaaattcagaccccggagcagaacatacttctccaaggccatggaggagtagagaatgcaaaggtggaggctggrgtgatctacaccgcaactgtgggccccggtccccacgtgtgccgcgctggacatcagtgtcatggtccaaacctcccacagcttcccagccttctctgttgtggccttcagagccctggagagccagttgttctgctctgacctgggtcaccaggtcctgtccctctacgaggtgcgtggggccaacatccatgctgggcctccagttcagaatgaaaatccactcttaaagaatctgctttaagaatccgatgaagcaagcactggctccctctctgcccccaatgtgcagcggcgcca

SEQ ID NO: 194434 - DNA, 601 bp, Human
tacacagtgggaggagttggtcatctggcctcagctgaccctggcttgtggttttcaagaacttaggaaaagaaaacccagcttggggagctgggcagagagcaggagtcccagcctggtggggctgcattagagtcaggtccctgcaatcccaccagggattccacgggtgctctcctgctgtcctctaatgcccaggagctcatggcggggtctgctttacttctaaggagactgaggcagaactgcaagcatctgccctatttgatgcacagagagagtgcaacttactggacttatygcaggagtcgcatccaacaagagagcgggtgagtggattggattccccaacactttctgcctttccacccattgtagtggaaggaggagaactcggtgggttcctgccctcctactaacctggctgtgggggtccatttccccttgggcctcagtttgctcatgtgctaaatggggtcagcagtgggcacagacagtgccaaggacacgtctcttccgcagtgagccacacgggacagagggtatattccagagctggtggcttgtcagacggcctcgccgcagtgtgggtgggctggat

SEQ ID NO: 194435 - DNA, 601 bp, Human
ccctgggggccatgtttgtaagaccctgtctttcatctccacatcatctgggatggaattagggttatctcaagtctaatcaggatcattctagaacaggatgccttttaggtttcttggagccctcggccagcaagactcgactcttccttcctggctgtctcactgtggacgagttacttatcttccatgaacctcagttttcatccacgaaatggggatgataatagtaccaatctcataggattgtgatggtgattaagtgaaatcatgcataagcagcactggtgtactgcctggmgcacaggcagggacgctcagttgttctgggctgtctcatggttctgcagcagcagccaactctaagccttctttgccttaaaacccattattgtctctgtcctgtagatgggaaaactcaggccaggagccaggcctggcatcccagactcttaacctttggcagactggaccagccttccccctttcctggtacaatgaatggggaagagtgtggggtcctgaggcatcttgaggattctggagggccaattcacccctcttggtgaatatcacagaaccccaaggcctctgaaaccac

SEQ ID NO: 194436 - DNA, 601 bp, Human
ccatggtttttttttttttttttttttttgtgagatggatcttgctctgtcacccaggctggagtgcagtggcaggatctcggctcactgcaagctccgcctcccgggttcacaccattctcctgcctcagtctcccaagtagctgggactacaggcgcccgccaccacgcccggctaattttttgtatttttggtagagacagggtttcaccgtgttagccaggatggtctcaatctcctgactttgtgatccgcccgcctaggcctcccaaaatgctgggattacgggcatgagccacygcaccgtgccctgggggccatgtttgtaagaccctgtctttcatctccacatcatctgggatggaattagggttatctcaagtctaatcaggatcattctagaacaggatgccttttaggtttcttggagccctcggccagcaagactcgactcttccttcctggctgtctcactgtggacgagttacttatcttccatgaacctcagttttcatccacgaaatggggatgataatagtaccaatctcataggattgtgatggtgattaagtgaaatcatgcataagcagcactggtgta

SEQ ID NO: 194437 - DNA, 601 bp, Human
tgggaagagcccaggccttggagccggatgccctgctgggaacccgggtgaggtcagatggcatcctggccagaagagagggctgcatcccttgcaggtgagtctcagaatcccagggtggaggatgagtgaatgggggactaagggaggaacctcagcagctctcaggcagcaccctgggcaggtggcaggaatgggggtgccagcgggcaggacacggaactcactgtagggaatgggggagacctgaggaggagagttggggatgaagggagaaaaccatttgactagagccgacccygggggctgtggcagtcagaccgcaggcctgtggccagtggggtgagacccaaaagaggagcagtgaggaaaaggggtactcctccgactgctagagttggagaagaccaagacttgtgctaaatagagctacccagagcctcgctgctcctacaccccacaggaaaccctgcaaaaaaaaaaaatcaataattttctaccagaatgcaagagaacgacaaagcaggctctcaccccaggcctccattcaaaggaaggatgaacgaagagagagtggaaagacttacagagttcctagcat

SEQ ID NO: 194438 - DNA, 601 bp, Human
gtgcctcttttgggaatctaacagaaaatcttcaaaatatgcatggggccaacagcatggagccactggatgcttccttcttggagcttctccaagctccgctggaaggattctggaatcatcttaataaaggaagtggtcccagatgtgcgcatctcaggaggtgggtgtatagaccctcagagcacaaaagaatttccccaaaggccacgtcctcatgggatggtcaactgaaggggcagaggggcccccgaatatccaggggcctggccagggccaagactgtggctctagagtcctygcctttggctctgccctccaccccttctcaccagctccaggtcccggaaaacaaatgtgtccttgagctgaatttctgtgacctgttggtcactggcctgcaggcaaggagatgaacggatggcctacaagggtccttgtacattctgcaatcctggacttcacatcagaagatcattcaggggccagatagacaaatgcaacagaatagagaccagatgtaaactctcaaatacatgcgcaattgattttcaacaaaggtcccaagaccggtcgatgagaaaagggccatcttttctac

SEQ ID NO: 194439 - DNA, 601 bp, Human
gatggcctagggtaggggacagggagttgcaagtgcctcttttgggaatctaacagaaaatcttcaaaatatgcatggggccaacagcatggagccactggatgcttccttcttggagcttctccaagctccgctggaaggattctggaatcatcttaataaaggaagtggtcccagatgtgcgcatctcaggaggtgggtgtatagaccctcagagcacaaaagaatttccccaaaggccacgtcctcatgggatggtcaactgaaggggcagaggggcccccgaatatccaggggcctrgccagggccaagactgtggctctagagtccttgcctttggctctgccctccaccccttctcaccagctccaggtcccggaaaacaaatgtgtccttgagctgaatttctgtgacctgttggtcactggcctgcaggcaaggagatgaacggatggcctacaagggtccttgtacattctgcaatcctggacttcacatcagaagatcattcaggggccagatagacaaatgcaacagaatagagaccagatgtaaactctcaaatacatgcgcaattgattttcaacaaaggtcccaaga

SEQ ID NO: 194440 - DNA, 601 bp, Human
aattatgccttagggcacatggctggaagaccaggctcaagcaggcctctgtttagtcacctaggccggggaagttcctaggaaggggagccggggacagctacttctctgcagctgtgctccccttggactctgctgtctagtccctggagccccagcccctggttgtgccattcactggatggcctagggtaggggacagggagttgcaagtgcctcttttgggaatctaacagaaaatcttcaaaatatgcatggggccaacagcatggagccactggatgcttccttcttggagctyctccaagctccgctggaaggattctggaatcatcttaataaaggaagtggtcccagatgtgcgcatctcaggaggtgggtgtatagaccctcagagcacaaaagaatttccccaaaggccacgtcctcatgggatggtcaactgaaggggcagaggggcccccgaatatccaggggcctggccagggccaagactgtggctctagagtccttgcctttggctctgccctccaccccttctcaccagctccaggtcccggaaaacaaatgtgtccttgagctgaatttctgtgacctgttg

SEQ ID NO: 194441 - DNA, 601 bp, Human
tggagtgcaatggtgtggtctcggctcactgcaacctctgcctcctgggttcaagtgattctcctgcctcagcctccctagtagctgggattacaggcgcccaccaccacgcccagctaattttttgtatttttagtagagacagggtttcactatgttggccaggctggtctcaaactcctgacctcaggcaatccacctgcctcggcctcccaaagtgctgggattacagatgtgagcaaccacacctggctttgtccttgcctattttaccttatttaagcctcaccctatcactaayaggtagacatgattcttatccccactttacaggtaaagaaactgaggcaaagaggtcaactaatttgcccaaggtcactcagctatgtgggctgaaatctgtttccaggtcctgagcttcatgggcttctccaaaccaaaggcatctgaagcatcaagcagcctgtgtagcccaattgtggaatgaacagtttccatgattttccaagaaccctagaaattatgccttagggcacatggctggaagaccaggctcaagcaggcctctgtttagtcacctaggccggggaagttcctagga

SEQ ID NO: 194442 - DNA, 601 bp, Human
ggcatccaggcagtgggcatgagccccctgggcaggggaggaaaaaggctctttggcttcaggagatctgggttcaattcacagcgggacagcctcaccttcctcatcttcaaattgaggatactaatatctcccagtgggtttccacaaaaagtctcagtccaggtgtggccaagggcaatgcccaccaggtgctttcttaattgcagatggggcccaggaagctggggcccaggaagggtgcagaggttgcctgacattccctgagcccgattctctgtgctcagccctgtgctgatcrgagaggaacacagcagaacccctgccctggggacaggctgaagttctgggtcaaataaacacagaaaacacattcagcagggagagagttattccccagctcatgacacatgtgtacgaggtgcagcagcctatggggaggaggggcctgaggggcctgggtggcctttgtccctccttgaagcctgcccccgctgcgttaggtagagatggcagcccccgcccctcccatcactcatccatgttttaaaagacaatgtcaaccacacagtaatcatagattcagtaataatttcttcat

SEQ ID NO: 194443 - DNA, 601 bp, Human
aaggaaggaaggaaggaaggaaggaaggaaggaaggaaggaagcaggcaggcagggagggagggagggagggagggaaggaaggaagaaaatggttttttcattgacttctgctcatctgaacaaaataaaaaattcaaaaaagtctcttctttaaaatgcatgatgtggccaggtgcagtgtctcacacttgtaatcccagcactttgggaggctgaggtgggcggatcacctgaggtcaggagttcgagaccagcctggccaacatggcaaaaccccatcttaaaaaaagaaaaaaaattatatatataatgcatggtgtgtcccttctaccaagcaaaccttaatccacagcgaacgtgagacaaatacatctcttttccacctgttactacttcttggcaggatggatcccctgcaacgggatagatctcctgagaggatactttgtgtagcacaaaactgggctctgtggaatcttctctcatggggctaaatcctgggggatgcattaatacagcagagcttgggcacatacattccctgaggaggcctggccctcactgtccacctgccacatggtacaagtaatatttccaaa

SEQ ID NO: 194444 - DNA, 601 bp, Human
ggaaggaaggaaggaaggaaggaaggaaggaaggaaggaaggaaggaagcaggcaggcagggagggagggagggagggagggaaggaaggaagaaaatggttttttcattgacttctgctcatctgaacaaaataaaaaattcaaaaaagtctcttctttaaaatgcatgatgtggccaggtgcagtgtctcacacttgtaatcccagcactttgggaggctgaggtgggcggatcacctgaggtcaggagttcgagaccagcctggccaacatggcaaaaccccatcttaaaaaaagaaraaaaaatatatatataatgcatggtgtgtcccttctaccaagcaaaccttaatccacagcgaacgtgagacaaatacatctcttttccacctgttactacttcttggcaggatggatcccctgcaacgggatagatctcctgagaggatactttgtgtagcacaaaactgggctctgtggaatcttctctcatggggctaaatcctgggggatgcattaatacagcagagcttgggcacatacattccctgaggaggcctggccctcactgtccacctgccacatggtacaagtaatatt

SEQ ID NO: 194445 - DNA, 601 bp, Human
agtgctgggattacaggtgtgagccacctcgcctggcccaaatatactcattccaatctagagaatcacttacaaactgaaaaagcaacaaggcttttctccccttggatgagaaagggaaagtaatggctcaattaattataagattgctttttttttttctgttgcctaggctggagcacagtggtacaatcacagctcactgtagcctcaacctcctgggctcaagcaatcctccctcctcagcctcctgagtagctggtactatgggcacacaacatcacagctggctaattaaaatttttttttttttttttttttgtagagacgaggtgtcactatgttgcccaggctggtctcaaactcctggattcaagcaattgtctcacctcagcctcccaaagtgctggaatacaggcatgagccaccatgcccagtcctagtttgtactttaagaaagtcatcaacttccttaaagttgataagaatgggaaagattcttcaatatttgctttttaaaaaatccacatttacaactataaaatagttaacaattcaaaatatctaaaggataattatacctaaaagttttggttggtgt

SEQ ID NO: 194446 - DNA, 601 bp, Human
aatttttgtacttttagtagaggtggggtttcaccatcttggccaggctggtcttgaactcctgacctcgagatccaccctcctcggcctcccaaagtgctgggattacaggtgtgagccacctcgcctggcccaaatatactcattccaatctagagaatcacttacaaactgaaaaagcaacaaggcttttctccccttggatgagaaagggaaagtaatggctcaattaattataagattgctttttttttttctgttgcctaggctggagcacagtggtacaatcacagctcactgyagcctcaacctcctgggctcaagcaatcctccctcctcagcctcctgagtagctggtactatgggcacacaacatcacagctggctaattaaaatttttttttttttttttttttgtagagacgaggtgtcactatgttgcccaggctggtctcaaactcctggattcaagcaattgtctcacctcagcctcccaaagtgctggaatacaggcatgagccaccatgcccagtcctagtttgtactttaagaaagtcatcaacttccttaaagttgataagaatgggaaagattcttcaat

SEQ ID NO: 194447 - DNA, 601 bp, Human
gtctccatgagaagcccatgtatgatctaacacttggagatcacttcctgatgcctcctggggtgggatgggtgttccagcttcagtctgggctctaagtgcccctgtcagcttctctcctcaaggaggctagaagtttcccggctcctcgtcccatccccaagctccatctcatggcgtgggtggttggatgagaccctgtccccggcaggacccactgccagagaaacagagtctcccatgctctcccctatcccagcaatacgtccgcagggttcagagaccccactggaccagaccmtcccttcacagccaagatgcggaggcccagagcaaggtcatactgcctgataatggaagggccaggacttgaaccctgcacctcctgcatccagccctgtggtctgtctgcccattgtccctctcaagccccctaaaccatgtggccctgggcgtgtcccaagacatctctcacttaattcccccaagcctctgtttcccttctgtagcagaaagaatcctgcagctccaccaccttcaccaagacactgtaatatcactttcatccggaggctggcgagatggaggagcttagatcctg

SEQ ID NO: 194448 - DNA, 601 bp, Human
acatacataaacagagcatatgcacagagagagacacagagagagacccagagagattgaaaataatgcaaatatggcaaaacatcaccatttggggagtcagcataaaaggcatctgggaattctttgtagtccacttataactttaagtgtaatactgtatcaaaataaaaaggtttttaaaagaaaaggtatgtggactaatggaaagaaggcaccttccctaggaacccctcttgtgaagctggcatatgtaatcatttgaacaggacctggatgagtttacctggcaacctccccrccttcccctcatcaccaccaccattcataattctacaaggggccttgtacgttgcaataaaaatcacaagacaaatgccaactctgggagcacacattgctccccagccctctggaagccctcactcccgtggaagccactgtgacccaattagaacatggggctcctttaagcagctcttctgagagctgtaggagaccaaggtcaagctactgttggaacttaaaagtttaaaaagtactttaatttttgagtctactgtaatttcaactgtcctacagttagtccaaatgagtaaag

SEQ ID NO: 194449 - DNA, 601 bp, Human
ttggctcagtgcaacctccgcctccccggttcaagctattctcctgccgcagcctcctgagtagctgggattacaggcacccagcaccacgcccggctaatttttgtactcttagtagagacagggtttcgccatgttggccaggctggtctcgaactcctgacctcagatgatctgccttcctgggcctcccaaagtgctgggattacaggcgtgagccaccgtgcccagcctataaacattttagtaaaatctaaccatattccgtacccctttccatgctgttctatattcttctacyacaccatccttaatggttacgtagcgagaacaatcactattttatttaatccatccttttctgttgggctcacaggtttctacttgtttgaaatcatagcaggtctgtgatttaaatctctcaatacatgcatggcgattcccttaggagaagctccaagaactagaaatatgaagttcaattatccacatatctgagggtctctgagaaacacggccaagttgtcttccagaaacatgtaatgtcctcagctaccacggtgtcccctcccacttcagagccaataatggtcattatagt

SEQ ID NO: 194450 - DNA, 601 bp, Human
ttgcttgcttgctttttgctaaatctgccaaccctgtacatcaggcttatgtggcattcagggtcccgaaggcaggactggtccccaccagactcacggacttacacgccagccttccatctagcttgaggttcagagacctgcttccgctctgcagcgcactgcacgagtatcttcaggcttccgcactcctgcgggcacccttccttctacctagcatgtctctctgcctctcctgtctgtggctaactactactttcacctggatagctttctctgtaacttttgtgacttttctttygcattacaaatgtaatctatgttctatatggaagattaaaaaaaaatcaagacagaccaaaagaaaatcactcacacacatacacatacacacacacacacaaacacacacagagaaaacattactttgtaaacttttgtgtttttttttgagatggagtctcgctgttgtcgcccaggctggagtgcagtggtgcaatcttggctcagtgcaacctccgcctccccggttcaagctattctcctgccgcagcctcctgagtagctgggattacaggcacccagcaccacgcccggctaa

SEQ ID NO: 194451 - DNA, 601 bp, Human
gctggtctgaattaattttctatttgttttcccaggaacaggttgaaatatctgaaagcagtgattagaatcctggatggtgcatgctctgagagcgggctgggctctgtgctgtgggattatgggaagcaagagacaagcaccacttggagagactcagttaaactggaattttagataaacagttaacactttaaacaatataagtatatcccaaatatggcacaagaaatacttttatcctacaaattattcattattcaaatgcagatttgactgagtaacctggttttgttgttttcttgcttgctttttgctaaatctgccaaccctgtacatcaggcttatgtggcattcagggtcccgaaggcaggactggtccccaccagactcacggacttacacgccagccttccatctagcttgaggttcagagacctgcttccgctctgcagcgcactgcacgagtatcttcaggcttccgcactcctgcgggcacccttccttctacctagcatgtctctctgcctctcctgtctgtggctaactactactttcacctggatagctttctctgtaacttttgtgacttttctttcgc

SEQ ID NO: 194452 - DNA, 601 bp, Human
ccctcccatggagcagggaatatatctgaacatgtgtgctttgtttaccctgctgtgtaacacctagtatcatagctggcatgcagtagatgctcagtaaacatttgatgaacaaatgaatgagatgatgctaagaaaggatagcgttttaacacatgcaaagatgttcaatttatatcaaataaatctcattttgatcaaaaagaggaagggagtggagcatttgtcctcagaaaatactacaagtttccagaagtggcaatatgggtctatgggttaattttgtttcttttcttttttkggggggcggggcggggctggtctgaattaattttctatttgttttcccaggaacaggttgaaatatctgaaagcagtgattagaatcctggatggtgcatgctctgagagcgggctgggctctgtgctgtgggattatgggaagcaagagacaagcaccacttggagagactcagttaaactggaattttagataaacagttaacactttaaacaatataagtatatcccaaatatggcacaagaaatacttttatcctacaaattattcattattcaaatgcagatttgactgagtaac

SEQ ID NO: 194453 - DNA, 601 bp, Human
actaacactgacctcatgacccagcaatcccactcctaggtatttaccctacagaaataatgacttattttaagaggagaggaacccaaacccataggcaaatgtctgcagcagctctattcagaatcaccccgaaatggagacacccccaagtgtcctttgacaggggaatggagacgcaagctgtggtctatccaggccatggatcgactccacagtgaaaagaaagaactgttgacaatgacatggatgaatctgaaaggtggccttagggtctgtaaacaaagccagtctcaaattyacatgaagtgcaactgcactcagctagcacatgaattctgggaaaggcaaaactacggggactctaggcaacagatcactggttgccaggtgtaggaggagggggaaggtttgtttacaaagggcttgcactggtgtgatggaactattctgtatcctgactgtggcagtgaatacatgaatctatacatgagtgtgttaaaactcataaaagtatataccaaaaagttttttacagctgggcgtggtggcttgcgcctgtaatcttagcactttgagaggcagaggcggatggtggatc

SEQ ID NO: 194454 - DNA, 601 bp, Human
agtgtagttaatagtaatatttaacaaaaagtgggcaaaatattctagcagacacttcacccaagaagatctacagggagcaaataagcatgaaatatgctcaacctcattacccactatggaaatgcaaattaaaagcacaatgagataccactatgtgcctatcacagtgggaataagacctgatgatgccaagttacggcgatgtatggagcacccggaactcccatccatcacagtgcaaacacttgggcggtgtcttatctagttaaactaacactgacctcatgacccagcaatmccactcctaggtatttaccctacagaaataatgacttattttaagaggagaggaacccaaacccataggcaaatgtctgcagcagctctattcagaatcaccccgaaatggagacacccccaagtgtcctttgacaggggaatggagacgcaagctgtggtctatccaggccatggatcgactccacagtgaaaagaaagaactgttgacaatgacatggatgaatctgaaaggtggccttagggtctgtaaacaaagccagtctcaaatttacatgaagtgcaactgcactcagctagc

SEQ ID NO: 194455 - DNA, 601 bp, Human
aaggaaccatgaggactaagtgtaatcaatgtgttctggggggaatgctggaacagtaaaaggacattgggggaagccagtgaaatctgaataaagtgtggagtgtagttaatagtaatatttaacaaaaagtgggcaaaatattctagcagacacttcacccaagaagatctacagggagcaaataagcatgaaatatgctcaacctcattacccactatggaaatgcaaattaaaagcacaatgagataccactatgtgcctatcacagtgggaataagacctgatgatgccaagttacggcgatgtatggagcacccggaactcccatccatcacagtgcaaacacttgggcggtgtcttatctagttaaactaacactgacctcatgacccagcaatcccactcctaggtatttaccctacagaaataatgacttattttaagaggagaggaacccaaacccataggcaaatgtctgcagcagctctattcagaatcaccccgaaatggagacacccccaagtgtcctttgacaggggaatggagacgcaagctgtggtctatccaggccatggatcgactccacagtgaaaagaaa

SEQ ID NO: 194456 - DNA, 601 bp, Human
cacaccctgtggcggagtgcacacaccgatgtaatctccttaaaaaaaacaggccagcatgaggccctttcatgctattgaaagggcactgactaaacccactgctgtccaaacggtcctgtgggggtgagggcggaggttaaagtttagccattgatcacgtccccaccccacctcatctgacactggggtctgtccagagctcaacttgaatgtccctaatttagctccagtcccaataaataatgccaaaggggtagtagtgactgggcttagatttcagcacacatgcacggggcayagctgtttgcagagacagacagtgtcccggccctcaaggggctgccaatcttcagcagagggtggggtggaaatggcagtcctcaggctagccagtggcacaggccatcctgctcacccacagccaccaacccaagccctgaaatgctctcgaaataaggaaagtctgagaaactgccccagactagaggaggccaaggaaccatgaggactaagtgtaatcaatgtgttctggggggaatgctggaacagtaaaaggacattgggggaagccagtgaaatctgaataaagtgtggagtg

SEQ ID NO: 194457 - DNA, 601 bp, Human
attctcaatcgggagccactgagcccttcaacctctgctggaactccccctggggggacccccgtaccactgggagctgtcgtttctagtgctgggaacccctggctgttggatttcagctggagaaatgcatgaagtggaaagccttgcttcgttcccttaacctctacccatctgtcctggttcaacccaatggcatcactctaatctagttttacctttttaaaacaggaaaacccttgagaggtttccaaaggtgactgatttttcttttttctttctttctttttttttttggccrtgatttaaagaatgaccttctagagccattttagggagagggtgctggtagcatctgtatgtacagatgtacacccgagggcctgtggcacaagtctgccattgtgagtgggtgtggggaacatatgtgtagttgcttgtggataggtttgtggagtgtgcatgcttgtgtggtcaagcgcaggcacacaagtgggatgtgtgtccccgtgggcagttgtgtgtgggtgcagatccgcgtgggtgggtgtggacatgggtggtgtgggcctgtgtggagccgtgcacaggcccatgcata

SEQ ID NO: 194458 - DNA, 601 bp, Human
agcgtgggtccaggccacccgccaggggttggacttctcacatcctccctggagcagctccttgtggacccggaaaggctctatgctgatgcccctcccatgatgagtttgtcccagggctgaggctatggggtccaagacaacgtagtcccaatctgcagcttcccagtcttgatctggaagtaaacccctgactacttagagccatcaatcaagtagtgaacctacatcactgagagcaatgcctgctccacggagggtgttgtgcacgcagtgtggccatcatggtatccagtgctcytcaaacaatcctaggtcagcattattgccatagactgcttttgatgaagtgggaagcattcagttcaaggttgtattctcaatcgggagccactgagcccttcaacctctgctggaactccccctggggggacccccgtaccactgggagctgtcgtttctagtgctgggaacccctggctgttggatttcagctggagaaatgcatgaagtggaaagccttgcttcgttcccttaacctctacccatctgtcctggttcaacccaatggcatcactctaatctagttttacctttttaa

SEQ ID NO: 194459 - DNA, 601 bp, Human
tgggcaagccttcttcagagccttggggcacctcgtgctggcataaggctgagcagcaacagcgcccagcgtgggtccaggccacccgccaggggttggacttctcacatcctccctggagcagctccttgtggacccggaaaggctctatgctgatgcccctcccatgatgagtttgtcccagggctgaggctatggggtccaagacaacgtagtcccaatctgcagcttcccagtcttgatctggaagtaaacccctgactacttagagccatcaatcaagtagtgaacctacatcacygagagcaatgcctgctccacggagggtgttgtgcacgcagtgtggccatcatggtatccagtgctcttcaaacaatcctaggtcagcattattgccatagactgcttttgatgaagtgggaagcattcagttcaaggttgtattctcaatcgggagccactgagcccttcaacctctgctggaactccccctggggggacccccgtaccactgggagctgtcgtttctagtgctgggaacccctggctgttggatttcagctggagaaatgcatgaagtggaaagccttgcttcgttccc

SEQ ID NO: 194460 - DNA, 601 bp, Human
caggatctgccaggaactggctccacacccaccctgccaccacactggggtagagaagaccgccagggagctctcagtttgcctggatgctgggcaagccttcttcagagccttggggcacctcgtgctggcataaggctgagcagcaacagcgcccagcgtgggtccaggccacccgccaggggttggacttctcacatcctccctggagcagctccttgtggacccggaaaggctctatgctgatgcccctcccatgatgagtttgtcccagggctgaggctatggggtccaagacaaygtagtcccaatctgcagcttcccagtcttgatctggaagtaaacccctgactacttagagccatcaatcaagtagtgaacctacatcactgagagcaatgcctgctccacggagggtgttgtgcacgcagtgtggccatcatggtatccagtgctcttcaaacaatcctaggtcagcattattgccatagactgcttttgatgaagtgggaagcattcagttcaaggttgtattctcaatcgggagccactgagcccttcaacctctgctggaactccccctggggggacccccgtacca

SEQ ID NO: 194461 - DNA, 601 bp, Human
cctgtggcattctcgcctccctctccaaggcatcaaggaaagggcatagaggtgagtgcccagagtaggcctgaaagcagcttcaggaggctgctcctgagggccactggcagtgcagacgccatgggggtgcacgaccggcccagcggcatcacgcatgacacctgtgtgagcccaggcacatgcagacagccatggcttcagtgacaacattctgcaaactgcagctggcagctgggccaagagctttcagcaaagatatttatcttcctggcagacaaatacattttatgttttaggttttttttttttttttttagaaaccccacccagcctcacaaaaataaccatccctgttttgcaacttcctggaagccagatgaggggctgagggaggtgagcactgagccctgagctctgatccccaggccccatctcacagccccatagacgcttgctggggattgggaccaccctgcacagcaatgggagctccatgttacaggaactgagagttggtatggaccagcctgaactcctagttttaactggggggaaactgaggccagagagagaaggaaacatgccccaattccggaca

SEQ ID NO: 194462 - DNA, 601 bp, Human
agcagccatgtctggcccagtggggcttggggtgaggaggacccagcattgaggcagacaggagtgcccctcctttcctggcctagtcccaccaggagttcagcaggagctgtggagactctgccccaagagtccagtgctgaggagtcaacacctccttccctgccccccaaccctgcacactggtctcacctattgttcaagagaagggtctttcttccttgggggtgcatgggattgaggcatgggccacatttcctgttacaagcagctcctgcccactgtttactgaggctgcccrggcaccttcatccccagcacgctgaccccgggcctgggtgggtgtacatgagcacagctcccagccactgcgtctggcagatggaccccccacccaccggcacattcctagctcaggactgcaaggacgagtcaacccatacacatcaagaaagaagaggtggaggctggggtgggagagtgaggcaagaagccactttaccaccacacagcctggtgagcttcctaggcagacacactcacctcctggcagagggtttgggacaacagtccctacctttttggcaccagggactggttt

SEQ ID NO: 194463 - DNA, 601 bp, Human
aactctggctcacccagggagctctctttagctgagggaggaggaaacaaagtcagaaaccaatggttgaaccaagcaagagaaggggaatgtcagggggagagtggggcactcgggtagccaccccctgcctttttcctcttagagctcattggatgcgaggtcaggagacttggcttctaattctggcttgccattaacttgctgtgtgaccttgggcaaatctcttccccaatctgagcctcttcaccatcatcttagactaggtcccttccagcaacaatgttatgtgaacctaagrcagccaatctgacctctgtgacctttaatccccacctcactgaccctgagctcctctctctagagggattccctgcatcaggacttttctggggcccgagaattctgaccccagtgccatggcctccctgggtggaagggaaactcattcagcagccatgtctggcccagtggggcttggggtgaggaggacccagcattgaggcagacaggagtgcccctcctttcctggcctagtcccaccaggagttcagcaggagctgtggagactctgccccaagagtccagtgctgaggagtca

SEQ ID NO: 194464 - DNA, 601 bp, Human; identical to SEQ ID NO: 40547

SEQ ID NO: 194465 - DNA, 601 bp, Human; identical to SEQ ID NO: 40548

SEQ ID NO: 194466 - DNA, 601 bp, Human; identical to SEQ ID NO: 40549

SEQ ID NO: 194467 - DNA, 601 bp, Human; identical to SEQ ID NO: 40550

SEQ ID NO: 194468 - DNA, 601 bp, Human; identical to SEQ ID NO: 40551

SEQ ID NO: 194469 - DNA, 601 bp, Human; identical to SEQ ID NO: 40552

SEQ ID NO: 194470 - DNA, 601 bp, Human; identical to SEQ ID NO: 40553

SEQ ID NO: 194471 - DNA, 601 bp, Human; identical to SEQ ID NO: 40554

SEQ ID NO: 194472 - DNA, 601 bp, Human; identical to SEQ ID NO: 40555

SEQ ID NO: 194473 - DNA, 601 bp, Human; identical to SEQ ID NO: 40556

SEQ ID NO: 194474 - DNA, 601 bp, Human; identical to SEQ ID NO: 40557

SEQ ID NO: 194475 - DNA, 601 bp, Human; identical to SEQ ID NO: 40558

SEQ ID NO: 194476 - DNA, 601 bp, Human; identical to SEQ ID NO: 40559

SEQ ID NO: 194477 - DNA, 601 bp, Human; identical to SEQ ID NO: 40560

SEQ ID NO: 194478 - DNA, 601 bp, Human; identical to SEQ ID NO: 40561

SEQ ID NO: 194479 - DNA, 601 bp, Human; identical to SEQ ID NO: 40562

SEQ ID NO: 194480 - DNA, 601 bp, Human; identical to SEQ ID NO: 40563

SEQ ID NO: 194481 - DNA, 601 bp, Human; identical to SEQ ID NO: 26257

SEQ ID NO: 194482 - DNA, 601 bp, Human; identical to SEQ ID NO: 26258

SEQ ID NO: 194483 - DNA, 601 bp, Human
attcctgagctcaagcgatccttctgcctcagcctcccagagtgctgggattacaggcatgagccacacgcgcctggcctcagcctccttagaggagtcgttctgcagctgcacgtgctgctgctgtctttccttgtctcttgatctgagccctggtctggattctcagggaggtgccctcctgcccgccctgggcctcacctcacttctccgtggagcctgtaggtggtggggcagggccactcccagggagctggcctcagtgtgggctgcctgtattgggcagggatgggaggtgaarggccctggaaagtggtgaaaatgttctttggaatcaggagattcctcatctctttgagtacatatttaaaactgtgttttctccactgctgtggtgtagtgaaggttgacactggtgtttatgtggttctttgtggattacagggcaccttcacctgctttctccttgaaattcaaagtgacctggacagtggggagtatgatgccattttagataattggcagtggtgcttatggtcctcagcggacctgagagacagataatgctgtcgtccccatcccaccagtgaatggactcctc

SEQ ID NO: 194484 - DNA, 601 bp, Human
gtccagcgcgctctgaggcccaggcctgggcaggggcccctgctgacggtgtccttggcttaggcactcgcccttagccctagaacaatcttcagcattccctctacacagttattactagttctatgaatgttaaacgttccctttgaaattactggcaccagcctttcttaatctgtatgcaaaataagctgactattagaagaaatataatactgcatctagtcacaagttggtctctaaggccaatagttctgtgtcctaactgccaccagattctccattgttgtcctttgccaaygcttttgtcactgccgcctccatcctgctgtctgcaggctcagcccgggtttccgccctcagtggccacttgctcctgtgaaagcctggggaccagcgagccagaccccttgttgctcggcatttctacgtctccttggtgagatggaaagctctaaccccctgcacaccgagccacgtggtgaccttgtgccagctcatccttgtcagcttctccctcctctggggaggagcaaggaaggggagctgagttacttgtagactcgctgagggtctgaaattcttgaagtgggtgagatga

SEQ ID NO: 194485 - DNA, 601 bp, Human
gaccacagcacttgaggactgctgcccgcagaaggttggatttgcaggagtgagttccttctcaactgttgcttactgagataagaccattaacagagaatggagaaataccttatgggtgtactggagtacccgagagctacatctgagtgagatagtggtacctgcatcacctgaagtacatctgaaaatcgcgctcataaaaaaggcaaaatacagaagcctcaagcccgtgagcagcgcagtctgctgtccagggtggcgcgtgcccctcggtgggaggacaagccaggggcgagcrggaggacgagcaagcaccaggctggggggcctctcccgggaggggtgccgtggcgcctcgctcgtgttggtgcagttttatttcttgcggtgcagtgtgttggtgggtgctcatcatctcattctccaccatttgttcatgacgacatacccaaaggtacaatcacagacacaatgcgaacagcactgtaagagtcagagccttagatgctgctgctgcctctgccccgctccgcgcggggagctgcagttcagagttcgcttcctttcatggacttactctgtttgcacagcctcttgg

SEQ ID NO: 194486 - DNA, 601 bp, Human
ggcgagcgggaggacgagcaagcaccaggctggggggcctctcccgggaggggtgccgtggcgcctcgctcgtgttggtgcagttttatttcttgcggtgcagtgtgttggtgggtgctcatcatctcattctccaccatttgttcatgacgacatacccaaaggtacaatcacagacacaatgcgaacagcactgtaagagtcagagccttagatgctgctgctgcctctgccccgctccgcgcggggagctgcagttcagagttcgcttcctttcatggacttactctgtttgcacagsctcttggatattctcttccttttccttccctttattgaaaatacatgtgacatactgctgtgagttacttttttctaaaacaaatttctcatgtacatagttatatatcaattttaaaaactcttcttcattgtagtggccacgtggtattatgtcatatgcctgtgccatttcttactgaatcagtccccagttgatggcaaccttagactgtttctatatttaataataagctggattgcagtaaaaattcttaaagttctatctttgtatatatgtgagttttcttttgggtaggtt

SEQ ID NO: 194487 - DNA, 601 bp, Human
cgagcgggaggacgagcaagcaccaggctggggggcctctcccgggaggggtgccgtggcgcctcgctcgtgttggtgcagttttatttcttgcggtgcagtgtgttggtgggtgctcatcatctcattctccaccatttgttcatgacgacatacccaaaggtacaatcacagacacaatgcgaacagcactgtaagagtcagagccttagatgctgctgctgcctctgccccgctccgcgcggggagctgcagttcagagttcgcttcctttcatggacttactctgtttgcacagccycttggatattctcttccttttccttccctttattgaaaatacatgtgacatactgctgtgagttacttttttctaaaacaaatttctcatgtacatagttatatatcaattttaaaaactcttcttcattgtagtggccacgtggtattatgtcatatgcctgtgccatttcttactgaatcagtccccagttgatggcaaccttagactgtttctatatttaataataagctggattgcagtaaaaattcttaaagttctatctttgtatatatgtgagttttcttttgggtaggttcc

SEQ ID NO: 194488 - DNA, 601 bp, Human
gagaatggagacttggaaaggtgaggggtgggaggaggggtgagtgatgagacacttctgaatgggtgcaacgtatgttgcacagactgtgcatagactgcacagacttcagcactgtgcagtctatgcatgtatagtaacaaaattgcacttgtactccatacgtttaaacaaatacattttcatcgtatctaagaaaactagagagtgggtctgtgaagagccagtttagctccctcaacatgcgatgccctgtgctacctcaggactctgtagagtccccgccagcacgtaggccctyaccaggtgcagtcccttgacctccaggacggtgatgaatacatttctctttttaaaaaataaatgacctagtctcaggtattcagttatagcaacaggaaatggactacgactatatatacatacacacagtagggatagagagatacaggtatagatatagtagttttgcagttaggtagtaatgcagatggtagtgagatttctcttactctagggttctacgcaaagtcagccggagctgtgttgggagtgttggtttataattttctcctgtaaacttagaaaacttttgacctgg

SEQ ID NO: 194489 - DNA, 601 bp, Human
gttttcgaattgttactataagtggcagattgttctgacagctcaagaagaagatcaggcagatgcgggtcactgatgtgttgggtgactggcacattgagtcttggctctgggatattactgcattcttcctgtgaatccactttttctaggttctccctccctgctttcttgccttatgttttgttttgttttgatttcaagcctggttggtttatttccttagtccacacccacctcctttaccggtgaagaaattatgtgctttgtttctgtcgttaaaggttctagtcctagtcarttgcttgggacatcataggccctaagatattttggaataatttaaattaatatctctacttaaatgtcttttcatgtgtaatattcatctttttctttcttgaataggacacccagtctttgtgcacatttttctccttcctttcacaaaacgtgctttgctatgacccagaaacctttctttggttccttacacgttactctgtaaccattgctgtaagtttgtctagttttatgtttgaaatggaattttgttgattctaaaatagttttgcttttgggcttggaattcttcctgccg

SEQ ID NO: 194490 - DNA, 601 bp, Human
caccctctatgacaccgacagggtctccgcatcaccttcctgctcacagctgcatccctgtcaggctctgtccccaggggcgctccccggagctggcaaggcaggagtgtcaccatagcaacgtttcaccctcacaggggcagttccttcccctctcagtttgcagtttgcccagctcattgcgccaaccttctggcccctcagaaacaatggatgggctgggtgccatggctcacacctgtaatccgagcatattgggaggccaggaattggaggttacagtgaactatgatcgtacccctgcgctccagcctgggagatagaatgagactcccaactctaaaaattcgaaaaaaactgggccgggcgtggtggctcatacctgtaatcccagcactttgggaggccaaggcaggccgatcatttgaggtcaggagttcgagaccagcctggccaacatagtgaaaccccgtctctactaaaaatacaaaaaaattatccgggcatggtggtgcgtgcctgtagtccccgctacttgggagactgaggcaggagaattgcttgaatctgggaggtggaggttgcagtgagcccagatcgc

SEQ ID NO: 194491 - DNA, 601 bp, Human
actgggccgggcgtggtggctcatacctgtaatcccagcactttgggaggccaaggcaggccgatcatttgaggtcaggagttcgagaccagcctggccaacatagtgaaaccccgtctctactaaaaatacaaaaaaattatccgggcatggtggtgcgtgcctgtagtccccgctacttgggagactgaggcaggagaattgcttgaatctgggaggtggaggttgcagtgagcccagatcgcaccactggactccagcctgggtgacagagtgaaacgctgtctcaacaaacaagcargcaaacaaacaaacaaacaaaacccaagggctggagccccatgtcctgtccctcggtggtctgggccccagctccaccggctgttttcctgtgagctgccaagttggagtaattccttctgcttccctgcattttcccagccctggggtggcagcggcttcccgaggttgctactccatggcatctcagagtccctctgcctttccatccctcaataccaagctaccccttctctacatagtactctctgttagaactacgggtggtttctgtctcctgagtgaaccctgaagaatatag

SEQ ID NO: 194492 - DNA, 601 bp, Human
gaaaaagaaaaattaaaaaatgagcaaaggacttgaatagacgtttctccaaagaagatacacaagtagtcaatgggcacgtggaaagatgcccaacatcatcaattattaggccagcgccaactaaacacacagtgagtcagcaccttacactccttgggatggctactataaaacaactgccaccaccatcacaagagagaaaaatgacccgtgttgggcaggatgcggaggagttggagtcctggcgcactgctgggaatgccaagtgccgcacccaccatgggaaacagtgtggtgkctcctcaaaaaaccaacagtacaatgaccacatggcccacagtcctacttctacgtatatacccaaagaattgaaatcaaggtcttgaggagatgctctttatacacatgttcatagcagtattatttgcaatagctgaaaggcagaagccacccagatgtccatcatcaggtgacggataaacacagtgtggtccatccataccgcggaatattattcagccttgaagaggaaggctacaacatggatgacccttgaggacaccatgctcagcaaaatcagccagtcacagaaggacac

SEQ ID NO: 194493 - DNA, 601 bp, Human
agcaattcattgttggcactgagagtggccaagaaatttggtacctgagcaggggttaaggttctacccttcccctcccctcatttctagcggttttactttggagggaacccgatgcttttctgggcctgtgtgtggtagtaatgccggttgaccggccgtcccttgggaccctgtagccaggcaggttgattggcctgaggcccttggttctccctgaagccggctggctcaggctggctcactgcatcctggatgcctgggggccagggtgaccggcctctgtggttggcgggcgggyggtgtctgctccactcagtgcccttgagtgctgggtgtggtggccgaaggctgggaggtggagatggtgccctgggggccacctgtcttctcagacagtcgtgaggagtcttctcaacttaaaagctggagtttgaaccaagtggtcttttaggccatttttattgttgttttccctgtttagtactctttggggaagagtcaagattatgtcacaccagcaggggtgctaaatcggcggtgatgatctgaatttattaatttacaaaactttgtcaatttgagaaacacgagtaaacgc

SEQ ID NO: 194494 - DNA, 601 bp, Human
ccaggtgtggtggctcacacctgtaatctcagcactttgggatgctgaggtaagtgattgcttgagcccaggagtttcagctcagcctgggcaacatagcaagacccagtctctacaaaaaatacaaacattagccgggcctgttggcacatgcctgtggtcccagctactcaggaggctgaggtgggaggatcacttgagcctgggaggtcgcggctgctgtgagccatgatcatacctctccctccggcctgggcgacagagtgagatcctgtctcaaaagaaaaaaaaaattaaactstcttatcactgtccatctaaataacagagagaggctctctgaaagaaatgatgtttatctgggagcagggcattggagtaggcagatacttgccatggtctacagtgcatagctggggaggccaaagaagacaaaggcttttaaaggaaaaatgaggatcacatgattgttttgagataattatccttgccacaaggatcagcaccaaggatgataccaggctggaggtgggcgggcggttgctgggcagatgtcctcacagtgtgttttgagtgaggctgtgatggcctgtgtgcatgg

SEQ ID NO: 194495 - DNA, 601 bp, Human
ccgtcatcctgttctgtgtttacagaggtggaggctttgtcagaggcacacagttggcagagcaaatacttgacgatcctgggatgactgtttttttttcaattttgcatgtttttcttgtataaaatatacctaagatttaccctgggatgacttttaaatctctctttttaaaaagtctttgttccacagtattccttgattttctgctatgccatgcattggacaagactaaacatctctttgcaaaagaataacctgatgccttttttcttcgtgtttagggctcaaaatttgggcrgggaactggactcactcagccttctcaacgcacgtctgctcggagatcatttgggagatccaagagattcagtatcactcgctcccttgatgatcttgaggtaatttaattttcatttttcttcttttctccttcaagttttaaaaaatgcaagtccaccttgcagatacgtctggctgttttttgagtccctgtggtcccctcccctcctcctctgtagtggtaacccctgttttctgggggacagcgtcccatgcacatttgggaacctttctaccctgcaatgtgtctgagctgtca

SEQ ID NO: 194496 - DNA, 601 bp, Human
atgccatgcattggacaagactaaacatctctttgcaaaagaataacctgatgccttttttcttcgtgtttagggctcaaaatttgggcggggaactggactcactcagccttctcaacgcacgtctgctcggagatcatttgggagatccaagagattcagtatcactcgctcccttgatgatcttgaggtaatttaattttcatttttcttcttttctccttcaagttttaaaaaatgcaagtccaccttgcagatacgtctggctgttttttgagtccctgtggtcccctcccctccycctctgtagtggtaacccctgttttctgggggacagcgtcccatgcacatttgggaacctttctaccctgcaatgtgtctgagctgtcacagggctttctggggtgctcttctgtgtgccagactccagtgaacacttctagaaatgagctggtttaatccccacaaatactctacgaggtagggcctgtcattgcccccttaaagacggggcgtgatccacagacatgggtaagtgtcattttgtgtggctcgtctatctgtgtttcttttgtaaagaacaatgaaaagattttatttt

SEQ ID NO: 194497 - DNA, 601 bp, Human
acatctctttgcaaaagaataacctgatgccttttttcttcgtgtttagggctcaaaatttgggcggggaactggactcactcagccttctcaacgcacgtctgctcggagatcatttgggagatccaagagattcagtatcactcgctcccttgatgatcttgaggtaatttaattttcatttttcttcttttctccttcaagttttaaaaaatgcaagtccaccttgcagatacgtctggctgttttttgagtccctgtggtcccctcccctcctcctctgtagtggtaacccctgttwtctgggggacagcgtcccatgcacatttgggaacctttctaccctgcaatgtgtctgagctgtcacagggctttctggggtgctcttctgtgtgccagactccagtgaacacttctagaaatgagctggtttaatccccacaaatactctacgaggtagggcctgtcattgcccccttaaagacggggcgtgatccacagacatgggtaagtgtcattttgtgtggctcgtctatctgtgtttcttttgtaaagaacaatgaaaagattttattttttatagcagttttaggtttacaga

SEQ ID NO: 194498 - DNA, 601 bp, Human
ctgccccttccctgctgggtgtaaacttctatctcatggtggattgctgctgggtgtgccccatgccagggtcagtgccatgctcctgatagacagctccagcgtctaatcactgggtgtccccagtggatgctccatctccaccagggccctgctgctttccacatggcttgtggtccctgctgtctttgccccacaccttaaacttcctggctgtaaatctcttactggggccaaggaggatggcccaggtggcagggctgcctgtccttttctgtgtgggccctgctcgctgctggcygccttccatgactccttggagagggatctgagcagccttcccaagtgaggggtggtttgcctcttgagcccatcgtcctgaataacacggaggaaggctctctgtaagaaaacgatatttattaatatttgggaataggcattgcaatgagaatatgcatgctgtagtaaactatgaatattcagggaggtcaagaaagacagcagtttttcaaggaaaaatgaggaggatcacaggattgttttgagataattatcttacaaggatgggaccagtccaaggttggacaggcagttgcgg

SEQ ID NO: 194499 - DNA, 601 bp, Human
gatgtaacatacaatatgtataaacatacataaaagcaaatacagacacaaataaagatcttatggctttcattttagaattttggtcatgaaacagaaaaacatagtaatacaaattcactggtttataaaatatagttggatcaaattatatttttgacaaaacggaacttttatctgtggctaagttctgtttaccctgataagtaattaatgaaggctgtggaccagaattatggataaagcagttttcatagcagtttgacttttaaaaaccttttaatccttttttcagattcarttgaatttagggttgaatattcaaatgtttacattttagctaggcctggctaaattgtattaaaaaaaaacaacaaaattttcaggttgccttgaattagtaacaaatctttttgtttgtttgctttttctggctcttaagtgtcagacaaaataatttttatgtcagacagagataccttttagtattgctctgagcttaaggttttaacctgtttgatctgacagcccttagcttatataaacatttataaagttttttttttagaatatcgatttttcaattagctttttcatcacc

SEQ ID NO: 194500 - DNA, 601 bp, Human
cgtacagtatttgtctttttgtaactggcttatttcacttggcataatgttctggggtcatccatgttgtagcttgtgtcagaatgtccttcctttttaaggctgaatgatattctactgtatggatatactcacattttgcttatctgttcacctgttgatagacacttgtgttgcttccgtgttttagctattgtgaataacactgctatgaatatgggtgtataaatacctgttcgagttcctgcttcccattcttttgggcatatcccaaaagtggaatttctgtatcatacggtartcctatttttaatttttgaggaaccaccgtactgttttccatagtggctgcaccactggatattcctaatgacagtgcacaaggtttccagcttctccttgacaacagcactttctgttttttgatagtagtcatcctagtgagtgtgaagtggtatctcatttttttgatttgtatttccctaatgtttagtgatgttgagcatcttttcatgtgctttttggctatttgcatattttctttggagaaatgtctactcaagtcctttgcccattttttaattggattgtttgtttttgt

SEQ ID NO: 194501 - DNA, 601 bp, Human
gagtctccctgggctgcagttccgtctgctgttttcatgctacagcggcagagtggggtcgagtgcgtggtgtcgcctgcacagcgggcagtgcctactcttggccctttacagggagtctggagggaggagggagacaggtgagaggagggagggaggacaggtcttgagggagggaggagggagggaggtggcaggagcttttgcgtctgtccccagtgagttgccttgattccatcttgaggcctgtactgtgatcttgcccatccagagctgtaaatcccagcaaaaaccgacggasccctgagtccgacctaagccttggtgtgagtcggacacggccttcttggctgttgggttgataatgttggcttcttcctggcctcccactcacctctgggacgacgtgccgcacgtcacattgtgtaggaatgagatcctcacaggcctttcagaataagctccttttaccctgtctcttaggtttgcgactttgctattttcagaatttaacttagaaatctttgcttgtcttggtctttcacacaccagtctgctttttaaacccattatatgggaaattttctgaactgtccttaag

SEQ ID NO: 194502 - DNA, 601 bp, Human
gcggggtcaggggtggagggcaggaggatgggagagcccagctgggggagatttgagggccctgcccatagaggagccacacctgggcctttggcttggcgaccagaggcctccagggttaagagcagggagagaatcagggcctgtgctcatatctgtgagctctgcagatgtctcccgggcacagtcagcagaggcgctcctccagttcccgcctctctgcctcgcacgccctcctagctgagagtgaggtggtccggccccatgaaggaggcagcagggcttgcggccgggatccacyagggccgtcccggttcctgggtgttccgcgctcgtctcctttctgctgttgagaaaccttcaggagagagtgcttctgttccctccaggtcgagctgtgcgccaggcatggccggaaagctcaggaggccctggttaggctggggcatcacgggatgtgtcctctagcagagactggtgtgggtgggcgcaggaactggtgagagaggcctgggagacaggtgagcctgtaaggaggcccagagtcaaggaggagctctttggcaggtcctgaagaccctgggtcacccacaggcccctt

SEQ ID NO: 194503 - DNA, 601 bp, Human
gaccagaggcctccagggttaagagcagggagagaatcagggcctgtgctcatatctgtgagctctgcagatgtctcccgggcacagtcagcagaggcgctcctccagttcccgcctctctgcctcgcacgccctcctagctgagagtgaggtggtccggccccatgaaggaggcagcagggcttgcggccgggatccaccagggccgtcccggttcctgggtgttccgcgctcgtctcctttctgctgttgagaaaccttcaggagagagtgcttctgttccctccaggtcgagctgtgygccaggcatggccggaaagctcaggaggccctggttaggctggggcatcacgggatgtgtcctctagcagagactggtgtgggtgggcgcaggaactggtgagagaggcctgggagacaggtgagcctgtaaggaggcccagagtcaaggaggagctctttggcaggtcctgaagaccctgggtcacccacaggcccctttgccttcactggaactttccagttagccaggcctctcctggccccaggacatagcccacgtgggtcctcacctctgcccggctcagctcctccccgccca

SEQ ID NO: 194504 - DNA, 601 bp, Human
ttgcggtgctttcttcctgtgcccagactggccatgcatgtgttggtgaagggctgtgctgggcttcccgggcccggggtctgaacccgactcccaccaggcactgagtaaacacatccatccaaacaagggaggtggagcacgaagcaggggcaatgggctggggcccagaatcttctggggatgtggctgtcagcagctcctggacctctgaccatgtggcagggggctcatccccgtctccccagggcacttgctgctggggccctcaggcggtcacaggagttctcccaggcgtgtkctggccctgccccatccctttcctcacccatctgcagaggggagttactggctaggcaggggaggtcagcagctgcaggaaaggacaggctcccacaaaagaggagatggggggagcctagagagagacaggagaacccggaggccctgttgttggaggccctgttgttagtgaccggacagcaacaggcggacccctagcagcctgggctgctttgtgggctctgcgaataaaccacgtagacaatgtgaaattgtgtttcttcctttccgtcctcgatggaacacaatgggatgaaga

SEQ ID NO: 194505 - DNA, 601 bp, Human
agctaggggtttgactttagtcctcagctgtcagaggccgcctcgggtgcatccacgctggcccccccaggtgtgccctgtgtggccggcatggaggtggcggcggccatcagggtgtggttttgtgacgtctcagggtgtcctttctttccttcatgagaagaagttctgcagtgtcagacacttggcagaaactttgtttctcaaggcaaagccctttagagacttgggagcacatgaggtgcggtgtagatttgtcttcatttctctcagcacggggttgtcttcaggctgccagagygtgacagaaagaactttctagagaccacagggcttctctccccttcaggcattgacgttctgtttaatattttaaaaatctttaaaaagggttgcactgtttaaaaacgtggaatattctcttgtaggcagtgtggaggccatggtcgctgaggaagggcaggagggaggaggcgtgggagctggtgcagtctgcggcccggcgtggctgcggtcacacagaggatgcggtgagacctggcagcgaggctcgaggcagacagacgctcatgcagggcagagggcaggacccgtgttggag

SEQ ID NO: 194506 - DNA, 601 bp, Human
gctgtatcggtcagcttacctttcgccccagacctctgttgccctgagcctggtgcaggagggcctggagtctgtgccggcgagcatcagcgcgtcccacttcagatgctggttgcagattcttctctcgttttctgacactctgagtctcgtcatctatataaggaaagatccaagtatatttgagaaaaactgttttaatacatttctattttcacctcttcccccttcttttcattaagaaattggacaccttgtgctgtaagctgtccgtccatgttacatagtcagaggtgtatcyttctcgggccaaaaacccccagccctttcccctgggtcctgaggaggaaggcagcgagcccgcttggcgaggcccttgagcactcagcaccttctcctaccatgtcccacgcggctctgtgaacgcaggcatccctgtctccgttgggcggatgtggaggctggttgaggttccttgcaacgcttgccatcctacgcatgatgcagggaccccggccctccgcagacagcaggagctgccgagctccgagtgctgggccagcttgccttgggcttctgcagcagcgccctccgggttccc

SEQ ID NO: 194507 - DNA, 601 bp, Human
agcctggtgcaggagggcctggagtctgtgccggcgagcatcagcgcgtcccacttcagatgctggttgcagattcttctctcgttttctgacactctgagtctcgtcatctatataaggaaagatccaagtatatttgagaaaaactgttttaatacatttctattttcacctcttcccccttcttttcattaagaaattggacaccttgtgctgtaagctgtccgtccatgttacatagtcagaggtgtatctttctcgggccaaaaacccccagccctttcccctgggtcctgaggargaaggcagcgagcccgcttggcgaggcccttgagcactcagcaccttctcctaccatgtcccacgcggctctgtgaacgcaggcatccctgtctccgttgggcggatgtggaggctggttgaggttccttgcaacgcttgccatcctacgcatgatgcagggaccccggccctccgcagacagcaggagctgccgagctccgagtgctgggccagcttgccttgggcttctgcagcagcgccctccgggttcccctcctctcctccgactccactggcttttcaccactgtcaggtcttc

SEQ ID NO: 194508 - DNA, 601 bp, Human
aggcaaaagataacaagtgtgggtgaggataggagaagagggaacccttgcactgttggtgggaatgtaaattgtacagccattgtggaaaacagcatggaggttccttgaaaaattaaatatggaactaccatatgatccactactgggtatatctccagaggaaataaaatcagtctctcatagttgtgctcccatgttcatggaagtgttaatcacaatagctaagatatgaaaacctaagggataaaggaaatgtgcgatgtgtgtgtgtgtgtgtgtgtgtgtgtgtgtgtgtgtttttagagagagaatgagaatagcatattctgccttaaaggaactcctgccatttgcaacaacatggatgaagccaaacatgtgtggcttcacttacatgtggactctaaaaacattgaattcatggacgcagagagtagattggtgcttaccagtgcctggcggtagtggtggagagatgttggacacaggatacagacttccaattataagatgaataagttctagagacctgatgtacagcttggtggttgtagttaataatgctgcatttattgtatgcttgaaatttgctaagaga

SEQ ID NO: 194509 - DNA, 601 bp, Human
ttacaatcatggcagaagggaaagcaaacacgtccttcttcacatggtggcagtagagagaagtgctgagcaaaagagggactaaccccttataaaaccgtcagatcttgtgagaactcactatcacaacagcatgagggtaactgttcccatgattcagttacctcccaactgggtgcctcccacaacacgggattattggaactacaagatgagatttcggtggggacacaacaaaaccatatcacctggacatcaaactgctgtcctccaagttttcatactttcagagaaattggtygtgacttttcctgacaagattacttaatttgcaaagagatcatttataattaccatgaatcttactgcttttgtttaatgaatatacctgggagtgagagagctgtgcactgtgtaaactgaggtccagccacctgtatgtgaaggccagaggcttccctgccagcacccagcaccactttgtacaccacaaagttttatttgtcaaaaaatagtcgtaacgtcaccgttcaagggcggttgactgctgttagctttggatattgttcctttgtggctagttacgtcttttcagtattta

SEQ ID NO: 194510 - DNA, 601 bp, Human
cagcttcacagatggttactcaacgctctgcattagattgttcccatgtctgagactctgctcattgttgtctctgctgatacccactcatgctgggcttctccttgggtttttcatagtgaactcatattcgagtgggctcactatctggaactcctgagggcccctgttgggctgttttctttctggaaggatttgcattaatatatgtggcttccaggagtgttgcacctaggacagcactactccccgagggccatggctgagctggatggaggatctcaggttgaggggacaaccktgctgtggctgaggctcactgcgggctacccggccctagtggcattggcattttctaactgcttccccctctgttccttcctcgtctcttttcagggatttccctttactctttttggagtagcggtatattaaaaagcatgtttgggtggggcatggaggctcacacctgtaatcctagcactttgagaggtcaaggtgggaggattgcttgaggccaggaattcaagaccagcctgggcaacagaatgagaccccatctctacaaaaaatacacaaagtagctgagcatgttggtgaa

SEQ ID NO: 194511 - DNA, 601 bp, Human
ggaggattgctcaaacccaggaggattgaggctgcaatgagccatcattatgccactgtactctatcctggtgacagagcgagactgtcaaaaaaaaaaagtatgtgtatctctctactgtctttaaaataattttttccataaatttaaagctgtttgaaaaggtaaagtttacttttaaaacagctctacactttacctgcatccgtgcactgtcttagagcctcccagaggctctggtctagccctacgtgcccgcagcctgtgcccatcacaggagcagcgatggcccatgcccatmttctttggcctctcagtgggcatcacacactccctggccaccttctccttcagtctgtttggcctctgggacactcctctctcctggttctcaagtttcagctaatttgggggatgtaaatgctgcgtgtatagaggttttctagagcactttgttcggcctgccagattctgagaattgaattttactcatgagcgtgacatgaagtgaaacacctccttcatatttatgaagtttacattttatgatttatctttcagatcttattgacagcatttctgattttgtgtatggccttgt

SEQ ID NO: 194512 - DNA, 601 bp, Human
gaggttttctagagcactttgttcggcctgccagattctgagaattgaattttactcatgagcgtgacatgaagtgaaacacctccttcatatttatgaagtttacattttatgatttatctttcagatcttattgacagcatttctgattttgtgtatggccttgtggattttcttctcataatctcaaaggtatagattgcctgtgatattatttatttattttaagacggagtctcactctctcacccaggctggagtgtagtggcacgatctcggctcattgcaacctctacctccygggttcaagcgattctcctgcctcagcctcccgagtagctgggattataggcatctgcttccacgctcggctaatttttatattttagtagagacgaggtctcttcatgttgaccaggctggtctcgaactcctgacctcaggtgatccactcacctcggcttcccaaagtgctgggattacaggtgtgagccactgcgcccagccttcctgtgatattatttagattgcgacatgattgtggatgatttattgcgggcatggaaggaatgacagccttccaaaatgtgtatgtcagcat

SEQ ID NO: 194513 - DNA, 601 bp, Human
tctcactctctcacccaggctggagtgtagtggcacgatctcggctcattgcaacctctacctcccgggttcaagcgattctcctgcctcagcctcccgagtagctgggattataggcatctgcttccacgctcggctaatttttatattttagtagagacgaggtctcttcatgttgaccaggctggtctcgaactcctgacctcaggtgatccactcacctcggcttcccaaagtgctgggattacaggtgtgagccactgcgcccagccttcctgtgatattatttagattgcgacatgattgtggatgatttattgcgggcatggaaggaatgacagccttccaaaatgtgtatgtcagcatctgtgacgtggctgccccagagcctctgataaaaaccagtccctgcggctgagggccaagggccacatggtggcttcaggggtgtgtgctctttccccttcctggccaatgagaggacagtgaagagatggatgcaggctgctgtgtgttttcactactgggaagtgggttggggggcaggaccctccgaagctggccccaggtggtctcacacagtgcctgtcagggggcttac

SEQ ID NO: 194514 - DNA, 601 bp, Human
gggattataggcatctgcttccacgctcggctaatttttatattttagtagagacgaggtctcttcatgttgaccaggctggtctcgaactcctgacctcaggtgatccactcacctcggcttcccaaagtgctgggattacaggtgtgagccactgcgcccagccttcctgtgatattatttagattgcgacatgattgtggatgatttattgcgggcatggaaggaatgacagccttccaaaatgtgtatgtcagcatctgtgacgtggctgccccagagcctctgataaaaaccagtycctgcggctgagggccaagggccacatggtggcttcaggggtgtgtgctctttccccttcctggccaatgagaggacagtgaagagatggatgcaggctgctgtgtgttttcactactgggaagtgggttggggggcaggaccctccgaagctggccccaggtggtctcacacagtgcctgtcagggggcttactttgggtgccagaggacagactctgcgggggaggaggatgcgcatagctggtgtaggtcgcagggccagggctggcagtggaccccggatggccaggctgcgtcgg

SEQ ID NO: 194515 - DNA, 601 bp, Human
gccagaggacagactctgcgggggaggaggatgcgcatagctggtgtaggtcgcagggccagggctggcagtggaccccggatggccaggctgcgtcggggcatggttgcccttgccggcaggctgggaggcagggctggggccctgtgccgaggttggggtggtcagacaggatgtgcagaattccagtgggtgtaccgctcgtgttaaaacccatacagtgtgtgtcccggagggccacacggtaggggcagcagctggaagccctggctccttttccttggtcccctcccccttgggwggttcctctgggcctcacttgtttggactttggcgtgggggggtcttaaagccccagtgacctccacttctcgggagtggccaggaggtaccaggttgcccatcacggcagcaccttctcgttcgctcccctggccctggcagccctcgccttggcagagaggaggacagaagtgggtccttgccaggccgtctgggaggtccccgcaggaaggggttcctgcctagatagcagcagagtgcctgcccagggatcagatcaaacacgggtttgtccagcctctggagctccattctgctc

SEQ ID NO: 194516 - DNA, 601 bp, Human
tcagggctcccgttggggccgccgtggcttcctgttcttttcggcttcctcctggctcagctgactgtctcgagttctcggcctcctcctggtcacgctggccttccggtaccgcctgccacccctccttcataacttgacttgtctgttcttgtccctggtgcctttaagccagccaccctgctctcctccagccccttccactgttccaagccccttcctcggaggcgtctccccaaccctcctgctggtggccgctcttgcactgcttgggtgggcgggcaccagatccggggcttgrctctgggcttgactcctctgctgccaccctgagtggtcattgcgcctctctaggccccgttccactcctgtgggagggcagtgatgctggagagcgtgaggggcggcgagtatggccctgggtggcgtcatggcacacaggcactgagtggactgttggtggctgcccccgagtgtggtcctgggtggcgtcacggcacgtgggcactgagtgggctgttggtggctgcccccagtgtgtgtgtcacttacagggcatgatgctactgaagtttgtgaagttggtttcattgacgctgtt

SEQ ID NO: 194517 - DNA, 601 bp, Human
atatcttgggttacacacgcactggcacctgaagccgagaccagagggatcccgacactcgtgtggtggagatgtattttgtagaataaaaggaattctatttcctattttatgtacaatgaaaatcatgtcatttaatcagtcttaaggtggagggaggataaacttccttaatgaaaagaaacaggacccggaaccaaatccaggataaagtgaccggtgttttgaatgatctgttcatgctttctctttctgccgtgttctcacttctcctttctggcagaagacattcatttcttgyaggcaatttatacatgaaagatttgcctaatatgtttagtttcaccatatataataagttttatttgcctccaaaagattgcttctgtcagcaatagatgcaggaacccagagttgtgttatgtgtccattttacagttgtttaaaaacctgcacctcccaagggtgggaagtctctagctcctcgccgtgctggctctgtgtgtccctctgaggaagtgtgtcctggctcctcgccacgctggctctgtgtgtccctctgaggaagtgtatcctggccacgcggagatcccctggtgct

SEQ ID NO: 194518 - DNA, 601 bp, Human
agacattcatttcttgcaggcaatttatacatgaaagatttgcctaatatgtttagtttcaccatatataataagttttatttgcctccaaaagattgcttctgtcagcaatagatgcaggaacccagagttgtgttatgtgtccattttacagttgtttaaaaacctgcacctcccaagggtgggaagtctctagctcctcgccgtgctggctctgtgtgtccctctgaggaagtgtgtcctggctcctcgccacgctggctctgtgtgtccctctgaggaagtgtatcctggccacgcrgagatcccctggtgctagggctttccaccccctgctcctccttcttttcccagtgtcagaccctggggccactgggacaggcccgtccctccatggagagccccagtcacagaggaggagacgggagggaggaggagacgggagggaggagacagtcatcagcacaccctgaatttcaggaaccgcagtgggcgggctggatgtttatttagttcctttttgtgtttttgttatttttccatcttcagtttctttgcttataagagtaaaaagagccagttatcttgtttaatgtgcaca

SEQ ID NO: 194519 - DNA, 601 bp, Human
gggaggaggagacgggagggaggagacagtcatcagcacaccctgaatttcaggaaccgcagtgggcgggctggatgtttatttagttcctttttgtgtttttgttatttttccatcttcagtttctttgcttataagagtaaaaagagccagttatcttgtttaatgtgcacatgagctctagatcggtgtcacattctgccgttgttagatgtagggcaccgaggcagagtggggagatccagcagctcacagtagtctgcaggtgagatggccagactcaggcctgcaggggaaagcmctggctgagaggcccctccaccctggctcccacccaccccccagccctgggcctccacacgcccagccccatggtcctggagagtcccccgctccagccctggaccctccagcgcctgcagcccctgctgccccttctggtgcctcaggcagaaagaggccccctcccccacaccctgccctccacggcagtgacaggagcctgggcggggtcggggtgggggggtggtcccagggaaactctggctgtgtttccacacagagatctttttataggctgtggtcagtgggagactcagtg

SEQ ID NO: 194520 - DNA, 601 bp, Human
gacctccacgtggcaggtcagagttgtcccggcacccggcacagcggctggcacgagagctgtctgttgagtgaatgatcgggtgttcagcagacatcagccagagcgtcagggcgaggcttgggcggggacagtggctttcagtgattttccttttagtcgtgaaaccttctcaaaaagcacacacaagcacagaagcagaaactcctgtgtgactggtgttgcggggtggacccactgccgccgcctcctcctgggctgctctgcgcgcctgccaggctcttccagtgccttcacccamcacgcgggcctttggagctcagacctggccatggcggaagattcgggctccacctgcagctccacagctgacaggccgatctcttggggcaagtcactttctctctcctagccttgtgtcttcatctcgccggtccttgttagcgaacaggcactgaggcctggggagctgtcacaaacggctgcctgatgggggagggttaccgtaattgccggattaacttgggggactttaaactgcattcctctttaaaatataaagtataattgttgatatttttggcaaatgccaaaatttgta

SEQ ID NO: 194521 - DNA, 601 bp, Human
attgtgggagtggttgttttaaccagaaccctttacttgatttaatatgtcacattcttttggtttgcttttggacttcaaaatgatgctcagaatcacacagtgtatttgtagggtgtggaataccgtattagtatttgtaaacaggagtcagactggagattttcagttttggaagtgtggagacttgatttctgccaggatgccttccgatgtacttgtttctttccaattctacaagatatttggagagtttttattactagtttttaatattgtgaaattattttttcaagcaaasaaattcaaaggtaataaaaccactaactgcatacctatcttccagagttaacgtgtgctagccagggggcctgtgcctgagaattgactcagggctggggtgaccacagaagcccttggtgcccctgcggctgcatcccctccccagaggccacacttggaagcaggcgccaccccttcccactccaagggagtttcttagttagattcttggggaaaagataaaacaaacgaagaactcctctcatgcaaccctaggcgtgagaagcagtgtccgccctgtttggtggtctggaggcca

SEQ ID NO: 194522 - DNA, 601 bp, Human
tgtgtttgggatttgttggggttcaggtatttttttcattgtttcccacttttgagactctaattatgcaagcatgttaggccacctggttttcccttcagctcatggaggccgtttcatgttcaggcttctgtgtcgcctgcatgcttgccatttcattgtttctcttgctctatcctgcagttcactgatctgtcattttagtgtcagatatacagctcattccctcctgtgagggaattcctgccgatcagcctgtcatctcagagactgtgttttcatctttagcagttccttctayttttttcatttctttctactgattctcttcacgctttgctttaaaaccccaaaaatgttggctgggtgcagtggttcatgcctgtaatcccagcactttgggaggctgaggtgggcggatcagctgaggtcaggagttcaagaccaccccggccaacatggtgaaaccccgtgtctaataaaaatataaaaatagctgggcatggtggcagatgcctgtaatcccagctactcgggaggctgaggcaggagaatctcttgaactcaggaggcagaggttgtagtgagctgagatggtgcc

SEQ ID NO: 194523 - DNA, 601 bp, Human
actattctactgtctggcaggaggggaaggcctgtcccaggtgctctcccacggcagatagagttctgtgatataatttttttcaccttacttgtgggatgtggtctgtaaagttcagaacaaaactcaggtcatgacggcaccttgtacaaagagcttcactgatttcccaaaagctgcctcacaacccagaaagagcaggttctcctctccccaggcccgtccctggagcatctgaggccagcaccatgctgggtctatggggaaatggctggaatttggggaggaagctgcccagccyaggttggacttggcctggctggctccctaggtgaagtgcagagaccaagcctctgcccggccctcagagcacctgcgactgacccttcctgccggcatctctctgaacgtggtgcccttccacggcatttcatccgtctgctccttcagcacatcttttttttttttcttttttgagacagagtctcgctctgtcacccaggctagagtacagtggtgcaatcttgactcactacaacctctgcctcttgggttcaagtgattcttgtgcctcagtctctcaagtagctggtattgcaga

SEQ ID NO: 194524 - DNA, 601 bp, Human
agattttcacagaatgaacacatgtgtgttatcagcactcagaccaagagacagaacattaccagcagcccaagcgcccctgcaggccctcagtcaccagctccggaagggacctctcacccgacggctgttgcctgttttcaaacttaaaaaaaaaagaagactgactgggcacagtggttcacatctgtaatcccagcactttgggaggccgagacaggtggattccttgaggccaagagttcaagaccagcctggccaatatggcaaaaccccgtctctaccaaaaatacaaaaaaamaaaacaaaacaaaaaaaaacattagctggatgtggtggcgcatgcctgtaatcccagctactagggtagctgaggcaggagaatctcttgaacctgggaggtgaaggttatagtaggcagaggttgcagtgagcagagtttgcgccactgcactccagcctgggtaacagagtgagagtccatctaaaaaaaaaaaaaaagactcaacgcagcgtatgctgtttagtgtctagcttcctttatttaacataggatggtgcattttgctcctgtgagtctatcaggagctgtttactctcc

SEQ ID NO: 194525 - DNA, 601 bp, Human
agacaggtggattccttgaggccaagagttcaagaccagcctggccaatatggcaaaaccccgtctctaccaaaaatacaaaaaaacaaaacaaaacaaaaaaaaacattagctggatgtggtggcgcatgcctgtaatcccagctactagggtagctgaggcaggagaatctcttgaacctgggaggtgaaggttatagtaggcagaggttgcagtgagcagagtttgcgccactgcactccagcctgggtaacagagtgagagtccatctaaaaaaaaaaaaaaagactcaacgcagcrtatgctgtttagtgtctagcttcctttatttaacataggatggtgcattttgctcctgtgagtctatcaggagctgtttactctcctagctgtggactgtccatggtgcaaatatggcatcgttcctccattcttctcttgatgacatcgtgttggttctgacttttggccgttacagatggtgccatataacatgcttgtacaggtcttttgggtgggcatctgcatacatttctgctctgataggctgggggtttgtatatattcacctatagtaaatactgccaatttccaaatgat

SEQ ID NO: 194526 - DNA, 601 bp, Human
ctttgcccttcccaagaccatgaaagtaaatctgttttgttttatcttcaatatttaaatctctgattcatctggaattggtatttttgtctatggtgtgaggtaggggtaagattcattttttctacatggtattcagttgtcccagctccatgtaatgaaaagacaatccttcccaataacttgaagcaacacctgtatcaggtaatcatatatttgtgggtctgtttctggcctctgtattctgttccattggtctgtttgtctatcattggatcaggacttcatgtcgtaattctcrtccctggcatttggatatctagtgctatagtcttcattttgcttgtctttaagattgccttggttattcctggcccttgcatttccttatatattttggaggcaattttcaagtcactggcagctttccagagtcatcttcacttttgtccaagctggttgagacatagcatttctggaatctgtgttgatgcttttcctggaaatgttatcacaagccacatgcagccattgacatttggacaattggggttttttttttttaattgctgtaattatacatatgtgatcttcaatatgt

SEQ ID NO: 194527 - DNA, 601 bp, Human
cttcccacactgaccttcgcaggagccgctctgctcactcgcatggcctcatgggctctggcagcatttcacccccgcctgttggcatttcactctccagaaggacttggtgtcacttcagacgtagagagtttgttttgctgggctctgccagaatagttataaatcacacgtttctagtactgactccaggaaagacccagaattcagatttctcctgtttgggcccacatttcttctggccctctgaggtaacgggaagtacactatatctcgaggggtccgtgagacctgccaggcrtggcagctcctctgcagggctgtgaggtctggctgtgggggccagactcacggtcagcccagaaagtgctgctggggataccgggacctcaccatggagaatgtggagtctgggcccagcatagtcactgatgtcagcccaggcaggtcatggaatgttttggacctcagcagcttcatctgtaaaatgggctgattgactgagatcgatagcatgtaaacacttttctgaggaggtgctattccagatccctgttttctaaccctcagcaggctctgctgttgtggcaggcttttgttg

SEQ ID NO: 194528 - DNA, 601 bp, Human
tggcatttcactctccagaaggacttggtgtcacttcagacgtagagagtttgttttgctgggctctgccagaatagttataaatcacacgtttctagtactgactccaggaaagacccagaattcagatttctcctgtttgggcccacatttcttctggccctctgaggtaacgggaagtacactatatctcgaggggtccgtgagacctgccaggcatggcagctcctctgcagggctgtgaggtctggctgtgggggccagactcacggtcagcccagaaagtgctgctggggatacygggacctcaccatggagaatgtggagtctgggcccagcatagtcactgatgtcagcccaggcaggtcatggaatgttttggacctcagcagcttcatctgtaaaatgggctgattgactgagatcgatagcatgtaaacacttttctgaggaggtgctattccagatccctgttttctaaccctcagcaggctctgctgttgtggcaggcttttgttgagatgcagagctgggccggcctccgcagcctgtgctgcttaaagcagagggggcctgagcctaccctacctgttcttgcccg

SEQ ID NO: 194529 - DNA, 601 bp, Human
caccagggaaccctagaaacgacagcggacaaatctggtgccccagccacatgatgagagccagcgtcacccaccctgcagtaaactgacaccacgtgcctcctcagaggaggtcccagagggacaccgcatggcttccagggcattccagccagtcacaaagaaacatcagccaagcccaaactgaggggcagtcttaaaaataaccagcctctgtcagggttggaaccacagagaggctggggaacattccagatggaaggagactgcagacacacagcagcagccaccctgagttccwccctgctctggggaaaagagctggaaaggacaggattgacgaagctggaagatggcttgttaaatttcctgattttgatgtcggtacttggttatgagagaatgtccaccttcttaggaaatctacactgacgtgtttaggggcaaagaggcatgctgtctccaacttaatctcagatagtctggaaaaaggttgcgtgtgtgcaggtgtgaacgtgtttagaggaagggagaatgggcggaagggagagggacgggatgatacagcaagcaggaagaatgcggacatttggtgaatctg

SEQ ID NO: 194530 - DNA, 601 bp, Human
gacgtgtttaggggcaaagaggcatgctgtctccaacttaatctcagatagtctggaaaaaggttgcgtgtgtgcaggtgtgaacgtgtttagaggaagggagaatgggcggaagggagagggacgggatgatacagcaagcaggaagaatgcggacatttggtgaatctgggcaaacggatatgggagtcccttttattattcttataatttttctgcaagtttgaaattatttcaaaagaaaaagttgcccccccaaaaaggatggcacacattgtctaggagagggctggtttgggtrtgaacaaaggtttcctgtggcatctcggtgctcgtatgtcccggctcccccataagcacatttagctgcactgatagtgcctacatctgggcttcggccacttgcccatcttcattctcctggccctcacaacagccctgcaagcccctgccagccgcagatggacacggggactgaggcccacgggactgtggggccccgccgaggtgaccggccagaaaggagtgcagaactccggccagggcgggctcagagcctgcacccacgcctcctgcctgggccgccctgtgaatgggggag

SEQ ID NO: 194531 - DNA, 601 bp, Human
gcatctcggtgctcgtatgtcccggctcccccataagcacatttagctgcactgatagtgcctacatctgggcttcggccacttgcccatcttcattctcctggccctcacaacagccctgcaagcccctgccagccgcagatggacacggggactgaggcccacgggactgtggggccccgccgaggtgaccggccagaaaggagtgcagaactccggccagggcgggctcagagcctgcacccacgcctcctgcctgggccgccctgtgaatgggggagaagggcttcctgtgcctcataaactggaggccaagaagcacatgatggacgggtgggccgaatgaggccaagctctgccttctacagcctttccaggacttttttcttggaaaatgtggagcttgattggatgcctttgtagtggagcttccatcaagttagagctgcttgtgtggcagtgtccatccgggagtcagtagatggggtcaacaaacagcgccttcagccaaaccctgccaccaaccagctttgtgtaatgaagtgtcagtgggatggccatgcccattcctgcagttgctgtcgggggccgcttctgtcct

SEQ ID NO: 194532 - DNA, 601 bp, Human
tggtccagtttggtatagttgcttatttcctaactaaatacatattcctgataacacgctgtttgagtgatcacctgcttataaaaagataggttttatatttatgggactaaaaattttttaatttaagttacatgtggaaagaagagttaaaaactatacaaaaagcctacaagtacttttttttcctttgccactgcttgtttaataaagcacaaattgctgaagtggagtagcgtgttgggaggccggggttccatctgcagtgtttatgccacgtgcagtcacctagctgtgctcrgcccgccttcaataattcaggctccgtggcggcagcagctgaggggctgctgtgaattatgcatgcgtcttcggcaaggcttcgtgcgacgtctcctgttggcttcccatccgtgagcctgcgtgcaggcagggcagagccgtctttgtcagccgtgtgctgggatcgcgggagaaactgcaataattggcctcctgggagtgtgagctcaggagcaatgtccctgtgtgggacgcaggcctttgctcggggccgcccgggctctgccggctgaccctggtatggactcagaggggtggt

SEQ ID NO: 194533 - DNA, 601 bp, Human
tcagccgtgtgctgggatcgcgggagaaactgcaataattggcctcctgggagtgtgagctcaggagcaatgtccctgtgtgggacgcaggcctttgctcggggccgcccgggctctgccggctgaccctggtatggactcagaggggtggtttgcagtgcatggttggaagtatttggttaagtggcatcacagtggctcttatcagctctacccaggtaaagtcccttgtccccatctgcgtaccttgtcgcgttgtcaggggcacactgacttgtgtggtcttcaggtatgtttgccrcagcgggattgtgtcggggatgaggggcccataggggtgcctgtgcagtgacgtgtttcgtgatctgacttggagttatgacttaaagagtcagagtgtttgaggttacggtttggatgagataacaacgggcccgggccgtgtgttacagaactaactgcaaacttttcatcttacggtattaacatttgtaacgtaacctacatgtttgacccaccaatatatacatggcggcttttccaattagcagcaaatctaaacagactttaaactctttttcaccaggaaagcatttctttg

SEQ ID NO: 194534 - DNA, 601 bp, Human
ggtaaagtcccttgtccccatctgcgtaccttgtcgcgttgtcaggggcacactgacttgtgtggtcttcaggtatgtttgccgcagcgggattgtgtcggggatgaggggcccataggggtgcctgtgcagtgacgtgtttcgtgatctgacttggagttatgacttaaagagtcagagtgtttgaggttacggtttggatgagataacaacgggcccgggccgtgtgttacagaactaactgcaaacttttcatcttacggtattaacatttgtaacgtaacctacatgtttgacccamcaatatatacatggcggcttttccaattagcagcaaatctaaacagactttaaactctttttcaccaggaaagcatttctttgactcagatgggtcagttgaaagaaaaaatcccacaacaataccgtaaactggaccgtgttctctaaggtggtgttgggatgtgggctgtgttttgtggatctcttttcttctttggcttagatcacaagtgtgggtttgactcacgtgttcagcaccagagaatcaggcaagccactgcaagcaggccagtgagttacagacgtggtggcatccctc

SEQ ID NO: 194535 - DNA, 601 bp, Human
gggatgaggggcccataggggtgcctgtgcagtgacgtgtttcgtgatctgacttggagttatgacttaaagagtcagagtgtttgaggttacggtttggatgagataacaacgggcccgggccgtgtgttacagaactaactgcaaacttttcatcttacggtattaacatttgtaacgtaacctacatgtttgacccaccaatatatacatggcggcttttccaattagcagcaaatctaaacagactttaaactctttttcaccaggaaagcatttctttgactcagatgggtcagtygaaagaaaaaatcccacaacaataccgtaaactggaccgtgttctctaaggtggtgttgggatgtgggctgtgttttgtggatctcttttcttctttggcttagatcacaagtgtgggtttgactcacgtgttcagcaccagagaatcaggcaagccactgcaagcaggccagtgagttacagacgtggtggcatccctcccgcgttctggccttggagctggggtcggaatggtggcttgtgcaaggaattttattttaggtgagtgctgctcagggttcaaggtcaggccttctgtga

SEQ ID NO: 194536 - DNA, 601 bp, Human
aaatatagcaaggttagcaacactgctgcctcgaattctgggctcaagccatcctctggaatagctgggaccacaggtgcctgctaccctgcccagctaattttttaatttattttcattttctgtagagatagggtctcactgtgttgcccaggctggtcttaaactcttggcctcaagtgatcatccagcctgcatgatcttattttttaaataggtagtatgtgcccatgcactggaatgtacacagaacaggatcggcccccgaggctgtttctggtgcagggcgtgccattgtgtrttctgtgcctttgggggggctgtccagccagctctggtcttccgtctcccagcactgggcgggaggtcctacagcttcaccgtggctgatgaacgaagtgcaccccggcagcagtagccggctctgggcatttatacttcatgtttgatcaatataatcagaggggttgatctgcgtttgctcctcccagcagtgcagaaggtgcctcttggctcagacttcactgccatcgtgatcttggccaggaggatggctacaaacagcctgaggcttaggctcatggctggcgttctgtgatga

SEQ ID NO: 194537 - DNA, 601 bp, Human
gttagcaacactgctgcctcgaattctgggctcaagccatcctctggaatagctgggaccacaggtgcctgctaccctgcccagctaattttttaatttattttcattttctgtagagatagggtctcactgtgttgcccaggctggtcttaaactcttggcctcaagtgatcatccagcctgcatgatcttattttttaaataggtagtatgtgcccatgcactggaatgtacacagaacaggatcggcccccgaggctgtttctggtgcagggcgtgccattgtgtattctgtgcctttgggggggctgtccagccagctctggtcttccgtctcccagcactgggcgggaggtcctacagcttcaccgtggctgatgaacgaagtgcaccccggcagcagtagccggctctgggcatttatacttcatgtttgatcaatataatcagaggggttgatctgcgtttgctcctcccagcagtgcagaaggtgcctcttggctcagacttcactgccatcgtgatcttggccaggaggatggctacaaacagcctgaggcttaggctcatggctggcgttctgtgatgaggccagtgaacc

SEQ ID NO: 194538 - DNA, 601 bp, Human
atttagggagaattcctgtctgtgatgttttgctcctcacttccctggtgacaggatattaggcaagcacaaagagtcagcccactccaaggacccctgccccagagagagtgagtgtgcaagttgagtgtgtgtgagagtttcacacctggcttacatgcagaacggggcacttgccacatgggggggagtcttggatgttgggattctttgagggagcctcacatggcccctgtccttctgtccttggccccagccctcctggcttggccgccctgtcctgcgtgtgagcgctggtgcrcgtcttcttgcagtgcgtgccgccccttccaccgcagctcggagtcagggcttccgtgtgagccccagccgcaggcctctgaaacttcagtgcgtgctggcggccaccgcggtcacacatttgatctataacagatcaacagcatggtggattcaaggaaacattaccaccgtgtttctgatcctatcccagaacttcctttcggtcttcttttaatttttttctatagcagtttacattatttgattattctttaacattttcttttttaatctaaatgctcttcgcactttgaatgac

SEQ ID NO: 194539 - DNA, 601 bp, Human
ctgggagcgcgctgtgccatatcccacatcgggtctcctgtaaatgagccgccgagccgacatgcgtggctgagggcttagctctggacactgtgcctgagagtttcgtgttgagaaggagcccacatgcagagcagtgtgcagtcacgggtgtgtgggcttcgcatccggaaggtgagcctcgtgcccccttcgactgagcacgctcccgagggcaccgtgggtcaggacgtaactcacgtggcatacgcggcgccccgcgcccagctgctttcgctctagcaagcctgtttgggaaacrtcttgttgccatgatggtcttagtgctctgtgtgcacatgctcctgtgtaaggttagttgcttttcctgttcaaccctgtggctgtagtttgttgttgcttgggcgagtgtgcacgtgtgagcatatgagtgtgcgtgcaagggtgctgtgtgggcctgcacatgtgaacatgtgtgtgtgctcgtgcacacacatgtgcagccgctcaaggttggggtctgtgttttgttccctgctccatccctgtgtgtagaatgcactggcaggtggtaggtgtgctgtgcatagttgttgactga

SEQ ID NO: 194540 - DNA, 601 bp, Human; identical to SEQ ID NO: 26259

SEQ ID NO: 194541 - DNA, 601 bp, Human; identical to SEQ ID NO: 26260

SEQ ID NO: 194542 - DNA, 601 bp, Human; identical to SEQ ID NO: 26261

SEQ ID NO: 194543 - DNA, 601 bp, Human; identical to SEQ ID NO: 26262

SEQ ID NO: 194544 - DNA, 601 bp, Human; identical to SEQ ID NO: 26263

SEQ ID NO: 194545 - DNA, 601 bp, Human; identical to SEQ ID NO: 26264

SEQ ID NO: 194546 - DNA, 601 bp, Human; identical to SEQ ID NO: 26265

SEQ ID NO: 194547 - DNA, 601 bp, Human; identical to SEQ ID NO: 26266

SEQ ID NO: 194548 - DNA, 601 bp, Human; identical to SEQ ID NO: 26267

SEQ ID NO: 194549 - DNA, 601 bp, Human; identical to SEQ ID NO: 26268

SEQ ID NO: 194550 - DNA, 601 bp, Human; identical to SEQ ID NO: 26269

SEQ ID NO: 194551 - DNA, 601 bp, Human
ttgagtccaggagttccagatcagcctgggcaacatagtgagaactcatctccacaaaaaaattaaaaaattagttgcatgtgttggtgtgcctccagctactcaggaggctgaggcaggaggattgcttgagcccaaagatcaaggccacagtgagccatgatcacactactgcactctagcctgggtgacagagcaagactctgttaaaaacacagaaacaaaacagtaaagttgaatgaataacccctcggatcaataccacaatacattcatcccctttccctctctccaatccagktaggtagcatcatatttagaaatatttcctcaaagcatctttaatcttttcagcagctgaaataatttcctaatatatcatcccatctccagtttctcttaactacttctgcaacggtctttttgtatgcaaatgtcatgtgttatcccctgcttaaaattcttcactgattttgcctttacctacactgaaagtagttgtgaactgatagcctgcaattgcacaatattggcctgcacaggttgaaaaaaaattttactggccagtggctcaagcttgtaatcccagtgctttgggagg

SEQ ID NO: 194552 - DNA, 601 bp, Human
taatttttttatttgttccttgggtgctatttctgaacatcatgttctcctttccctcttccatctagctcagtgaatgtggggtgttctttctatatgctttcacttccacttaacattcttctaaatgctgtacagtccctaagcttacactctccatactaaattttggtggccagtgtttttaccatgattaaatctcactgttatccagtttatcgttaaaagtttttctcctctcctctggatacagtttactttgtgtttttcttctaaactgtctacctgtgtcaccttcttyactgcctcgctcctgttttttctctgtgtgtaattctttaaagttcttccaggtttttcttcttttctattgccctgtctaatgtcctagatttaaatatagttctgcaagtcaaaggtaagttctttctactccccatggatctaatttataaggaagaggaagctttgcttgtaagtatattgaagttatttatatgttcatctgtgtgtgtgtgcacgcacacacagggaaagagagagaacattatgctaaccagagatgtctaatacaaccacatttggtgacttcagatataaa

SEQ ID NO: 194553 - DNA, 601 bp, Human
accctgtctccactaaacatacaaaaattagctgggcgtggtggtgggcgcctgtaatcccagctactcaggaggctgaggcgggagaattgcttgaacccgggaggtggaggttgcagtgagccgagatcgcgccattgcactccatctcaaaaaaaaaaaaaacagaaaaaacaaaaacaccaaaaaaaaaaaaaaaaagcaaataagaaaaagaaaaactactattcagtaactgaattttacctttcaagccttttgtcatttactctcatttctttttactttcattcttgccagcctttcactctgggcagaagttgtaattttgcagcattttaccgttctgcactgcaaatgaggaagaaagagaatgacagagttcagtgtcatttttttaaataccaaaatgtatggttgtatgtgtgagagagacgttgctaagattttcgtttctggagaaatgagaattgaaattgaaagcaaggccaggtgtggtggtttatgcatgtaatcctggaatttttttttttttaagtgacagcaagtttattaggaaagtaaagcaataaagaatggctactccataggcagagcagcc

SEQ ID NO: 194554 - DNA, 601 bp, Human
tttttttgagacaggatttcactctgttgcccaggtaaagtgcagtggcgcagccatggttcactgcagcctcaacctcccttggctcaggtgatcctctctcctcagcctcctgagtatctaggaccataggccaccacgcctgtgtgccaccaggcttggctaatttttgtattttttatagagacggggttttgccatgttacccaggctggtttcaaactcctgggctcaagcgatctgcccatctcagcctcccagagtgttgggattacaggcttgagccactatgtggggcctrtagtatttaattttattcgtctatcactgtttgtccattttatacctttaattgatttttgagtgatttccaatttagttgcttatgtaaacagcattgctgtgaacataaattcacccgcatacatgcaaaagtttctgtaggaataagaagtaaaattactgggaatgcttatgatgcctgttttccaaactggctttccaattttctctccccccagtgtaatcaagctctcattaatctatgtctttgccagcatttagtagtgtctggctttctcatttttgtcattctgctgag

SEQ ID NO: 194555 - DNA, 601 bp, Human
cactctgttgcccaggtaaagtgcagtggcgcagccatggttcactgcagcctcaacctcccttggctcaggtgatcctctctcctcagcctcctgagtatctaggaccataggccaccacgcctgtgtgccaccaggcttggctaatttttgtattttttatagagacggggttttgccatgttacccaggctggtttcaaactcctgggctcaagcgatctgcccatctcagcctcccagagtgttgggattacaggcttgagccactatgtggggcctatagtatttaattttattcatctatcactgtttgtccattttatacctttaattgatttttgagtgatttccaatttagttgcttatgtaaacagcattgctgtgaacataaattcacccgcatacatgcaaaagtttctgtaggaataagaagtaaaattactgggaatgcttatgatgcctgttttccaaactggctttccaattttctctccccccagtgtaatcaagctctcattaatctatgtctttgccagcatttagtagtgtctggctttctcatttttgtcattctgctgagtgtttactatttttttgtt

SEQ ID NO: 194556 - DNA, 601 bp, Human
ataagtcattctttttttttttttttgagacggagtctcgttctgtcgctcaggctgaagtgcagtggtgtgatgttggctcactgcaacctctgcctcccaggttcaagcgattttcctgccttagccttccaagtagctggagctgggattacaggcatgtgccaccacgcctggctaatttttgtaattttagtagagatggggtttcaccatgttggccaggctggtcttgaactcctgacctcaagtgatccacccatctcagcctcccaaagggctgggattacaggtgtgaggkctcttttttttttttttttttttttttaagacggagtcttgctctgtcccttagtaagtcattcttgaaaattagttaagaatgcttgataaagcacttccacttgtaccttttgaatagatgtgataacttttgttggcttgtatttttttgagtcttgctttattgcccaggctggagtgcaatggtgaacctcagcccactgcagcctccgcctcctgggctcaagtgatcctcccacctcagcctcctcagtagctgggactacaggcccacgccaacatgcccggctaatttttg

SEQ ID NO: 194557 - DNA, 601 bp, Human
gtcattctttttttttttttttgagacggagtctcgttctgtcgctcaggctgaagtgcagtggtgtgatgttggctcactgcaacctctgcctcccaggttcaagcgattttcctgccttagccttccaagtagctggagctgggattacaggcatgtgccaccacgcctggctaatttttgtaattttagtagagatggggtttcaccatgttggccaggctggtcttgaactcctgacctcaagtgatccacccatctcagcctcccaaagggctgggattacaggtgtgaggtctcttttttttttttttttttttttttaagacggagtcttgctctgtcccttagtaagtcattcttgaaaattagttaagaatgcttgataaagcacttccacttgtaccttttgaatagatgtgataacttttgttggcttgtatttttttgagtcttgctttattgcccaggctggagtgcaatggtgaacctcagcccactgcagcctccgcctcctgggctcaagtgatcctcccacctcagcctcctcagtagctgggactacaggcccacgccaacatgcccggctaatttttgtatt

SEQ ID NO: 194558 - DNA, 601 bp, Human
cttgaactcctgacctcaagtgatccacccatctcagcctcccaaagggctgggattacaggtgtgaggtctcttttttttttttttttttttttttaagacggagtcttgctctgtcccttagtaagtcattcttgaaaattagttaagaatgcttgataaagcacttccacttgtaccttttgaatagatgtgataacttttgttggcttgtatttttttgagtcttgctttattgcccaggctggagtgcaatggtgaacctcagcccactgcagcctccgcctcctgggctcaagtratcctcccacctcagcctcctcagtagctgggactacaggcccacgccaacatgcccggctaatttttgtattttttatagcgataggattttgccaatgttgtctggttttgtctcaaactcctgggatcaagcaatccgcctgcctcggcctcccaaagtgctagaattaggcatatgagtcaccatgcctggcctgttggctattttataattatcttgtttggtagactctgatcttttacagttgaacttaattcaactcttttgcaatgtttacaaagattagacctagaatta

SEQ ID NO: 194559 - DNA, 601 bp, Human
atttaactgactttgtaaatcactttttaattttatctaacacttctttgttttgactaagaatcatttcacattattatatttacttttattaataatgctagcagttgactttcttattaaggtatttttacaaggcaataatttttgtttcttgagaattattgagtagcctagaatatgtagagaacaagcatattcttacattatggtcagtaggctaggttcattgactccttacatgattttctgcacacactgacattgcaaagtatgtgattcacatatgtgcttcagaaayatgacaaatctactacatgtttgattttcaaagttgcttgaactattgtgcttattaatgttatcagtgttaaagctgcatatgtcagtggtctatgatatttaaatgaagagattataaaattggtgttacagctattttagaactatatctatcttagattgatagatgcagtggctcacacctgtaatcccagcactttgggaggctgaggtgggaagactgcttgagcccaggagttcctgaccagcttgggcaacatagtgagacctcatctctataaaaaacaaacaaaaacta

SEQ ID NO: 194560 - DNA, 601 bp, Human
taatttccaggaatgcttagaaaagtaaaacttaattatgagcaacagtttggtaccagcttgcagaaggtaccctcaagccatctcccaaatatgtcacatttttaaaaatgatctgcctgtgcacacacacggacatttactcaacattcccatacattcaaacattcaatcaaattacatagacatgtaatgcatatatatatatatatgatgagaggaaaaggagtaaatgaaaaagaggaaaaaaagacagaatgaagtcagaagtgaggtatagccaagacaagagaatcgcttkagcctaggagtttgagactagcctggacaacatagtgagatcccacttcttaaaaaaaaaagtttaaaaaaaagtgaggtacaaacatgtaatctgcagaccataagatcccttgtagttatgagaaccgagctacaaagttgcctctgggtttcctagcagccaaagcaatgaaggaaacacaaccagatacaagactcctggcgtccattaaatgaaagtaagctggttgatcaggagcagcacagcttctcctggtgctaataccagagagaagcttcttctggaattcttccaaca

SEQ ID NO: 194561 - DNA, 601 bp, Human
ccctttatggagcaaaactactcgctgagatggcacaagatgtaaggcaagagagagatgagaactcaccactcttaggcattcacttaattaatttaaccaaataatttccaggaatgcttagaaaagtaaaacttaattatgagcaacagtttggtaccagcttgcagaaggtaccctcaagccatctcccaaatatgtcacatttttaaaaatgatctgcctgtgcacacacacggacatttactcaacattcccatacattcaaacattcaatcaaattacatagacatgtaatgcttatatatatatatatgatgagaggaaaaggagtaaatgaaaaagaggaaaaaaagacagaatgaagtcagaagtgaggtatagccaagacaagagaatcgcttgagcctaggagtttgagactagcctggacaacatagtgagatcccacttcttaaaaaaaaaagtttaaaaaaaagtgaggtacaaacatgtaatctgcagaccataagatcccttgtagttatgagaaccgagctacaaagttgcctctgggtttcctagcagccaaagcaatgaaggaaacacaaccagatacaag

SEQ ID NO: 194562 - DNA, 601 bp, Human
gttagaatgaagaatttgttaaactgtggattccagggcttcattccagaaattctgatttggtaggtctgacttgaggcccaggaatctttaatagtatttaagatgcaggtatttggagaaccacagtgtaaacagtgttagcattaccataatgctgtaaccaccaagattcaccctcactcaggaatctcatcacctctcatgctcatcatctcaagatgcactggcttgtcctgatgaaaatgtgcctttggaaggagtctaactacagggccgttggtcaacatagcctacacamtttctggcaacaaggtacaattccacatacccactacttccaaagaggcaagtgcaaatcatacatggaatctctcagtagaatacttaccatatttttgctatcaattaagttcctagaggtcaagagctatatccaattcatccgtatgttcctcaaagcatgaaacagaatgcttctcactgagtagatgtttaataagtgctgtactgaattaattttttttggggggggatggagtttcgctcttgttgcccaggctggagtggtgcaatctcggctcactgcaacctccgcctt

SEQ ID NO: 194563 - DNA, 601 bp, Human
gtgtattttgaggtggtgcaggatccttacagcaggcacataataaacagggagcatggaagacacagagttggggtaaagagccacaaagtgccaagttccacctcacttctgatgaccctactggcatatttctcactacaccagtggttttcaaacttcagaatcatctgtgagtttgttagaatgaagaatttgttaaactgtggattccagggcttcattccagaaattctgatttggtaggtctgacttgaggcccaggaatctttaatagtatttaagatgcaggtatttggaraaccacagtgtaaacagtgttagcattaccataatgctgtaaccaccaagattcaccctcactcaggaatctcatcacctctcatgctcatcatctcaagatgcactggcttgtcctgatgaaaatgtgcctttggaaggagtctaactacagggccgttggtcaacatagcctacacaatttctggcaacaaggtacaattccacatacccactacttccaaagaggcaagtgcaaatcatacatggaatctctcagtagaatacttaccatatttttgctatcaattaagttcctaga

SEQ ID NO: 194564 - DNA, 601 bp, Human
accctgctagggacagtctggcagggaagggttgctgtcataagaactctttaaactttacaataccttgggatttatctggacagcctcttcattataatgtaggagagctttctgacctggatggctgaggttcacaaacacctgaagacacgggtacttcccctgaccgtggcagtgcacaccacaggtgaaggcacagtccagccagtcgtccatgatatctgtgtggatggcagtgcaggtcgattcttctctctgaatgcttcaatttgaaaaaaaaaaaatgttcttcacttaytagaaaatttcattctacattttggtgtggttatgagcttatgtacacaatgcccaaggcatttgtgtacaaggcatttgtgtattttgaggtggtgcaggatccttacagcaggcacataataaacagggagcatggaagacacagagttggggtaaagagccacaaagtgccaagttccacctcacttctgatgaccctactggcatatttctcactacaccagtggttttcaaacttcagaatcatctgtgagtttgttagaatgaagaatttgttaaactgtggattccagggctt

SEQ ID NO: 194565 - DNA, 601 bp, Human
gggtctcctggaaccttctcagcttaacaagaggctactatgagcctggctggggccccatcctgggtacaaacaagaaaggcaaaaagacgagggcagaatccaggggctgcgctgcatctgtgcctggcacctcagctgttggatacctactcggtgcctggccctggatacaggaaggggaaggggcaggaccaagcacagaactggaatgattcttccacccacacacacctacctattcaccaggacaagccccccttatgggctggccctgccccaggtgccaggggccttgggytgaggcacagatcaggtgggccagggctcaccttgacaggtggggactgggcccgcaggctggcaatggtctcgtggctgtcacgcaggcgccgactgagccgctcctcctcctgtgccttctcagccaggcagtccttgagtcgcagctccacctcagccagccggtcggtcttctgctgcacctctaggttcagctctgacagcatgcctttgctttccgccatctccagctgcagctgggacagcttgtcacggagctgggcgctctcctgcagccattgggaggcactggatgagt

SEQ ID NO: 194566 - DNA, 601 bp, Human
cagtacctcgaggtgcgggagggagaggggcaggtgccacaccgagaaagaaactggtcacctcccatgcacatgaacacacatgcacacacacatgtgcacacccagaggggcagaatggccttgtctccctccccctacagggctgtgagctctgggcattggctccaacaccaacccagtgctgagcacacatcaggtgcccaagccacgtgccctcaggaaggtaggagagggcctctgtgatgacagtgacaagtgccatgtagagcttactgagcacagcctgtgtgctgggccrtgggcacaaagcttcttgggatgacgttcctgagtccccactgtgaggtgggttctgggaccagatcgtgttataatagatgaggaaaaggaaaccagacaaaacttgccctgggtcccgtggccatcggggagaggagggactggaccccgtgtctgtggggtacccaaatgtttaaccgatgcattggcccaagggcctgcctctggcttcctggctgggcatgtgcccccacacagcctgggtacctgcgcccggagccgcgcggtcagctggtgtgagctctgcagctgctgttcc

SEQ ID NO: 194567 - DNA, 601 bp, Human
ggggtggggcaggggctgctgtctgagcggctttgtctgagctttggagggacgccctgagtggatgtcgtgcctctcccagtgcacccccttagcctggaccctcccacccactgccctcgctcacctcggccttgacactcctgagggcctcctgcagcagcagtgggaagccgcgcacctgccgcttgagcccattgtagtcgttggtgagggtccgcagtgccggctgcaaggtcagcaagttggtccggacgcctatggggacactcgggctgtgaggcgggaggggatgaggggycgcggcgtggggcagacagggcccagctggtcagctcacctgctagattctcgtgcacagccttcatctccacctgggctctggcaaaggcctcctcaatggcccggttcttgtcctcttccagggactgcatctcctccagcatctgcccatgggcccgctccagctctgactcgtacatggcaatctggccagaccaggaaaaggctcagtacctcgaggtgcgggagggagaggggcaggtgccacaccgagaaagaaactggtcacctcccatgcacatgaacacacatgcacaca

SEQ ID NO: 194568 - DNA, 601 bp, Human
aataatttttttaaaaaatacgtatgtagcatgttttttgtttgtttttgagataaagtctcgctgtcacacaggctgaagtgcagtggcatgatcttggttcaccgcaacctccgccttctgggttcaagtgattctcctgcctcagcctcccgagtagctggaattaacaggcacctgccacccatgcccagctaatttttgtaattttagtagagacgaagtttcgccttgttggccaggctggtctcaaactcctgacctcaagtgatccgcctgcctcggcctcccaaagtgttgraattacaggtgtgagccaccgcgcctggcctgcatgtttgaaatatgaagttatctgtaacatgtttggtttaaagaatcatagtaagacaaatagccgaatgcctgccctgagcagtctagtttcaaacagggcctataagggcagcagtaagtgtcatggggggtggggcaggggctgctgtctgagcggctttgtctgagctttggagggacgccctgagtggatgtcgtgcctctcccagtgcacccccttagcctggaccctcccacccactgccctcgctcacctcggccttga

SEQ ID NO: 194569 - DNA, 601 bp, Human
caggagggtcgcttgaacccgggaggtgggggttgcagtaagctgagatcccgccattgcactccagcctgggcaacaagagtgaaacactgtctcaaaaacaaaaaaatgctgtgtaaatagttgttatatgttattttttatttctattatttctaattgttgtactgttaatttttttcaactatttttgatctgtggttgtttgaatctgggaatgcagaacctgtggatgggggaagggcctaccatatattctcacacacacacacacacacacacacacacacacacacacacrcacaattggcttaagcatgctcagaacagtcgggggaaatgctgagaggccacattggaagagttgggtgggtggcagagaggcctttcctattcacctgatgccctgctatggagtttgacttttcaccacgtccatgtattactgatatagtcttttaaaggagaagaactatattctgttcccaaaatatattagtctttgcaaagctatcatacaaattcaaggagctaacggctataaacagctcgacatgtaggaggcacttaagaggcactggttattctcatatgtacaagt

SEQ ID NO: 194570 - DNA, 601 bp, Human
cccatgtactttaaatcatctccaggttacttataatatctaatacaatgaaaatgctgggtaggggctgggtgcagtggctcatgccggtaatgccagcactttgggaggcggaggtgggcggatcacctgaggtcaggagttcaaaaccagcctggccaacatggtgaagcccagcctctattaaaaatacaaaacaaacaaacaaacaaacaaaactagcccggcatggtggcacacgcctgtaatcccagctatccaggaggctgaggcaggagggtcgcttgaacccgggaggtgrgggttgcagtaagctgagatcccgccattgcactccagcctgggcaacaagagtgaaacactgtctcaaaaacaaaaaaatgctgtgtaaatagttgttatatgttattttttatttctattatttctaattgttgtactgttaatttttttcaactatttttgatctgtggttgtttgaatctgggaatgcagaacctgtggatgggggaagggcctaccatatattctcacacacacacacacacacacacacacacacacacacacacgcacaattggcttaagcatgctcagaaca

SEQ ID NO: 194571 - DNA, 601 bp, Human
gctgttatccgtcattcacactatagtatgaattcacttagtacatttcttcttgaacagaccagttgactggggtggagctctgccttggggatggggaggaaaggtcagttgtggggctcaagcactgcaccccgtcagggtgagacaccagaacggacactctttttctccctggacttcagtttcttcattcagacaatgaggggcttgggccccaatgagcaaagagccttgtcctgaatggcaggacagggcttaggaatcagatgggcatataggcccaggcagcaggtgatgrctggtggtgtatctgagggcccagatagtggggcagccacaggggtatctggcagcatgagctggtcatgccgccatctacttccagcctttgttgggatccctgtgctcttggaatgaagaggaaacaccccccactgccagcatggcccacctgccctcccttttcacccatccgttccagctcactgtccaggtctcagctctaactttgccttctctgggaagcccctcaacacacttgcctgtcccatacccaggaaagcctgtctcagccctggaagggggcagggttggggtt

SEQ ID NO: 194572 - DNA, 601 bp, Human
tcaagaccagtctccattctggtccactggtgtcccaggcagactagttgacctaggagtcccctgacttttaagcacagccccctaggggaagggggcccacaaagctgttatccgtcattcacactatagtatgaattcacttagtacatttcttcttgaacagaccagttgactggggtggagctctgccttggggatggggaggaaaggtcagttgtggggctcaagcactgcaccccgtcagggtgagacaccagaacggacactctttttctccctggacttcagtttcttcatycagacaatgaggggcttgggccccaatgagcaaagagccttgtcctgaatggcaggacagggcttaggaatcagatgggcatataggcccaggcagcaggtgatggctggtggtgtatctgagggcccagatagtggggcagccacaggggtatctggcagcatgagctggtcatgccgccatctacttccagcctttgttgggatccctgtgctcttggaatgaagaggaaacaccccccactgccagcatggcccacctgccctcccttttcacccatccgttccagctcactgtcca

SEQ ID NO: 194573 - DNA, 601 bp, Human
ttcccgcatggggccacactcacgtcctgctgcgaggcctgtggggagaagaccttgtccagctcgaaggacacaggcttgcccttgtgcagcaggtggatgatggagtcgtcgtcggcatcgaaagtcacagcattggtggcctcaggtccttccccatcctctttggtgactggccggacacgagcaatcactcggatgttccctggattggttggggatggggaaatgggtccaggccatgtcaagaccagtctccattctggtccactggtgtcccaggcagactagttgacctagragtcccctgacttttaagcacagccccctaggggaagggggcccacaaagctgttatccgtcattcacactatagtatgaattcacttagtacatttcttcttgaacagaccagttgactggggtggagctctgccttggggatggggaggaaaggtcagttgtggggctcaagcactgcaccccgtcagggtgagacaccagaacggacactctttttctccctggacttcagtttcttcattcagacaatgaggggcttgggccccaatgagcaaagagccttgtcctgaatggcagg

SEQ ID NO: 194574 - DNA, 601 bp, Human
atctctccttcctaaggaggctttcaagggcttcagtcttaacttcccaccctcttctgtcctccagaggaaggagcaggaccctggctccccacttctgattcctgcaccccccactcttaacgcttcttcctgcccagcgcccccgctccctgtgagtccatctttccctctctcccttgctttccctttcccgcatggggccacactcacgtcctgctgcgaggcctgtggggagaagaccttgtccagctcgaaggacacaggcttgcccttgtgcagcaggtggatgatggagtcrtcgtcggcatcgaaagtcacagcattggtggcctcaggtccttccccatcctctttggtgactggccggacacgagcaatcactcggatgttccctggattggttggggatggggaaatgggtccaggccatgtcaagaccagtctccattctggtccactggtgtcccaggcagactagttgacctaggagtcccctgacttttaagcacagccccctaggggaagggggcccacaaagctgttatccgtcattcacactatagtatgaattcacttagtacatttcttcttgaacaga

SEQ ID NO: 194575 - DNA, 601 bp, Human
ggacactgagaacacatggttctcatacagcctcagggggttgggggattcctaggaaggcccaggggactgatacaggagggtattcccggatggggaagatgggcagggtcatgaagatggatggggccatgtgggtggccatgggggtgggaggggctgtgatggtgggaggggcctgaaagtgggtgaggccacatggtgggaagatgggaggggcctgagggtgggtggggccatgcagatgggaggagccacagcatgagggtgggatgggctgtgatggtaggaggggccttgrgagtgggcagggccatgcagtggaaggggccacctgaatgggaggacccaaagccatggtggtgggaggggctgtgggtgaggccatgtggtggaaggggctgtggatataggaggggccacatggtgggaggagccacagctgagagaatggaatgagttacgatagtgggaagggcctcaagggtgggcggggccacacggtagaaggggccttggggacgggaggaaccacagccatgggaggggatgggctgtgtctggatctctccttcctaaggaggctttcaagggcttcagt

SEQ ID NO: 194576 - DNA, 601 bp, Human
acagccttcatatgccagtcttgccctgggatctccttgaggactgagacccgccactcatcccagatcccccaggcccggcccaaggcagcggtaaagcaggagtgtgcagtgcacactcaaggtgaaatgcagccctggtcctgagagaggtcggtggcctgccccagactctgtccccaagccgagatccctgtgatgatagtccccccttgcctctctcccagtcctgctgggcccattgtgggtgcccttgggcaagggggccccctcttaaggcctggtgcctcagggctaacayagataactacagcctctgctcctgggttgtgaggaccaaatgaggcaaaacacacactgcacaataccccaagaccaatgagggagcccgcattcccttcatgcttcactgtgaacccccaccccattgggcagcacccacctccatcgtgtacgtcttgccggcgcccgtctggccgtacgcaaagatgcagacattgaagccatcaatgcaagaggtgaccagggcctgcacctcctggaacacctgggagggtggtgggagggaggctggtggggggggcttccagggccgctggga

SEQ ID NO: 194577 - DNA, 601 bp, Human
aggctgagacctgggctctgtgggtggtagagaggaggcacaaggaggagcgggccagtgtcctggggaaggacgggtgggccggcctttctagaaggaaacctggagtccccacccgggacctcgaggccctgggagcctggccctcacccctcttctgatagcacctctcactcactctctattccggccacaggggcctcctggctgggcctcaggtgcccctggcatgctctggcctcttggcctcagccctgcagctccctctgccccgggtactcctctgaccgccccttggccrgctccgtcatctccctcagggaggctgctcccaagatgccccctcagggaggctgctccttcgcccagcacccccaaatgccctgtccctccccctagtcagttccgcattcctggctttatttttctccctggcctgacaggacacttgctgatttgtgtggaccctgctgtctccccacagccaggttggccctgtggggagggccctctgtgggggcagggactgtttgggtcacagctgtgcctggcacgatgcctgatacaccttatgcatcagcagatacacttgaggatgaac

SEQ ID NO: 194578 - DNA, 601 bp, Human
aatggcatcgccctgccaggactaccctgagacttatagtgcagcactgggatgaggggcctggcccagaccccacacagggcagctgagggccagatgcatgcctggccctgtggggccacctgggaggggcactggaaatgaatgaccccaccactgcccagaaaggcgctcagtctcagggaggctgagacctgggctctgtgggtggtagagaggaggcacaaggaggagcgggccagtgtcctggggaaggacgggtgggccggcctttctagaaggaaacctggagtccccaccygggacctcgaggccctgggagcctggccctcacccctcttctgatagcacctctcactcactctctattccggccacaggggcctcctggctgggcctcaggtgcccctggcatgctctggcctcttggcctcagccctgcagctccctctgccccgggtactcctctgaccgccccttggccggctccgtcatctccctcagggaggctgctcccaagatgccccctcagggaggctgctccttcgcccagcacccccaaatgccctgtccctccccctagtcagttccgcattcctgg

SEQ ID NO: 194579 - DNA, 601 bp, Human
gacgctcgtgtggtgtctgtccccaaagccccttgactacccctcacaagcaagcctccttgcccaaagctcttacctacctgccactgtcccccaaaatgccctccaccagctgcgggcaactgcacctctatttccccaccattaaaatggcatcgccctgccaggactaccctgagacttatagtgcagcactgggatgaggggcctggcccagaccccacacagggcagctgagggccagatgcatgcctggccctgtggggccacctgggaggggcactggaaatgaatgaccccrccactgcccagaaaggcgctcagtctcagggaggctgagacctgggctctgtgggtggtagagaggaggcacaaggaggagcgggccagtgtcctggggaaggacgggtgggccggcctttctagaaggaaacctggagtccccacccgggacctcgaggccctgggagcctggccctcacccctcttctgatagcacctctcactcactctctattccggccacaggggcctcctggctgggcctcaggtgcccctggcatgctctggcctcttggcctcagccctgcagctccctctg

SEQ ID NO: 194580 - DNA, 601 bp, Human
gtgaactcggtcgtgcgattagtgtggccaaactcaaacacctgggggattgggaggagggcagaggcacagcgttgagaatggggtcctcagagtcacctggccccaagcacccatgaggagtggcaccaccctccgcagtttagatgaggaaactgaggctcagagaggcgtgcggacttgcccaagggtgcgtgcttaggacacagcagagcctacattcaaacccagttgtgtcctctagagcagtgtggctgtggtcaggggctcccgcctccacaccttgttgatgtcgtccacrctctgcacttggaactcagtcagccctggtacatacagctgcccactgccgtctgggcacagccggatctccagtttttcctgaggctctttccctagcaggtccctggaggggcaggtgagacagtcaccccctcctcccatttccagctgctgtttgcactgcacccagccccccagccaggaatgttcccccaacccaggaagccttctccagccatcagctgagtgcatctctcctcctccagctcctccaccgcattcagctgaagacgtggagatctcactccacaatacaatg

SEQ ID NO: 194581 - DNA, 601 bp, Human
cgtagcccctacatgctagggactggcccgccctaacccaaggtcctcacctgtaccaccatgagggtcttgctgtcaccactaagcgaatcctgcagcaggtaggtgagcttggagttgcggaagggcacgtggccctggcgggagcgcagggcagcaatgacgtcccccagagccgacagcgacttgttgatgtgctgcgcctcccgcaggcggctgccctcggcccccgacttgcccacgcgctccgagccagccaagtccaccaggttcagcttccctgcagggaaggcacccaccwgatcaggcctgccctgccccttggggttgtggggatcctcaggccaggctgcctgccactctcacccgtggtgcggaggcctgtgctgcagtccacgcctcgcaccgtcacgatgagcagcgcgtgcgagcgggagctgtgctcgttcaggttggtgaactcggtcgtgcgattagtgtggccaaactcaaacacctgggggattgggaggagggcagaggcacagcgttgagaatggggtcctcagagtcacctggccccaagcacccatgaggagtggcaccaccctccgcagtttag

SEQ ID NO: 194582 - DNA, 601 bp, Human
actgtgagcagggaagggcggatgggcgggggccacggctgccctggctccccaccctgctgtgcttctctctactcccctgccctgcctcctaacacccagtttcctcatctgcaaaatgggcatgatgtttgtgccccagcctcagttatggcaagaattaaatgagataattcatgtaaagaagtcaactagttaccactgagcatctactatgtgccacccccacggccagctcgtcaccccacaggaacctccgaggccaagaagaaatacctgtactgaagaggctgctggctgkgggttccagccgtagctccacccaactccggcagcttccctgcccccactgcttcaggacgtccccgcccagctccctgctcctgccatgacccaaagtctctgacccagggccacctgagccaggcctgtgacagtccccgtacctctagatgctcctggcttgaccaggacccaagctctgccctgcgtagcccaggccccagctccacagagcgcaccctctcagcaaacttgagggaatagagcgtctcgctagtgttcttctccacgggggacacctaggggacacgagagctca

SEQ ID NO: 194583 - DNA, 601 bp, Human; identical to SEQ ID NO: 40403

SEQ ID NO: 194584 - DNA, 601 bp, Human; identical to SEQ ID NO: 91643

SEQ ID NO: 194585 - DNA, 601 bp, Human; identical to SEQ ID NO: 91644

SEQ ID NO: 194586 - DNA, 601 bp, Human; identical to SEQ ID NO: 91645

SEQ ID NO: 194587 - DNA, 601 bp, Human; identical to SEQ ID NO: 91646

SEQ ID NO: 194588 - DNA, 601 bp, Human; identical to SEQ ID NO: 91647

SEQ ID NO: 194589 - DNA, 601 bp, Human; identical to SEQ ID NO: 91648

SEQ ID NO: 194590 - DNA, 601 bp, Human; identical to SEQ ID NO: 91649

SEQ ID NO: 194591 - DNA, 601 bp, Human; identical to SEQ ID NO: 91650

SEQ ID NO: 194592 - DNA, 601 bp, Human; identical to SEQ ID NO: 91651

SEQ ID NO: 194593 - DNA, 601 bp, Human; identical to SEQ ID NO: 91652

SEQ ID NO: 194594 - DNA, 601 bp, Human; identical to SEQ ID NO: 91653

SEQ ID NO: 194595 - DNA, 601 bp, Human; identical to SEQ ID NO: 91654

SEQ ID NO: 194596 - DNA, 601 bp, Human; identical to SEQ ID NO: 91655

SEQ ID NO: 194597 - DNA, 601 bp, Human; identical to SEQ ID NO: 91656

SEQ ID NO: 194598 - DNA, 601 bp, Human; identical to SEQ ID NO: 91657

SEQ ID NO: 194599 - DNA, 601 bp, Human; identical to SEQ ID NO: 91658

SEQ ID NO: 194600 - DNA, 601 bp, Human; identical to SEQ ID NO: 91659

SEQ ID NO: 194601 - DNA, 601 bp, Human; identical to SEQ ID NO: 91660

SEQ ID NO: 194602 - DNA, 601 bp, Human; identical to SEQ ID NO: 91661

SEQ ID NO: 194603 - DNA, 601 bp, Human; identical to SEQ ID NO: 91662

SEQ ID NO: 194604 - DNA, 601 bp, Human; identical to SEQ ID NO: 91663

SEQ ID NO: 194605 - DNA, 601 bp, Human; identical to SEQ ID NO: 91664

SEQ ID NO: 194606 - DNA, 601 bp, Human; identical to SEQ ID NO: 91665

SEQ ID NO: 194607 - DNA, 601 bp, Human; identical to SEQ ID NO: 91666

SEQ ID NO: 194608 - DNA, 601 bp, Human; identical to SEQ ID NO: 91667

SEQ ID NO: 194609 - DNA, 601 bp, Human; identical to SEQ ID NO: 91668

SEQ ID NO: 194610 - DNA, 601 bp, Human; identical to SEQ ID NO: 91669

SEQ ID NO: 194611 - DNA, 601 bp, Human; identical to SEQ ID NO: 91670

SEQ ID NO: 194612 - DNA, 601 bp, Human; identical to SEQ ID NO: 91671

SEQ ID NO: 194613 - DNA, 601 bp, Human; identical to SEQ ID NO: 91672

SEQ ID NO: 194614 - DNA, 601 bp, Human; identical to SEQ ID NO: 91673

SEQ ID NO: 194615 - DNA, 601 bp, Human; identical to SEQ ID NO: 91674

SEQ ID NO: 194616 - DNA, 601 bp, Human; identical to SEQ ID NO: 91675

SEQ ID NO: 194617 - DNA, 601 bp, Human; identical to SEQ ID NO: 91676

SEQ ID NO: 194618 - DNA, 601 bp, Human; identical to SEQ ID NO: 91677

SEQ ID NO: 194619 - DNA, 601 bp, Human; identical to SEQ ID NO: 91678

SEQ ID NO: 194620 - DNA, 601 bp, Human; identical to SEQ ID NO: 91679

SEQ ID NO: 194621 - DNA, 601 bp, Human; identical to SEQ ID NO: 91680

SEQ ID NO: 194622 - DNA, 601 bp, Human; identical to SEQ ID NO: 91681

SEQ ID NO: 194623 - DNA, 601 bp, Human; identical to SEQ ID NO: 91682

SEQ ID NO: 194624 - DNA, 601 bp, Human; identical to SEQ ID NO: 91683

SEQ ID NO: 194625 - DNA, 601 bp, Human; identical to SEQ ID NO: 91684

SEQ ID NO: 194626 - DNA, 601 bp, Human; identical to SEQ ID NO: 91685

SEQ ID NO: 194627 - DNA, 601 bp, Human; identical to SEQ ID NO: 91686

SEQ ID NO: 194628 - DNA, 601 bp, Human; identical to SEQ ID NO: 91687

SEQ ID NO: 194629 - DNA, 601 bp, Human; identical to SEQ ID NO: 91688

SEQ ID NO: 194630 - DNA, 601 bp, Human; identical to SEQ ID NO: 91689

SEQ ID NO: 194631 - DNA, 601 bp, Human; identical to SEQ ID NO: 91690

SEQ ID NO: 194632 - DNA, 601 bp, Human; identical to SEQ ID NO: 91691

SEQ ID NO: 194633 - DNA, 601 bp, Human; identical to SEQ ID NO: 91692

SEQ ID NO: 194634 - DNA, 601 bp, Human; identical to SEQ ID NO: 91693

SEQ ID NO: 194635 - DNA, 601 bp, Human; identical to SEQ ID NO: 91694

SEQ ID NO: 194636 - DNA, 601 bp, Human; identical to SEQ ID NO: 91695

SEQ ID NO: 194637 - DNA, 601 bp, Human; identical to SEQ ID NO: 91696

SEQ ID NO: 194638 - DNA, 601 bp, Human; identical to SEQ ID NO: 91697

SEQ ID NO: 194639 - DNA, 601 bp, Human; identical to SEQ ID NO: 91698

SEQ ID NO: 194640 - DNA, 601 bp, Human; identical to SEQ ID NO: 91699

SEQ ID NO: 194641 - DNA, 601 bp, Human; identical to SEQ ID NO: 91700

SEQ ID NO: 194642 - DNA, 601 bp, Human; identical to SEQ ID NO: 91701

SEQ ID NO: 194643 - DNA, 601 bp, Human; identical to SEQ ID NO: 91702

SEQ ID NO: 194644 - DNA, 601 bp, Human; identical to SEQ ID NO: 91703

SEQ ID NO: 194645 - DNA, 601 bp, Human; identical to SEQ ID NO: 91704

SEQ ID NO: 194646 - DNA, 601 bp, Human; identical to SEQ ID NO: 91705

SEQ ID NO: 194647 - DNA, 601 bp, Human; identical to SEQ ID NO: 91706

SEQ ID NO: 194648 - DNA, 601 bp, Human; identical to SEQ ID NO: 91707

SEQ ID NO: 194649 - DNA, 601 bp, Human; identical to SEQ ID NO: 91708

SEQ ID NO: 194650 - DNA, 601 bp, Human; identical to SEQ ID NO: 91709

SEQ ID NO: 194651 - DNA, 601 bp, Human; identical to SEQ ID NO: 91710

SEQ ID NO: 194652 - DNA, 601 bp, Human; identical to SEQ ID NO: 91711

SEQ ID NO: 194653 - DNA, 601 bp, Human; identical to SEQ ID NO: 91712

SEQ ID NO: 194654 - DNA, 601 bp, Human; identical to SEQ ID NO: 91713

SEQ ID NO: 194655 - DNA, 601 bp, Human; identical to SEQ ID NO: 91714

SEQ ID NO: 194656 - DNA, 601 bp, Human; identical to SEQ ID NO: 91715

SEQ ID NO: 194657 - DNA, 601 bp, Human; identical to SEQ ID NO: 91716

SEQ ID NO: 194658 - DNA, 601 bp, Human; identical to SEQ ID NO: 91717

SEQ ID NO: 194659 - DNA, 601 bp, Human; identical to SEQ ID NO: 91718

SEQ ID NO: 194660 - DNA, 601 bp, Human; identical to SEQ ID NO: 91719

SEQ ID NO: 194661 - DNA, 601 bp, Human; identical to SEQ ID NO: 91720

SEQ ID NO: 194662 - DNA, 601 bp, Human; identical to SEQ ID NO: 91721

SEQ ID NO: 194663 - DNA, 601 bp, Human; identical to SEQ ID NO: 91722

SEQ ID NO: 194664 - DNA, 601 bp, Human; identical to SEQ ID NO: 91723

SEQ ID NO: 194665 - DNA, 601 bp, Human; identical to SEQ ID NO: 91724

SEQ ID NO: 194666 - DNA, 601 bp, Human; identical to SEQ ID NO: 91725

SEQ ID NO: 194667 - DNA, 601 bp, Human; identical to SEQ ID NO: 91726

SEQ ID NO: 194668 - DNA, 601 bp, Human; identical to SEQ ID NO: 91727

SEQ ID NO: 194669 - DNA, 601 bp, Human; identical to SEQ ID NO: 91728

SEQ ID NO: 194670 - DNA, 601 bp, Human; identical to SEQ ID NO: 91729

SEQ ID NO: 194671 - DNA, 601 bp, Human; identical to SEQ ID NO: 91730

SEQ ID NO: 194672 - DNA, 601 bp, Human; identical to SEQ ID NO: 91731

SEQ ID NO: 194673 - DNA, 601 bp, Human; identical to SEQ ID NO: 91732

SEQ ID NO: 194674 - DNA, 601 bp, Human; identical to SEQ ID NO: 91733

SEQ ID NO: 194675 - DNA, 601 bp, Human; identical to SEQ ID NO: 91734

SEQ ID NO: 194676 - DNA, 601 bp, Human; identical to SEQ ID NO: 91735

SEQ ID NO: 194677 - DNA, 601 bp, Human; identical to SEQ ID NO: 91736

SEQ ID NO: 194678 - DNA, 601 bp, Human; identical to SEQ ID NO: 91737

SEQ ID NO: 194679 - DNA, 601 bp, Human; identical to SEQ ID NO: 91738

SEQ ID NO: 194680 - DNA, 601 bp, Human; identical to SEQ ID NO: 91739

SEQ ID NO: 194681 - DNA, 601 bp, Human; identical to SEQ ID NO: 91740

SEQ ID NO: 194682 - DNA, 601 bp, Human; identical to SEQ ID NO: 91741

SEQ ID NO: 194683 - DNA, 601 bp, Human; identical to SEQ ID NO: 91742

SEQ ID NO: 194684 - DNA, 601 bp, Human; identical to SEQ ID NO: 91743

SEQ ID NO: 194685 - DNA, 601 bp, Human; identical to SEQ ID NO: 91744

SEQ ID NO: 194686 - DNA, 601 bp, Human; identical to SEQ ID NO: 91745

SEQ ID NO: 194687 - DNA, 601 bp, Human; identical to SEQ ID NO: 91746

SEQ ID NO: 194688 - DNA, 601 bp, Human; identical to SEQ ID NO: 91747

SEQ ID NO: 194689 - DNA, 601 bp, Human; identical to SEQ ID NO: 91748

SEQ ID NO: 194690 - DNA, 601 bp, Human; identical to SEQ ID NO: 91749

SEQ ID NO: 194691 - DNA, 601 bp, Human; identical to SEQ ID NO: 91750

SEQ ID NO: 194692 - DNA, 601 bp, Human; identical to SEQ ID NO: 91751

SEQ ID NO: 194693 - DNA, 601 bp, Human; identical to SEQ ID NO: 91752

SEQ ID NO: 194694 - DNA, 601 bp, Human; identical to SEQ ID NO: 91753

SEQ ID NO: 194695 - DNA, 601 bp, Human; identical to SEQ ID NO: 91754

SEQ ID NO: 194696 - DNA, 601 bp, Human; identical to SEQ ID NO: 91755

SEQ ID NO: 194697 - DNA, 601 bp, Human; identical to SEQ ID NO: 91756

SEQ ID NO: 194698 - DNA, 601 bp, Human; identical to SEQ ID NO: 91757

SEQ ID NO: 194699 - DNA, 601 bp, Human; identical to SEQ ID NO: 91758

SEQ ID NO: 194700 - DNA, 601 bp, Human; identical to SEQ ID NO: 91759

SEQ ID NO: 194701 - DNA, 601 bp, Human; identical to SEQ ID NO: 91760

SEQ ID NO: 194702 - DNA, 601 bp, Human; identical to SEQ ID NO: 91761

SEQ ID NO: 194703 - DNA, 601 bp, Human; identical to SEQ ID NO: 91762

SEQ ID NO: 194704 - DNA, 601 bp, Human; identical to SEQ ID NO: 91763

SEQ ID NO: 194705 - DNA, 601 bp, Human; identical to SEQ ID NO: 91764

SEQ ID NO: 194706 - DNA, 601 bp, Human; identical to SEQ ID NO: 91765

SEQ ID NO: 194707 - DNA, 601 bp, Human; identical to SEQ ID NO: 91766

SEQ ID NO: 194708 - DNA, 601 bp, Human; identical to SEQ ID NO: 91767

SEQ ID NO: 194709 - DNA, 601 bp, Human; identical to SEQ ID NO: 91768

SEQ ID NO: 194710 - DNA, 601 bp, Human; identical to SEQ ID NO: 91769

SEQ ID NO: 194711 - DNA, 601 bp, Human; identical to SEQ ID NO: 91770

SEQ ID NO: 194712 - DNA, 601 bp, Human; identical to SEQ ID NO: 91771

SEQ ID NO: 194713 - DNA, 601 bp, Human; identical to SEQ ID NO: 91772

SEQ ID NO: 194714 - DNA, 601 bp, Human; identical to SEQ ID NO: 91773

SEQ ID NO: 194715 - DNA, 601 bp, Human; identical to SEQ ID NO: 91774

SEQ ID NO: 194716 - DNA, 601 bp, Human; identical to SEQ ID NO: 91775

SEQ ID NO: 194717 - DNA, 601 bp, Human; identical to SEQ ID NO: 91776

SEQ ID NO: 194718 - DNA, 601 bp, Human; identical to SEQ ID NO: 91777

SEQ ID NO: 194719 - DNA, 601 bp, Human; identical to SEQ ID NO: 91778

SEQ ID NO: 194720 - DNA, 601 bp, Human; identical to SEQ ID NO: 91779

SEQ ID NO: 194721 - DNA, 601 bp, Human; identical to SEQ ID NO: 91780

SEQ ID NO: 194722 - DNA, 601 bp, Human; identical to SEQ ID NO: 91781

SEQ ID NO: 194723 - DNA, 601 bp, Human; identical to SEQ ID NO: 91782

SEQ ID NO: 194724 - DNA, 601 bp, Human; identical to SEQ ID NO: 91783

SEQ ID NO: 194725 - DNA, 601 bp, Human; identical to SEQ ID NO: 91784

SEQ ID NO: 194726 - DNA, 601 bp, Human; identical to SEQ ID NO: 91785

SEQ ID NO: 194727 - DNA, 601 bp, Human; identical to SEQ ID NO: 91786

SEQ ID NO: 194728 - DNA, 601 bp, Human; identical to SEQ ID NO: 91787

SEQ ID NO: 194729 - DNA, 601 bp, Human; identical to SEQ ID NO: 91788

SEQ ID NO: 194730 - DNA, 601 bp, Human; identical to SEQ ID NO: 91789

SEQ ID NO: 194731 - DNA, 601 bp, Human; identical to SEQ ID NO: 91790

SEQ ID NO: 194732 - DNA, 601 bp, Human; identical to SEQ ID NO: 91791

SEQ ID NO: 194733 - DNA, 601 bp, Human; identical to SEQ ID NO: 91792

SEQ ID NO: 194734 - DNA, 601 bp, Human; identical to SEQ ID NO: 91793

SEQ ID NO: 194735 - DNA, 601 bp, Human; identical to SEQ ID NO: 91794

SEQ ID NO: 194736 - DNA, 601 bp, Human; identical to SEQ ID NO: 91795

SEQ ID NO: 194737 - DNA, 601 bp, Human; identical to SEQ ID NO: 91796

SEQ ID NO: 194738 - DNA, 601 bp, Human; identical to SEQ ID NO: 91797

SEQ ID NO: 194739 - DNA, 601 bp, Human; identical to SEQ ID NO: 91798

SEQ ID NO: 194740 - DNA, 601 bp, Human; identical to SEQ ID NO: 91799

SEQ ID NO: 194741 - DNA, 601 bp, Human; identical to SEQ ID NO: 91800

SEQ ID NO: 194742 - DNA, 601 bp, Human; identical to SEQ ID NO: 91801

SEQ ID NO: 194743 - DNA, 601 bp, Human; identical to SEQ ID NO: 91802

SEQ ID NO: 194744 - DNA, 601 bp, Human; identical to SEQ ID NO: 91803

SEQ ID NO: 194745 - DNA, 601 bp, Human; identical to SEQ ID NO: 91804

SEQ ID NO: 194746 - DNA, 601 bp, Human; identical to SEQ ID NO: 91805

SEQ ID NO: 194747 - DNA, 601 bp, Human; identical to SEQ ID NO: 91806

SEQ ID NO: 194748 - DNA, 601 bp, Human; identical to SEQ ID NO: 91807

SEQ ID NO: 194749 - DNA, 601 bp, Human; identical to SEQ ID NO: 91808

SEQ ID NO: 194750 - DNA, 601 bp, Human; identical to SEQ ID NO: 91809

SEQ ID NO: 194751 - DNA, 601 bp, Human; identical to SEQ ID NO: 91810

SEQ ID NO: 194752 - DNA, 601 bp, Human; identical to SEQ ID NO: 91811

SEQ ID NO: 194753 - DNA, 601 bp, Human; identical to SEQ ID NO: 91812

SEQ ID NO: 194754 - DNA, 601 bp, Human; identical to SEQ ID NO: 91813

SEQ ID NO: 194755 - DNA, 601 bp, Human; identical to SEQ ID NO: 91814

SEQ ID NO: 194756 - DNA, 601 bp, Human; identical to SEQ ID NO: 91815

SEQ ID NO: 194757 - DNA, 601 bp, Human; identical to SEQ ID NO: 91816

SEQ ID NO: 194758 - DNA, 601 bp, Human; identical to SEQ ID NO: 91817

SEQ ID NO: 194759 - DNA, 601 bp, Human; identical to SEQ ID NO: 91818

SEQ ID NO: 194760 - DNA, 601 bp, Human; identical to SEQ ID NO: 91819

SEQ ID NO: 194761 - DNA, 601 bp, Human; identical to SEQ ID NO: 91820

SEQ ID NO: 194762 - DNA, 601 bp, Human; identical to SEQ ID NO: 91821

SEQ ID NO: 194763 - DNA, 601 bp, Human; identical to SEQ ID NO: 91822

SEQ ID NO: 194764 - DNA, 601 bp, Human; identical to SEQ ID NO: 91823

SEQ ID NO: 194765 - DNA, 601 bp, Human; identical to SEQ ID NO: 91824

SEQ ID NO: 194766 - DNA, 601 bp, Human; identical to SEQ ID NO: 91825

SEQ ID NO: 194767 - DNA, 601 bp, Human; identical to SEQ ID NO: 91826

SEQ ID NO: 194768 - DNA, 601 bp, Human; identical to SEQ ID NO: 91827

SEQ ID NO: 194769 - DNA, 601 bp, Human; identical to SEQ ID NO: 91828

SEQ ID NO: 194770 - DNA, 601 bp, Human; identical to SEQ ID NO: 91829

SEQ ID NO: 194771 - DNA, 601 bp, Human; identical to SEQ ID NO: 91830

SEQ ID NO: 194772 - DNA, 601 bp, Human; identical to SEQ ID NO: 91831

SEQ ID NO: 194773 - DNA, 601 bp, Human; identical to SEQ ID NO: 91832

SEQ ID NO: 194774 - DNA, 601 bp, Human; identical to SEQ ID NO: 91833

SEQ ID NO: 194775 - DNA, 601 bp, Human; identical to SEQ ID NO: 91834

SEQ ID NO: 194776 - DNA, 601 bp, Human; identical to SEQ ID NO: 91835

SEQ ID NO: 194777 - DNA, 601 bp, Human; identical to SEQ ID NO: 91836

SEQ ID NO: 194778 - DNA, 601 bp, Human; identical to SEQ ID NO: 91837

SEQ ID NO: 194779 - DNA, 601 bp, Human; identical to SEQ ID NO: 91838

SEQ ID NO: 194780 - DNA, 601 bp, Human; identical to SEQ ID NO: 91839

SEQ ID NO: 194781 - DNA, 601 bp, Human; identical to SEQ ID NO: 91840

SEQ ID NO: 194782 - DNA, 601 bp, Human; identical to SEQ ID NO: 91841

SEQ ID NO: 194783 - DNA, 601 bp, Human; identical to SEQ ID NO: 91842

SEQ ID NO: 194784 - DNA, 601 bp, Human; identical to SEQ ID NO: 91843

SEQ ID NO: 194785 - DNA, 601 bp, Human; identical to SEQ ID NO: 91844

SEQ ID NO: 194786 - DNA, 601 bp, Human; identical to SEQ ID NO: 91845

SEQ ID NO: 194787 - DNA, 601 bp, Human; identical to SEQ ID NO: 91846

SEQ ID NO: 194788 - DNA, 601 bp, Human; identical to SEQ ID NO: 91847

SEQ ID NO: 194789 - DNA, 601 bp, Human; identical to SEQ ID NO: 91848

SEQ ID NO: 194790 - DNA, 601 bp, Human; identical to SEQ ID NO: 91849

SEQ ID NO: 194791 - DNA, 601 bp, Human; identical to SEQ ID NO: 91850

SEQ ID NO: 194792 - DNA, 601 bp, Human; identical to SEQ ID NO: 91851

SEQ ID NO: 194793 - DNA, 601 bp, Human; identical to SEQ ID NO: 91852

SEQ ID NO: 194794 - DNA, 601 bp, Human; identical to SEQ ID NO: 91853

SEQ ID NO: 194795 - DNA, 601 bp, Human; identical to SEQ ID NO: 91854

SEQ ID NO: 194796 - DNA, 601 bp, Human; identical to SEQ ID NO: 91855

SEQ ID NO: 194797 - DNA, 601 bp, Human; identical to SEQ ID NO: 91856

SEQ ID NO: 194798 - DNA, 601 bp, Human; identical to SEQ ID NO: 91857

SEQ ID NO: 194799 - DNA, 601 bp, Human; identical to SEQ ID NO: 91858

SEQ ID NO: 194800 - DNA, 601 bp, Human; identical to SEQ ID NO: 91859

SEQ ID NO: 194801 - DNA, 601 bp, Human; identical to SEQ ID NO: 91860

SEQ ID NO: 194802 - DNA, 601 bp, Human; identical to SEQ ID NO: 91861

SEQ ID NO: 194803 - DNA, 601 bp, Human; identical to SEQ ID NO: 91862

SEQ ID NO: 194804 - DNA, 601 bp, Human; identical to SEQ ID NO: 91863

SEQ ID NO: 194805 - DNA, 601 bp, Human; identical to SEQ ID NO: 91864

SEQ ID NO: 194806 - DNA, 601 bp, Human; identical to SEQ ID NO: 91865

SEQ ID NO: 194807 - DNA, 601 bp, Human; identical to SEQ ID NO: 91866

SEQ ID NO: 194808 - DNA, 601 bp, Human; identical to SEQ ID NO: 40404

SEQ ID NO: 194809 - DNA, 601 bp, Human; identical to SEQ ID NO: 40405

SEQ ID NO: 194810 - DNA, 601 bp, Human; identical to SEQ ID NO: 91869

SEQ ID NO: 194811 - DNA, 601 bp, Human; identical to SEQ ID NO: 91870

SEQ ID NO: 194812 - DNA, 601 bp, Human; identical to SEQ ID NO: 91871

SEQ ID NO: 194813 - DNA, 601 bp, Human; identical to SEQ ID NO: 91872

SEQ ID NO: 194814 - DNA, 601 bp, Human; identical to SEQ ID NO: 91873

SEQ ID NO: 194815 - DNA, 601 bp, Human; identical to SEQ ID NO: 91874

SEQ ID NO: 194816 - DNA, 601 bp, Human; identical to SEQ ID NO: 91875

SEQ ID NO: 194817 - DNA, 601 bp, Human; identical to SEQ ID NO: 91876

SEQ ID NO: 194818 - DNA, 601 bp, Human; identical to SEQ ID NO: 91877

SEQ ID NO: 194819 - DNA, 601 bp, Human; identical to SEQ ID NO: 91878

SEQ ID NO: 194820 - DNA, 601 bp, Human; identical to SEQ ID NO: 91879

SEQ ID NO: 194821 - DNA, 601 bp, Human; identical to SEQ ID NO: 91880

SEQ ID NO: 194822 - DNA, 601 bp, Human; identical to SEQ ID NO: 91881

SEQ ID NO: 194823 - DNA, 601 bp, Human; identical to SEQ ID NO: 91882

SEQ ID NO: 194824 - DNA, 601 bp, Human; identical to SEQ ID NO: 91883

SEQ ID NO: 194825 - DNA, 601 bp, Human; identical to SEQ ID NO: 91884

SEQ ID NO: 194826 - DNA, 601 bp, Human; identical to SEQ ID NO: 91885

SEQ ID NO: 194827 - DNA, 601 bp, Human; identical to SEQ ID NO: 91886

SEQ ID NO: 194828 - DNA, 601 bp, Human; identical to SEQ ID NO: 91887

SEQ ID NO: 194829 - DNA, 601 bp, Human; identical to SEQ ID NO: 91888

SEQ ID NO: 194830 - DNA, 601 bp, Human; identical to SEQ ID NO: 91889

SEQ ID NO: 194831 - DNA, 601 bp, Human; identical to SEQ ID NO: 91890

SEQ ID NO: 194832 - DNA, 601 bp, Human; identical to SEQ ID NO: 91891

SEQ ID NO: 194833 - DNA, 601 bp, Human; identical to SEQ ID NO: 91892

SEQ ID NO: 194834 - DNA, 601 bp, Human; identical to SEQ ID NO: 91893

SEQ ID NO: 194835 - DNA, 601 bp, Human; identical to SEQ ID NO: 91894

SEQ ID NO: 194836 - DNA, 601 bp, Human; identical to SEQ ID NO: 91895

SEQ ID NO: 194837 - DNA, 601 bp, Human; identical to SEQ ID NO: 91896

SEQ ID NO: 194838 - DNA, 601 bp, Human; identical to SEQ ID NO: 91897

SEQ ID NO: 194839 - DNA, 601 bp, Human; identical to SEQ ID NO: 91898

SEQ ID NO: 194840 - DNA, 601 bp, Human; identical to SEQ ID NO: 91899

SEQ ID NO: 194841 - DNA, 601 bp, Human; identical to SEQ ID NO: 91900

SEQ ID NO: 194842 - DNA, 601 bp, Human; identical to SEQ ID NO: 91901

SEQ ID NO: 194843 - DNA, 601 bp, Human; identical to SEQ ID NO: 91902

SEQ ID NO: 194844 - DNA, 601 bp, Human; identical to SEQ ID NO: 91903

SEQ ID NO: 194845 - DNA, 601 bp, Human; identical to SEQ ID NO: 91904

SEQ ID NO: 194846 - DNA, 601 bp, Human; identical to SEQ ID NO: 91905

SEQ ID NO: 194847 - DNA, 601 bp, Human; identical to SEQ ID NO: 91906

SEQ ID NO: 194848 - DNA, 601 bp, Human; identical to SEQ ID NO: 91907

SEQ ID NO: 194849 - DNA, 601 bp, Human; identical to SEQ ID NO: 91908

SEQ ID NO: 194850 - DNA, 601 bp, Human; identical to SEQ ID NO: 91909

SEQ ID NO: 194851 - DNA, 601 bp, Human; identical to SEQ ID NO: 91910

SEQ ID NO: 194852 - DNA, 601 bp, Human; identical to SEQ ID NO: 91911

SEQ ID NO: 194853 - DNA, 601 bp, Human; identical to SEQ ID NO: 91912

SEQ ID NO: 194854 - DNA, 601 bp, Human; identical to SEQ ID NO: 91913

SEQ ID NO: 194855 - DNA, 601 bp, Human; identical to SEQ ID NO: 91914

SEQ ID NO: 194856 - DNA, 601 bp, Human; identical to SEQ ID NO: 91915

SEQ ID NO: 194857 - DNA, 601 bp, Human; identical to SEQ ID NO: 91916

SEQ ID NO: 194858 - DNA, 601 bp, Human; identical to SEQ ID NO: 91917

SEQ ID NO: 194859 - DNA, 601 bp, Human; identical to SEQ ID NO: 91918

SEQ ID NO: 194860 - DNA, 601 bp, Human; identical to SEQ ID NO: 91919

SEQ ID NO: 194861 - DNA, 601 bp, Human; identical to SEQ ID NO: 91920

SEQ ID NO: 194862 - DNA, 601 bp, Human; identical to SEQ ID NO: 91921

SEQ ID NO: 194863 - DNA, 601 bp, Human; identical to SEQ ID NO: 91922

SEQ ID NO: 194864 - DNA, 601 bp, Human; identical to SEQ ID NO: 91923

SEQ ID NO: 194865 - DNA, 601 bp, Human; identical to SEQ ID NO: 91924

SEQ ID NO: 194866 - DNA, 601 bp, Human; identical to SEQ ID NO: 91925

SEQ ID NO: 194867 - DNA, 601 bp, Human; identical to SEQ ID NO: 91926

SEQ ID NO: 194868 - DNA, 601 bp, Human; identical to SEQ ID NO: 91927

SEQ ID NO: 194869 - DNA, 601 bp, Human; identical to SEQ ID NO: 91928

SEQ ID NO: 194870 - DNA, 601 bp, Human; identical to SEQ ID NO: 91929

SEQ ID NO: 194871 - DNA, 601 bp, Human; identical to SEQ ID NO: 91930

SEQ ID NO: 194872 - DNA, 601 bp, Human; identical to SEQ ID NO: 91931

SEQ ID NO: 194873 - DNA, 601 bp, Human; identical to SEQ ID NO: 91932

SEQ ID NO: 194874 - DNA, 601 bp, Human; identical to SEQ ID NO: 91933

SEQ ID NO: 194875 - DNA, 601 bp, Human; identical to SEQ ID NO: 40406

SEQ ID NO: 194876 - DNA, 601 bp, Human; identical to SEQ ID NO: 40407

SEQ ID NO: 194877 - DNA, 601 bp, Human; identical to SEQ ID NO: 40408

SEQ ID NO: 194878 - DNA, 601 bp, Human; identical to SEQ ID NO: 40409

SEQ ID NO: 194879 - DNA, 601 bp, Human; identical to SEQ ID NO: 40410

SEQ ID NO: 194880 - DNA, 601 bp, Human; identical to SEQ ID NO: 40411

SEQ ID NO: 194881 - DNA, 601 bp, Human; identical to SEQ ID NO: 40412

SEQ ID NO: 194882 - DNA, 601 bp, Human; identical to SEQ ID NO: 40413

SEQ ID NO: 194883 - DNA, 601 bp, Human; identical to SEQ ID NO: 40414

SEQ ID NO: 194884 - DNA, 601 bp, Human; identical to SEQ ID NO: 40415

SEQ ID NO: 194885 - DNA, 601 bp, Human; identical to SEQ ID NO: 40416

SEQ ID NO: 194886 - DNA, 601 bp, Human; identical to SEQ ID NO: 40417

SEQ ID NO: 194887 - DNA, 601 bp, Human; identical to SEQ ID NO: 40418

SEQ ID NO: 194888 - DNA, 601 bp, Human; identical to SEQ ID NO: 40419

SEQ ID NO: 194889 - DNA, 601 bp, Human
ggaaccaggggaggctgagcagagccccagctctgcccctcagtcagcacaactatctttaatacataaaaggcaatttcacttactgggctaaatgcagaggatcctaccaccaaaatgagtgaagggctgcggccaggtgggtggtctctgtgaggtggggacacttcggttgcatctgctcactgtccttaccagacctccctctgccccacttctaccttgcaggaaaagcagggggcaatcagctggggtgcaggccagccacacacacacatatgggggccccaccagctcctgytcctgctcctgctccctgaaccagcatgcctgtgcagggcctgcctcccattccctctgcctcctccctgcctggggtgggtgcggcgggcggggagccatgcttagctggccttgttctccaactcagcttttccgaagctccccctggggccacggcagatgttctgccccgctccttctgctgagggcctgtgggaaggggaatagctgggtggttctggcctcactgggcccccagcaacttaccaacaactcacttcggacttctaacccttcattaagtctgggcacatcttaa

SEQ ID NO: 194890 - DNA, 601 bp, Human
tggtggccgcaggaaccaggagccaggaggatggaaggagccacgcagtggtcctcctgtcccaactgggcaagacggtgcctaacctggaaatggaagctgggcatgaccactcagggtccttgcgggaaagggtgggagagaagatgattgctttccagatgtaaaatcacagcgtgagagaacagtgatgcacaggacagggaaacatacagacccacattcagggattctgacagcagcccgggaggagcccgtcttccacgttcccccaacatccccacaccgaatcctgatctargtcggttccagcctgtgctcctcgggaaccaggggaggctgagcagagccccagctctgcccctcagtcagcacaactatctttaatacataaaaggcaatttcacttactgggctaaatgcagaggatcctaccaccaaaatgagtgaagggctgcggccaggtgggtggtctctgtgaggtggggacacttcggttgcatctgctcactgtccttaccagacctccctctgccccacttctaccttgcaggaaaagcagggggcaatcagctggggtgcaggccagccacacacacac

SEQ ID NO: 194891 - DNA, 601 bp, Human
tgctggcaccctgaccttgggcttcccagcctccaggactgcgaagaacaaggctctgttgtgtaagccacccagtctgcggtatttctgttagagcagccgaagctgaggaagatggagtgtgagctgtcctggcaccgtggaaggctgcggccggggcagactctaagtcactggtggccgcaggaaccaggagccaggaggatggaaggagccacgcagtggtcctcctgtcccaactgggcaagacggtgcctaacctggaaatggaagctgggcatgaccactcagggtccttgcrggaaagggtgggagagaagatgattgctttccagatgtaaaatcacagcgtgagagaacagtgatgcacaggacagggaaacatacagacccacattcagggattctgacagcagcccgggaggagcccgtcttccacgttcccccaacatccccacaccgaatcctgatctaggtcggttccagcctgtgctcctcgggaaccaggggaggctgagcagagccccagctctgcccctcagtcagcacaactatctttaatacataaaaggcaatttcacttactgggctaaatgcagag

SEQ ID NO: 194892 - DNA, 601 bp, Human
cagtgtgggggccttcgggaagcgttaggtgatggccctcatgagtgggactgatgtcctcatgagaagagacctgagagagatgccctctctccctgccatgtgaggagaccacaggaagatggcaagccaggaagagggtcctcccagaagccaaccttgctggcaccctgaccttgggcttcccagcctccaggactgcgaagaacaaggctctgttgtgtaagccacccagtctgcggtatttctgttagagcagccgaagctgaggaagatggagtgtgagctgtcctggcaccgyggaaggctgcggccggggcagactctaagtcactggtggccgcaggaaccaggagccaggaggatggaaggagccacgcagtggtcctcctgtcccaactgggcaagacggtgcctaacctggaaatggaagctgggcatgaccactcagggtccttgcgggaaagggtgggagagaagatgattgctttccagatgtaaaatcacagcgtgagagaacagtgatgcacaggacagggaaacatacagacccacattcagggattctgacagcagcccgggaggagcccgtcttccacgt

SEQ ID NO: 194893 - DNA, 601 bp, Human
cctcccgtgcttccttcctggtcctcctcgctcgggcaagccccacctagcgcccacctgtgcccacatctccccttccttcctagcaaaggcccctcattctcatgccttgctaaaaccctcccagacctgcctttgtggcagtctgagccacgtggggactgcagaggccgccactctggattctccctcccagacggaggggggtactgtgggcaggtggtcaagggctcctcccatcaggctgggccaacaggaactggctggggccaggcaggcctggctcccggcccctgggggktcctagccatctctttcctgggcaccattacctcatctcttgcccccaaagctcccctcactcgagcatggaggggaggggaacaacccagagaaatgctggctggcgttcccctcagccagtggcgcaggtggggttgcaggcgaggaggggcccaggtaaggcagtgctgtggcctgagtgcgtgtgtcccctcaaattcatatggtgaagccctaacccccagtgtgggggccttcgggaagcgttaggtgatggccctcatgagtgggactgatgtcctcatgagaagagacctga

SEQ ID NO: 194894 - DNA, 601 bp, Human
cgtcctcctgtgtccatgcctgagctgctcccctcccgtgcttccttcctggtcctcctcgctcgggcaagccccacctagcgcccacctgtgcccacatctccccttccttcctagcaaaggcccctcattctcatgccttgctaaaaccctcccagacctgcctttgtggcagtctgagccacgtggggactgcagaggccgccactctggattctccctcccagacggaggggggtactgtgggcaggtggtcaagggctcctcccatcaggctgggccaacaggaactggctggggycaggcaggcctggctcccggcccctggggggtcctagccatctctttcctgggcaccattacctcatctcttgcccccaaagctcccctcactcgagcatggaggggaggggaacaacccagagaaatgctggctggcgttcccctcagccagtggcgcaggtggggttgcaggcgaggaggggcccaggtaaggcagtgctgtggcctgagtgcgtgtgtcccctcaaattcatatggtgaagccctaacccccagtgtgggggccttcgggaagcgttaggtgatggccctcatgagt

SEQ ID NO: 194895 - DNA, 601 bp, Human
aagatctgagggaaatggccagcacacagcctgtattctgcaatgaccctagatgagttggcacagcggtgtggcgagtatttctggaagctactattacacctggacagacacaatcatttaactctacttgtaagagacagaatcatggcaataagccaaaacaaatgccctcaatccattttctctgtagccaaagcagcaaaatgcccaaggccattctaatggcacccacaggaggggaagtgtatcagtggcacccacgggaggagaattgtatcaatgagaagcaggaatgaaragagaagtgctgttaatcaagtatggttaaaatatcttatttttgcaaaatttacaaaaatgtgaccatgtaaacacatggcttggcctctcccagggtctcggaaggggctcctgtgagcaagggaccccaaagcgtaagcatcatgagcttcatggtaaatcgacttctgcttccctcccaaagcccctccatggctccccactcgcagcaggacaagccctgtggctggcatcaaagactcggtacgactggcctctacttacgcctcagggtcaccttcccccagcacagcagcac

SEQ ID NO: 194896 - DNA, 601 bp, Human
cctttctaaagaaatatccatgttggatctgtgtttaaagtactccatctataaaacaaacctaaaaatcaaacaaaatactgcccatatagaagtagtgacaacctccggtaccgctgaggcacctttttctgcaaagatctgagggaaatggccagcacacagcctgtattctgcaatgaccctagatgagttggcacagcggtgtggcgagtatttctggaagctactattacacctggacagacacaatcatttaactctacttgtaagagacagaatcatggcaataagccaaaamaaatgccctcaatccattttctctgtagccaaagcagcaaaatgcccaaggccattctaatggcacccacaggaggggaagtgtatcagtggcacccacgggaggagaattgtatcaatgagaagcaggaatgaaaagagaagtgctgttaatcaagtatggttaaaatatcttatttttgcaaaatttacaaaaatgtgaccatgtaaacacatggcttggcctctcccagggtctcggaaggggctcctgtgagcaagggaccccaaagcgtaagcatcatgagcttcatggtaaatc

SEQ ID NO: 194897 - DNA, 601 bp, Human
gatatgtgtctcttcctcctaatgagcaactgcttttggtttgatataaaacctttcttttttggtgacaatgagctttttgaagtcagagttattattttttttatttccttgctcattttctactactttagtttcatatcccattaatttttatctgaattttctttcctttctaataaataaattagaaaatgataaaaggtatatttgatacatatatccaaatcacagtctgtcatttcttccttattttatggaaacattcccaagccactttcaaaacggaagtgaaaacagygccttcagacgtaaccaacatttctgcatctcgctttcattgcggtttctcttctgtctttgaaattttttagagcccttcatttattgtcatccatatgttgtgaggctaggctaacttttatttatttatgttttatttatttatcgttttgagatggagtctcactctgtcgtccaggctggagtgcagtggcatgatcttgactcactgcaagctccacctcccgggttcaagtgattctcctgcctcagcctccccagtagctaggactataggcatgcgccaccatgcctggct

SEQ ID NO: 194898 - DNA, 601 bp, Human
ggccctggcatattgagggaaattctttctttttaaaaaatgatcagtactttaaagaagttatgggtgacgccatctgaacatttaggatgatgacatttggaggaggtgctctctggtttccgtccttgatgtggttttcagggcatttcaagttttctctgtgggagcttgactttaagacactctttggatgagcaacgctcagtagcagttgccgtggacgccctgactgcagtggcagcgttcgcagctccctggcgtctttgatgttgtcaacatttcatggcaaatcagaaaratgtctgaaccattttcctatgtgttcatcagattcactcctcttcgttaatgagactgtcaaacgctccaaggcctgttaacttctttgatatgtgtctcttcctcctaatgagcaactgcttttggtttgatataaaacctttcttttttggtgacaatgagctttttgaagtcagagttattattttttttatttccttgctcattttctactactttagtttcatatcccattaatttttatctgaattttctttcctttctaataaataaattagaaaatgataaaaggtatatt

SEQ ID NO: 194899 - DNA, 601 bp, Human
gcttcagcctcctgagtagttgggattataggtgcccaccacaaggcccagctaatttttttgtatttttagcagagacagggtttcaccatgttggccaggctggtctcaaactcctgacctcaggtgatcctcctgcctcagcctcccaaactgctgggattacaggcatgagccactgcacccggcctgtacactttaaaaagtgaatttaaatatagatctcaccttattaaagctgttagggaaaaaaaccaataccaaccaaacaggcagcagatggagttggccagcacttggscctggcatattgagggaaattctttctttttaaaaaatgatcagtactttaaagaagttatgggtgacgccatctgaacatttaggatgatgacatttggaggaggtgctctctggtttccgtccttgatgtggttttcagggcatttcaagttttctctgtgggagcttgactttaagacactctttggatgagcaacgctcagtagcagttgccgtggacgccctgactgcagtggcagcgttcgcagctccctggcgtctttgatgttgtcaacatttcatggcaaatcagaaagat

SEQ ID NO: 194900 - DNA, 601 bp, Human
tggattgaggtgactactaaagggtttggaacttttcagagtgacaaaaatgttccagcgcttgtttgttgtgatggctgtaaaactctatgaatacactgaaaatcactgaattgtacactctcttttacttatttatttatttttgagacgaagtttcgctcttgttgtcccggctggagcgaagtggcgagatctcggctcaccgcaacctctgcttcccgggttcaagtgattctcctgcttcagcctcctgagtagttgggattataggtgcccaccacaaggcccagctaatttktttgtatttttagcagagacagggtttcaccatgttggccaggctggtctcaaactcctgacctcaggtgatcctcctgcctcagcctcccaaactgctgggattacaggcatgagccactgcacccggcctgtacactttaaaaagtgaatttaaatatagatctcaccttattaaagctgttagggaaaaaaaccaataccaaccaaacaggcagcagatggagttggccagcacttggccctggcatattgagggaaattctttctttttaaaaaatgatcagtactttaaagaagt

SEQ ID NO: 194901 - DNA, 601 bp, Human
ccaagtgaaagacgccaggcgcaaaatgtcccatgttgtatgattccattgatatgaaatgtccagaattggaaaatcgataaagacagcaagaggatgagtggctacgagtggctatctggagttgggcgagagtaggatggattgaggtgactactaaagggtttggaacttttcagagtgacaaaaatgttccagcgcttgtttgttgtgatggctgtaaaactctatgaatacactgaaaatcactgaattgtacactctcttttacttatttatttatttttgagacgaagtttckctcttgttgtcccggctggagcgaagtggcgagatctcggctcaccgcaacctctgcttcccgggttcaagtgattctcctgcttcagcctcctgagtagttgggattataggtgcccaccacaaggcccagctaatttttttgtatttttagcagagacagggtttcaccatgttggccaggctggtctcaaactcctgacctcaggtgatcctcctgcctcagcctcccaaactgctgggattacaggcatgagccactgcacccggcctgtacactttaaaaagtgaatttaaatat

SEQ ID NO: 194902 - DNA, 601 bp, Human
tttgcagaccacttacactggtgagtgtgataacagacttgtatccagaataaataaaaaactcttaggattcaataataaaaatataaataactccatgaaaaaataagcaaaggatctaaatagacatttatacaaaaaatatatacaaattgccattaagcacatgaaaagacggtcatcataggtcactagggaaatacaaatcaaaaccccaatgagatatatcacttcacatgcactaggattggtataacaaataaaataacaagttttggggaggatatggagaaatctgaakcatcattgccagttggaatgtaaaacaggctgctttgggaaactggcagttcctcaaaatgtcaaacatggagttaccataaaatccaatgattccatttctaggtgtacatccaagaaaaacgacccatgcacgcaatactttgtacacgaatgtttgtgcggtatttcccatcattaccgaaaggtggaaacaacccaaatgtccatcaactaataaatgatgaatacccacacagtggattagtattcagcaacaggaaggaatgcagggctgctgcacactacaacagggatgagc

SEQ ID NO: 194903 - DNA, 601 bp, Human
aggacagacaaatataccgacggaatagaacaaaagcctagaactaaacctttacatttgataagttaaactttgacaattcaatggaaaaggaatagtctcttcaacgaatggttctgagacaactggatattcacatgcaaaagaatgacgttggacatcttcctcacacttacacaaaaattaactcaaaaatggatcacagatgtcaatgtaagagctgaaactctgagaataaaacataggagtaaatcttcttgacctaagtaatggtttctcaaatacaacaccaaaagcacargtgataaaagtaaaaatagataaattagacttcatcaaaattaaacacttttgcacctcaatgatgccatcacgaaagtgaaaagacaacccacagaatgggaggaaatatttgcagaccacttacactggtgagtgtgataacagacttgtatccagaataaataaaaaactcttaggattcaataataaaaatataaataactccatgaaaaaataagcaaaggatctaaatagacatttatacaaaaaatatatacaaattgccattaagcacatgaaaagacggtcatcataggtc

SEQ ID NO: 194904 - DNA, 601 bp, Human
accttagtaataaattgaacaaaaggaatgcaaaacgtgtccactaaaaattacaatacatcattgaaagaagttcaagttctaagtaaatggaaagacatctcaatgttcattgatcagtgttaaaatggaaatactttcacactgatctacaggttcaacataattcctatcaaaatgcagactagaattttgcaaagttgagaagctgctcctaaaattcatatggaaagtcacaggatgtagaatagccaaaataatattgaaaaaagagcaaagtgggaagacacttcaccatttygaagcttactattaaactacagtaatcaagacagtgtatccctggcataaggacagacaaatataccgacggaatagaacaaaagcctagaactaaacctttacatttgataagttaaactttgacaattcaatggaaaaggaatagtctcttcaacgaatggttctgagacaactggatattcacatgcaaaagaatgacgttggacatcttcctcacacttacacaaaaattaactcaaaaatggatcacagatgtcaatgtaagagctgaaactctgagaataaaacataggagtaa

SEQ ID NO: 194905 - DNA, 601 bp, Human
aatggcagttaaaacagtatattatctttattttcagacaaaatgatcttctgtatagaaaatcccaaagaatcccctacaaaacttaaagctaacaaacaaattaactgaggtttcaggaaacaagaccaatatacaaaaaaatcaactgcatttctataaactagtaataaatgatttaaaaatgaaattaagaaaataactccatttacaatagcaccaaaaagaaaaaaagaaccttagtaataaattgaacaaaaggaatgcaaaacgtgtccactaaaaattacaatacatcatygaaagaagttcaagttctaagtaaatggaaagacatctcaatgttcattgatcagtgttaaaatggaaatactttcacactgatctacaggttcaacataattcctatcaaaatgcagactagaattttgcaaagttgagaagctgctcctaaaattcatatggaaagtcacaggatgtagaatagccaaaataatattgaaaaaagagcaaagtgggaagacacttcaccatttcgaagcttactattaaactacagtaatcaagacagtgtatccctggcataaggacagacaaatat

SEQ ID NO: 194906 - DNA, 601 bp, Human
tagggcacaagctctgctccaggtacaccaggccaagaatggtggacctgatagcccctccccagattgcttatagggtagaggttccatgttgaaaggggcaagcccagaagactagtggctaccattcccatctagtgagcagtctgtaggccaggaatgtcactctgggagaagcaggccactgaccctgctcctttagctctggctcagtggtgcaggggcctgcccagagggagagtcagaacagaaggcttcacagctctccctaaggggactgactttgatctgaaacagagcrtggaggatgttcatgtctaagggcactgtcaaaaacaacaagggtcttagcagtgagcaattaagaggaggccaatggtcctaatagcaacaaacaaaatgttaaaccagctacaggttgagtgtcccttatctgaaatgctcggaaccagaagcgtttggaaccagaagtgtttcggatttcagattttcagattaaggatgctcaacctgtagaagttaaacagacagaaccagggacaaagacagctaagagccctcctgaaggtctcaatacacctcagatactggcaacaccctg

SEQ ID NO: 194907 - DNA, 601 bp, Human
ctcaagaaaatctattaaatcttggtaagaaaagcaaaagtctatggcattggagccacagccctcccccattcctgccctagctcagtgtgacagaagctttactgccaagaagacggggctgcctctactccaagctcccggtctgaggctacagtttcatactgagaaacccaggccactggtgtcatccctctcaactctgttgcagagtctctctctggtgggatggccaagaggcctggggcccccttcccccacccaggccccactcatagggcacaagctctgctccaggtayaccaggccaagaatggtggacctgatagcccctccccagattgcttatagggtagaggttccatgttgaaaggggcaagcccagaagactagtggctaccattcccatctagtgagcagtctgtaggccaggaatgtcactctgggagaagcaggccactgaccctgctcctttagctctggctcagtggtgcaggggcctgcccagagggagagtcagaacagaaggcttcacagctctccctaaggggactgactttgatctgaaacagagcgtggaggatgttcatgtctaagggca

SEQ ID NO: 194908 - DNA, 601 bp, Human
gttggagtgcagtgacgatcttggctcactgcaacctccgcctcctgggttcaagcgattctcttgcctcagcctcccgagtagctgggattacaggtgtccaccaccacccccagctaatttttgcattttttttttttttatttttagtagacacagggttttgccatgttggccaggctggtctcgaactcctgacctcaggtgatccacctgcctcagccttccaaagtgctaggattacaggcgtgagccaccgcgcccggccgactgcatactctttaacccttctttgtatgayctaattttgtagcactgtttccacaaagagaacagaaagagaacgcagccattccttggcaaactcttctcagcaaaccattcctcagcaaattctttctgtaaaagggccagagagtaactattgtagactttgcaggctatataatctctgttgcaattaatcaattctgccatcagagcttgaaagcagctatagacaacctataaatgaatggacatggctgtgttccttattggaactttattttgtaaactttatttacaaaaacaggcagcaaacagaaactttgaatggaag

SEQ ID NO: 194909 - DNA, 601 bp, Human
tcacacaaaaacgttttaaaactgacaatgaccaaacaaccaaaaaacagagaacaaggacttctaatacattgactgacagaacttttccttcagttccgactgcatgctctttttttttttttttttttgagacagagtctcactctgtccccccaggttggagtgcagtgacgatcttggctcactgcaacctccgcctcctgggttcaagcgattctcttgcctcagcctcccgagtagctgggattacaggtgtccaccaccacccccagctaatttttgcattttttttttttttatttttagtagacacagggttttgccatgttggccaggctggtctcgaactcctgacctcaggtgatccacctgcctcagccttccaaagtgctaggattacaggcgtgagccaccgcgcccggccgactgcatactctttaacccttctttgtatgacctaattttgtagcactgtttccacaaagagaacagaaagagaacgcagccattccttggcaaactcttctcagcaaaccattcctcagcaaattctttctgtaaaagggccagagagtaactattgtagactttgcaggct

SEQ ID NO: 194910 - DNA, 601 bp, Human
gagaaaatacatcacacaaaaacgttttaaaactgacaatgaccaaacaaccaaaaaacagagaacaaggacttctaatacattgactgacagaacttttccttcagttccgactgcatgctctttttttttttttttttttgagacagagtctcactctgtccccccaggttggagtgcagtgacgatcttggctcactgcaacctccgcctcctgggttcaagcgattctcttgcctcagcctcccgagtagctgggattacaggtgtccaccaccacccccagctaatttttgcattytttttttttttatttttagtagacacagggttttgccatgttggccaggctggtctcgaactcctgacctcaggtgatccacctgcctcagccttccaaagtgctaggattacaggcgtgagccaccgcgcccggccgactgcatactctttaacccttctttgtatgacctaattttgtagcactgtttccacaaagagaacagaaagagaacgcagccattccttggcaaactcttctcagcaaaccattcctcagcaaattctttctgtaaaagggccagagagtaactattgtaga

SEQ ID NO: 194911 - DNA, 601 bp, Human
ctggcatgtaggaaaaatgattccacatcttaatctgatcacagtgctctcattcctctagggggaggaagcgtctacagtttaggggacccactttaagaagaagattgcaaaattaaagaattaaattaggtgcaaaatgggttattgacttgaaatgagaaaatacatcacacaaaaacgttttaaaactgacaatgaccaaacaaccaaaaaacagagaacaaggacttctaatacattgactgacagaacttttccttcagttccgactgcatgctctttttttttttttttttttgagacagagtctcactctgtccccccaggttggagtgcagtgacgatcttggctcactgcaacctccgcctcctgggttcaagcgattctcttgcctcagcctcccgagtagctgggattacaggtgtccaccaccacccccagctaatttttgcattttttttttttttatttttagtagacacagggttttgccatgttggccaggctggtctcgaactcctgacctcaggtgatccacctgcctcagccttccaaagtgctaggattacaggcgtgagccaccgcgcccggccgact

SEQ ID NO: 194912 - DNA, 601 bp, Human
agaactggtgtgcagccacagggccctccaggacagggctggctggagagggtctcctggaccctcagctgccactcagcaaggccagggggacatggggccaactcactgtgggttgtcacactggcgggtcctgaacttcacgcccgtgccacaggtacgtgagcaggagccaaacggactccaagcgccccagctgccgtcccgtttgaggatgtcaggtgtcagccagatgcagtgtcctttaaaacaatgctgaaagacaggaagccagtccctccactcaccctcacaccgggcygtggggacagtcctgcgctctgcagcctgcagtgtctgggacacgtcctggccccactctggggcacagggggagctcaccctcctcgcccctagatgctcagagcccccagaagacaggcctcattggccagaggcaataagaggcacagtgaggggctggcctgccctgcctcccgcttgctgacccaccctcctgccttctagcagctctgtgtcccctcagctggaagctgcaccacatgacgccgccaggatagatgcctcctgggtgcccacacacagcccatttataaagata

SEQ ID NO: 194913 - DNA, 601 bp, Human
ggcggggcagcctgccctgcacctctccagaactggtgtgcagccacagggccctccaggacagggctggctggagagggtctcctggaccctcagctgccactcagcaaggccagggggacatggggccaactcactgtgggttgtcacactggcgggtcctgaacttcacgcccgtgccacaggtacgtgagcaggagccaaacggactccaagcgccccagctgccgtcccgtttgaggatgtcaggtgtcagccagatgcagtgtcctttaaaacaatgctgaaagacaggaagccrgtccctccactcaccctcacaccgggccgtggggacagtcctgcgctctgcagcctgcagtgtctgggacacgtcctggccccactctggggcacagggggagctcaccctcctcgcccctagatgctcagagcccccagaagacaggcctcattggccagaggcaataagaggcacagtgaggggctggcctgccctgcctcccgcttgctgacccaccctcctgccttctagcagctctgtgtcccctcagctggaagctgcaccacatgacgccgccaggatagatgcctcctgggt

SEQ ID NO: 194914 - DNA, 601 bp, Human
attacagattgtcaatattttcaggcaaatcaaaatctttaaaataccagacaggccaaaaaggaaagaccgaagctctgtgtgtctaagcagctgcagggcctgcggcgtaagagcccgctgcgcaggtgggagacgggggtaacgctgatgtttgtggagggttctccctccatgccagcccccccgggacactccctgggtgaggccagggtgagcgttcaggcaggaggagacaggcagtggaggagggagaggagggtgtggatgagaaagtggctgcgggctgaggagggagcaygggcccgggagatatttacggggtgtgtgggggtgaggtgggaggaatgagaaggggcaggaggacagcacagggcatggggcctgcgtggcgggtggggctgaggtatagctgagcatggggatgcagctggcatgggccggctctacaggttgtccctcccctgggcagccagacactgatgacaaatcccgaccctgccctcacctggctgcaaacagctgcccaggtgctagcatcgggggggctgagagaccacccccgcttacccccatttccccagctcggtcctccctcctc

SEQ ID NO: 194915 - DNA, 601 bp, Human
ggccgcagaggccggagcgcagcagccgggacgcacccggagccctgcccgccagctggtaactgggcccggctgtgcatctgtgatgcccaatttggaggctggaaatctgttttgtttgtttttctaatgtgaaattacagattgtcaatattttcaggcaaatcaaaatctttaaaataccagacaggccaaaaaggaaagaccgaagctctgtgtgtctaagcagctgcagggcctgcggcgtaagagcccgctgcgcaggtgggagacgggggtaacgctgatgtttgtggagggytctccctccatgccagcccccccgggacactccctgggtgaggccagggtgagcgttcaggcaggaggagacaggcagtggaggagggagaggagggtgtggatgagaaagtggctgcgggctgaggagggagcacgggcccgggagatatttacggggtgtgtgggggtgaggtgggaggaatgagaaggggcaggaggacagcacagggcatggggcctgcgtggcgggtggggctgaggtatagctgagcatggggatgcagctggcatgggccggctctacaggttgtccctcccc

SEQ ID NO: 194916 - DNA, 601 bp, Human
ttcgcttcactgggaacagcaccaacccacacactgcctcttgaggttctaaatgcccagcaatctctttccgagtctggcgtaaaagccccaggggtgcttgaggaggggccacggggctccctgtctgcttctggccgggagggcagcctggagcctggggcaggaggacagcaggggtaggagagggctccatgcacgagcgtgttcacacgtgctgctgagggaggctgtcccactgcgggatccctccgcggagccgtgactgcgggtcctctctggctccgcagggtccagctcrggcctggccagagcaaggagagcagcccgagtgaacaggacccaggagcggccgcagaggccggagcgcagcagccgggacgcacccggagccctgcccgccagctggtaactgggcccggctgtgcatctgtgatgcccaatttggaggctggaaatctgttttgtttgtttttctaatgtgaaattacagattgtcaatattttcaggcaaatcaaaatctttaaaataccagacaggccaaaaaggaaagaccgaagctctgtgtgtctaagcagctgcagggcctgcggcgtaaga

SEQ ID NO: 194917 - DNA, 601 bp, Human
ccagagtcccggtgctgcagttctcagcaagtgtcttggcacaaagcagacgcatcacggccgctgggttttctccctgtggagaaggcgggctgcgtttctgcaacgtcttcgcttcactgggaacagcaccaacccacacactgcctcttgaggttctaaatgcccagcaatctctttccgagtctggcgtaaaagccccaggggtgcttgaggaggggccacggggctccctgtctgcttctggccgggagggcagcctggagcctggggcaggaggacagcaggggtaggagagggmtccatgcacgagcgtgttcacacgtgctgctgagggaggctgtcccactgcgggatccctccgcggagccgtgactgcgggtcctctctggctccgcagggtccagctcgggcctggccagagcaaggagagcagcccgagtgaacaggacccaggagcggccgcagaggccggagcgcagcagccgggacgcacccggagccctgcccgccagctggtaactgggcccggctgtgcatctgtgatgcccaatttggaggctggaaatctgttttgtttgtttttctaatgtgaaattac

SEQ ID NO: 194918 - DNA, 601 bp, Human
ggcatgctgaggccccagagtcccggtgctgcagttctcagcaagtgtcttggcacaaagcagacgcatcacggccgctgggttttctccctgtggagaaggcgggctgcgtttctgcaacgtcttcgcttcactgggaacagcaccaacccacacactgcctcttgaggttctaaatgcccagcaatctctttccgagtctggcgtaaaagccccaggggtgcttgaggaggggccacggggctccctgtctgcttctggccgggagggcagcctggagcctggggcaggaggacagcasgggtaggagagggctccatgcacgagcgtgttcacacgtgctgctgagggaggctgtcccactgcgggatccctccgcggagccgtgactgcgggtcctctctggctccgcagggtccagctcgggcctggccagagcaaggagagcagcccgagtgaacaggacccaggagcggccgcagaggccggagcgcagcagccgggacgcacccggagccctgcccgccagctggtaactgggcccggctgtgcatctgtgatgcccaatttggaggctggaaatctgttttgtttgtttttc

SEQ ID NO: 194919 - DNA, 601 bp, Human
ctcctctgcagctggccctgggcaccgagcctagcacagaaagaggcatgctgaggccccagagtcccggtgctgcagttctcagcaagtgtcttggcacaaagcagacgcatcacggccgctgggttttctccctgtggagaaggcgggctgcgtttctgcaacgtcttcgcttcactgggaacagcaccaacccacacactgcctcttgaggttctaaatgcccagcaatctctttccgagtctggcgtaaaagccccaggggtgcttgaggaggggccacggggctccctgtctgctyctggccgggagggcagcctggagcctggggcaggaggacagcaggggtaggagagggctccatgcacgagcgtgttcacacgtgctgctgagggaggctgtcccactgcgggatccctccgcggagccgtgactgcgggtcctctctggctccgcagggtccagctcgggcctggccagagcaaggagagcagcccgagtgaacaggacccaggagcggccgcagaggccggagcgcagcagccgggacgcacccggagccctgcccgccagctggtaactgggcccggctgtgcatctg

SEQ ID NO: 194920 - DNA, 601 bp, Human
cagcactgatgcctgggcttggagatgaacaggaagctgtgattgggtgtttaggttctgtgttccccacagggcgaaaaccccagcacggcaggagctgagtgagtctcctctgcagctggccctgggcaccgagcctagcacagaaagaggcatgctgaggccccagagtcccggtgctgcagttctcagcaagtgtcttggcacaaagcagacgcatcacggccgctgggttttctccctgtggagaaggcgggctgcgtttctgcaacgtcttcgcttcactgggaacagcaccaasccacacactgcctcttgaggttctaaatgcccagcaatctctttccgagtctggcgtaaaagccccaggggtgcttgaggaggggccacggggctccctgtctgcttctggccgggagggcagcctggagcctggggcaggaggacagcaggggtaggagagggctccatgcacgagcgtgttcacacgtgctgctgagggaggctgtcccactgcgggatccctccgcggagccgtgactgcgggtcctctctggctccgcagggtccagctcgggcctggccagagcaaggagagcag

SEQ ID NO: 194921 - DNA, 601 bp, Human
ttgtccagcctgtcaggcctcagagtgaagctcttgaaaggacaggacaggatggccacatcctccctcctggggttcctgtggggaggcagcatctgctcacagccctggtgccacctcctccccagcactgatgcctgggcttggagatgaacaggaagctgtgattgggtgtttaggttctgtgttccccacagggcgaaaaccccagcacggcaggagctgagtgagtctcctctgcagctggccctgggcaccgagcctagcacagaaagaggcatgctgaggccccagagtcccrgtgctgcagttctcagcaagtgtcttggcacaaagcagacgcatcacggccgctgggttttctccctgtggagaaggcgggctgcgtttctgcaacgtcttcgcttcactgggaacagcaccaacccacacactgcctcttgaggttctaaatgcccagcaatctctttccgagtctggcgtaaaagccccaggggtgcttgaggaggggccacggggctccctgtctgcttctggccgggagggcagcctggagcctggggcaggaggacagcaggggtaggagagggctccatgcacg

SEQ ID NO: 194922 - DNA, 601 bp, Human
ttggccgggctggaggagaaagcaaaggccttgccgctccgtgccattggaaagaggcagcacccgggtgcccttgtgagatctttttaggggggatccctaagtctcaggtgtccggggggcagctctgctgagcaaagggaccttgccctgccatgtcctagctgtaagacctgggcagttgtccagcctgtcaggcctcagagtgaagctcttgaaaggacaggacaggatggccacatcctccctcctggggttcctgtggggaggcagcatctgctcacagccctggtgccacctyctccccagcactgatgcctgggcttggagatgaacaggaagctgtgattgggtgtttaggttctgtgttccccacagggcgaaaaccccagcacggcaggagctgagtgagtctcctctgcagctggccctgggcaccgagcctagcacagaaagaggcatgctgaggccccagagtcccggtgctgcagttctcagcaagtgtcttggcacaaagcagacgcatcacggccgctgggttttctccctgtggagaaggcgggctgcgtttctgcaacgtcttcgcttcactgggaacagc

SEQ ID NO: 194923 - DNA, 601 bp, Human
agtacaggtcccactggcggcactgctcctcgcggaagtcagccagggagtcggggcagtcctggcggctgcagagctggaagtcgtaggcaaggcccgagcaggtgcggcccccgttggccgggctggaggagaaagcaaaggccttgccgctccgtgccattggaaagaggcagcacccgggtgcccttgtgagatctttttaggggggatccctaagtctcaggtgtccggggggcagctctgctgagcaaagggaccttgccctgccatgtcctagctgtaagacctgggcagttgyccagcctgtcaggcctcagagtgaagctcttgaaaggacaggacaggatggccacatcctccctcctggggttcctgtggggaggcagcatctgctcacagccctggtgccacctcctccccagcactgatgcctgggcttggagatgaacaggaagctgtgattgggtgtttaggttctgtgttccccacagggcgaaaaccccagcacggcaggagctgagtgagtctcctctgcagctggccctgggcaccgagcctagcacagaaagaggcatgctgaggccccagagtcccggtg

SEQ ID NO: 194924 - DNA, 601 bp, Human
cctcccagaagggctcaccatcccggtgctcgtggggcagccagtggtgctgggcgtcgccgtgctcgaagtacaggtcccactggcggcactgctcctcgcggaagtcagccagggagtcggggcagtcctggcggctgcagagctggaagtcgtaggcaaggcccgagcaggtgcggcccccgttggccgggctggaggagaaagcaaaggccttgccgctccgtgccattggaaagaggcagcacccgggtgcccttgtgagatctttttaggggggatccctaagtctcaggtgtcyggggggcagctctgctgagcaaagggaccttgccctgccatgtcctagctgtaagacctgggcagttgtccagcctgtcaggcctcagagtgaagctcttgaaaggacaggacaggatggccacatcctccctcctggggttcctgtggggaggcagcatctgctcacagccctggtgccacctcctccccagcactgatgcctgggcttggagatgaacaggaagctgtgattgggtgtttaggttctgtgttccccacagggcgaaaaccccagcacggcaggagctgagtgagtctc

SEQ ID NO: 194925 - DNA, 601 bp, Human
aagcccccaccctgcccaccctagggcctgcctgctgagcccccactgatgcctcccagaagggctcaccatcccggtgctcgtggggcagccagtggtgctgggcgtcgccgtgctcgaagtacaggtcccactggcggcactgctcctcgcggaagtcagccagggagtcggggcagtcctggcggctgcagagctggaagtcgtaggcaaggcccgagcaggtgcggcccccgttggccgggctggaggagaaagcaaaggccttgccgctccgtgccattggaaagaggcagcaccygggtgcccttgtgagatctttttaggggggatccctaagtctcaggtgtccggggggcagctctgctgagcaaagggaccttgccctgccatgtcctagctgtaagacctgggcagttgtccagcctgtcaggcctcagagtgaagctcttgaaaggacaggacaggatggccacatcctccctcctggggttcctgtggggaggcagcatctgctcacagccctggtgccacctcctccccagcactgatgcctgggcttggagatgaacaggaagctgtgattgggtgtttaggttct

SEQ ID NO: 194926 - DNA, 601 bp, Human
cagccttgccccatgcaggatcagaggcacaagcccccaccctgcccaccctagggcctgcctgctgagcccccactgatgcctcccagaagggctcaccatcccggtgctcgtggggcagccagtggtgctgggcgtcgccgtgctcgaagtacaggtcccactggcggcactgctcctcgcggaagtcagccagggagtcggggcagtcctggcggctgcagagctggaagtcgtaggcaaggcccgagcaggtgcggcccccgttggccgggctggaggagaaagcaaaggccttgcygctccgtgccattggaaagaggcagcacccgggtgcccttgtgagatctttttaggggggatccctaagtctcaggtgtccggggggcagctctgctgagcaaagggaccttgccctgccatgtcctagctgtaagacctgggcagttgtccagcctgtcaggcctcagagtgaagctcttgaaaggacaggacaggatggccacatcctccctcctggggttcctgtggggaggcagcatctgctcacagccctggtgccacctcctccccagcactgatgcctgggcttggagatgaa

SEQ ID NO: 194927 - DNA, 601 bp, Human
gggcaacagccatggaggagaaacaaggactgtgtttacagtccgtcccaggagggtccccagctgccacacaagcactgccatgcccaaggccaccagactcctcaggtccctgagccaataaatgccttctagtgctgaaaccggttggagtcaactttctgacactcgcaactgagagtcccgactaatagagaaggtcagaggtcaccagattccttggcagggtcagccctggcctcagccctgagctgaccacacagctcaagcctcgtccacccacggtgaactgcaggagccyggcccctgccgagcccgcagcccggccacctcttccatgtcctcagctactctggggtgttctggtgctctgggattgcagccctgctaggaactttaatgccccacccaggagtgggccagggcagccacaccagccagggtgggctctcctgccagcccagggtcgcggcagccttgccccatgcaggatcagaggcacaagcccccaccctgcccaccctagggcctgcctgctgagcccccactgatgcctcccagaagggctcaccatcccggtgctcgtggggcagccagtggt

SEQ ID NO: 194928 - DNA, 601 bp, Human
ggccgagcttgcagtgagccaagactgcgccactgcacactgcactccagcctgggtgacggagcaagactccatctcaaaaaaaaaaaaaaaaaggccaggagcagtggctcatgcctgtaatcccagcactttgggaggccgaggcaggcggatcatgacgtcaggagatggagaccatcctggctaacatggtgaaaccctgtctctacaaaaaatgcaaaaatttagccgggtgtggtggcgtgcgcctgaagtcccagctactcaggaggctgaggcaggagaatagcttgaaccygggaggcagaggttgcagtgagcagagatcacgccactgcactccagcctgggcaacagagtgagactccgtctcaaaaaaaaaaaaagtaaataatccttttcagtcaatctctgaaatccagaatgaggccagcctgcctcgattcagactcaggtccctggaaccttcccttctcagcctttatctgaggcaactaaaacgctgggcccccagactgtggcctccgccagagggggaccccatctgctgtgtcacctccaaccctgcactggcccacatgaggcagcagctgctggg

SEQ ID NO: 194929 - DNA, 601 bp, Human
aggcaagatggctcacacctgtaatcccagcgctttgggaggcagaggcaggtggatcacttgaggtcaggagttccagaccagcctggccaacatggtgaaacccgtctctactaaaaatacaaaaattagctgggtgtggtggtgagcgcctgtaatcccagatacttgggaggctgaggcaggagaatcgcttgaacccaggaggccgagcttgcagtgagccaagactgcgccactgcacactgcactccagcctgggtgacggagcaagactccatctcaaaaaaaaaaaaaaaaaggccaggagcagtggctcatgcctgtaatcccagcactttgggaggccgaggcaggcggatcatgacgtcaggagatggagaccatcctggctaacatggtgaaaccctgtctctacaaaaaatgcaaaaatttagccgggtgtggtggcgtgcgcctgaagtcccagctactcaggaggctgaggcaggagaatagcttgaacctgggaggcagaggttgcagtgagcagagatcacgccactgcactccagcctgggcaacagagtgagactccgtctcaaaaaaaaaaaaagtaaat

SEQ ID NO: 194930 - DNA, 601 bp, Human
ggggtctgcaaggagccctgatggcttccccatgtgtgtgcaaaggaggcaccaagcaggagaaatttccacaagggtccccacgtggcccaccctccagggcagacagagagggaaaggggtgggtgacagcagcccccttcctgtctctgtgtctcctaagcctttgaccctggtggttgtggactttggaagagcttttcccaaccaagccagccaggctgttggtgcagcccggctctcacatccccgaggccccgcttggagacctccgaggctgcaaatgtctgtttgctgggtygctatctaaagaacccttttcaggccaggcaagatggctcacacctgtaatcccagcgctttgggaggcagaggcaggtggatcacttgaggtcaggagttccagaccagcctggccaacatggtgaaacccgtctctactaaaaatacaaaaattagctgggtgtggtggtgagcgcctgtaatcccagatacttgggaggctgaggcaggagaatcgcttgaacccaggaggccgagcttgcagtgagccaagactgcgccactgcacactgcactccagcctgggtgacggagcaag

SEQ ID NO: 194931 - DNA, 601 bp, Human
ccaataccccgaaaagggggaggtcagtacccaggaagctgagacttgacacggtagccccccgtgccggcctctgtgtactcaccctgcagtccccgcgcacacagaggctgaaggcgtccttgtaggagcagcgcgtcccgtcatgcaccatgcgcttcatggacaccacctccccggtctccctggactcgcagtacaggtggcatctctccttggctggaagggaagcagctgggggtctgcaaggagccctgatggcttccccatgtgtgtgcaaaggaggcaccaagcaggagawatttccacaagggtccccacgtggcccaccctccagggcagacagagagggaaaggggtgggtgacagcagcccccttcctgtctctgtgtctcctaagcctttgaccctggtggttgtggactttggaagagcttttcccaaccaagccagccaggctgttggtgcagcccggctctcacatccccgaggccccgcttggagacctccgaggctgcaaatgtctgtttgctgggttgctatctaaagaacccttttcaggccaggcaagatggctcacacctgtaatcccagcgctttg

SEQ ID NO: 194932 - DNA, 601 bp, Human
gacgtctgaggtggagtccaaactctccaggtgagtcctaggcatactcaagtctcaggctcccagcacaggggaggggtaaacagacatttgccaagagcctgccctggtccgggcattgtttctgacacttcgtatgcttcacctcatgcatcttgccaataccccgaaaagggggaggtcagtacccaggaagctgagacttgacacggtagccccccgtgccggcctctgtgtactcaccctgcagtccccgcgcacacagaggctgaaggcgtccttgtaggagcagcgcgtcccrtcatgcaccatgcgcttcatggacaccacctccccggtctccctggactcgcagtacaggtggcatctctccttggctggaagggaagcagctgggggtctgcaaggagccctgatggcttccccatgtgtgtgcaaaggaggcaccaagcaggagaaatttccacaagggtccccacgtggcccaccctccagggcagacagagagggaaaggggtgggtgacagcagcccccttcctgtctctgtgtctcctaagcctttgaccctggtggttgtggactttggaagagcttttccca

SEQ ID NO: 194933 - DNA, 601 bp, Human
agtgccctgcagggtgcaaggatggggcctgcttcacaagggtcccctgtaggtcacgtgcattggaaatcacctgggatgctcctaaaaattcatgctcccaggccgccaccaccgtgacctgtggaatcaggacgtctgaggtggagtccaaactctccaggtgagtcctaggcatactcaagtctcaggctcccagcacaggggaggggtaaacagacatttgccaagagcctgccctggtccgggcattgtttctgacacttcgtatgcttcacctcatgcatcttgccaatacccygaaaagggggaggtcagtacccaggaagctgagacttgacacggtagccccccgtgccggcctctgtgtactcaccctgcagtccccgcgcacacagaggctgaaggcgtccttgtaggagcagcgcgtcccgtcatgcaccatgcgcttcatggacaccacctccccggtctccctggactcgcagtacaggtggcatctctccttggctggaagggaagcagctgggggtctgcaaggagccctgatggcttccccatgtgtgtgcaaaggaggcaccaagcaggagaaatttccaca

SEQ ID NO: 194934 - DNA, 601 bp, Human
ggagcctggcagggacaagtctatgttcatgtcaccgtcacatggcgaggtgacacgagattgtttttcctgacagccaaagattgaagccaaaggcatcataataaaagaaaacagaggagggcatttctacaaagcaccaaaccagtgaccctcacagtggccacccagatccagcaagaagctgcccagtgccctgcagggtgcaaggatggggcctgcttcacaagggtcccctgtaggtcacgtgcattggaaatcacctgggatgctcctaaaaattcatgctcccaggccgccrccaccgtgacctgtggaatcaggacgtctgaggtggagtccaaactctccaggtgagtcctaggcatactcaagtctcaggctcccagcacaggggaggggtaaacagacatttgccaagagcctgccctggtccgggcattgtttctgacacttcgtatgcttcacctcatgcatcttgccaataccccgaaaagggggaggtcagtacccaggaagctgagacttgacacggtagccccccgtgccggcctctgtgtactcaccctgcagtccccgcgcacacagaggctgaaggcgt

SEQ ID NO: 194935 - DNA, 601 bp, Human
aagctggagtcagtggcgcgatcttggctcactgcagcctccgcctcccaggttcaagtgagtctcctgcctcagcctcccgagtcgctgcctgtagtcccagctaattttttttttttttgtatttttagtagagacggggtttcaccatgttggtcaggctagtcttgaaccccagacctcaaataatctgcccgcctcggcctcccaaagtgctgggattacaggcgtgagccaccacgcccagcccctatccttctttaatacccatgtcaggagtgacgtgatagccacacccacrgagacagtgcattagtgatcttccctccccgttaggtttacaaccatgatcacagctgccatctgaagctacttgtactacaactgtttcccatgcttgctgcctgtattaattatgtttttgtttttcaaaacgtcctatgtcttgatattttgacatcttaaaaatcttcctgtctggggagagactacacctcccaggggtatccagttctaagggacagcaaagcactgggttggggacacacctttcacatgcaagccagccagtcttcagtctataccccaagcacctccttta

SEQ ID NO: 194936 - DNA, 601 bp, Human
cttcttgggtgaccgtgtgaacgtgcccttgaccactttgcagtggctgttgtcccctccgcacacgccacacttgtcttcctgcttgctggagccgatcacaccgtcacagcccaccttctgttgggggaggaggcagtgagcacttgagacgtcctgctagtagagtcagggtcatactatgttgcccccagtctcgaacacctggcctcaagcgatcctcctgccttggcctcccaaagcattgggattacaggcgtgaaccaccttgcctggcctcatcttttattatctccaaaawcagagtgcgtctagtcatcagttaaacggaccttgcctgccacctacagcagtgtctcgacctggcagtttccgtctgggcccctgtgcacgcggctggtcttgggcaggggactcatcgaggcccaggcaggcaccgtccctggcttgatgaacatttatgtttggcaagcaggagatgctgtttatttttacatttttttttgagacggaatcttgctctgtcgcccaggctggagtacaatggtgcaatctcagctcactgcaacctctgcctcctgggttcaagcaattcttctgc

SEQ ID NO: 194937 - DNA, 601 bp, Human
cctggctcaggtcatggctgcacaacccgggcccctgacccctgacccctggcactctgcccattgatcccagaggagccaggtcctgaggacgtcaagttgtccggctctgagactcacccagatggtggctggtggcgtctacctcctgaatgagcaggtgtctggctcctgcagggatctcaaacatcttgatgtaacctttttttgatgtggaaagacacagaaaactgagaagggaaggcgccgctcaaattcgcaccatgcaaggaggggcctcgctcttgaaggcagctcctcsggaggctctcccaggaccctggtatttctctggctttgaggacccacctgagaggggccaccaggaaagctgctgcctccaggctagtctttaaggcccaacccgggcatcctcatatactggcattctccactctaacccctgtgaccccggcccccactctcctcttccccacccaccctggcacccagctggggctgtccccgacttaggattctccctccccctcagtgtcacagacctctccccctccccagaacagtcataagcccggacagccccaggatgagtcaggccctc

SEQ ID NO: 194938 - DNA, 601 bp, Human
cgtctctgtactcccactccacgcccatggcaatgaaggttttggaactggcatccacgtcattctcttcatttaagatgaacttgcctgtctccaggttcttgacggctgagaatggcaagaccaagtcccccgttgtggtcacccaagagcaggacccaggcccactggtttgggctggtcggggagtgggggcagctagctggaccccttgtctctctggctgcccccggccagtttcctctgtgccacgacagcccagatggctctgggagccctgcttgcccatcactgctccctygggaccagattaccctccactcgcatcctctgcccccaccagccctggaggtgccggctccccttggaagccactcagtagccgtcaaggccacctacccataccctattgggagcactcagtgggcgcttagaggccacccggggcaggatggctgggaggggtctgtacgcggtgcagggcatctgctggacaggcgagcacatgaccctgctggagtagggcttcctgccatggggtgagtatatgtctggctgaaacagcagaacccccaccccatcagggaccatggcccagccg

SEQ ID NO: 194939 - DNA, 601 bp, Human
agggtcaggaggctcagcgtcccaggcacccccatccctcccccagtggccacccgcacccttccctgggcccagccctgcttggactcaccagaacggtgatggtgccgtggagggggcccatggtctgcagcgtctcccggccgtcctcgtctctgtactcccactccacgcccatggcaatgaaggttttggaactggcatccacgtcattctcttcatttaagatgaacttgcctgtctccaggttcttgacggctgagaatggcaagaccaagtcccccgttgtggtcacccaagrgcaggacccaggcccactggtttgggctggtcggggagtgggggcagctagctggaccccttgtctctctggctgcccccggccagtttcctctgtgccacgacagcccagatggctctgggagccctgcttgcccatcactgctccctcgggaccagattaccctccactcgcatcctctgcccccaccagccctggaggtgccggctccccttggaagccactcagtagccgtcaaggccacctacccataccctattgggagcactcagtgggcgcttagaggccacccggggcagg

SEQ ID NO: 194940 - DNA, 601 bp, Human
gaatcaattttagtgagcaggtgaatttgcaaatacagaaaccgtgagtgccgaggaccagctgctcacacactgatgcaggcaggtcaccaaaggcacgtccagggggccagaagtcactgcaggcgaggcaggcagggtgccagggggtacacggggcatacctggctcactgctgcacctgcttacaggtgcacccacgtgtggagcgctgggggctggtggattaatcccaatgccagcatgcccaccttagggaggggctccagagcatgggagccttatttgtgatatgtacctyttttgacaaataaaatatatccctatgcagttaaattacattttaaaaagtgatctgacctcctcaaaaccaggtaaaaagaaagtgatttgaaaatccagcccccgtggtactttcctacaaccaggagatctggggtcccatcctgcttagagacacagtccagctcaacctgggtctgggcatctagcttcccagaccctgagcgtcacctcccagagtgtcaccgattccaatgtaacagcacactcgaacgagcatgctgatggcagctgtgaatgtcattcagatggtgaaacc

SEQ ID NO: 194941 - DNA, 601 bp, Human
actgcaacctccgcctcccaggttcaagcgattctcctgcctcagcctcctgagtagctgggattacaggcgcccgccaccacgcctggctaatttttgtatttttagtagagacagggcttccccatgttggccaggctggtcttgaactcctgacctcaagtgatccacccgcctcggcctcccaaagtactgggattacaggcatgagccactgcgcctggcctatgtgtgagtctgtttaaagacactttatttaatttttactgtgattcattaacactgaactcacagtcaatcrcactgcagcccatgcctgaacgaagcttattcaacacatgtattttcttcttaagacaccactgcttcctgggcttaggaacactggacagcacttcagcaacaggctcagggtgattttcaacagcgaaatcgcccccaaaatagcacaaaatgtgatgtatgtgacactcaacagactgcagaaagaacccctgtttgtgggatgagagcagaaacaagcagacagcgtgctgagttgctcccacctccgctgggaacacgtgtggcaggcgactcacacttcaccactctgtgcgtg

SEQ ID NO: 194942 - DNA, 601 bp, Human
tgctccctaccttctcgtggtcaccctcatgtcacccaggtccccagcttcgagaccccctcacctccgccacagggcttggagcacggagaccacttcttcagggcccactcgtagaccacagagtcctcttccaggacgttgttgtcgtcgacattcagtgagtcctcatggatcatgtatttgtacgtcagtgagacccgggtgtctcccaccgggatgacctgtgccagcccaagagccttgatgtgcctgacctgccctccatgcttcctccccagccagcttaggaacggcagcygaggccgactccagaggagtctcatcattcatggcagttacattccatgaagtcgccccgagcaccaaattcttgaatagggagccattaccccagggggcacagggtgaggttcctgtgagcctctgtctcaacatttttgttacccgatcaatatataaccttgttttatgtgtgagtctgtttatttttttgtttgtttttgtttgtttttgagatggagtttcgctcttgtagcccaggctggagtgtagtggcacgatctcggctcactgcaacctccgcctcccaggttcaagc

SEQ ID NO: 194943 - DNA, 601 bp, Human
gctttgggcttcgagagggcggcacagaagccacggtgtaccatcttgtggtccagcctccggcggcagccatacttggtgaactgggaccctgaaggcagagagctcgacgggggtcggtggggcagcatgccctgcccgagggtgcaaggaggggtgggctgcaccagcagtgctggcctcgttttcctgctcacccttgtgatgacaataagggtgggcagggcaccgagcctgcggctggctggggggaggccttggtgtgtcccgggtggaggggcgagagggcaggagaggccaytttctcccctaggctgcctctccctcactgggctcctgggtcagagtggaggccctatttccttgctactgctaggcaccgcttctaccttgacctcacatgcccagcaggcctggtgcaagccaggagccgggcaagcactgggcccgcagcccgcatgcttcctcccacaggcccagagcagccgtgctcaacccgggtgattttctccagcaggggacatttggccacgtctgggacatgtttggttgtcacaactgggggaaggggtgctactggcatctggtgagcaaaggccaa

SEQ ID NO: 194944 - DNA, 601 bp, Human
ttggtcaaatgcctcggatgatgccaggcccaggccccacacctccaagcacgggagcccctggtggcccctggcctgtctcctctagtgggagcccgagctgggggcactcacactggctgggagcattcctgtgggttgcacgctctgcggatggctttgggcttcgagagggcggcacagaagccacggtgtaccatcttgtggtccagcctccggcggcagccatacttggtgaactgggaccctgaaggcagagagctcgacgggggtcggtggggcagcatgccctgcccgaggrtgcaaggaggggtgggctgcaccagcagtgctggcctcgttttcctgctcacccttgtgatgacaataagggtgggcagggcaccgagcctgcggctggctggggggaggccttggtgtgtcccgggtggaggggcgagagggcaggagaggccattttctcccctaggctgcctctccctcactgggctcctgggtcagagtggaggccctatttccttgctactgctaggcaccgcttctaccttgacctcacatgcccagcaggcctggtgcaagccaggagccgggcaagcactgg

SEQ ID NO: 194945 - DNA, 601 bp, Human
tacagggccaggaggcgagccctgcgcctctgaacccccatttccccatctgggcatccctgtttcttgtcatctctaagatgctgttcagtttggcgggtttgaagctggggtgcgccttctgccctgcagcatcttagattccatgaaatgtggtgagagagacttggtcaaatgcctcggatgatgccaggcccaggccccacacctccaagcacgggagcccctggtggcccctggcctgtctcctctagtgggagcccgagctgggggcactcacactggctgggagcattcctgygggttgcacgctctgcggatggctttgggcttcgagagggcggcacagaagccacggtgtaccatcttgtggtccagcctccggcggcagccatacttggtgaactgggaccctgaaggcagagagctcgacgggggtcggtggggcagcatgccctgcccgagggtgcaaggaggggtgggctgcaccagcagtgctggcctcgttttcctgctcacccttgtgatgacaataagggtgggcagggcaccgagcctgcggctggctggggggaggccttggtgtgtcccgggtggaggg

SEQ ID NO: 194946 - DNA, 601 bp, Human
agctgggcccagccccagggcctgaacgtcaaagccactgcttaagaaacatctaccccatggtacagggccaggaggcgagccctgcgcctctgaacccccatttccccatctgggcatccctgtttcttgtcatctctaagatgctgttcagtttggcgggtttgaagctggggtgcgccttctgccctgcagcatcttagattccatgaaatgtggtgagagagacttggtcaaatgcctcggatgatgccaggcccaggccccacacctccaagcacgggagcccctggtggccccyggcctgtctcctctagtgggagcccgagctgggggcactcacactggctgggagcattcctgtgggttgcacgctctgcggatggctttgggcttcgagagggcggcacagaagccacggtgtaccatcttgtggtccagcctccggcggcagccatacttggtgaactgggaccctgaaggcagagagctcgacgggggtcggtggggcagcatgccctgcccgagggtgcaaggaggggtgggctgcaccagcagtgctggcctcgttttcctgctcacccttgtgatgacaataagg

SEQ ID NO: 194947 - DNA, 601 bp, Human
atgtcaccactgggaggccctggtggagctggtggctctggaggtccctagcctgaagaggtttcccagcctccttagggtctgggccctgctacctggcctcaccttctgctgacgtcacaaatccttctcggcagagctcaagagcagtgtggattccctcagcacgctgtcctatgtggcccccacctgcccatttcccaactgtcttccccactgaggtccctggacccagaaacgcagctgggcccagccccagggcctgaacgtcaaagccactgcttaagaaacatctaccccrtggtacagggccaggaggcgagccctgcgcctctgaacccccatttccccatctgggcatccctgtttcttgtcatctctaagatgctgttcagtttggcgggtttgaagctggggtgcgccttctgccctgcagcatcttagattccatgaaatgtggtgagagagacttggtcaaatgcctcggatgatgccaggcccaggccccacacctccaagcacgggagcccctggtggcccctggcctgtctcctctagtgggagcccgagctgggggcactcacactggctgggagcattc

SEQ ID NO: 194948 - DNA, 601 bp, Human
ccagcgccgctccctgcagcccaggtagacagcgagcacagagggcagcctgcacccctccccggtgcaccttctcttattctcactaagatgctggctgtccaggcttgcacagaggggaaactgaggctcagctgccccaggtcctactgaccatgagtcccatgcatgtcaccactgggaggccctggtggagctggtggctctggaggtccctagcctgaagaggtttcccagcctccttagggtctgggccctgctacctggcctcaccttctgctgacgtcacaaatccttctcrgcagagctcaagagcagtgtggattccctcagcacgctgtcctatgtggcccccacctgcccatttcccaactgtcttccccactgaggtccctggacccagaaacgcagctgggcccagccccagggcctgaacgtcaaagccactgcttaagaaacatctaccccatggtacagggccaggaggcgagccctgcgcctctgaacccccatttccccatctgggcatccctgtttcttgtcatctctaagatgctgttcagtttggcgggtttgaagctggggtgcgccttctgccctg

SEQ ID NO: 194949 - DNA, 601 bp, Human
agcacctggagaacctgcctggctgagctccagcgccgctccctgcagcccaggtagacagcgagcacagagggcagcctgcacccctccccggtgcaccttctcttattctcactaagatgctggctgtccaggcttgcacagaggggaaactgaggctcagctgccccaggtcctactgaccatgagtcccatgcatgtcaccactgggaggccctggtggagctggtggctctggaggtccctagcctgaagaggtttcccagcctccttagggtctgggccctgctacctggcctcrccttctgctgacgtcacaaatccttctcggcagagctcaagagcagtgtggattccctcagcacgctgtcctatgtggcccccacctgcccatttcccaactgtcttccccactgaggtccctggacccagaaacgcagctgggcccagccccagggcctgaacgtcaaagccactgcttaagaaacatctaccccatggtacagggccaggaggcgagccctgcgcctctgaacccccatttccccatctgggcatccctgtttcttgtcatctctaagatgctgttcagtttggcggg

SEQ ID NO: 194950 - DNA, 601 bp, Human
ggcacacgccaccacatctggctaattttttttaatttttttgtaaagacggtgttttgccatgccgcccaggctggtctctaacacctgagttcaggcgatccacccgcctgggcctcccaaagtgctgggatcactggcgtaagccactgtgcccggccaacgcctgttttcaagactggcccttgtgcagctcctgggaaccaagctcatggaaggctccacctattaagagtgtttttgcctgcctgaggccttgagtcaccagtaccagttggtctgggtagttcataccaacagygatggatggggaacacctgcttttcctctacagtctgaggtcacacctatgtagctgaccccattgaaaaccctggacgcccaggctctggtgggctcccctgcttggcagcatttcacatgcattgccacacatgggtgcagggagaattcagggcatttccgtgaccccactgggaggggacaccgggagcctgcgcctggattcctcccaacctccttgcctgtgacttttctttttcccgattctactctgtatcctttcaccgtaagcccctgcaactgcgagtcccgcttctga

SEQ ID NO: 194951 - DNA, 601 bp, Human
ccacctcccaggctcaagcaatcctcccaccttagcctcccgaggagcagggagtacaggcacacgccaccacatctggctaattttttttaatttttttgtaaagacggtgttttgccatgccgcccaggctggtctctaacacctgagttcaggcgatccacccgcctgggcctcccaaagtgctgggatcactggcgtaagccactgtgcccggccaacgcctgttttcaagactggcccttgtgcagctcctgggaaccaagctcatggaaggctccacctattaagagtgtttttscctgcctgaggccttgagtcaccagtaccagttggtctgggtagttcataccaacagtgatggatggggaacacctgcttttcctctacagtctgaggtcacacctatgtagctgaccccattgaaaaccctggacgcccaggctctggtgggctcccctgcttggcagcatttcacatgcattgccacacatgggtgcagggagaattcagggcatttccgtgaccccactgggaggggacaccgggagcctgcgcctggattcctcccaacctccttgcctgtgacttttctttttcc

SEQ ID NO: 194952 - DNA, 601 bp, Human
gtcctcgctgtctcaggacgctcctcctggcagatgccgaagctgtcgtccgcggtgcggcagagcactggccgctcctgggtgccgttgccacaggttactgagcactgcagggggagagtcgccaggcagggttcacctcccacacagggcccgcactggcagagctggaggagcccacagtccccaggcacatgacccatgcgctcaggaggaggtgtgggacagtggggagagtggggtttcaggttgccttgccccaccctcgggggcagccccaatctcctggggctctaaagamgggacccacatgcctgtctctctgagctgctgtgagacagtgcccatatacagactggcataggcctggcgctgctggactctcagtgacagcctcacttctctggctggaggaggtccaaggcccaggagaacctgctgtgccctgggcaggggttgaggtggggcactgggaaagctctgacccagcctaggaggcgccagtaggctccccacaatcctgggcatgagggtccaccactagtgccctcactggctcctccagcccccagcaccaccactgctccaccacactgaccag

SEQ ID NO: 194953 - DNA, 601 bp, Human
gacctggcctgcagtgccccgcttctccatgctcacagatgttgagtccagctactctccgggaagagccagatttgcctgaaccaagcctctgacacccccgccctgggctgctgcatgctgggagcaggggcaggggctgcaggtggcttacggggacaggggccaagcctgcaggtcctcgctgtctcaggacgctcctcctggcagatgccgaagctgtcgtccgcggtgcggcagagcactggccgctcctgggtgccgttgccacaggttactgagcactgcagggggagagtcrccaggcagggttcacctcccacacagggcccgcactggcagagctggaggagcccacagtccccaggcacatgacccatgcgctcaggaggaggtgtgggacagtggggagagtggggtttcaggttgccttgccccaccctcgggggcagccccaatctcctggggctctaaagaagggacccacatgcctgtctctctgagctgctgtgagacagtgcccatatacagactggcataggcctggcgctgctggactctcagtgacagcctcacttctctggctggaggaggtccaagg

SEQ ID NO: 194954 - DNA, 601 bp, Human
agacctggcctgcagtgccccgcttctccatgctcacagatgttgagtccagctactctccgggaagagccagatttgcctgaaccaagcctctgacacccccgccctgggctgctgcatgctgggagcaggggcaggggctgcaggtggcttacggggacaggggccaagcctgcaggtcctcgctgtctcaggacgctcctcctggcagatgccgaagctgtcgtccgcggtgcggcagagcactggccgctcctgggtgccgttgccacaggttactgagcactgcagggggagagtygccaggcagggttcacctcccacacagggcccgcactggcagagctggaggagcccacagtccccaggcacatgacccatgcgctcaggaggaggtgtgggacagtggggagagtggggtttcaggttgccttgccccaccctcgggggcagccccaatctcctggggctctaaagaagggacccacatgcctgtctctctgagctgctgtgagacagtgcccatatacagactggcataggcctggcgctgctggactctcagtgacagcctcacttctctggctggaggaggtccaag

SEQ ID NO: 194955 - DNA, 601 bp, Human
cgagtcagaaggacacgctcagcaaagggtcggcggcagcagcgacggcggtggcagccgggaagcacctggcagtgccggaaactcggggtggggtccccgcacgacgccgcgagaccgcgaacccccccgggccgggacgggctcggcccggagggtcgccctttggccaccggcccctcctgcaaccacgacagatctttgcccctttacaagccatcaccaaccaggttcggccccagcagaggcccgagcccccgccagcaggcagcgcggcccggagcggacgccgagctcagasgcccgggagaaaacggtcaccccagagcgcgcccgcagagtcaggggagctttccatagacagagaggaggggggcccaaggcaagctccacagggcgcagggcatgcactggagggcagaggcagagttataaacgggtcggttacttgacgagatcttccggatgggcgagtcggggtccgggcgggacagccactgaactacgtagctcttcttggagggatctgagatgtttcctagagggaggagagaggggctgcggccgcagggcaccaggctggggcccccaccccaggcag

SEQ ID NO: 194956 - DNA, 601 bp, Human
gttcacacgcgtgggcgaggcacgcgcgcaccagacggccactctctctctcagccctgcggcgggggagctgtgcgcgaggcgagaaaaggccaccggggccgacgggcggacagtggaggtggggagtgtccccgcgcccctccgccgcctccgcgaccggacccccgcaggacagggccgcgcggggctgtgagctgcgcgaaggccgggcggaagcgggccatagttccacgagtcagaaggacacgctcagcaaagggtcggcggcagcagcgacggcggtggcagccgggaagcmcctggcagtgccggaaactcggggtggggtccccgcacgacgccgcgagaccgcgaacccccccgggccgggacgggctcggcccggagggtcgccctttggccaccggcccctcctgcaaccacgacagatctttgcccctttacaagccatcaccaaccaggttcggccccagcagaggcccgagcccccgccagcaggcagcgcggcccggagcggacgccgagctcagaggcccgggagaaaacggtcaccccagagcgcgcccgcagagtcaggggagctttccatagacagaga

SEQ ID NO: 194957 - DNA, 601 bp, Human
acaccttccctgccttctactggcccacgttccccctctgaagctggagttggcagccaatcccgttacctttcaactttaaggcatcttctacatagtttttctaagcaaaaaagcaataaaaattgaggtaattctgtagtggttcacacgcgtgggcgaggcacgcgcgcaccagacggccactctctctctcagccctgcggcgggggagctgtgcgcgaggcgagaaaaggccaccggggccgacgggcggacagtggaggtggggagtgtccccgcgcccctccgccgcctccgygaccggacccccgcaggacagggccgcgcggggctgtgagctgcgcgaaggccgggcggaagcgggccatagttccacgagtcagaaggacacgctcagcaaagggtcggcggcagcagcgacggcggtggcagccgggaagcacctggcagtgccggaaactcggggtggggtccccgcacgacgccgcgagaccgcgaacccccccgggccgggacgggctcggcccggagggtcgccctttggccaccggcccctcctgcaaccacgacagatctttgcccctttacaagccatcac

SEQ ID NO: 194958 - DNA, 601 bp, Human
gaggggccctaaatatctatgttgggcagtggggagtggggcagtaaagtcattcaaattagaaaccggggtagttaatgctactgagtgaggccccgcaactcctcagtgtctgggcccccaaaaagagaaggagccatcagcttgccaaacccacgcacccagtttcatggaacttttattgagtttatttgtgggatgcatgacaggaggtctttccatcattagtaagaatgaaaggtcattttcacagtcactttggcacacgctaacgtctcataaaaaaaaccagaaaagcaamgacaatggaacctatagaatacgtcattaaatacatacaaaacactaataaaatatccctgataaaccaaagtgcatatgcccaggacagtattgcaccttccccagtcgcgcgtgtcgctcgcatggcctcgtcaaagttggaagttaacagtcgtgagattagtacgcaggtgcacaccagttatttacagaacggcggtcagagccgcgggagtaggggccggccgcccggcaggggtgcggtgtgaacagaggcggtggctggggtggaggggcggggaggagtgctacatggatc

SEQ ID NO: 194959 - DNA, 601 bp, Human
ttctatgtctgattttctccccacagtgggcggcattgctcttagtttaaaaaaataaaaatacgtcaatgagtaaatacaaaattgaaataaaatcctggccaagagattgactatgcaaatagcctaggaaaatttcaaaatagcctagaaaaatttcaaagtcatcatgaccaactgatcttaaagatgccccaggtttgtacatttttaagtatcatcacggaccacagagaagagtgatgcacctgaggtaatgactggcgatgcctctccgccaagatgaacactgtggttttayaatatttggtcttcggccatttccagtagcaatcaagtagtgagacctattgtcttccagtgaatgacaatcaaccattgagagtaaacacagttttcataaacttaagtcactgtaggctactcccacgatcttggctacacctgaacagcacctgcattattatttgcttagtcatatcctttaaattaactcctttttacacttaaaatttgttttagaagaccttatactattaccactcatggaaagctactgcagtgaacaaaggtaaccctaaaataggaatacaaaaaaaaa

SEQ ID NO: 194960 - DNA, 601 bp, Human
aatgcccaaaatattgactacctggccctttacagaaaaggttgactgatcgtgggtcaagtgcacgcctaggtcagagccatgcacgagaaagtgctccataaatgcccattgagtgaggggtggcagccccaggtggggtcccccttccacctggtctacatactggacttctatgtctgattttctccccacagtgggcggcattgctcttagtttaaaaaaataaaaatacgtcaatgagtaaatacaaaattgaaataaaatcctggccaagagattgactatgcaaatagcctakgaaaatttcaaaatagcctagaaaaatttcaaagtcatcatgaccaactgatcttaaagatgccccaggtttgtacatttttaagtatcatcacggaccacagagaagagtgatgcacctgaggtaatgactggcgatgcctctccgccaagatgaacactgtggttttacaatatttggtcttcggccatttccagtagcaatcaagtagtgagacctattgtcttccagtgaatgacaatcaaccattgagagtaaacacagttttcataaacttaagtcactgtaggctactcccac

SEQ ID NO: 194961 - DNA, 601 bp, Human
cggccctgagcttctacgtggccaaaataaggagaacacatgactggctgcagggtccaccatgaaaagggagttaaaacccatcggccatcaggagaagtggggatctccctgacactgagcccaagaaccatgctcacagtgccaaggaggaagggggagggcctggtacccaggggagatgccagaaatcaaatcggaagatcctgagatgtggctgtcaggattttgaaactggcagaaggcttttctcagataaaaatcttacacaggtgcccaatatatgaaacagatagactcrgactgctgatgatagtactgtttgaaggtgggtggaggagacacagagctcccatccctgccccaccccatcctctccagcagcctggtttgtgaaaccactgagccctaccctcagggaaacacagggggttctggataagagctgatggtggcctcccttctccctaccccataggctttgacaaaggagggagcctgggcctgatggtgctgggagggacaccctggctgcacactgccccctctcctgttgcccatagtttttccttcacacagataaggctggtgttacacattt

SEQ ID NO: 194962 - DNA, 601 bp, Human
cccaacaccgcctgttgtggtctctgctcagctgctctctactctccacagtgatgacttcagacctttcccacacaaacccccgacgtgccctccttttccctcactctccttagttgaactcatctactattgaaaggaaggaaggagggagagggtgaaaggaaggaggaactgaaggaaggaaagaaaggaaaaaaggaaagggagggagggacaaaaggaagaaagggaggaggaaagggagggagaaagggagggagaaaggctcaggcattggatgggagccacatctgacagytatcccatacaccaacatatgacacaatctacacctgaagctgtccaaaacagacaagacccccttccttccatcgagggccagtggttctgatgtcctgcttcttaatggccactgctccagcctgtaattttcccttagaagctggtgacagaccaccagctccaaacccctgaagcttcagacttgctacaagccaaatccaccaagggcctgtgggtcccaaaagcccgagacccaacccctgcagcgtgagcttagggcctctgctgcccaccctgtctcggtgcatggtgtttc

SEQ ID NO: 194963 - DNA, 601 bp, Human
aaacctgcatgggctttcttatacttgcctcaacttacccaacaacctcatttccagcctctgctccatccccctatagcaccgccaccttgcgcatccagccatttcccaaagaaacgtgctgccctcacatagattaatcgttccaccctgcacatctttctctttcctttccacccaagaaactggtcatctgtggtccagcttacatggagagccccgactctccacagaagccaccattatctctcactttccacccagccatcttctccctggcccatctcgacctctgtctgcrgctatgttcattcaacccatcaactcttcttgcgctcacactctctttactctctgtctccttcccaagttttcaccccttccctctccccatcccctcattccacaacacaaaaattaagatgattttaaaaaattcactcaagaagaaagaataagtcatgttacaggagatacttgatccagtataaattccgaatcactgacctccgtgagcccaacaccgcctgttgtggtctctgctcagctgctctctactctccacagtgatgacttcagacctttcccacacaaacccccg

SEQ ID NO: 194964 - DNA, 601 bp, Human
acagagtgattccaaactcatcttaaagaataggactttatcacatcttcacatttgacatcccagtggtaaccccagtgaaattctgtggcaaggcttgactctacaataatctctaagtagtaactataacaaaattaaacctaaaagagccaattcctaagacccaatatagcaaatcccagggccgctgtggccccaccatgctccacaactccctgatgttgctcccattctgacccagatgccccggacgatcttttaactgaacagcacctaaaggaaagttaaacatcacccraacctgcatgggctttcttatacttgcctcaacttacccaacaacctcatttccagcctctgctccatccccctatagcaccgccaccttgcgcatccagccatttcccaaagaaacgtgctgccctcacatagattaatcgttccaccctgcacatctttctctttcctttccacccaagaaactggtcatctgtggtccagcttacatggagagccccgactctccacagaagccaccattatctctcactttccacccagccatcttctccctggcccatctcgacctctgtctgcg

SEQ ID NO: 194965 - DNA, 601 bp, Human
agcttggaggggctgtcattctaaaattgcaaatctacccataaatgacaatcctgggctggaaaccagaatgtcaaattcttgtgctgaaatcaacttttcacatggcctgaggcaggccattctactattctaagaatgctcagacatacaagtatgtaataatgttccaaacacttttttttgggggggggggcacttcctgtaagtaaaaagtttctatgactgggaaaggaacaaaataaagtaataaaagaaacaggaatacccctggcacaccttcctcaaacgaacaacgttaaaaaaaaaagaaaacacacacacacagctaattttaatctagcctactctccccccaatggacacacctacagtttcttatcaaaatgtacaagactcaaagcccatttaattcaattatgaatctcactcaacaagcatcaagcacatcaggcgcctctctacagcgatatccccacaagtttcagagaaatgccagcagggactctgtagttatgattcctatcaaacggccccctaacccgtatttctcctggacatacacatgcagattcattaaccaaaacctacccagcacccc

SEQ ID NO: 194966 - DNA, 601 bp, Human
tccaaacagaactgtccctaatttattaagaacaaaacactagtaaaaccaacctgtgaattgggccttcagtacaattaagcacatcctgtttcatataacagtaataatgaagagcttggaggggctgtcattctaaaattgcaaatctacccataaatgacaatcctgggctggaaaccagaatgtcaaattcttgtgctgaaatcaacttttcacatggcctgaggcaggccattctactattctaagaatgctcagacatacaagtatgtaataatgttccaaacacttttttttgggggggggggcacttcctgtaagtaaaaagtttctatgactgggaaaggaacaaaataaagtaataaaagaaacaggaatacccctggcacaccttcctcaaacgaacaacgttaaaaaaaaaagaaaacacacacacacagctaattttaatctagcctactctccccccaatggacacacctacagtttcttatcaaaatgtacaagactcaaagcccatttaattcaattatgaatctcactcaacaagcatcaagcacatcaggcgcctctctacagcgatatccccacaagtttc

SEQ ID NO: 194967 - DNA, 601 bp, Human
cttcatattcatatacccagatgtgtattttggaggaaaatctagtttataaggtcacagacacagcaggaaaacaaaaagaaccttttattttgactatgatcattcttctaaaggagatcttagaagaacaaatgaaaatgtgaaaacaagagtacaaactcaacatgcagagctatctgtatgataagaaccagttgccaggcacctgaaaatgtcaagtcctctgaacctgaaaggattgtgagaagagtaaagagagtgggcaaggatgtgtgtcaaatggcataagataaaaccrtatcagagggagcttcatcatactctctgaggacagtacccagtgagaaacctcagactctcaatttctaacctgccggggaaaaaaagcctgaaccttcctaattccttctccccctcactaagatagtaggctgctgaagaattaaaagacacctacagaatgtatcctaggagaaggttctattctgagagccctagagaataggctggactgagaagtaatttctactgtccagcctcttagttgaacagatccagcagtgggaaggcaaatttctccttcctactcttcaaatag

SEQ ID NO: 194968 - DNA, 601 bp, Human
acagcagatgtttggtgaagcccattagcttactggttaatagtaaaagtgcatttctggcttcatattcatatacccagatgtgtattttggaggaaaatctagtttataaggtcacagacacagcaggaaaacaaaaagaaccttttattttgactatgatcattcttctaaaggagatcttagaagaacaaatgaaaatgtgaaaacaagagtacaaactcaacatgcagagctatctgtatgataagaaccagttgccaggcacctgaaaatgtcaagtcctctgaacctgaaaggrttgtgagaagagtaaagagagtgggcaaggatgtgtgtcaaatggcataagataaaaccgtatcagagggagcttcatcatactctctgaggacagtacccagtgagaaacctcagactctcaatttctaacctgccggggaaaaaaagcctgaaccttcctaattccttctccccctcactaagatagtaggctgctgaagaattaaaagacacctacagaatgtatcctaggagaaggttctattctgagagccctagagaataggctggactgagaagtaatttctactgtccagcc

SEQ ID NO: 194969 - DNA, 601 bp, Human
aacaagagacaacatacagcaatgtatccctcaaagctcccaggggcctctgcactcagattctcttcttgttctcattggttttaggggcactttggcttatcaaagctttcatcaatgcttcgcccagagggttaacgtctgaaaaatcaaacaggtgaaaaaaaggaattgtaacagaactaaaccaaataaatcccaaacaaaactcaagtagaaagataatttttttagagatggggtcttgctctgtcacccagactggagtgcagtggcacaatcacagctcactgtaacctgsaaactcctgggttcaagtgatcctcccaccctagcctgggactacaggtacgcaccaccacgctcagctaatttttctttttattttcgagataggatctcacaaggctgcccaggctggtcacgaactcttgggcccaaacactcctcccacctcagactcactgagcagctaaggttataggcgcaagcgaccgtgcccgcctgacccacaaggatcttaatcaatgttcaccatcatcaacaatgctcaagaacacttcagtttgcatacctcccagccctgaatccttttagagct

SEQ ID NO: 194970 - DNA, 601 bp, Human
agttttctttctaactagatgagctggctgtccagtcctcccactatcaaaaatagctactctcagattggcagccaaagttacatatccaaaaatcagaattctgtttgggtgtctaccttgaaggctggttcataaacttctgtgctattttccccaataaattacaagctaatcaaagacagtacacaggacagtatggtgtgtgctctgctgccaccccttggataggggagcaagcattctggccaaaccacggaatcaaggaaatttatgatacactgcttcagttatcatcacmaacacttgctaggcttctaaactgtaatttccaaaaaacctttttgataattccttctggagttatgtcaaactctacatacatgccaatggagagaaaagatacttgctttggaagagactggaaacactgggcaactaaacagaacttccatcacaatctagactgtaggtgccacctacctgacacaggggtccactcatgcacagggagaatacgaagagataaaagatggggaaaacacttgagtaccaattttactggcttatgcttggtaagccaattctcaaggggcctaca

SEQ ID NO: 194971 - DNA, 601 bp, Human
gtggcatgatcttggctgactgcaacctccgcctcccaggtttaagcaattctcctgcctcagcctctggagtagctgggattacaggcatgcaccatcatgcccaacagctattgttttttttttgagatggagtctcgctctgctgcccaggctggagtgcagtggtgccatctcagctcactgcaagctctgcctcctgggttcaagcaattcttctgcctcagcctcctgaggagctgagactacaggcgcatgcaaccacacccagctaattttttgtatttttagtagagatggkgtttcaccatgttagccaggatgttctcgatctcccgaccttgtgatccgcccacctcagcctcccaaagtactgggattacaggcatgagccaccatgcctgaccttctaatttttgtatttttagtagagatgtggtttcaccatgttggtcgggctggtctggaactcctgagctcatgatccacctgccttggcctcccaaagtgctaggattacaggtgtgagccactgtacccggcccagaaaacagttttctttctaactagatgagctggctgtccagtcctcccactatca

SEQ ID NO: 194972 - DNA, 601 bp, Human
tggttttcttcccgcctaccccctgccccccaggatggagtcttgctctgttgctcaggctggagtacagtggcatgatcttggctgactgcaacctccgcctcccaggtttaagcaattctcctgcctcagcctctggagtagctgggattacaggcatgcaccatcatgcccaacagctattgttttttttttgagatggagtctcgctctgctgcccaggctggagtgcagtggtgccatctcagctcactgcaagctctgcctcctgggttcaagcaattcttctgcctcagcctcctgaggagctgagactacaggcgcatgcaaccacacccagctaattttttgtatttttagtagagatggggtttcaccatgttagccaggatgttctcgatctcccgaccttgtgatccgcccacctcagcctcccaaagtactgggattacaggcatgagccaccatgcctgaccttctaatttttgtatttttagtagagatgtggtttcaccatgttggtcgggctggtctggaactcctgagctcatgatccacctgccttggcctcccaaagtgctaggattacaggtgtgagcca

SEQ ID NO: 194973 - DNA, 601 bp, Human
atggttttcttcccgcctaccccctgccccccaggatggagtcttgctctgttgctcaggctggagtacagtggcatgatcttggctgactgcaacctccgcctcccaggtttaagcaattctcctgcctcagcctctggagtagctgggattacaggcatgcaccatcatgcccaacagctattgttttttttttgagatggagtctcgctctgctgcccaggctggagtgcagtggtgccatctcagctcactgcaagctctgcctcctgggttcaagcaattcttctgcctcagcctsctgaggagctgagactacaggcgcatgcaaccacacccagctaattttttgtatttttagtagagatggggtttcaccatgttagccaggatgttctcgatctcccgaccttgtgatccgcccacctcagcctcccaaagtactgggattacaggcatgagccaccatgcctgaccttctaatttttgtatttttagtagagatgtggtttcaccatgttggtcgggctggtctggaactcctgagctcatgatccacctgccttggcctcccaaagtgctaggattacaggtgtgagcc

SEQ ID NO: 194974 - DNA, 601 bp, Human
tctaaactttcccctaattactgagagtgcatcatctcacagtagcccaatatgccagctttaataaaatctcacctatccagagtccagtggaagctggcaagaaaaagaaatcagaaagctggttacagagtcaaattaaatgggcttacgtgttaagtgactagtaagaacagaagcagcactgtgaggggaacgaaaataaaccccctatattagcttttaactacaggtgtttaaaatatgaaaatatctcaaattgggtcctagaaagcttattttcataaagcaaaatttcatraacgtgtactatagtgtcttcggtatttgcattgggaagggatctcattaacaggacctcttgccctggaagttttctcctagtggttaattccacaggttttccaggcagaaaatggttttcttcccgcctaccccctgccccccaggatggagtcttgctctgttgctcaggctggagtacagtggcatgatcttggctgactgcaacctccgcctcccaggtttaagcaattctcctgcctcagcctctggagtagctgggattacaggcatgcaccatcatgcccaacagctattg

SEQ ID NO: 194975 - DNA, 601 bp, Human
aactagaaatcccaaatctgccctgacctgatctaaaggctggctttagtacaatagctaccagtataaattgagctgacttacatcttgaaggcaaaggctgatctgatatgaaccgaagcacactaaaaaatgcagtatcacctggccaggcgcggtagctcatacctgtaatcccagcactgtgggaggccgaggcgggtggatcacctgaggtcaggagttcgagaccagcctggccaagatggtgaaaccccatctctactaaaaatacaaaaattagctgggtgtggtggcacaygcctataatcccagctactttgaaggctgaggcaggagaatcgcttgaacttgggagacagaggttgcagtgagcagagatcacgccactcacttcagtctgggcaacagagtgagactctgtttaaaaaaaaaaaaaaaaaaagaaatgtgttatcactttataaactgtttctatctgatatttcacgagactgtaagaaagttacttcctgagatccttatagattattggatctatacccttaaagggtatataagtttaatattgtagttagactgccagaaccatctaaacttt

SEQ ID NO: 194976 - DNA, 601 bp, Human
atgctgttgggaatgttaagtggtacaatacttccagaaaacagtctggcagtccttaggagtttaaacacagagttaccatatgacccaaccactctactcttagttagatacccaagagaactgacaaaatatgtaacacacaaaaatttgtgcttcaatgttcatggaggcattattcataatagtaaaaaaaaaaacaaaacaaacgaaaaaaagaaacaacccatatgtccaactgataaatgaataatcaaaatgtggtacattcatatgctaaaaactattcagcaataaaatmaatgacatattgcattaacttacactacattggccaggtgtggtggctcatgcctgtaatcccagcattttgggaggctgaggcaggaggatcacaaggtcaggagatcgagatcatcctggctaacatggtgaaaccccatctctactaaaaatacaaaaaattagccgggcgcagtggcaggcgcctgtagtctcagctattcaggaggctgagtcaggagaatggtgtgaacccgggaggcagagcttgcagttagccaagatagcgccactgcagtctggttggggcgaaagagca

SEQ ID NO: 194977 - DNA, 601 bp, Human
tacagagtagccattctcttgttttttgtttttttggttttttttacttctctaatcaacttgctttcattctcaaaaaaacccaaaaaccgacctttggacttcaaaggatagcattaggaaagtaaaaagacccacagaatgggagaaaatatatgcaaatcatattatctcttaagatttatgtaaagaatataaagaatatgtaaaaactcataattcatcaacaaaaaacccaaataaaaaatgggcaaagggtgtgaggagacatttctacaaagacatagcatgtgaagaaatygaaatcttcattcaatgctgttgggaatgttaagtggtacaatacttccagaaaacagtctggcagtccttaggagtttaaacacagagttaccatatgacccaaccactctactcttagttagatacccaagagaactgacaaaatatgtaacacacaaaaatttgtgcttcaatgttcatggaggcattattcataatagtaaaaaaaaaaacaaaacaaacgaaaaaaagaaacaacccatatgtccaactgataaatgaataatcaaaatgtggtacattcatatgctaaaaacta

SEQ ID NO: 194978 - DNA, 601 bp, Human
ccaccgcgcccagcctgtaagttaaaattttttagagcatgcacttccccaaaacagtagttcagttctcaattttttgcagatgaaaatcacctggggagttcattctaggtgattccttttcaaaaaggattcctgtaagtttcatttcttttctcatcctgatttttcttagtttagtcacaacatggataaacgactatttaaaatattagatgatctacatcaagtggatttcaaaattaaaaacttttaggctgctctacagagtagccattctcttgttttttgtttttttggttttttttacttctctaatcaacttgctttcattctcaaaaaaacccaaaaaccgacctttggacttcaaaggatagcattaggaaagtaaaaagacccacagaatgggagaaaatatatgcaaatcatattatctcttaagatttatgtaaagaatataaagaatatgtaaaaactcataattcatcaacaaaaaacccaaataaaaaatgggcaaagggtgtgaggagacatttctacaaagacatagcatgtgaagaaatcgaaatcttcattcaatgctgttgggaatgttaagtgg

SEQ ID NO: 194979 - DNA, 601 bp, Human
cccttctgagcagttaccaacccatttttaagccccctttaaatttcaacaccaatgccagtaacatatcttttttgtctacaacttccaaagacacttatcatcactaccagtcaagaaatatctcatcggaaaattcctacttctatgcaaagcaaacacagtggctcacacctgtaatcccagcactttgggaggctaaggtaggaggatcacttgagtccaggagtttgagaacagcctgggcaacataatgaggcccccatctgtacaaaaaataaataatcagctgggtgtcacrtgatgcaggcctgtagccctagctattcaggaggctgaggcaggaatatcactcaagcccaggagttagaaactgcagtgagctatgatttgccactgcactccagcctgggcaacagtataagactgtctcaaaaaaggaaggaaggaaacaaagtgttggtgaggatgtggagaaattggaacccttgtgcattgccagtgggaatataaaatggtacagccatgtgggataagtgtggtagctcttccaaaaaaaaaaatttttttttaacacctaattaccatatgatctagccat

SEQ ID NO: 194980 - DNA, 601 bp, Human
gaaatctctctctctcggccgggcacgatggctcacgcttataatcccagcactttgggaggccgaggcgggcggatcacaaggtcaggagttcgaggcaagcctggccaacagagtgaaacctcgtctcaattaaaaaaaaaaaaaattcgctgggcatggtggcaagtgcctgtaatcccagctattcaggtggctgaggcacgagaatcacttgaatccgggaggcggaggttgcagtgagccgagatcatgtcactgcactccagcctgggcgacagagctagacttagtctcgagaaaaaaaaaaaaaaatctctctctcacaaactcattctctttaaatggcaacatattaattgcatttgagtttgattaaaaggaggaatgactgacagcctgataaattctgggtgcccaaccaaactcaagtttttagaactaaaaaacgggaccaaaatctgacctatggaagattttggttttttaactttttaataataacaatgctgatgtgtgtgagatgttgtctcattgcggttttgatttggatttctctgattaatgatgttgagcatttttttcatatgtttatggggca

SEQ ID NO: 194981 - DNA, 601 bp, Human
ctaatgatgggaaaggagaactgtggaagtcacagaaatgtcccagttatgaaatctctctctctcggccgggcacgatggctcacgcttataatcccagcactttgggaggccgaggcgggcggatcacaaggtcaggagttcgaggcaagcctggccaacagagtgaaacctcgtctcaattaaaaaaaaaaaaaattcgctgggcatggtggcaagtgcctgtaatcccagctattcaggtggctgaggcacgagaatcacttgaatccgggaggcggaggttgcagtgagccgagaycatgtcactgcactccagcctgggcgacagagctagacttagtctcgagaaaaaaaaaaaaaaatctctctctcacaaactcattctctttaaatggcaacatattaattgcatttgagtttgattaaaaggaggaatgactgacagcctgataaattctgggtgcccaaccaaactcaagtttttagaactaaaaaacgggaccaaaatctgacctatggaagattttggttttttaactttttaataataacaatgctgatgtgtgtgagatgttgtctcattgcggttttgatttgg

SEQ ID NO: 194982 - DNA, 601 bp, Human
taaaagcaagctacagggagatgccccaaagttatggaaacaggtcactctcaaaggagtaatgtagggactatattagtcttgtttatgaacgtatacacagagttaggaacagtgttcagaatctagtgctcaatttgattgaatagtgaggtaagttatgtaaagaatacacttggagagatacttgagaaacacctcatttcctaaagaaagaagctatctatgataaataaggagtgtcaacaggctggaatttggtagtgaatctgtccgtgggagagccttcaaatgtggtggytgagtgggagacgccatgacaggatgatgcaatgagtctttccaaagtctaggcatatttgtaatcaagaatttagtattctaatgatgggaaaggagaactgtggaagtcacagaaatgtcccagttatgaaatctctctctctcggccgggcacgatggctcacgcttataatcccagcactttgggaggccgaggcgggcggatcacaaggtcaggagttcgaggcaagcctggccaacagagtgaaacctcgtctcaattaaaaaaaaaaaaaattcgctgggcatggtggcaagt

SEQ ID NO: 194983 - DNA, 601 bp, Human; identical to SEQ ID NO: 31064

SEQ ID NO: 194984 - DNA, 601 bp, Human; identical to SEQ ID NO: 31063

SEQ ID NO: 194985 - DNA, 601 bp, Human; identical to SEQ ID NO: 31062

SEQ ID NO: 194986 - DNA, 601 bp, Human; identical to SEQ ID NO: 31061

SEQ ID NO: 194987 - DNA, 601 bp, Human; identical to SEQ ID NO: 31060

SEQ ID NO: 194988 - DNA, 601 bp, Human; identical to SEQ ID NO: 31059

SEQ ID NO: 194989 - DNA, 601 bp, Human; identical to SEQ ID NO: 31058

SEQ ID NO: 194990 - DNA, 601 bp, Human; identical to SEQ ID NO: 31057

SEQ ID NO: 194991 - DNA, 601 bp, Human; identical to SEQ ID NO: 31056

SEQ ID NO: 194992 - DNA, 601 bp, Human; identical to SEQ ID NO: 31055

SEQ ID NO: 194993 - DNA, 601 bp, Human
ctcttgggactatggaatggatttaataacagaacctcactggtaatgtcattggaggattaagaaagggcaaaggaacgttgtgagtacggagttctcagggcagcacttagcacatctgaaatactcagggccagaaataaataagttgaaggtaaagaatgtaggaagtattaactcttcaattaggttaaatgatgacttgcctaaactgatgtctgcgccatgactgtgggtgatttgatcaattcactgtctcacttttgcctcttatgactcttaatgacttgctgtaacatartctgtgttttaatttaagaagagatttacctaaagcaatatagagatccgtctcctggctctgtatttatatgaataatactggtggcttccagatctttaagaggtgcctttaagcttgcaaaactctgtggatttagtcccacttctttgagtgggaagacatgtaatttgaaagcacagggctcaaatgaaaggatgtagctgttggctgaaaaattaattggatgaaaagagtatacacataaccctgggtgggagacagcctattaagctgtatctcaggagacttaggtcgtac

SEQ ID NO: 194994 - DNA, 601 bp, Human
tttgatcaattcactgtctcacttttgcctcttatgactcttaatgacttgctgtaacataatctgtgttttaatttaagaagagatttacctaaagcaatatagagatccgtctcctggctctgtatttatatgaataatactggtggcttccagatctttaagaggtgcctttaagcttgcaaaactctgtggatttagtcccacttctttgagtgggaagacatgtaatttgaaagcacagggctcaaatgaaaggatgtagctgttggctgaaaaattaattggatgaaaagagtayacacataaccctgggtgggagacagcctattaagctgtatctcaggagacttaggtcgtactcctagctccacctaaattggccttgggcaactcaagtgacctgcccaagcctctgctttttcacccataaggtgaagaaggggaggggagtgtaacctctaagtgacctccgaatccaacattcagtgggtctccaggcaacatgtgatgttgctgaagctaaaaagaggaagaagatgaggcaggaagcaacagctaggaggcctggattccagcaccatcactgcctctcaccagc

SEQ ID NO: 194995 - DNA, 601 bp, Human
tctgtggatttagtcccacttctttgagtgggaagacatgtaatttgaaagcacagggctcaaatgaaaggatgtagctgttggctgaaaaattaattggatgaaaagagtatacacataaccctgggtgggagacagcctattaagctgtatctcaggagacttaggtcgtactcctagctccacctaaattggccttgggcaactcaagtgacctgcccaagcctctgctttttcacccataaggtgaagaaggggaggggagtgtaacctctaagtgacctccgaatccaacattcartgggtctccaggcaacatgtgatgttgctgaagctaaaaagaggaagaagatgaggcaggaagcaacagctaggaggcctggattccagcaccatcactgcctctcaccagcagattaaccttaggcagttttcataacctcattcctcagtttccccacttcctaaatggagataagacctaacccttggaattctatttaaagtgatgtgtttaaatctgacgtgttttatcacaagcgttaaagtttagctacaataatattaataatctaatattattatattagacacaatttgc

SEQ ID NO: 194996 - DNA, 601 bp, Human
aaaattaattggatgaaaagagtatacacataaccctgggtgggagacagcctattaagctgtatctcaggagacttaggtcgtactcctagctccacctaaattggccttgggcaactcaagtgacctgcccaagcctctgctttttcacccataaggtgaagaaggggaggggagtgtaacctctaagtgacctccgaatccaacattcagtgggtctccaggcaacatgtgatgttgctgaagctaaaaagaggaagaagatgaggcaggaagcaacagctaggaggcctggattccrgcaccatcactgcctctcaccagcagattaaccttaggcagttttcataacctcattcctcagtttccccacttcctaaatggagataagacctaacccttggaattctatttaaagtgatgtgtttaaatctgacgtgttttatcacaagcgttaaagtttagctacaataatattaataatctaatattattatattagacacaatttgctataatgcttgaaccttgagtaaagacttccaaatcctctccccctgcaaacttgtaatttgtaacagttcattctctaaacctcgtg

SEQ ID NO: 194997 - DNA, 601 bp, Human
gaggaacagagatctctcagataaattcctccaaatgcccgagtagacaaataccgtgaatgatctttgcaaggcaggagtccttccgctgtcaaagggacccactgcctgaggctgtgagcacctgtggtctgagtcagggccaatagactagtttctaaaacatctagatcctaccttgggccaatatgagttttatgtattattacttaattaggaacttgtttgttaagatctgtgagatatgactgtagggaccaaagagtttttgttcctttactttaaaaaaatcatgctttgwgtgtgacaggttttttttttttttttttttttggagacagacagagtctcactcagttgcccatgctggagtacaatggcaccattgcaacctctgcctcctgggtttaagcgattctcctgcctcagcctcctgagtagctgggattacaggcacccgccatcatgcccacttaatttttgtagagacaggatttcaccatgttggccaaactggtcttggactcctaacctcaggtgatccacccgcctaggcctcccaaagtgctaggattacagagtgctaggattacaggattct

SEQ ID NO: 194998 - DNA, 601 bp, Human
gcagatgaagtattaatgcaattgtcattataccaattacaaggacagaaaacagttgaccgggctcggtggctcacatctgtaatcccagcattttgggaggctgaggtgggtggatcatgaggtcaggagttcgagaccagcctgaccaacacggtgaaagcccgtctctactaaaaatacaaaaattagctgggcgtggtggcgcacgcctgtaatcccagctcctcaggaggctgaggcaggagaatcgcttgaacttgggaggcagaggttgcactgagctgagatggtgccactrcaagactctgtctcaaaacaaaacaaaaaaacaacagaaaacagtttacaaactataaggcagaggtttattgaaataatatgattttcctcttttaggtgaataggaacatgagagacaatgtgggttgaggggctggaaggggcagaggacagacgtagaaatgagggaaggttacttaacagcagcctctggttgctcagtgtcagggaggaaaaacttttcctctgtcctcttaagttcagtacctgggggcctgcaaattaagctgataaaagacagattaacaggtgggcaggg

SEQ ID NO: 194999 - DNA, 601 bp, Human
cttggctcctcctattcttttattcctttactttcccaattgatacagtttgactatgtccccacccaaatctcatcttgaattcccatgtgttgtgggagggacctggtgggaggtaattgaatcatgggggcaggtctttccatgctgttgtcgtgacagtgaataagtctcacaagatctgatggttttataaaggggagtttccctgcacaagctctctctttgcctgctgccatccatgtaagacatgacttgctcctccttgccttccaccatgattgtgaggcctcgccagccrtgtggaactgggagtccattaaacctctttcctgtataaattacccagtctcaggtatgtgtttattagcagcatgaaaacaaactaatacactaataaacttgctttcactttactctatggatgcaccctaaattcttggatcttgcgtgagatccaagaaccctctcttggggtttggatcaggaaccctttctagtaacacttccatgcaccatttctatagtttcttaccagagaagtttctctgaacatgtggagcaccggaaaccacgaggaggcggctcagcattcactcct

SEQ ID NO: 195000 - DNA, 601 bp, Human
gatctgatggttttataaaggggagtttccctgcacaagctctctctttgcctgctgccatccatgtaagacatgacttgctcctccttgccttccaccatgattgtgaggcctcgccagccgtgtggaactgggagtccattaaacctctttcctgtataaattacccagtctcaggtatgtgtttattagcagcatgaaaacaaactaatacactaataaacttgctttcactttactctatggatgcaccctaaattcttggatcttgcgtgagatccaagaaccctctcttggggtytggatcaggaaccctttctagtaacacttccatgcaccatttctatagtttcttaccagagaagtttctctgaacatgtggagcaccggaaaccacgaggaggcggctcagcattcactcctgagcatgaagctggctcttggtggtgcttctctgcaattgccttttgctgctgatgatcactcttctcttcctttgggagagtgaaagggaaaggaagccatctgaagggtcttcatggttattttttaaaaagaaaaatcccaatatctagtactaaacccctgacggaccaaatca

SEQ ID NO: 195001 - DNA, 601 bp, Human
tttactctatggatgcaccctaaattcttggatcttgcgtgagatccaagaaccctctcttggggtttggatcaggaaccctttctagtaacacttccatgcaccatttctatagtttcttaccagagaagtttctctgaacatgtggagcaccggaaaccacgaggaggcggctcagcattcactcctgagcatgaagctggctcttggtggtgcttctctgcaattgccttttgctgctgatgatcactcttctcttcctttgggagagtgaaagggaaaggaagccatctgaagggtyttcatggttattttttaaaaagaaaaatcccaatatctagtactaaacccctgacggaccaaatcagaccctcggggggataggagggacacaggtgtgtgtgatgtaaacccccctccccaggagtgtccagtgtgtgaccaaggtcaagaatcactcaccaaatgaaagaagggtccctttggtaagtgcatcaaaataaggttaccaaaagaaaaaactgaatacccaaatactgcccaaaacatggtttatgaaaaacaataaagccgttaggtggttaaatcacaaatagtaaag

SEQ ID NO: 195002 - DNA, 601 bp, Human
aagctcactcagaggagatgtttttacctaaacttgaggagaactgatctgcctgtttgcaactggaaagcagacttgaaacaaacaaatgaacaataaatttgcagtgtggggcaggactcggtggctccagtgaaagcacctcattatgaggaagatgtgaaattattactgtgttttgaattggctgctaacctactctgaaagatagaaaaagatgctgctttaaaatgagggctgtgcttttctgaaaatacagcaggtgccttgctgtgaagagtaaggaatcatatggccttakggttaaagggatcttggcaaaccagggctactcaatccatacctataccaggatgtttgcatacctataccaggatgtttgttttgcaggaacttggtgttagaatggaaattagaattgaagacatctacccataggtctggtgatctttctgctcccatacctgtctttctactgtctgagatcatagtaaatgataaaaacagaaaataggttctaaggtatgctggctttagtaataagattctttttctcatctgtaacactactgttacacttctataacaaacactatttgtt

SEQ ID NO: 195003 - DNA, 601 bp, Human
caaggtagaaaaagtaacccccagccctgagttaaggtttattttaaggtcacagaatgccaggcaattgccgtgatttacctctcagaattatggactctgttgtgtttcttcctttttgtctaatttagggaatcttatttgcttggaatgaaaaggatttgccagcaggaagacagccacagatggcagtgcacattctgtaaaatacaaaaacaaaacaaacaccagaaaaaataaatccaagagtctgatcccataaatttctgcactaaggagcaactccaaactgcacaccaasctgctttaaaaggcgtttgtgttaagccttagagtgttttatcacattcgtgatatttgatacagaatacgtcagaccaaaagccacatcctaggatcttctttaaaatatcattaaaatagatgaagcattttaagatgtaaagtttcatttcctaagggatcctctagttgtaaagattgcagctagttgttgttgttattattatttgagatggagtctcgctctgtcactaggctggagtgtagaggcgtgatctcggctcactgcaacctccacctccggggtacaagcaattct

SEQ ID NO: 195004 - DNA, 601 bp, Human
aaaagtaatcattcctgctcttataattacatcttaattatttctgaacagatcccttttctctccttatgctaagactgcatgattaatgcatttttatctctcacactcagtctttttattatgttatttgtctttttccctcttcagtcaccaacacagttcacacttaatcgtgtgaagaaaaactatcatcccttgcttgctaatgtgcattttcctgcaaagatccaaattccacttttcctgcaaaaacaccaagcgcatttatgtatctcaaatcaactatggtattagtctyacctatttttgcctggtcattttagttgtatcccaccttttgtttctacagtgttttcatagaaaatcagtttctacagtgttttcatagaaaatcacattgtatccatgattttgttgagtcaaaggatatgtgtgtttttaattttgatactactacaaaccatcctctaatgatataatccgattgacagtccagcaatctatgaataccttttccccacatcctcaccaaaacagtgcatcatattattcttttaaatgtggctgttctatatgaaaaataaaattttcttgttat

SEQ ID NO: 195005 - DNA, 601 bp, Human
aacacagttcacacttaatcgtgtgaagaaaaactatcatcccttgcttgctaatgtgcattttcctgcaaagatccaaattccacttttcctgcaaaaacaccaagcgcatttatgtatctcaaatcaactatggtattagtcttacctatttttgcctggtcattttagttgtatcccaccttttgtttctacagtgttttcatagaaaatcagtttctacagtgttttcatagaaaatcacattgtatccatgattttgttgagtcaaaggatatgtgtgtttttaattttgatactrctacaaaccatcctctaatgatataatccgattgacagtccagcaatctatgaataccttttccccacatcctcaccaaaacagtgcatcatattattcttttaaatgtggctgttctatatgaaaaataaaattttcttgttatagtttgtatttcattaattatgagttgggttaagtatctttgcatatgtttatatatcatttatatttatttttccataaactccctctttatattctttgctccaataattatttatatctttatattctttcctattgatttataagtattct

SEQ ID NO: 195006 - DNA, 601 bp, Human
ttagttgtatcccaccttttgtttctacagtgttttcatagaaaatcagtttctacagtgttttcatagaaaatcacattgtatccatgattttgttgagtcaaaggatatgtgtgtttttaattttgatactactacaaaccatcctctaatgatataatccgattgacagtccagcaatctatgaataccttttccccacatcctcaccaaaacagtgcatcatattattcttttaaatgtggctgttctatatgaaaaataaaattttcttgttatagtttgtatttcattaattatragttgggttaagtatctttgcatatgtttatatatcatttatatttatttttccataaactccctctttatattctttgctccaataattatttatatctttatattctttcctattgatttataagtattcttaatatattaagtaaattagtatttttaatgttttccttgtttcatctcaatttttttgaatttatgggatttttttttccatgtaaaagttactaaattttacatggtgaaatgtaaagtgttttatggcttttgggttttgtgacataccttctccatttagaac

SEQ ID NO: 195007 - DNA, 601 bp, Human
ttgtgctaatgcaaccgaaaagagtatttcaaaaccaagagccgaactgggcattcataaaagacttaaaatatgtgtagaattaatttttaaaagcactttaggtttgcccatgccccccttctaaccgcacagtggagacagaatctggtcagctgtctgtggtctgggtgactccaccatgttctcagcaacgctcctcatctatgtattatactagtttctgaaaacttaagaataaaaaggatcaacctcacattttgatgaaatagcagttacaacacaaacatcccatgcctaytggcagaactggtccacagagcgcagaagcacattcatcgtgtaaagctgaaaacagcgtcttctgcaagttgagataccgaggttccagcagaagataaaaagcatttaaaaatatttaattattcactgaactcctttgaaagacacaggatgacaaagcagatcaataatattcagccatttccaaagggtccatccacagccaaagtatggcctttgaatttactagaaatttccacagagggagagtaaaaggaatcccttcatccttgcttgagtcctaaaataacatgcgcct

SEQ ID NO: 195008 - DNA, 601 bp, Human
gccgaactgggcattcataaaagacttaaaatatgtgtagaattaatttttaaaagcactttaggtttgcccatgccccccttctaaccgcacagtggagacagaatctggtcagctgtctgtggtctgggtgactccaccatgttctcagcaacgctcctcatctatgtattatactagtttctgaaaacttaagaataaaaaggatcaacctcacattttgatgaaatagcagttacaacacaaacatcccatgcctattggcagaactggtccacagagcgcagaagcacattcatcrtgtaaagctgaaaacagcgtcttctgcaagttgagataccgaggttccagcagaagataaaaagcatttaaaaatatttaattattcactgaactcctttgaaagacacaggatgacaaagcagatcaataatattcagccatttccaaagggtccatccacagccaaagtatggcctttgaatttactagaaatttccacagagggagagtaaaaggaatcccttcatccttgcttgagtcctaaaataacatgcgcctaagtattctcacaaatgatgaagcgcatctcttgagtaga

SEQ ID NO: 195009 - DNA, 601 bp, Human
ctcacaaatgatgaagcgcatctcttgagtagacttaaggtgataaaatgttattttcactgagctcccaagccatacatcatggaagtccaaagcccttactgataattgcataatgcccaggggatgtgtttctctgcagaagtctgaagacaatagatccagggtctcctgaagactttcatcttatgaattgtgcgaatccctgaccactgcctaagaggaaaggtgaaatacatcagagaatgtccttaaaaatatccctttttgacttactataattggttgctttcctcttttractatcataattttctcagccaccctctccctagaaactggggctatttctatgactcagcaaacaaccaattcttgctaatactgctttgctaataaggaaaccacaagttctcttagctgagactcctgtatagcaggtgtgttcacaaaacttggtgagcacccatatctgagacacagcattccataaagccagaggcagtcaccgaggctgtctgacataccataatatgcccgtatggcttcaggctttccaccctgatctggctgtatcccgcattgcacccatgcagcagca

SEQ ID NO: 195010 - DNA, 601 bp, Human
cactgcctaagaggaaaggtgaaatacatcagagaatgtccttaaaaatatccctttttgacttactataattggttgctttcctcttttaactatcataattttctcagccaccctctccctagaaactggggctatttctatgactcagcaaacaaccaattcttgctaatactgctttgctaataaggaaaccacaagttctcttagctgagactcctgtatagcaggtgtgttcacaaaacttggtgagcacccatatctgagacacagcattccataaagccagaggcagtcaccraggctgtctgacataccataatatgcccgtatggcttcaggctttccaccctgatctggctgtatcccgcattgcacccatgcagcagcagaaccagcagtaagaatgttttgtcaaaaaacaaatccataaacttcaaaaaaatccacggtacagtatttttaaaaatacgtctagccaggcgcagtggcacgtgcctatagtcccagctacatgagtccaggagttcaagatcagcctgagcaacatagcaagaccctgtctctaaaaagaaaattttaaaatgcatctgttctctct

SEQ ID NO: 195011 - DNA, 601 bp, Human
aaggtgaaatacatcagagaatgtccttaaaaatatccctttttgacttactataattggttgctttcctcttttaactatcataattttctcagccaccctctccctagaaactggggctatttctatgactcagcaaacaaccaattcttgctaatactgctttgctaataaggaaaccacaagttctcttagctgagactcctgtatagcaggtgtgttcacaaaacttggtgagcacccatatctgagacacagcattccataaagccagaggcagtcaccgaggctgtctgacatrccataatatgcccgtatggcttcaggctttccaccctgatctggctgtatcccgcattgcacccatgcagcagcagaaccagcagtaagaatgttttgtcaaaaaacaaatccataaacttcaaaaaaatccacggtacagtatttttaaaaatacgtctagccaggcgcagtggcacgtgcctatagtcccagctacatgagtccaggagttcaagatcagcctgagcaacatagcaagaccctgtctctaaaaagaaaattttaaaatgcatctgttctctctcatatatgcctttaa

SEQ ID NO: 195012 - DNA, 601 bp, Human
atactgctttgctaataaggaaaccacaagttctcttagctgagactcctgtatagcaggtgtgttcacaaaacttggtgagcacccatatctgagacacagcattccataaagccagaggcagtcaccgaggctgtctgacataccataatatgcccgtatggcttcaggctttccaccctgatctggctgtatcccgcattgcacccatgcagcagcagaaccagcagtaagaatgttttgtcaaaaaacaaatccataaacttcaaaaaaatccacggtacagtatttttaaaaataygtctagccaggcgcagtggcacgtgcctatagtcccagctacatgagtccaggagttcaagatcagcctgagcaacatagcaagaccctgtctctaaaaagaaaattttaaaatgcatctgttctctctcatatatgcctttaaacgcatccatagcatcaagaacctaaatgccaacatcccaatatttttcctccctgataaacttgctttagagattcaacttgtatttttgctttgaaccaggaaaggtatccaaggtcatactaagataaccatttattaaactctttggctgtt

SEQ ID NO: 195013 - DNA, 601 bp, Human
cccgcattgcacccatgcagcagcagaaccagcagtaagaatgttttgtcaaaaaacaaatccataaacttcaaaaaaatccacggtacagtatttttaaaaatacgtctagccaggcgcagtggcacgtgcctatagtcccagctacatgagtccaggagttcaagatcagcctgagcaacatagcaagaccctgtctctaaaaagaaaattttaaaatgcatctgttctctctcatatatgcctttaaacgcatccatagcatcaagaacctaaatgccaacatcccaatatttttcckccctgataaacttgctttagagattcaacttgtatttttgctttgaaccaggaaaggtatccaaggtcatactaagataaccatttattaaactctttggctgttttttcctaaactgtaataaactccccctctccaacattcaaaataatagtaaataattctctctgaaattaacacagtgttcctattattgctttcacaacactaaaaagaaatagaactaacggagtcgaactgtggggcattctggcaggcaaatcattaaattcacacaaatgattcggccaagggaaaaag

SEQ ID NO: 195014 - DNA, 601 bp, Human
cactctgggagcctgttagaaatacagatgcccaggtcccccacccgagaccaactcaggcagaagcagcatttttaccagagctcagggcatccgtatgccccttaatgtttgaaaggtctgaatcagagtgctctcccccaaaggcatctcagactgagatagaaattgaagaaaaagcctaaggaggttcagcaactttttcaaggccgaagaacccaccagttacacaagtgcagagccctttgtccctgacattcagagccctgcatgcataggaagtgacagccccttccggggmaccctgctgccgccacgcgcattctggaaactgtgcagcaggagaaacagcgttttccttcagaccggggtttaaatggcacttcccgaatttatattcccctagatttggggcttcttccttcttgcactcctgttaacatcagcatgaattcataaactccctgcagcggaaaggaaaagaagccgcgacaaacctcaacgaagagccgtacggcactgttaaccaagtgctccagtcctgccccagtgtttacaggaaattggttccaggacccccaaagacacccaaatccacaga

SEQ ID NO: 195015 - DNA, 601 bp, Human
tacacacaccctcccatatactttaaattgtctcttgtagattacttgtaatacctaatacaacataaatgctatgtaaagagttgttggccaggcacagtggctcacgcctgtaatccaagcactttgggaggctgaggcaagcagatcacgaggtcaggagttcgagaccagcctaaccaacatggtgaaacccaatctctactaaaaatacaaaaattagccgggcatggtggcgcatgcctgtaatttcagctactcaggaggctgaggcaggagaatcacttgaacccaggaagcrgaggttgcagtgagctgagattgtgccactacactccagcctgggcgacagagtgagactccgcctcaaaaaaaaaaaaaagatttgttatgctggattgtttagggaacaatgacaagaaaaaaatatctgtacgtgttcagtacagctgaaactttttttcccgaatatttttgatctgagtttggttgaatccacagttggggaacccgtggatgtggagggccagctggatagctgctcctggcagtgaggctctctgatccagactttcaaggttcaccctgagaactacagtaa

SEQ ID NO: 195016 - DNA, 601 bp, Human
ctttgaccattgatttataaacaattataaccaaacattaggactggaacaatttgcccacctgagaaataacaagacatttatctcacatgaaaatggacaccaaataccttaccttcgtgtttattttatgaaatacaaaatctgagcatatattaataatgagctatttttttcttttttcttttttttttgagatggagtcttgctcttttgcccaggctggagtgcagtggcacaatctcggctcactgcaatctccgcttcccgggttcatgctattctcctgcctcagcctccygagtagctaggactacaggcacccaccaccacacccagctacttttttgtatttttagtagagacggggtttcaccgtgttaaccaggatggtctcgatctcccgacctcatgatctgtctgcctcagcctcccaaagtgctaggattacaggcgtgagccactgtgcccggcctaatgagctattttcaattaaaatacctctttatcgttaatcagacaaaagagtacaatgtcagcctactctgagagcattaagaaatctttttcctgaaaggcaattgagacaattcagaagtta

SEQ ID NO: 195017 - DNA, 601 bp, Human
ggtacatattatttaaagaaggtcggccgggcgcggtggctcacgcctgtaatcccagcactttaagaggccaagaccggcagatcacgaggtcaggagatcgagaccatcttggataacacggtgaaaccccgtttctactaaaaatacaaaaaattagccgggcatgttggcgggcgcctgtagtcccagctactcgggaggctgaggcaggagaatggcgtgaacccaggaggcagagcttgcagtgagctgagatcgcgccactgcactccaacctgggggacacagcgagactccrtctcaaaaaataaagaaagaaagaaataaagaaggtcatgacggggcaggggataagggaagacaaagaaaaaggaggtcaggaaatttctgcgtttatcaaaaggagacaggaaatatcactcactcacaaagtatccaaatatctagtaaatatctccacctgggtgccccattagcacctccaactcaatatgtccaatacaaaactaattaattcctcatcacctaaaagggctcctcctcccatagtcccaacccaagccaaactgtctgcaagctgggacttcctcaacccttc

SEQ ID NO: 195018 - DNA, 601 bp, Human
tctgcgtttatcaaaaggagacaggaaatatcactcactcacaaagtatccaaatatctagtaaatatctccacctgggtgccccattagcacctccaactcaatatgtccaatacaaaactaattaattcctcatcacctaaaagggctcctcctcccatagtcccaacccaagccaaactgtctgcaagctgggacttcctcaacccttcaactccttgtccctttctagccttcaaaaggcagggtagagaagattgttgactttggaacgaaccctacacctgggttctaattttarctagactattcacaagcttagtgactttctagaaggatatggactaaatagtgtccagagaagagtaattataatgtcaaaaggtctggaaaagatgggcagtaacggtgcaagttttcattcctgaaaaatagcttttggtctttgaagggtggcttatgccagggaattgtatacattcataaccaaatcttcctgtgcttatggtttatgggtagcatgacttatcaggcaatttactgtaaatggacaagttcataattgaaaccacatccatgcttcagtatataatctaaagac

SEQ ID NO: 195019 - DNA, 601 bp, Human
acaggaaatatcactcactcacaaagtatccaaatatctagtaaatatctccacctgggtgccccattagcacctccaactcaatatgtccaatacaaaactaattaattcctcatcacctaaaagggctcctcctcccatagtcccaacccaagccaaactgtctgcaagctgggacttcctcaacccttcaactccttgtccctttctagccttcaaaaggcagggtagagaagattgttgactttggaacgaaccctacacctgggttctaattttaactagactattcacaagcttrgtgactttctagaaggatatggactaaatagtgtccagagaagagtaattataatgtcaaaaggtctggaaaagatgggcagtaacggtgcaagttttcattcctgaaaaatagcttttggtctttgaagggtggcttatgccagggaattgtatacattcataaccaaatcttcctgtgcttatggtttatgggtagcatgacttatcaggcaatttactgtaaatggacaagttcataattgaaaccacatccatgcttcagtatataatctaaagactatataaaccaaactcttca

SEQ ID NO: 195020 - DNA, 601 bp, Human
gactttggaacgaaccctacacctgggttctaattttaactagactattcacaagcttagtgactttctagaaggatatggactaaatagtgtccagagaagagtaattataatgtcaaaaggtctggaaaagatgggcagtaacggtgcaagttttcattcctgaaaaatagcttttggtctttgaagggtggcttatgccagggaattgtatacattcataaccaaatcttcctgtgcttatggtttatgggtagcatgacttatcaggcaatttactgtaaatggacaagttcataaytgaaaccacatccatgcttcagtatataatctaaagactatataaaccaaactcttcaaggatgcgtagaataaacagaccatgtcggaccaagaagttctcattagctaaagaactttattctttgtctattttattgttcactgtatatcctcagcacttggaaagaagtctgacatatagtaggcattctataaagatttagtgaataagtaaatgaataaatttgaagagaagattcaggtttaaaaaagaaagccaaggtttttattcaaggtttttattatatgtttttatata

SEQ ID NO: 195021 - DNA, 601 bp, Human
ggttctaattttaactagactattcacaagcttagtgactttctagaaggatatggactaaatagtgtccagagaagagtaattataatgtcaaaaggtctggaaaagatgggcagtaacggtgcaagttttcattcctgaaaaatagcttttggtctttgaagggtggcttatgccagggaattgtatacattcataaccaaatcttcctgtgcttatggtttatgggtagcatgacttatcaggcaatttactgtaaatggacaagttcataattgaaaccacatccatgcttcagtayataatctaaagactatataaaccaaactcttcaaggatgcgtagaataaacagaccatgtcggaccaagaagttctcattagctaaagaactttattctttgtctattttattgttcactgtatatcctcagcacttggaaagaagtctgacatatagtaggcattctataaagatttagtgaataagtaaatgaataaatttgaagagaagattcaggtttaaaaaagaaagccaaggtttttattcaaggtttttattatatgtttttatataaaccagttttattcccacgggataa

SEQ ID NO: 195022 - DNA, 601 bp, Human
aaggtctggaaaagatgggcagtaacggtgcaagttttcattcctgaaaaatagcttttggtctttgaagggtggcttatgccagggaattgtatacattcataaccaaatcttcctgtgcttatggtttatgggtagcatgacttatcaggcaatttactgtaaatggacaagttcataattgaaaccacatccatgcttcagtatataatctaaagactatataaaccaaactcttcaaggatgcgtagaataaacagaccatgtcggaccaagaagttctcattagctaaagaactttattctttgtctattttattgttcactgtatatcctcagcacttggaaagaagtctgacatatagtaggcattctataaagatttagtgaataagtaaatgaataaatttgaagagaagattcaggtttaaaaaagaaagccaaggtttttattcaaggtttttattatatgtttttatataaaccagttttattcccacgggataattttaggactaatcttatatctgatgataagcctaataaatgaaagatctttgcattcttgggctgacatttgggattgggaatattaatccac

SEQ ID NO: 195023 - DNA, 601 bp, Human
aaatagcttttggtctttgaagggtggcttatgccagggaattgtatacattcataaccaaatcttcctgtgcttatggtttatgggtagcatgacttatcaggcaatttactgtaaatggacaagttcataattgaaaccacatccatgcttcagtatataatctaaagactatataaaccaaactcttcaaggatgcgtagaataaacagaccatgtcggaccaagaagttctcattagctaaagaactttattctttgtctattttattgttcactgtatatcctcagcacttggaawgaagtctgacatatagtaggcattctataaagatttagtgaataagtaaatgaataaatttgaagagaagattcaggtttaaaaaagaaagccaaggtttttattcaaggtttttattatatgtttttatataaaccagttttattcccacgggataattttaggactaatcttatatctgatgataagcctaataaatgaaagatctttgcattcttgggctgacatttgggattgggaatattaatccacactacctaccccagaaaatcctgaagggaaatgggaaagtgagctgat

SEQ ID NO: 195024 - DNA, 601 bp, Human
aagactatataaaccaaactcttcaaggatgcgtagaataaacagaccatgtcggaccaagaagttctcattagctaaagaactttattctttgtctattttattgttcactgtatatcctcagcacttggaaagaagtctgacatatagtaggcattctataaagatttagtgaataagtaaatgaataaatttgaagagaagattcaggtttaaaaaagaaagccaaggtttttattcaaggtttttattatatgtttttatataaaccagttttattcccacgggataattttaggaytaatcttatatctgatgataagcctaataaatgaaagatctttgcattcttgggctgacatttgggattgggaatattaatccacactacctaccccagaaaatcctgaagggaaatgggaaagtgagctgatgagaaagtagctgactacactgtactacatgttggctctccccatttccctgcctagctaactggatttaggattggaccaattggccgggcatggtggctcacacctgtaatcccagcactttgaaaggccaaggtgggaggatcgtttgagcccaggaattcaag

SEQ ID NO: 195025 - DNA, 601 bp, Human
aaagatttagtgaataagtaaatgaataaatttgaagagaagattcaggtttaaaaaagaaagccaaggtttttattcaaggtttttattatatgtttttatataaaccagttttattcccacgggataattttaggactaatcttatatctgatgataagcctaataaatgaaagatctttgcattcttgggctgacatttgggattgggaatattaatccacactacctaccccagaaaatcctgaagggaaatgggaaagtgagctgatgagaaagtagctgactacactgtactacrtgttggctctccccatttccctgcctagctaactggatttaggattggaccaattggccgggcatggtggctcacacctgtaatcccagcactttgaaaggccaaggtgggaggatcgtttgagcccaggaattcaagaccagcttgggcaacatagggaaaccccatctctacaaaaaataaaaaaatttgccaggtgtgatagtgcatggctgtggtcccagctactcaggagtctgaggcaggaggaacacttgagcctgggaggtccaggctgcagtgagccatgattgtgccact

SEQ ID NO: 195026 - DNA, 601 bp, Human
cgggcatggtggctcacacctgtaatcccagcactttgaaaggccaaggtgggaggatcgtttgagcccaggaattcaagaccagcttgggcaacatagggaaaccccatctctacaaaaaataaaaaaatttgccaggtgtgatagtgcatggctgtggtcccagctactcaggagtctgaggcaggaggaacacttgagcctgggaggtccaggctgcagtgagccatgattgtgccactgcactccagcctggtcaacacagcaagaccaaatcttaaaaaaaaaaaaaaaaaaaaaaggattgagccagttaaaacaagcaaaaaccatcagtggtctcttttgcatcccccagttaaagacttggggaatatgaaatccttgaatacccaagagttaagttcactttcatttgtagcttgcttagtgtctgtgcttttactcagtcaactgatagttgagataatttggaatatatatacgtatctatctaaaaagtataattttcctggtcctaaacaagaatatcaagtctggccaggtgcagtggctcatgcctgtaattgcagcattttgggaggccagggtgagtggataa

SEQ ID NO: 195027 - DNA, 601 bp, Human
aacatagggaaaccccatctctacaaaaaataaaaaaatttgccaggtgtgatagtgcatggctgtggtcccagctactcaggagtctgaggcaggaggaacacttgagcctgggaggtccaggctgcagtgagccatgattgtgccactgcactccagcctggtcaacacagcaagaccaaatcttaaaaaaaaaaaaaaaaaaaaaaggattgagccagttaaaacaagcaaaaaccatcagtggtctcttttgcatcccccagttaaagacttggggaatatgaaatccttgaatacycaagagttaagttcactttcatttgtagcttgcttagtgtctgtgcttttactcagtcaactgatagttgagataatttggaatatatatacgtatctatctaaaaagtataattttcctggtcctaaacaagaatatcaagtctggccaggtgcagtggctcatgcctgtaattgcagcattttgggaggccagggtgagtggataacttgagatcaggagtttgagaccaggctggctaacatggtgaaaccctgtctctactaaaaatacaaaaattagccaggcgtggtggcaggt

SEQ ID NO: 195028 - DNA, 601 bp, Human
tccttgaatacccaagagttaagttcactttcatttgtagcttgcttagtgtctgtgcttttactcagtcaactgatagttgagataatttggaatatatatacgtatctatctaaaaagtataattttcctggtcctaaacaagaatatcaagtctggccaggtgcagtggctcatgcctgtaattgcagcattttgggaggccagggtgagtggataacttgagatcaggagtttgagaccaggctggctaacatggtgaaaccctgtctctactaaaaatacaaaaattagccaggcrtggtggcaggtgcctgtaatcccagctacttgggaggctgaggcaggagaatcacctgagcctgcaaggcagcagttgcagcaagccaagatcacaccactgcactcactccagcctggacaacagagtgagaccctttccccacactgcccccgccccacacacacacaaaaaaagaatatcaagtctaaaagagaaaggattaaatcacatgtgttgaaagaatctggaatctccctttttggttgccatatttccaagagaagaggaggaaaaagggctctacctgcttttcatcat

SEQ ID NO: 195029 - DNA, 601 bp, Human
ctgtgcttttactcagtcaactgatagttgagataatttggaatatatatacgtatctatctaaaaagtataattttcctggtcctaaacaagaatatcaagtctggccaggtgcagtggctcatgcctgtaattgcagcattttgggaggccagggtgagtggataacttgagatcaggagtttgagaccaggctggctaacatggtgaaaccctgtctctactaaaaatacaaaaattagccaggcgtggtggcaggtgcctgtaatcccagctacttgggaggctgaggcaggagaawcacctgagcctgcaaggcagcagttgcagcaagccaagatcacaccactgcactcactccagcctggacaacagagtgagaccctttccccacactgcccccgccccacacacacacaaaaaaagaatatcaagtctaaaagagaaaggattaaatcacatgtgttgaaagaatctggaatctccctttttggttgccatatttccaagagaagaggaggaaaaagggctctacctgcttttcatcattatcccggataatcttggaagtccatagcccaggaataaattagtgttagaa

SEQ ID NO: 195030 - DNA, 601 bp, Human
atcaagtctggccaggtgcagtggctcatgcctgtaattgcagcattttgggaggccagggtgagtggataacttgagatcaggagtttgagaccaggctggctaacatggtgaaaccctgtctctactaaaaatacaaaaattagccaggcgtggtggcaggtgcctgtaatcccagctacttgggaggctgaggcaggagaatcacctgagcctgcaaggcagcagttgcagcaagccaagatcacaccactgcactcactccagcctggacaacagagtgagaccctttccccacacygcccccgccccacacacacacaaaaaaagaatatcaagtctaaaagagaaaggattaaatcacatgtgttgaaagaatctggaatctccctttttggttgccatatttccaagagaagaggaggaaaaagggctctacctgcttttcatcattatcccggataatcttggaagtccatagcccaggaataaattagtgttagaaaacggagtatgtagcaatgttctccctgaatcataacataaacctgtttgcctggtgtgtacacatttcattgtaccaaataagtacttctaaatt

SEQ ID NO: 195031 - DNA, 601 bp, Human
gctcatgcctgtaattgcagcattttgggaggccagggtgagtggataacttgagatcaggagtttgagaccaggctggctaacatggtgaaaccctgtctctactaaaaatacaaaaattagccaggcgtggtggcaggtgcctgtaatcccagctacttgggaggctgaggcaggagaatcacctgagcctgcaaggcagcagttgcagcaagccaagatcacaccactgcactcactccagcctggacaacagagtgagaccctttccccacactgcccccgccccacacacacacamaaaaagaatatcaagtctaaaagagaaaggattaaatcacatgtgttgaaagaatctggaatctccctttttggttgccatatttccaagagaagaggaggaaaaagggctctacctgcttttcatcattatcccggataatcttggaagtccatagcccaggaataaattagtgttagaaaacggagtatgtagcaatgttctccctgaatcataacataaacctgtttgcctggtgtgtacacatttcattgtaccaaataagtacttctaaattctttttacatttaactggtgcca

SEQ ID NO: 195032 - DNA, 601 bp, Human
ttgggaggccagggtgagtggataacttgagatcaggagtttgagaccaggctggctaacatggtgaaaccctgtctctactaaaaatacaaaaattagccaggcgtggtggcaggtgcctgtaatcccagctacttgggaggctgaggcaggagaatcacctgagcctgcaaggcagcagttgcagcaagccaagatcacaccactgcactcactccagcctggacaacagagtgagaccctttccccacactgcccccgccccacacacacacaaaaaaagaatatcaagtctaaaagwgaaaggattaaatcacatgtgttgaaagaatctggaatctccctttttggttgccatatttccaagagaagaggaggaaaaagggctctacctgcttttcatcattatcccggataatcttggaagtccatagcccaggaataaattagtgttagaaaacggagtatgtagcaatgttctccctgaatcataacataaacctgtttgcctggtgtgtacacatttcattgtaccaaataagtacttctaaattctttttacatttaactggtgccatccagtagccagagcttgctttag

SEQ ID NO: 195033 - DNA, 601 bp, Human
tcttggaagtccatagcccaggaataaattagtgttagaaaacggagtatgtagcaatgttctccctgaatcataacataaacctgtttgcctggtgtgtacacatttcattgtaccaaataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgcygacttgcagatggacttcgggatctatttgcctttaccgggcttaaaatttgttttatcttagagaaatacctaaatttaacacaactgattcttacgtttataatagggaaagaaatagaaaattcactaggcagttaatattcttaactgttttgaattattacccccttacaaattcctaaagtgtgccagtgtcttattacagccatgaaaaatacaagtttaaaggaatgattcctttttaaactttttaatactgtagctgtaaaaagctcatctacaaatacattgaatgcca

SEQ ID NO: 195034 - DNA, 601 bp, Human
gtacacatttcattgtaccaaataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgccgacttgcagatggacttcgggatctatttgcctttaccgggcttaaaatttgttttatcttagagaaatacctaaatttaacacaactgattcttacrtttataatagggaaagaaatagaaaattcactaggcagttaatattcttaactgttttgaattattacccccttacaaattcctaaagtgtgccagtgtcttattacagccatgaaaaatacaagtttaaaggaatgattcctttttaaactttttaatactgtagctgtaaaaagctcatctacaaatacattgaatgccaccagttgtgcatggggttaaaagtggatgggaagcagatttcaaccaaatgtaagaaacatattcaaatgcataaactcgtctgtctgtggaactaga

SEQ ID NO: 195035 - DNA, 601 bp, Human
acatttcattgtaccaaataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgccgacttgcagatggacttcgggatctatttgcctttaccgggcttaaaatttgttttatcttagagaaatacctaaatttaacacaactgattcttacgtttrtaatagggaaagaaatagaaaattcactaggcagttaatattcttaactgttttgaattattacccccttacaaattcctaaagtgtgccagtgtcttattacagccatgaaaaatacaagtttaaaggaatgattcctttttaaactttttaatactgtagctgtaaaaagctcatctacaaatacattgaatgccaccagttgtgcatggggttaaaagtggatgggaagcagatttcaaccaaatgtaagaaacatattcaaatgcataaactcgtctgtctgtggaactagagcag

SEQ ID NO: 195036 - DNA, 601 bp, Human
aataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgccgacttgcagatggacttcgggatctatttgcctttaccgggcttaaaatttgttttatcttagagaaatacctaaatttaacacaactgattcttacgtttataatagggaaagaaayagaaaattcactaggcagttaatattcttaactgttttgaattattacccccttacaaattcctaaagtgtgccagtgtcttattacagccatgaaaaatacaagtttaaaggaatgattcctttttaaactttttaatactgtagctgtaaaaagctcatctacaaatacattgaatgccaccagttgtgcatggggttaaaagtggatgggaagcagatttcaaccaaatgtaagaaacatattcaaatgcataaactcgtctgtctgtggaactagagcaggccagctcaggtagct

SEQ ID NO: 195037 - DNA, 601 bp, Human; identical to SEQ ID NO: 37240

SEQ ID NO: 195038 - DNA, 601 bp, Human; identical to SEQ ID NO: 37241

SEQ ID NO: 195039 - DNA, 601 bp, Human; identical to SEQ ID NO: 37242

SEQ ID NO: 195040 - DNA, 601 bp, Human; identical to SEQ ID NO: 37243

SEQ ID NO: 195041 - DNA, 601 bp, Human; identical to SEQ ID NO: 37244

SEQ ID NO: 195042 - DNA, 601 bp, Human; identical to SEQ ID NO: 37245

SEQ ID NO: 195043 - DNA, 601 bp, Human; identical to SEQ ID NO: 37246

SEQ ID NO: 195044 - DNA, 601 bp, Human; identical to SEQ ID NO: 37247

SEQ ID NO: 195045 - DNA, 601 bp, Human; identical to SEQ ID NO: 37248

SEQ ID NO: 195046 - DNA, 601 bp, Human; identical to SEQ ID NO: 37249

SEQ ID NO: 195047 - DNA, 601 bp, Human; identical to SEQ ID NO: 37250

SEQ ID NO: 195048 - DNA, 601 bp, Human; identical to SEQ ID NO: 37251

SEQ ID NO: 195049 - DNA, 601 bp, Human; identical to SEQ ID NO: 37252

SEQ ID NO: 195050 - DNA, 601 bp, Human; identical to SEQ ID NO: 37253

SEQ ID NO: 195051 - DNA, 601 bp, Human; identical to SEQ ID NO: 37254

SEQ ID NO: 195052 - DNA, 601 bp, Human; identical to SEQ ID NO: 37255

SEQ ID NO: 195053 - DNA, 601 bp, Human; identical to SEQ ID NO: 37256

SEQ ID NO: 195054 - DNA, 601 bp, Human; identical to SEQ ID NO: 37257

SEQ ID NO: 195055 - DNA, 601 bp, Human; identical to SEQ ID NO: 37258

SEQ ID NO: 195056 - DNA, 601 bp, Human; identical to SEQ ID NO: 37259

SEQ ID NO: 195057 - DNA, 601 bp, Human; identical to SEQ ID NO: 37260

SEQ ID NO: 195058 - DNA, 601 bp, Human; identical to SEQ ID NO: 37261

SEQ ID NO: 195059 - DNA, 601 bp, Human; identical to SEQ ID NO: 37262

SEQ ID NO: 195060 - DNA, 601 bp, Human; identical to SEQ ID NO: 37263

SEQ ID NO: 195061 - DNA, 601 bp, Human; identical to SEQ ID NO: 37264

SEQ ID NO: 195062 - DNA, 601 bp, Human; identical to SEQ ID NO: 37265

SEQ ID NO: 195063 - DNA, 601 bp, Human; identical to SEQ ID NO: 37266

SEQ ID NO: 195064 - DNA, 601 bp, Human; identical to SEQ ID NO: 37267

SEQ ID NO: 195065 - DNA, 601 bp, Human; identical to SEQ ID NO: 37268

SEQ ID NO: 195066 - DNA, 601 bp, Human; identical to SEQ ID NO: 37269

SEQ ID NO: 195067 - DNA, 601 bp, Human; identical to SEQ ID NO: 37270

SEQ ID NO: 195068 - DNA, 601 bp, Human; identical to SEQ ID NO: 37271

SEQ ID NO: 195069 - DNA, 601 bp, Human
cagatgttatgatttgtttgctctttttcttttatagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaaracggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtctt

SEQ ID NO: 195070 - DNA, 601 bp, Human
tagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggmggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatg

SEQ ID NO: 195071 - DNA, 601 bp, Human
ggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccrtgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaacca

SEQ ID NO: 195072 - DNA, 601 bp, Human
attggctgggtcaggtatagtttttttttaaattgctaggctatttttttttttgagttgtacatgttattgtgtacatagtctatgtggtttggggacatttacattttccaaatagaaaagataaacattttccattctacccaagcaactaatttattaaacagtcacttgatctaagtcatgagcacttggaagagaaccagagtggaaacagcatttagcactgaacacaaaccatcccagcagcccctggaagcgtcctggagccctttatttgcacagggccctgcagagaacrgagaacaccacacccggtgagaggaggctgtgggtacaaggatgactcttatgaaaggcaggagaaaagtgagcctgaggaggcgctggccaggcagagccagtagcaccttacacaacctgacaggtgtgcacacaggccctgtgctgacctgtgaggtttcgctggagtgaggttgggccctgccttggggaactagagcctcttttgggagtggcaaggaccagagccaggtccagggactttccacagtccatgaggcctgaaggcagcagcagagctacagctcttcccagagca

SEQ ID NO: 195073 - DNA, 601 bp, Human
tatagtttttttttaaattgctaggctatttttttttttgagttgtacatgttattgtgtacatagtctatgtggtttggggacatttacattttccaaatagaaaagataaacattttccattctacccaagcaactaatttattaaacagtcacttgatctaagtcatgagcacttggaagagaaccagagtggaaacagcatttagcactgaacacaaaccatcccagcagcccctggaagcgtcctggagccctttatttgcacagggccctgcagagaacggagaacaccacaccyggtgagaggaggctgtgggtacaaggatgactcttatgaaaggcaggagaaaagtgagcctgaggaggcgctggccaggcagagccagtagcaccttacacaacctgacaggtgtgcacacaggccctgtgctgacctgtgaggtttcgctggagtgaggttgggccctgccttggggaactagagcctcttttgggagtggcaaggaccagagccaggtccagggactttccacagtccatgaggcctgaaggcagcagcagagctacagctcttcccagagcaactgactgttctggg

SEQ ID NO: 195074 - DNA, 601 bp, Human
ttttccaaatagaaaagataaacattttccattctacccaagcaactaatttattaaacagtcacttgatctaagtcatgagcacttggaagagaaccagagtggaaacagcatttagcactgaacacaaaccatcccagcagcccctggaagcgtcctggagccctttatttgcacagggccctgcagagaacggagaacaccacacccggtgagaggaggctgtgggtacaaggatgactcttatgaaaggcaggagaaaagtgagcctgaggaggcgctggccaggcagagccagtascaccttacacaacctgacaggtgtgcacacaggccctgtgctgacctgtgaggtttcgctggagtgaggttgggccctgccttggggaactagagcctcttttgggagtggcaaggaccagagccaggtccagggactttccacagtccatgaggcctgaaggcagcagcagagctacagctcttcccagagcaactgactgttctgggaacaatgagtacaggacagtcaggtcaaggagggaggaaaggtgaaggaagggatagagggaatggtgcgctttcatgtatttattcagca

SEQ ID NO: 195075 - DNA, 601 bp, Human
aagagaaccagagtggaaacagcatttagcactgaacacaaaccatcccagcagcccctggaagcgtcctggagccctttatttgcacagggccctgcagagaacggagaacaccacacccggtgagaggaggctgtgggtacaaggatgactcttatgaaaggcaggagaaaagtgagcctgaggaggcgctggccaggcagagccagtagcaccttacacaacctgacaggtgtgcacacaggccctgtgctgacctgtgaggtttcgctggagtgaggttgggccctgccttggggarctagagcctcttttgggagtggcaaggaccagagccaggtccagggactttccacagtccatgaggcctgaaggcagcagcagagctacagctcttcccagagcaactgactgttctgggaacaatgagtacaggacagtcaggtcaaggagggaggaaaggtgaaggaagggatagagggaatggtgcgctttcatgtatttattcagcaaacacttaaggaagacttacgtgccagtgaggatttctggacctggcgttgtgctggggatatagtgacaagacattccctttgagttg

SEQ ID NO: 195076 - DNA, 601 bp, Human
accacacccggtgagaggaggctgtgggtacaaggatgactcttatgaaaggcaggagaaaagtgagcctgaggaggcgctggccaggcagagccagtagcaccttacacaacctgacaggtgtgcacacaggccctgtgctgacctgtgaggtttcgctggagtgaggttgggccctgccttggggaactagagcctcttttgggagtggcaaggaccagagccaggtccagggactttccacagtccatgaggcctgaaggcagcagcagagctacagctcttcccagagcaactgacwgttctgggaacaatgagtacaggacagtcaggtcaaggagggaggaaaggtgaaggaagggatagagggaatggtgcgctttcatgtatttattcagcaaacacttaaggaagacttacgtgccagtgaggatttctggacctggcgttgtgctggggatatagtgacaagacattccctttgagttgaggagtaaaagacaggttatggagaatctatggggtcttttggacacaaacaccagggagggaaggacaggctgcctggaaggggacagggctggggtggggggatagccat

SEQ ID NO: 195077 - DNA, 601 bp, Human
cacccggtgagaggaggctgtgggtacaaggatgactcttatgaaaggcaggagaaaagtgagcctgaggaggcgctggccaggcagagccagtagcaccttacacaacctgacaggtgtgcacacaggccctgtgctgacctgtgaggtttcgctggagtgaggttgggccctgccttggggaactagagcctcttttgggagtggcaaggaccagagccaggtccagggactttccacagtccatgaggcctgaaggcagcagcagagctacagctcttcccagagcaactgactgttytgggaacaatgagtacaggacagtcaggtcaaggagggaggaaaggtgaaggaagggatagagggaatggtgcgctttcatgtatttattcagcaaacacttaaggaagacttacgtgccagtgaggatttctggacctggcgttgtgctggggatatagtgacaagacattccctttgagttgaggagtaaaagacaggttatggagaatctatggggtcttttggacacaaacaccagggagggaaggacaggctgcctggaaggggacagggctggggtggggggatagccatgacg

SEQ ID NO: 195078 - DNA, 601 bp, Human
accagagccaggtccagggactttccacagtccatgaggcctgaaggcagcagcagagctacagctcttcccagagcaactgactgttctgggaacaatgagtacaggacagtcaggtcaaggagggaggaaaggtgaaggaagggatagagggaatggtgcgctttcatgtatttattcagcaaacacttaaggaagacttacgtgccagtgaggatttctggacctggcgttgtgctggggatatagtgacaagacattccctttgagttgaggagtaaaagacaggttatggagaatstatggggtcttttggacacaaacaccagggagggaaggacaggctgcctggaaggggacagggctggggtggggggatagccatgacgcaggacgagctgtggtcctgaccagttcccccaggagggcaaaggacattttcaggaacatctttagggctcacggtagcgacaaggattgcctgcctcctatctgtgctgaagcctccttctgatcccagggcgcttgggttcttgggtgcaggggcggcagcgtctcactggggccctagtcatgtagagcatggagtggcgtctggcat

SEQ ID NO: 195079 - DNA, 601 bp, Human
tgaccagttcccccaggagggcaaaggacattttcaggaacatctttagggctcacggtagcgacaaggattgcctgcctcctatctgtgctgaagcctccttctgatcccagggcgcttgggttcttgggtgcaggggcggcagcgtctcactggggccctagtcatgtagagcatggagtggcgtctggcatggtggcagcccctggaggcaggtgccttccccagcctcctggcaggcctccctagggccttccgaagcctgtgcctactcctatcacctttgccctctgctctgtgrttacagtgacgccccgctgcatttaccctgttccctggccctctattttgtctccctgggctggtgctgtaacccaggtcctcatcatctgtgttggttcttgctgggcttcttcactcttccccactggtctttctctaccctcgtttgtaaatcctgctttgctagacacagcaaaagtctcccggagtcaagggcattagctctgaactgtgtcggagtcgctggggggctttgcagactgtgcctgacctcaggctctttctctccacccacgcagctttgttcagtattccctga

SEQ ID NO: 195080 - DNA, 601 bp, Human
gaagcctgtgcctactcctatcacctttgccctctgctctgtgattacagtgacgccccgctgcatttaccctgttccctggccctctattttgtctccctgggctggtgctgtaacccaggtcctcatcatctgtgttggttcttgctgggcttcttcactcttccccactggtctttctctaccctcgtttgtaaatcctgctttgctagacacagcaaaagtctcccggagtcaagggcattagctctgaactgtgtcggagtcgctggggggctttgcagactgtgcctgacctcakgctctttctctccacccacgcagctttgttcagtattccctgaacccaggctgctttgctcatggattttccttccccactatcagcagtgaattagtcaggggattgtctctgcattgcacattcatttaacaaataactccgaggagcctgagcaggaggtgccgcttgccacgggagtcctcagtgactgcctttgttaggactggtggccaaatggtgcccagagtgcacagtcagatgcccagaggcctcctctttctgacacctgtcccaggtttgtactcagccaggtccatg

SEQ ID NO: 195081 - DNA, 601 bp, Human
ccactggtctttctctaccctcgtttgtaaatcctgctttgctagacacagcaaaagtctcccggagtcaagggcattagctctgaactgtgtcggagtcgctggggggctttgcagactgtgcctgacctcaggctctttctctccacccacgcagctttgttcagtattccctgaacccaggctgctttgctcatggattttccttccccactatcagcagtgaattagtcaggggattgtctctgcattgcacattcatttaacaaataactccgaggagcctgagcaggaggtgccrcttgccacgggagtcctcagtgactgcctttgttaggactggtggccaaatggtgcccagagtgcacagtcagatgcccagaggcctcctctttctgacacctgtcccaggtttgtactcagccaggtccatgaccttgtgggactttgcttctgtctttatctctgacgatggtgcctcaaaacattgcacctactttgattccttgtatctctcgtgtaatcctattaatgggctcctgtggggagcctagcccagcttcacttttaaatgtgcggtgggtaatgttaaaacacagca

SEQ ID NO: 195082 - DNA, 601 bp, Human
ctgcattgcacattcatttaacaaataactccgaggagcctgagcaggaggtgccgcttgccacgggagtcctcagtgactgcctttgttaggactggtggccaaatggtgcccagagtgcacagtcagatgcccagaggcctcctctttctgacacctgtcccaggtttgtactcagccaggtccatgaccttgtgggactttgcttctgtctttatctctgacgatggtgcctcaaaacattgcacctactttgattccttgtatctctcgtgtaatcctattaatgggctcctgtggrgagcctagcccagcttcacttttaaatgtgcggtgggtaatgttaaaacacagcagggaactttgagggtgaagtgtgttaaaagataaactcaggtgcattaaaattgtagtttttttaggctgggcgcagtggctcatgcctgtaatcccagcacgctgggaggccgaggaaggtggatcacacgaggtcaggagatcaagaccgtcctgaccaacatgctgaaaccctgtctctactaaaaatacaaaatttagctgggtgtggtggcgcatgcctgtaatcccagctacttgggag

SEQ ID NO: 195083 - DNA, 601 bp, Human
taaaagataaactcaggtgcattaaaattgtagtttttttaggctgggcgcagtggctcatgcctgtaatcccagcacgctgggaggccgaggaaggtggatcacacgaggtcaggagatcaagaccgtcctgaccaacatgctgaaaccctgtctctactaaaaatacaaaatttagctgggtgtggtggcgcatgcctgtaatcccagctacttgggaggctgaggcaggagaatcgcttgaacccagaggtggaggtgcagtccagcctgggcaacaagcactaaactccatcttaaraagaagtcatagcgttttttggagcagaccaattcatgaatcagcaccaaaccacaagcagtatgagctccacctagaaggtgtgtgggaaagccattttgtaagacgtgtttgcacaagcaagacaaaggaagcatttgattggtcagagtggaaagttccggaggttagtgggtggtttctccttggaacaatctctcattagaagtcaattggcagtttctgattgctttaagtttccttccactgttgggtttccatgtgcttatgtaagacacaagacaccatctcagcctgatg

SEQ ID NO: 195084 - DNA, 601 bp, Human
aaatacaaaatttagctgggtgtggtggcgcatgcctgtaatcccagctacttgggaggctgaggcaggagaatcgcttgaacccagaggtggaggtgcagtccagcctgggcaacaagcactaaactccatcttaaaaagaagtcatagcgttttttggagcagaccaattcatgaatcagcaccaaaccacaagcagtatgagctccacctagaaggtgtgtgggaaagccattttgtaagacgtgtttgcacaagcaagacaaaggaagcatttgattggtcagagtggaaagttccrgaggttagtgggtggtttctccttggaacaatctctcattagaagtcaattggcagtttctgattgctttaagtttccttccactgttgggtttccatgtgcttatgtaagacacaagacaccatctcagcctgatggccttctaattaatttgttttaataagggcatactgaatccttggcccttgcctcatagattggaataatctgagaaaagaaaaacttctattcaaaagtgtaggatgatgaaaagtgaaataatgatagccaagcacttattttaagcatgctttgttggca

SEQ ID NO: 195085 - DNA, 601 bp, Human
cagtttctgattgctttaagtttccttccactgttgggtttccatgtgcttatgtaagacacaagacaccatctcagcctgatggccttctaattaatttgttttaataagggcatactgaatccttggcccttgcctcatagattggaataatctgagaaaagaaaaacttctattcaaaagtgtaggatgatgaaaagtgaaataatgatagccaagcacttattttaagcatgctttgttggcagctgtgcaatttggccatcatttcaaaagtcttttacagaaggaaaggctaggygaaaggaacagacccaaatctaggaagtgccatagatttcaatggtctcacgttgttaggggaaaaaagcaataaagtcgatcattaaaattaaccactctcagttttaaacatttaaaaattattaaatccaccatgacctaaattactcccatataaccaaattctctatttcattgttcccaaacttgggggtacaacattataggttgtcctgaaagatgacgtccagtcgctttgagagtcaaatcatttgctgaataaatgccttgttgttataagtaaaccaagggattatta

SEQ ID NO: 195086 - DNA, 601 bp, Human
tgcttgtttattaatttcgcctgattttctccaagcctttttaggaaattgaatttagcccaggaaattgaatttctccgtgtctctcattctgtctgttctgaatgttaggtgccaggacttaagatacttgtcaatattgtatgtgaacaaacttacaggtgaaatacatgcttgttgtagaaaacttagaaaataattcaaggaaagaaagaaaagttgcctataatttcatcttagagataaaactgacgatattgtggtattatctttttcccatatctttcattgcttttaatargtttttttctaagcagtagagatacacacatacacatacaacatcttgtaacctacttttagcagttggtaagtatttcttctgacttaatagaaacacttaatgaaaatgactgacagtgaggatttcatatgcttgggccagacattcccatgtctcaacgggtcctcatggtgtggtggctggagcacctgggaaaagggacattgccagccagccctgcctctgtgatgttctctggccatgtcaccatattcctgtgagcttccacgttctgatctgtaaaatagggataatagt

SEQ ID NO: 195087 - DNA, 601 bp, Human
aatataacacacttgtgctaattcagactaattgtcagcaggcttttctggaaagagccaggtagtgcatatcttaggctttgtgggccaagatactgggtaggtatttacgatgagagaaaacacattttcacaaaagtttcagtggtaaattcaaaatatattatcttagtgcattttttgtaatatatgtctaatgagaagaatagaattcttttcttggtgagggataacatttcacttattgggattcaaagttagtgtttcctattatcaacatctattgtaaatgttcctctcttagtgttgatctgtcatgagattttatgtattttatctctataaatggaagcgttgacatcagtccacatgtatatgattttaattgagcatgatcatcacttggaaggcactcatggaatcctgttagattcttctcttgatctttgcctttccatatggtattacattacagattcatatcttcctatggaagattagatggcaactcttccactgcacagctaaatggattttgaaatatggaaatccaggttcacacactgtatttaaacttagaatttatatccactgcaaactc

SEQ ID NO: 195088 - DNA, 601 bp, Human
ctaattgtcagcaggcttttctggaaagagccaggtagtgcatatcttaggctttgtgggccaagatactgggtaggtatttacgatgagagaaaacacattttcacaaaagtttcagtggtaaattcaaaatatattatcttagtgcattttttgtaatatatgtctaatgagaagaatagaattcttttcttggtgagggataacatttcacttattgggattcaaagttagtgtttcctattatcaacatctattgtaaatgttcctctcttagtgttgatctgtcatgagattttaygtattttatctctataaatggaagcgttgacatcagtccacatgtatatgattttaattgagcatgatcatcacttggaaggcactcatggaatcctgttagattcttctcttgatctttgcctttccatatggtattacattacagattcatatcttcctatggaagattagatggcaactcttccactgcacagctaaatggattttgaaatatggaaatccaggttcacacactgtatttaaacttagaatttatatccactgcaaactcatgtgagcatggagagctcacttcttt

SEQ ID NO: 195089 - DNA, 601 bp, Human
agagctcacttcttttaattttaatagcatggaaagtacagaacgcagtttgatatgacttgtgattggaacaatggcagttgtcatcaaaatgactttaacacagtatgagttttgcacaagtgctgttttgccttgcagctttaggttgaatttattatcaagtctgcagtaaaagctacttaagcccttcagaactcaataatggtggtgagggcagttcttgctcagaaaagtttcagtctcagctctgagctcaaaataatgtgatgaaactttattaagccatcaaactggtgtrtttatgtgggacaaatcggcatagtcagcttatttgtgacaaaaagttagagaactgatgatagttgagtccatgagagggattgtcattcactgttgacactatgggcttaatcacacacaacagattttctgcaaaagacctgctgatacaaggaatagcatgaaacaccttacatttttacaagtttgtaagtttgtaatttgttttttttttgtcccatacatttttatcaccatcatttgcaacagcttagcagattccactttggattctactaaattcgtgttttctcaacat

SEQ ID NO: 195090 - DNA, 601 bp, Human
gcagttcttgctcagaaaagtttcagtctcagctctgagctcaaaataatgtgatgaaactttattaagccatcaaactggtgtgtttatgtgggacaaatcggcatagtcagcttatttgtgacaaaaagttagagaactgatgatagttgagtccatgagagggattgtcattcactgttgacactatgggcttaatcacacacaacagattttctgcaaaagacctgctgatacaaggaatagcatgaaacaccttacatttttacaagtttgtaagtttgtaatttgttttttttttgtcccatacatttttatcaccatcatttgcaacagcttagcagattccactttggattctactaaattcgtgttttctcaacatctttgaaaatattctcaccggtagttgttctgcacagactatctaaagagcctaacccttcattcacttcagccttgatgtgaactcctcaaataaacaactgagccatatcagtaacatccatagactcacccagagccgacaaagactgctcatcatctgccttgctttttcttttttaattattattttgagacaggatctcactctgtcacc

SEQ ID NO: 195091 - DNA, 601 bp, Human
tccatagactcacccagagccgacaaagactgctcatcatctgccttgctttttcttttttaattattattttgagacaggatctcactctgtcacccaagctggagtgcagtggcatgatcctcagcttattgcagcctccacctcccaggctctgatgatcctcccacctcagtctcccaagtagctgggactacaggcatgtaccaccacacccagctaattttcatattttttgtagagagggggtttcgccatgttgcccaggctagtcacagccatctacctgccttggcctccygaagtgctgggattacaggcatgagccactgcatctggtcctgccttgcttaaatagactgttgagggtgctcccagtgtccttaactcctctagcaagtgttctccccaaaaggctaattgtgagaaacaagtgtgtattctctggacacgcctctttggttgctgctgttgattaactcaccattgatgcacagctttccttgcttcactaaccaatgagccgcccgataacctactttggttgcagcctcattttcctttgttttgtgaagaaatcctgctgccttggcctctgtgc

SEQ ID NO: 195092 - DNA, 601 bp, Human
agctgggactacaggcatgtaccaccacacccagctaattttcatattttttgtagagagggggtttcgccatgttgcccaggctagtcacagccatctacctgccttggcctcctgaagtgctgggattacaggcatgagccactgcatctggtcctgccttgcttaaatagactgttgagggtgctcccagtgtccttaactcctctagcaagtgttctccccaaaaggctaattgtgagaaacaagtgtgtattctctggacacgcctctttggttgctgctgttgattaactcaccrttgatgcacagctttccttgcttcactaaccaatgagccgcccgataacctactttggttgcagcctcattttcctttgttttgtgaagaaatcctgctgccttggcctctgtgccttaaatgttctagtttttctgaccagtgcttttctgtgagttgggaataggctggtgagtgcagagtctgataatattatcctctattatattcttttgacacagttctagtgtcattgccagctgacgtttttcaggtcagaattcaacccacaacttagaagaaaattgggagaaatggatc

SEQ ID NO: 195093 - DNA, 601 bp, Human
tagagtgagagccactctgtcttctgccattaattctgtccatccgggtctaacacaaggcctcctgttctggttgacaaatgggccgaggcaggaaggatgtctgatcacaagacaagattgcctcctgtttttaagggagcctatgacagtccaagaagcccacacgtacctctgtcaaaaccaaattctgcttgttccacaggaaatgttggtatgcaagcacttgcagtgtgcctacatcccaaatgccagcccatggtacccattgtctgcccggatctgaatcatgattccaagrcgcagagagaaattgctgggattcgttgttcttattcattgcttggcaacactgcagcttccaggagaatacccacctcactgatgacacaacatctgaatgcacacttactggccaacacgtgctttgctgtaaatcagtatgaagtcttcctaggggtcctggcctgaatgagatgagaaccttggaggctgcttttgactcatgtgaatgtcttccccaggagttaagtgggagtgctggggagagagtggcttgaggatgcacagccagcatgacactactattatgtgattactg

SEQ ID NO: 195094 - DNA, 601 bp, Human
attaattctgtccatccgggtctaacacaaggcctcctgttctggttgacaaatgggccgaggcaggaaggatgtctgatcacaagacaagattgcctcctgtttttaagggagcctatgacagtccaagaagcccacacgtacctctgtcaaaaccaaattctgcttgttccacaggaaatgttggtatgcaagcacttgcagtgtgcctacatcccaaatgccagcccatggtacccattgtctgcccggatctgaatcatgattccaaggcgcagagagaaattgctgggattcgttrttcttattcattgcttggcaacactgcagcttccaggagaatacccacctcactgatgacacaacatctgaatgcacacttactggccaacacgtgctttgctgtaaatcagtatgaagtcttcctaggggtcctggcctgaatgagatgagaaccttggaggctgcttttgactcatgtgaatgtcttccccaggagttaagtgggagtgctggggagagagtggcttgaggatgcacagccagcatgacactactattatgtgattactgtcgacgttcataaccataactaatgact

SEQ ID NO: 195095 - DNA, 601 bp, Human
cctatgacagtccaagaagcccacacgtacctctgtcaaaaccaaattctgcttgttccacaggaaatgttggtatgcaagcacttgcagtgtgcctacatcccaaatgccagcccatggtacccattgtctgcccggatctgaatcatgattccaaggcgcagagagaaattgctgggattcgttgttcttattcattgcttggcaacactgcagcttccaggagaatacccacctcactgatgacacaacatctgaatgcacacttactggccaacacgtgctttgctgtaaatcagtrtgaagtcttcctaggggtcctggcctgaatgagatgagaaccttggaggctgcttttgactcatgtgaatgtcttccccaggagttaagtgggagtgctggggagagagtggcttgaggatgcacagccagcatgacactactattatgtgattactgtcgacgttcataaccataactaatgactaattatgactttaccctggcgcacatggtcagaatggaaacaaataacaagctttacagtttttcctgctctattaaggtataatttacaaataataaaattcacccattttaa

SEQ ID NO: 195096 - DNA, 601 bp, Human
ttgggctggtcgcggtggctcaggcctgtaatcccaacactttgggaggtagaggcaggtggatcacctgaggtcgggagttcgagaacagcctgaccaacatggagaaaccccgtctctactaaaaatacaaaattagccgggtgtggtaacacatgcctgtaatcccagctactcgggaggctgaggcaggagaatcgcttcaacccgggaggcggaggttgcggtgagccgagatcacgccactgcactccagcctggaccacaagagcgaaactccatctcaaaaaaaaaaaaaaaagtctgtagcttgatgaattttggtgattgcatatagttgtgtaatcatcaccgcaaatcaagaggtagaacagctgtattcctctaaaaaactccctttgtgtcattgtggccagtctccaccctgactctatttttgccttgtctggatttcgtaagtctaaattcagtttcacaatctatttttttttattttctttattattatacttgaagttctagggtatatgtgcagaacgtgcaggtttgttacataggtatacacatgccatggtggtttgctgcacccattaacccgtga

SEQ ID NO: 195097 - DNA, 601 bp, Human
ggctgggacaggaagatcgcttaagccctggagctcaaggccgcagtgagccatgatcaagccactgtactgcagcctgggcaacacagcaagaacctgtctcaaaaaataaaattaaaatcaaaatccacttttagcttagatataataaattagtataaatgttactgaggatgacatttgtacaagaaagtaagatttaaaacccaaatcatttaagataggattacagaaatgattatctttaattttttaaaaaattgtgcctgtttcttgtttcctaaggtgcttaatttacccrtttctgatgcgaggaggaaagcctatgccactgttggcgtgtacaatggcgattatgttctgtacctgtaacggctatttgcaaagcagatacttgagccattgtgcagtgtatgctgatgactgggtaacagatccccgttttctaataggtgagtgtccacagcagtgaactccgccttgttcacatcattgcttttatattgatgtcccagtggtttctaatgagaaagtccaagcttcctgtgagaacaaagacaacagagaaagcagcagcaccccggagtcccatgggagagcc

SEQ ID NO: 195098 - DNA, 601 bp, Human
gccgcagtgagccatgatcaagccactgtactgcagcctgggcaacacagcaagaacctgtctcaaaaaataaaattaaaatcaaaatccacttttagcttagatataataaattagtataaatgttactgaggatgacatttgtacaagaaagtaagatttaaaacccaaatcatttaagataggattacagaaatgattatctttaattttttaaaaaattgtgcctgtttcttgtttcctaaggtgcttaatttacccatttctgatgcgaggaggaaagcctatgccactgttggcrtgtacaatggcgattatgttctgtacctgtaacggctatttgcaaagcagatacttgagccattgtgcagtgtatgctgatgactgggtaacagatccccgttttctaataggtgagtgtccacagcagtgaactccgccttgttcacatcattgcttttatattgatgtcccagtggtttctaatgagaaagtccaagcttcctgtgagaacaaagacaacagagaaagcagcagcaccccggagtcccatgggagagcccagctgtctcagcacagctgggggcagagaggtgacgca

SEQ ID NO: 195099 - DNA, 601 bp, Human
ttaagttctaagcaaaaatgaaaataaaacagccatcaaaaatatttgcaagagcattaaaaattaacactctggctgggtgcagtggctcacactgtaatcctagcactttgggaggctgaggtgggcagatgacttgaatccaggagttcaagaccagcctgggcaacatggcgaaactccagctctacaaaaaatacaaaaacgtagctgggcatggtgacacgcaccatggtcccagcttactcagaggcactgaggtgggaggatcacctgaggccaggagatcaaggctgcagtragccatgattgtgccactgcgttccagcctgggtgacagagtgagactctgtctcaaaaaaaaaaaaaaaaaaaactcagggatcttatatataagaaaggttcttctatatatttgtttagtctatcctagcatttagatattaaaccatactgaggtgttgcttacaatggtagcatgctaaaagtctgaagtcagtctgtcagatttgcaaactaccctgcagtgcttcaccttaagctacataaagtgaccttacattgcattgtgctttttctccatgtgtattaatttataatc

SEQ ID NO: 195100 - DNA, 601 bp, Human
ttaaaaattaacactctggctgggtgcagtggctcacactgtaatcctagcactttgggaggctgaggtgggcagatgacttgaatccaggagttcaagaccagcctgggcaacatggcgaaactccagctctacaaaaaatacaaaaacgtagctgggcatggtgacacgcaccatggtcccagcttactcagaggcactgaggtgggaggatcacctgaggccaggagatcaaggctgcagtgagccatgattgtgccactgcgttccagcctgggtgacagagtgagactctgtctcaaaaaaaaaaaaaaaaaaaactcagggatcttatatataagaaaggttcttctatatatttgtttagtctatcctagcatttagatattaaaccatactgaggtgttgcttacaatggtagcatgctaaaagtctgaagtcagtctgtcagatttgcaaactaccctgcagtgcttcaccttaagctacataaagtgaccttacattgcattgtgctttttctccatgtgtattaatttataatcatagaaataaactaacacttggatagtactttgttgctgagagatccctttcacat

SEQ ID NO: 195101 - DNA, 601 bp, Human
aataagtaattatgcctactgtagttaccatgaagtaataagcaaataataataatatatttttttttttgagatggagtttctctatcgcccaggctggagtgcagaggtgcaatctcggctcactgcaacctctgcctcctgagttcaagagattctcctgcctcagcctcccgagtagctgggactataggtgcatgccactatgcccaactaattttttttattttttttagtaaagacagggtttcatcatgttggccagactggtcttggactcctgacctcaggtgattcaccygcctcagcctcccaaagtggtgggattacaggtgtgagccaccatgcccagcaaatttctaacaaaaggtttttcaaaacagcaaaagtggttaatctaaaatattttatagaaagattttaagttttttttttgtttgtttgtttgtttgtttgttttttcttgaggcagcctgtcatccaggctggagtgcagtggcgtgatcttggctcatggcaacgtgtgcctcccaggctcaagcaattcttgtgcctcaacctcagagtagctgggattacaggcttgcgccatcttacctgg

SEQ ID NO: 195102 - DNA, 601 bp, Human
agatctactcctaggaactgccacccttcaaggggtgacgtacagccagtggtgacagagcagcacaggagcatcacccctcctggttcatgtggtggagatggcagcattgcctcatgcagattttgtgagaaataagtgggatgcgtctgtctggtgggctgactccctgatgctccctggaaaggagccgtgtgcccaagtcagatttctgtccatacttgtcatcctgaagatgtagattgtgatgaacaggtcaaagtattttgagtacattagatgatgtatttgtattattagraaaacaaagccctgcttggcatacctgacaacagtccttaatggtttttactaccagttatggctaatatgttacactaacaatggtaatctgaagggttgcaataatactgttcagtcaggctggggctcgtagtgaaattttacggtttattagccataatcatcttgcaatttttttcctttaggttttggcttgtggttaacgggcatgttgataaacatccattcagatcatatcctaaggaatctcagaaaaccaggagatactggatacaaaataccaaggggtacgtacaga

SEQ ID NO: 195103 - DNA, 601 bp, Human
atttctgtccatacttgtcatcctgaagatgtagattgtgatgaacaggtcaaagtattttgagtacattagatgatgtatttgtattattagaaaaacaaagccctgcttggcatacctgacaacagtccttaatggtttttactaccagttatggctaatatgttacactaacaatggtaatctgaagggttgcaataatactgttcagtcaggctggggctcgtagtgaaattttacggtttattagccataatcatcttgcaatttttttcctttaggttttggcttgtggttaacrggcatgttgataaacatccattcagatcatatcctaaggaatctcagaaaaccaggagatactggatacaaaataccaaggggtacgtacagaaagtgaagaatttctgtgaaagttgcttgccatggttcctggctattttagtgttgccagctctaagaagtagtagcgtagtagttattagctacaagttttcagtgtaagtcatcattattaataacaagtgctattgttattgtcttattagaataacaaaagacccaaatctagctaactgaacagttattaaacaaagcagaa

SEQ ID NO: 195104 - DNA, 601 bp, Human
aaaactttaatggagaaagggcgtgacatcacttagtttgaaattcttccacttatgttcctagaaaccatatgagaatagcaacaaaaacaaacaatgctacaaacctcaaattacttaaactgtgaccctgagaacctggaatcagcaaagccagctccagacgtgatggtagtgtgatagaagtggcagagaagagaaaacatgacagagtcctagacaggctgctgatcacctattcagcccctgggtggattggggaagaatcctctctttggtgttgggcttatgagcaaactgyaccctcatggggtcatcccaaggagccgcttcctctggcaggtacagtggctgggagagcacagtgtaagctggatggtggccccctcgcttcctgcccagcacccttgcatggggaacagcatgattccaaattaatcggcaagtgttcatcccctgaaggagagggccctgtcctgaggaggagctgccatgagccagactaagaagggacagggcacagtcctggggaaggcagaatgaaaaggtgcagaagataccagaagccacagactggcagatttgagaaacaccacttcca

SEQ ID NO: 195105 - DNA, 601 bp, Human
gggacagggcacagtcctggggaaggcagaatgaaaaggtgcagaagataccagaagccacagactggcagatttgagaaacaccacttccaaaagaaagggcatccccagagacggcaggatcccatgggagggccctcctgggccaggctggttacggaaaggcctgcggtgccttatacagagggtcctgtccactgttccacagtagttgagatgccacaaaaacttttcagcccctgtccctccatttcctgctctcagtgtctgatccttgttctaatccaacatattcaaaccygaacaacaaaaaaggtacaatccccaaatctgtgcagtcataacattaggacagcaaaaaagcagcaaaacttacctgagcagaaacgtgtttcacaaagcaggggaaaattgtaatcaaaattccaacatgaattttaaaatgtgaatggaggccaagcgtggtggctgacgcctgtaatcccagcatgttgagaggccgaggtgggcagatcacatgaggtccagagttcgagaccaacctggccaacatggtaaaaccccatccctactaaaaacacaaaaattagctgggcgtggt

SEQ ID NO: 195106 - DNA, 601 bp, Human
gttcacgccattctcttgcctcagccccccgagtagctgggactacaggcgcccgccaccacgcctggctaattttttgtatttttactagagatggggtttcaccgtgttagccaggatggtctcgatctcctgacctcgtgatccgcccaccttggcctcccaaagtgctgggattacaggcgtgagccaccgtgcccggccaaaaaagatcattcttattgtgaatgatgttttggtgatagctggagaaggtagggaaaatatatccatcctaggcacattgaagtccatgaagaagaaatccaaagcattggaacagaatatattttaaaaactaattcaagaaagcttttgtgaagtaaaacaagacacaagagcgtctgccgtttgcaggtacgcaccctataccggaggaagtggacaggaaacagtgacgatcatctgcacgtgccatgagtggcttgtaagggaaagttcgttagattcttcagggcagcgttccgtgccagggtcttagaggcagcaacacgagaggcccaaggaacgtggaagccaaaatattatcctagctttggagtccctcatgtaaaatctgtca

SEQ ID NO: 195107 - DNA, 601 bp, Human
ttttgtatttttactagagatggggtttcaccgtgttagccaggatggtctcgatctcctgacctcgtgatccgcccaccttggcctcccaaagtgctgggattacaggcgtgagccaccgtgcccggccaaaaaagatcattcttattgtgaatgatgttttggtgatagctggagaaggtagggaaaatatatccatcctaggcacattgaagtccatgaagaagaaatccaaagcattggaacagaatatattttaaaaactaattcaagaaagcttttgtgaagtaaaacaagacamaagagcgtctgccgtttgcaggtacgcaccctataccggaggaagtggacaggaaacagtgacgatcatctgcacgtgccatgagtggcttgtaagggaaagttcgttagattcttcagggcagcgttccgtgccagggtcttagaggcagcaacacgagaggcccaaggaacgtggaagccaaaatattatcctagctttggagtccctcatgtaaaatctgtcaggttttgaagactcaggtgtagggagtctgagtgctgtgccccatgaagactccaccatggtcggctttgtgac

SEQ ID NO: 195108 - DNA, 601 bp, Human
ccgtgttagccaggatggtctcgatctcctgacctcgtgatccgcccaccttggcctcccaaagtgctgggattacaggcgtgagccaccgtgcccggccaaaaaagatcattcttattgtgaatgatgttttggtgatagctggagaaggtagggaaaatatatccatcctaggcacattgaagtccatgaagaagaaatccaaagcattggaacagaatatattttaaaaactaattcaagaaagcttttgtgaagtaaaacaagacacaagagcgtctgccgtttgcaggtacgcacmctataccggaggaagtggacaggaaacagtgacgatcatctgcacgtgccatgagtggcttgtaagggaaagttcgttagattcttcagggcagcgttccgtgccagggtcttagaggcagcaacacgagaggcccaaggaacgtggaagccaaaatattatcctagctttggagtccctcatgtaaaatctgtcaggttttgaagactcaggtgtagggagtctgagtgctgtgccccatgaagactccaccatggtcggctttgtgaccagctcccttcgctgcagactcttaatttt

SEQ ID NO: 195109 - DNA, 601 bp, Human
ccatctcaggctgggtgtcatggctcacacctgtaatcccagcactttgggaggccaagagaggtgggtcacctgaggtcaggaattccacaccagcctagccagcatagtgaaaccccatccctactaaaaatacaaaactccaaaaaaaaaaaaaaaaaggtagccaaaagccctcatgcatgcatgtaagttgcagtgtgctcagagatgtagtctctaccctatgctgcagtatttgctgaaattggtcttatgacttagggcgtaataggtttgtcttttttttttttttttttttgagacagagtctagctctgtcacccaggctggagtgcaatggcacgatctcggctcattgcaacctctgcctcctgggttcaagcgattctcatgcgtcagcctcccgagtagctgggactacaggtgtgtgccatcacacctggctgatttttgtattttcagtatagacaaggtttcaccatgttggccaggctggtctccaactcctgacctcacatgatccacctgcctcagcctcccaaagttctgggattagaggcgtgagccactgcgcccagcctaatttttttttaaaaaa

SEQ ID NO: 195110 - DNA, 601 bp, Human
tgtcatggctcacacctgtaatcccagcactttgggaggccaagagaggtgggtcacctgaggtcaggaattccacaccagcctagccagcatagtgaaaccccatccctactaaaaatacaaaactccaaaaaaaaaaaaaaaaaggtagccaaaagccctcatgcatgcatgtaagttgcagtgtgctcagagatgtagtctctaccctatgctgcagtatttgctgaaattggtcttatgacttagggcgtaataggtttgtcttttttttttttttttttttgagacagagtctagstctgtcacccaggctggagtgcaatggcacgatctcggctcattgcaacctctgcctcctgggttcaagcgattctcatgcgtcagcctcccgagtagctgggactacaggtgtgtgccatcacacctggctgatttttgtattttcagtatagacaaggtttcaccatgttggccaggctggtctccaactcctgacctcacatgatccacctgcctcagcctcccaaagttctgggattagaggcgtgagccactgcgcccagcctaatttttttttaaaaaaagctctgtccttaca

SEQ ID NO: 195111 - DNA, 601 bp, Human
gggcgtaataggtttgtcttttttttttttttttttttgagacagagtctagctctgtcacccaggctggagtgcaatggcacgatctcggctcattgcaacctctgcctcctgggttcaagcgattctcatgcgtcagcctcccgagtagctgggactacaggtgtgtgccatcacacctggctgatttttgtattttcagtatagacaaggtttcaccatgttggccaggctggtctccaactcctgacctcacatgatccacctgcctcagcctcccaaagttctgggattagaggcrtgagccactgcgcccagcctaatttttttttaaaaaaagctctgtccttacatgccttcagaattttctcagctctgcagacatagtgtccagttggaacctggggcagatcacaccaggcctctctaaacacacttgagtaaccacaaagctacagcctgagggtgagtcccaagtccaaggaggggccttctgccctccctctctgctgggacccttctccccacccctcatctggtctttggagtgtgccagccattgctgtctgcctcagggcctttgctgcatctcttctcctgc

SEQ ID NO: 195112 - DNA, 601 bp, Human
gacagagtctagctctgtcacccaggctggagtgcaatggcacgatctcggctcattgcaacctctgcctcctgggttcaagcgattctcatgcgtcagcctcccgagtagctgggactacaggtgtgtgccatcacacctggctgatttttgtattttcagtatagacaaggtttcaccatgttggccaggctggtctccaactcctgacctcacatgatccacctgcctcagcctcccaaagttctgggattagaggcgtgagccactgcgcccagcctaatttttttttaaaaaaagytctgtccttacatgccttcagaattttctcagctctgcagacatagtgtccagttggaacctggggcagatcacaccaggcctctctaaacacacttgagtaaccacaaagctacagcctgagggtgagtcccaagtccaaggaggggccttctgccctccctctctgctgggacccttctccccacccctcatctggtctttggagtgtgccagccattgctgtctgcctcagggcctttgctgcatctcttctcctgcctggagcactcctgagagcacctccagcacctgccaggct

SEQ ID NO: 195113 - DNA, 601 bp, Human
gagccacccacttcatccactcaaaacatctaatcgaaatctccaatgctgctgatgctacgaggtgcaaaaatgtataactctgtcctacttcatggagtttatcatcttttttgggactaaggacagagagaaaaagctaaaagaagaatagattgatatggtatagtgggaagagtacctaggtgtacttcccagcctcaccacgagtttgcagatgcaaaggatgattattggagataagaagaagaaaggtcatatctgaagtatctctttgtctaattttttttttaagacagcrtctcactctgtcacccaggctggagtgcagtggcacaatctcagctcactgccacctctgcctcccaggctcaggtgatcttcccacctcagccttccgagtagctgggattacaggcatgcaccaccaggcctggctaattttttatattttttgtagagttgtggtctcactatattgcccaagctggtcttaaactcctggactcaagtaatcctcacacctcagcctcctgaagtgctaggattcgaggcgtgagccaacgtggctggcctctttgtctaatacttgaagaagtga

SEQ ID NO: 195114 - DNA, 601 bp, Human
gtttatcatcttttttgggactaaggacagagagaaaaagctaaaagaagaatagattgatatggtatagtgggaagagtacctaggtgtacttcccagcctcaccacgagtttgcagatgcaaaggatgattattggagataagaagaagaaaggtcatatctgaagtatctctttgtctaattttttttttaagacagcgtctcactctgtcacccaggctggagtgcagtggcacaatctcagctcactgccacctctgcctcccaggctcaggtgatcttcccacctcagccttccragtagctgggattacaggcatgcaccaccaggcctggctaattttttatattttttgtagagttgtggtctcactatattgcccaagctggtcttaaactcctggactcaagtaatcctcacacctcagcctcctgaagtgctaggattcgaggcgtgagccaacgtggctggcctctttgtctaatacttgaagaagtgatagcataaatgtgagctctaagagcagcgccccgcattcttcgagacactccatcgtgccagtggcctggtattttcacgcatagacagtgaggagaga

SEQ ID NO: 195115 - DNA, 601 bp, Human
gaagtatctctttgtctaattttttttttaagacagcgtctcactctgtcacccaggctggagtgcagtggcacaatctcagctcactgccacctctgcctcccaggctcaggtgatcttcccacctcagccttccgagtagctgggattacaggcatgcaccaccaggcctggctaattttttatattttttgtagagttgtggtctcactatattgcccaagctggtcttaaactcctggactcaagtaatcctcacacctcagcctcctgaagtgctaggattcgaggcgtgagccawcgtggctggcctctttgtctaatacttgaagaagtgatagcataaatgtgagctctaagagcagcgccccgcattcttcgagacactccatcgtgccagtggcctggtattttcacgcatagacagtgaggagagagcgagatcagagagccacgacctacctaaatcccagagctgctgagaaaaacagaggggtctgcggaaagttgagtgagtgccgaaggcagagagggtttgagaaggaggctcaatgccaggcatggcagaaaacactgtgggccaggaatgggccttctgtgc

SEQ ID NO: 195116 - DNA, 601 bp, Human
ggcatggcagaaaacactgtgggccaggaatgggccttctgtgctgagaactgtgtctgccagaaggtcatatgagagtcctaagccctggcacctgtgaaagcgaccttactggagaacgttatcagttgagatgagaaggggaaacgtggatagacgtacaccaggtgatcacacagagtgggaaggccatgcgaagatggacacagaggcgggggcgatgcagccatgaacccaggaacacgtggtgccaccagagctgggggaaatgggactggaaccttccctgaaccttcagagrgagcgtagccctgctgccaccttgatttccaactcctggcatccagaactgggagagaatcagtggccgttattataagccacccagtgtgtggttaactttgttctagcagccacagggaactgatacgccagccttccagccatttaaaattgactgggaaagtaagggcaggagtatgattggtgaacccctctgttttctcctccgccagatgactttgttgtcaccggtttggttgaaatacaacgttatctctctaaatatacattctacaatctgacttcctcccctctgcgc

SEQ ID NO: 195117 - DNA, 601 bp, Human
ccaccttgatttccaactcctggcatccagaactgggagagaatcagtggccgttattataagccacccagtgtgtggttaactttgttctagcagccacagggaactgatacgccagccttccagccatttaaaattgactgggaaagtaagggcaggagtatgattggtgaacccctctgttttctcctccgccagatgactttgttgtcaccggtttggttgaaatacaacgttatctctctaaatatacattctacaatctgacttcctcccctctgcgcccgctgctcccagcackgcacctggcctgggcctcacttcccggtgaagatgccatccttttatattcctaatatttgatgtgaagaagtgagtaatggctcatttctcattaaaaaaaacaaatgagataacactgacgtttaaaaaaacacggatcagagtaagattgaacatgggcacaccaagtcagtggcaaagatgttttctcaaatgaaatcaggaaacaggaaagcccctctcagtatttgaatatgaaacatatagaaatggaaaataaataattcagttatctaaatgaaagtctttgctaatgaaa

SEQ ID NO: 195118 - DNA, 601 bp, Human
cagaagagttcatgagttgaaagagctctttgtcattcatttgctgtttaaattggtgtcagtgtgaaaccagttttaagccctgaagaattaatcaattcagttttgcagaagtatgttcagaaatgtaggacttacaagctgagaataaaataaaaactcctttttaaaaaatattttcataaacccaactaattaagccatcaaataaaagtattccaaaagaaaacatgccaaggatctattccttgcactccatttataatgttctttttttttttgagacagtctcgctctgtcrcccaggctggagtgcagtggcgcgatctcggctcactgcaagctctgcctcccaggttcacgccattctcctgcctcagcctcctgagtagctgggactacaggtgcccgccaccatgcccggctaatttttttgtatttttagtagagacggggtttcaccgtgtcagccaggatggtcttgatctcctgacctcgtgatttgcccgcctcagcctcccaaagcactggaattacaggcgtcagccaccgcgcctgactggattataacgttctaaaaacaaaattgtattcaatgaaa

SEQ ID NO: 195119 - DNA, 601 bp, Human
gaaatacacttaacctcttcagccaacatcccttcattgtgtgagaacaccctgacctcacacatgttctttctgatgtcacggagcccagccttgctgcccagcctggtgggggggcgcgttttctcggcatcctgcggcagtcctgtgtttcccatctcccacctgccctctcgtgtttgcccatttcaggctctcctgctgtcatgtactctgcccttgccttttcgggccagggtgcccatcttcccacgggcagtttctgggagagaggcgctcacctgctatgtcactgtgcggyggccagtgccgctggcccatggggaagctcttcagcacttgcaagtgctggatggcctggatcccagcaggcctgtgaacaccttcagcctctaaccagcgaacatgtttgcaatgcactttcgcaggtttgacaccagctgttaggcttggccacgttgtgtgttgggcactcgtgggtccatgcgccaccactgagccacgtagctggaaaggctgcagtctcgaggcctcatgccaggggaagtgacgcttgatccggaagtcctgaccgacttcttagaattgttcttattacatg

SEQ ID NO: 195120 - DNA, 601 bp, Human
taatccattgttgcataggggaggcgtgggcacttggagttgtcttaggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaaggtgagttttcttcttttggttcatggccccaggagcctatcagaagtgggagctactcttgttgatacagagagagggaagcaggcagtctgccgccactatartgggagtcagacatctcaggtggcttttaaacaacatgaatgggaagagaattggtttatgaattgaagaaataggattataacatcttctggtgtggtcttggatgtttctttcatccttggattttatccttgtttctgtaaaattcataggtctggctcatatgtgtttccctccctggtttgatggggttgtggggaagacatcccatctgcttgtgctgggggaaaacaggaaggaggtgctagtccactatagtatcactctcctactgccatctatttctcctcagctgactc

SEQ ID NO: 195121 - DNA, 601 bp, Human
tgacagcaagactccatctcaaaaaaaaaaaaaaaaaaaaaaaatgaagaaaagaagaccaggtagtggtgaagatctcggggatgtcatgattgctagaaaaatatttaaaatccatggccaggcacggtggctcacgcctgtaatcctagcactttgggagactgaggtgggcagatcacctgaggtcaagagtttgagaccaacctggccaacctggtgaaactccgtctctactaaaaatacaaaaaattagccgggcgtggtggtaggcacctataatcccagctacaggaggtgraggcaggagaatcacttgaacccaggaggcggaggttgcagtgagtcgagattgcaccattgcactccagcctgggcgacggagcaagactctgtctcaaaaaaaaaaattttttttaactccagttggcctagcacaatggctcatgggcacagtggctcatgcttgtaatcccagcactttgggaggctgagccgggcagatcacttgaggtcaggagttcaagaccagcctggccaacatggcaaaaccccatctctactaaaagtacaaaaattagctgggcgtagtggtgggcgc

SEQ ID NO: 195122 - DNA, 601 bp, Human
ctacagagtcccttgcatctggctagcagataagggaagagagaatgtgtgaaggatctcacaagagattttagggaccaggcctaaaagtgataatgtgcatcatttccaccccattagattggtcagaactcagtcatgtggctccatctaactgtagtggacatggagaaattagtctcgctgtgtgtcaggaggaaatgaaatggatttgggggacacataacagtgtctctggcacaaagacatcatttacggtagttggtgagccttagtcttgccttttcttttggatgctgawgcagggaggagtcctggaacccagaggggcattaatattaatggaaggcattctggcttcacatattatcacatgccccatcatttcacctagatagacgacaaaagctttcctgggaacattaaagacataataaatgtgtgttcacttacagagctttggatattttctgagctgtgtcagtcagttctgctgtcctttgctttggtcgttggcctcagtctcttctatctgcgcgtcaccattgcttggatctgagatgattcttttgctcagttgttgttggatgtctgactcaaa

SEQ ID NO: 195123 - DNA, 601 bp, Human
tgtcatctgtgtcagtgacagcaaagctggacctgtgctaggccctggtgggtcatctttaagcactggacttttatcttgttaggaatatagaagcaagcgtctcacatctctgacagatgggctttacggcttggcctaaagctctggttgtttttaaggcccttgaataaaaataaaagacgatgtttgcagattttaagaggaagttttttttttttttgagacagagtctcgctctgtcacccaggctactggagtgcaatggcgttatcttggctcactgcaacctctgtctccygggttcaagcgattctccgcctcagcctcctgagtagctgggattacaggcacccgccatcatgcccggctaatttttgtatttttgtagagatggggtttcaccatgttggccaggctagtcttgaactcctgacctcaggtgatccgcccgcctcggcctcccaaagtgctgggatcacggggatgagccatcgcacctggccaagaggaagtattttttttttctatcctgctctttctgaaaagcttgaacatttttctgtactttccttttcttttttgagacagggtcttgctc

SEQ ID NO: 195124 - DNA, 601 bp, Human
tagagacgtgtgagtcctttggaatagaatagcagtgatggaactggagtcctagtccaggttctctccttgttcagcctggattcagcactgggtatcgaaacaagcctgcaccctcagaggagatggctaggggacagtgcgtccaggcctcttctaccacacagagttttcttttttttataaagggtatacacatttaaaatttaatgatactcccaaattgctcttcaaaaaggctgtgcaaaattacagtcctgataacagctacccagagatcctgtaacggcatttgccctctttattattattattattattattattattattattattattatttgaatttgagacggagttctgctctgttgcccaggctggagtgcagtggcgcaatcttggctcactgcaacctctgcctcccgggttcaagcaattctcctgtctcaccctccctagtagctgggattacaggtgagcaccaccacgcctggctaatttttgtatttttagtagagacggggtttcaccatattggccagactggtctcgaactcctgacctcaggtgatccgcccgtctcggcctcccaaagtgc

SEQ ID NO: 195125 - DNA, 601 bp, Human
tcttctaccacacagagttttcttttttttataaagggtatacacatttaaaatttaatgatactcccaaattgctcttcaaaaaggctgtgcaaaattacagtcctgataacagctacccagagatcctgtaacggcatttgccctcattattattattattattattattattattattattattattatttgaatttgagacggagttctgctctgttgcccaggctggagtgcagtggcgcaatcttggctcactgcaacctctgcctcccgggttcaagcaattctcctgtctcascctccctagtagctgggattacaggtgagcaccaccacgcctggctaatttttgtatttttagtagagacggggtttcaccatattggccagactggtctcgaactcctgacctcaggtgatccgcccgtctcggcctcccaaagtgctaggattacagatgtgagccactggggctggttgccctcactatttaatgggttatttgcaacctgtgaatcatgtctcctatttccttgttaatgatgcttattgattatagacttaggaatatcagcacctcctttgtagctcttcattc

SEQ ID NO: 195126 - DNA, 601 bp, Human
gatcctgtaacggcatttgccctcattattattattattattattattattattattattattattatttgaatttgagacggagttctgctctgttgcccaggctggagtgcagtggcgcaatcttggctcactgcaacctctgcctcccgggttcaagcaattctcctgtctcaccctccctagtagctgggattacaggtgagcaccaccacgcctggctaatttttgtatttttagtagagacggggtttcaccatattggccagactggtctcgaactcctgacctcaggtgatcygcccgtctcggcctcccaaagtgctaggattacagatgtgagccactggggctggttgccctcactatttaatgggttatttgcaacctgtgaatcatgtctcctatttccttgttaatgatgcttattgattatagacttaggaatatcagcacctcctttgtagctcttcattcttacatgatataataattaatttttttttttgagacagagtctcactctgttgcccaggctggagtgcagtgtcacaatgttggctcactgcaacctccacctcctgggttcaagcgattctcc

SEQ ID NO: 195127 - DNA, 601 bp, Human
ggagtgcagtggcgcaatcttggctcactgcaacctctgcctcccgggttcaagcaattctcctgtctcaccctccctagtagctgggattacaggtgagcaccaccacgcctggctaatttttgtatttttagtagagacggggtttcaccatattggccagactggtctcgaactcctgacctcaggtgatccgcccgtctcggcctcccaaagtgctaggattacagatgtgagccactggggctggttgccctcactatttaatgggttatttgcaacctgtgaatcatgtctcctrtttccttgttaatgatgcttattgattatagacttaggaatatcagcacctcctttgtagctcttcattcttacatgatataataattaatttttttttttgagacagagtctcactctgttgcccaggctggagtgcagtgtcacaatgttggctcactgcaacctccacctcctgggttcaagcgattctcctgcctcagcctcctgagtagctgggactacaggtgcgtgccactacacctgactaatttttgtatttttagtagagacagggtttcgccatgttggctaggctggt

SEQ ID NO: 195128 - DNA, 601 bp, Human
taagaagattgttgaagaaaaaaaggttttgtccccccttggtttgattggactagagtgggctcagtctgtgcctgtggctggcatcaggcaggaacagtggtatagcagggtatagaccatatttagggacctaaaatcacatctttcatgattcatgtggttcttgttccaactgcccaggactcaggcacatcaaaatatgacacaaaagcagaagcttttcataatggagattagaccatgtctaggattcctacccagtcctcttgagctctcctcactccagtgttgttttccrtgtttgttttttgttttccccagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttat

SEQ ID NO: 195129 - DNA, 601 bp, Human
tgtctaggattcctacccagtcctcttgagctctcctcactccagtgttgttttccatgtttgttttttgttttccccagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggagratgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccgtccctgtacctgcagtgcctctcccagaaactgagacaagaaaggtgagccccc

SEQ ID NO: 195130 - DNA, 601 bp, Human
tttgttttccccagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactaygtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccgtccctgtacctgcagtgcctctcccagaaactgagacaagaaaggtgagcccccaggaggtggtcagttccggaccacctgcttattttcgtgccaccaggatgggaattaccactgtgc

SEQ ID NO: 195131 - DNA, 601 bp, Human
gctctgttgcccaggctggagtgcattggcgcaatcttggctcactgcaacctccacctcccaggttcaagcagttgtcctgcctcaccctcccaagtagctgggattacaggcatgtgccaccacgccctggctaatttttgtatttttagtagagactgggtttcaccatgttgaccaggccagtcttgaactcctgacctcaggtgatctgcctgcctcagcctcccaaagtgctaggattacaagcgtgagccactgcgcctggccacaaatttttatttttaatttttcttttttyttttttttttttttttgagacagagtttcactcttgttgcccaggctggagtacagtggcatgatcttggctcgctgcaacctccgcctgctgggttccagtgattctcctgcctcagcttcccgagtagctgggattacaggcgtccgccatcacacctggctaatttttgtatttttagtggagacagggtttccaccatgttggccaggctggtctggaactcctggcctcaagtgatccacgtacctcggcctgccaaagtgctgggattacaggcatgagccaccatgctcagcc

SEQ ID NO: 195132 - DNA, 601 bp, Human
cagcctcccaaagtgctaggattacaagcgtgagccactgcgcctggccacaaatttttatttttaatttttctttttttttttttttttttttttgagacagagtttcactcttgttgcccaggctggagtacagtggcatgatcttggctcgctgcaacctccgcctgctgggttccagtgattctcctgcctcagcttcccgagtagctgggattacaggcgtccgccatcacacctggctaatttttgtatttttagtggagacagggtttccaccatgttggccaggctggtctgsaactcctggcctcaagtgatccacgtacctcggcctgccaaagtgctgggattacaggcatgagccaccatgctcagccaccttccagatctttttttatttgatacccacacagtcatgtagaagtatatcttttttgtttgtttgttttttgagatgacatctcactctgttgtccaggctggagtgcagtggcacacctcggcttactgcaacatccacctcccgggttcaggcaattctcctgcctcagtctcctgagtagctgggactacaggcgcacaccactacggctttgct

SEQ ID NO: 195133 - DNA, 601 bp, Human
caagcgtgagccactgcgcctggccacaaatttttatttttaatttttctttttttttttttttttttttttgagacagagtttcactcttgttgcccaggctggagtacagtggcatgatcttggctcgctgcaacctccgcctgctgggttccagtgattctcctgcctcagcttcccgagtagctgggattacaggcgtccgccatcacacctggctaatttttgtatttttagtggagacagggtttccaccatgttggccaggctggtctggaactcctggcctcaagtgatccaygtacctcggcctgccaaagtgctgggattacaggcatgagccaccatgctcagccaccttccagatctttttttatttgatacccacacagtcatgtagaagtatatcttttttgtttgtttgttttttgagatgacatctcactctgttgtccaggctggagtgcagtggcacacctcggcttactgcaacatccacctcccgggttcaggcaattctcctgcctcagtctcctgagtagctgggactacaggcgcacaccactacggctttgctaatttttgtatttttagtagagat

SEQ ID NO: 195134 - DNA, 601 bp, Human
gactctgtctctaatttttttttctttttttttgagacagggtctgggctctgtcacctagagcagtggtatgatcttggctcaccacagctccaacctcctgggctcaggtgatctgcccacctcagcctcccatacagctgggactactagcttctgccaccacgtccagctaacttttgtattttttgtagaaatgaggtttcaccatgttgcctaggcttgtctcaaacctttgggctcaagcgatctacccacctctacctcccaaactgctgggattacaggagtgagccaccayaccaggtcaaaaaaatttttttaaacaacaacgacaacaaaaaattgtggacttggctgtgatatgaaggaaaaattttaaaaataaaaataaaaaataaagataataaatacttcatctataacttatgaccattgcttgtaaaacatgtcctcttgggccatttttctagtcataatactgtttcctattatggggaaactgggtgtattagagaaaaagtttaacccatttatgtaatatttgtataaaataaagcaacaggttttttaaggggctgtttgtgaggcactgtattag

SEQ ID NO: 195135 - DNA, 601 bp, Human
acaatacatctcccaattgggtaaaactggatcttggcacaggagggagtgtggaaaaaagactttgacattattaatataatagtctgtggccctccaaagcgtcacagtacataaacagatatacagcatatatgtagtactgaaatttttagggtgggaaaaagtgattaggagaaaatgtctaaaaaggctaattaggggtcaataattttaaaaaggttgaaaaacatagggcatgatgccaaaaaataaggcaaagttccccagtgtgaggaatgaatgaatgaatgaatgaatraataaataaataaataaataaataaatggtatgggtttcatatgtgctgagtactgattctctcaggcctttgaggatgccaatcaaggccagtagcaggggtagggttagggccctggggtatttgtccttggtctgcagcatcctcttctatttattccattgtgcctccaaatatcatttgctgtgagtgctgttatgtgagaaaggttggaagcactgaatttctacaacaaacatactacttttttaagagacaatttttatgataaaagtttcctttgtggaatactgttatca

SEQ ID NO: 195136 - DNA, 601 bp, Human
atatatgatacattattaattgcaaaaagtctatttataaacgtaatggtgcaagcttatgtgtgcccatgcatgtatgaacagacagaagatacacactgaaatgttaacggttccacgttctctaaagcaggcattcttgacaggtacaatacatctcccaattgggtaaaactggatcttggcacaggagggagtgtggaaaaaagactttgacattattaatataatagtctgtggccctccaaagcgtcacagtacataaacagatatacagcatatatgtagtactgaaattttwagggtgggaaaaagtgattaggagaaaatgtctaaaaaggctaattaggggtcaataattttaaaaaggttgaaaaacatagggcatgatgccaaaaaataaggcaaagttccccagtgtgaggaatgaatgaatgaatgaatgaataaataaataaataaataaataaataaatggtatgggtttcatatgtgctgagtactgattctctcaggcctttgaggatgccaatcaaggccagtagcaggggtagggttagggccctggggtatttgtccttggtctgcagcatcctcttct

SEQ ID NO: 195137 - DNA, 601 bp, Human
acatgtcaaaactcttattgtagaagaatgtctaatgacagagtaatgtatatatgatacattattaattgcaaaaagtctatttataaacgtaatggtgcaagcttatgtgtgcccatgcatgtatgaacagacagaagatacacactgaaatgttaacggttccacgttctctaaagcaggcattcttgacaggtacaatacatctcccaattgggtaaaactggatcttggcacaggagggagtgtggaaaaaagactttgacattattaatataatagtctgtggccctccaaagcrtcacagtacataaacagatatacagcatatatgtagtactgaaatttttagggtgggaaaaagtgattaggagaaaatgtctaaaaaggctaattaggggtcaataattttaaaaaggttgaaaaacatagggcatgatgccaaaaaataaggcaaagttccccagtgtgaggaatgaatgaatgaatgaatgaataaataaataaataaataaataaataaatggtatgggtttcatatgtgctgagtactgattctctcaggcctttgaggatgccaatcaaggccagtagcaggggt

SEQ ID NO: 195138 - DNA, 601 bp, Human
tctagctgttctccttcctagtcaagtgaactcacacaagtcactttacctctctgaacctcaaattctccacctataagttaggtatttaactgccaaatatctgtaaattacaaagcactatataaattaagagatcaattttttcattgaatttctggcaatttttcatcatgtcttactttgtaacactaaggcttttgctttttagtcaattgcttaccttcggttgaaccttgtctgaagcagaatggcctaaagaatgaaacaaaaagccatgacttactacggacacttcacttttcattgtggtctagtttcattaaaagtaaagtttgccaggcatggtggctcacatctgtaatcccagcactttgggaggcaaggcaggaagattgcttgaggccaggagttcaagaccaacctgagcatcatagcgtgatcctgtgtctattcaaaaaattaaaaattaaaaaaaaaaaaaaaaagcaaagttgcagcttctacatagaagccaccacattattactgaattataaattaattccatctccaccggaggattatcactattagtttcatgattactcacatttttaac

SEQ ID NO: 195139 - DNA, 601 bp, Human
agtttattgtcttgtgatagattgctggtgtcattaaaatctgatttgattttaagaatagtactctaggccgggcacagtggctcatgcctgtgtaatcccagcattttgggaggccaaggcgggcagatcacctgaggtcgggagtttgagaccagcctgaccaacatggagaaatcccgtctctactaaaaatacaaaattagccgggcgtgctggtgcatgcctgtaatcccagctactcgagaggttgaggcaggacaactgcttgaacctgggaggtggaggttgcggtgagccragatcacgttattggactccagcctggacaacacaatgaaactcttcctcagggggaaaaaaaaaaaaaaagaatagtactctaataactgagctaatcccttaccaatggaattacagtatgtctcaaattttttgatcaagatcctcaaaaatttttacattttgtcatcttgacccagtacacgtgtatatataactaaaaaaaattataaaacagaaatttaaaattctgttctacttcatttgttaaaaatgcagtttatgtcctattaaactgatttcaagattgagtattgag

SEQ ID NO: 195140 - DNA, 601 bp, Human
taaataataacatggaaattaatgactgatctgagtgaaagaggctagaaaaaaagaaaaatattttgctttcaatagactgcattagaactagatgagcttagttcctagaactagaagattatgacaaatgggttcaaaccattctcctgcctcagactcccaagtagctgtgattataggcacgtgccaccacacccagctaatttttgtatttttagcagagacagggtctcaccatgttggccaggctggtctcaaaactcctgacctcaagtgaaccgcccaccttaacctcccaaagtactgggattatgggtgtgagccacagcgcccggcccaatggagtatttttttaaaagatagtattatgtagcaatcataagtatgaaagggaacgggcacccctatgtatatggcaatgggccttttaatgtgctagaaatttactggtgttaaagtattacattctttgaggagagaaggagagatttacactttcttactttctgtatttaaaaaattgtaactttttgtaggagtacaaagtctgtttttttatagaatactttaataccataaattgttagcacattaaaac

SEQ ID NO: 195141 - DNA, 601 bp, Human
agaaattcacttttgtcattgttctgtttagaaatagaaaaagcattaaataataacatggaaattaatgactgatctgagtgaaagaggctagaaaaaaagaaaaatattttgctttcaatagactgcattagaactagatgagcttagttcctagaactagaagattatgacaaatgggttcaaaccattctcctgcctcagactcccaagtagctgtgattataggcacgtgccaccacacccagctaatttttgtatttttagcagagacagggtctcaccatgttggccaggctgrtctcaaaactcctgacctcaagtgaaccgcccaccttaacctcccaaagtactgggattatgggtgtgagccacagcgcccggcccaatggagtatttttttaaaagatagtattatgtagcaatcataagtatgaaagggaacgggcacccctatgtatatggcaatgggccttttaatgtgctagaaatttactggtgttaaagtattacattctttgaggagagaaggagagatttacactttcttactttctgtatttaaaaaattgtaactttttgtaggagtacaaagtctgtt

SEQ ID NO: 195142 - DNA, 601 bp, Human
ttttgcaatatgaagtatcaaacctaaagatgaaaaatgctggtggcagagtaaaagataggaagaatctgggtccttaatgatactgttaagtcacatcaaccatggaacttgcatctccatacttgttttgatgtgagatacttaaatgtctatggcttaaactaccattatagaattttctgttgctgcctactgaaaacgtcatactaactaatatagcactcaataaatggtacttatgattataattattactaatacatacacatacaccatcccagagttgattcaagaattktctttttaaacaaaccacaacctcatccctacaactccccagaaataatatagctagttttacatttatcaaataagaataaagccagtttcacactaaacaggcataaaactgtttttaaaagctaacttccaaaatatgagtgaaaaaacttaaacaaatcagcatatttattctgaacaacagatatactgcagaggattatcccaagtcagcatgtaacaaatgtagatattaaaaaaaaaaagaaaaaaaaaggcttgattttgtgggcatatatagctcagcagattcaggtgt

SEQ ID NO: 195143 - DNA, 601 bp, Human
ttgaccagtgaattgagggaaaatagctggcagcttctgagaaggattttcctcaattacggaagaaaagcccctatttatacccatcgtttaaagctatgaaagccattttgcaatatgaagtatcaaacctaaagatgaaaaatgctggtggcagagtaaaagataggaagaatctgggtccttaatgatactgttaagtcacatcaaccatggaacttgcatctccatacttgttttgatgtgagatacttaaatgtctatggcttaaactaccattatagaattttctgttgctgcstactgaaaacgtcatactaactaatatagcactcaataaatggtacttatgattataattattactaatacatacacatacaccatcccagagttgattcaagaattgtctttttaaacaaaccacaacctcatccctacaactccccagaaataatatagctagttttacatttatcaaataagaataaagccagtttcacactaaacaggcataaaactgtttttaaaagctaacttccaaaatatgagtgaaaaaacttaaacaaatcagcatatttattctgaacaacagatatac

SEQ ID NO: 195144 - DNA, 601 bp, Human
gacggagtttcgttcttattgcccaggctagtacaatggcatgatctcggctcactacagcctctgcctcctgggttccagcaattctcctgcttcagcctcccgcgtagctgggattacaggcacacatcaccacacctggctaatttttgtgtttttagtagagacagggtttcaccatgttggccaggctggtctcgaactcctgacctcaggtgatccacccgccttggcctcccaaagtgctgggattacaggcatgagccactgtgcccagcctaaaaagttcatttttatacartggaattgagatgtcacttttagcatatactatttagcatatactatggtattaattcatgaatatgtagacaggccagaaaagaaagcccagaagtagaaacaaatatatgtgggaatttatgtggaaggctgagaaaatatagaaaagtgaagaaaaaatattattttgagagatgtggatctcttagggtagcctatctttgaaatattacacaatttttctttaaggttaaagtctctctcttcacttactgttttatctcttttcattctcttagaaggtgtttctttgccaaca

SEQ ID NO: 195145 - DNA, 601 bp, Human
ggctcctcaattgctctgaacctttagacagagcaccaggataattagccttttctaaaaccaaggtgcctgcaatgttcttccaaatgactcaacatgggtccctagccacatcattcattacactgacttgaatacattgacaatggtacaaaaacaagatacactgagaactcatgcctccaattgtccaatcaatatttacttaaaagttcattttttatttttgttattttttattctaatcccatagcttatttaaaaatttatttatttatttttgagacggagtttcgttctyattgcccaggctagtacaatggcatgatctcggctcactacagcctctgcctcctgggttccagcaattctcctgcttcagcctcccgcgtagctgggattacaggcacacatcaccacacctggctaatttttgtgtttttagtagagacagggtttcaccatgttggccaggctggtctcgaactcctgacctcaggtgatccacccgccttggcctcccaaagtgctgggattacaggcatgagccactgtgcccagcctaaaaagttcatttttatacagtggaattgagatgtca

SEQ ID NO: 195146 - DNA, 601 bp, Human
aaggaagggacagaaagctatttaagcagtaggctcctcaattgctctgaacctttagacagagcaccaggataattagccttttctaaaaccaaggtgcctgcaatgttcttccaaatgactcaacatgggtccctagccacatcattcattacactgacttgaatacattgacaatggtacaaaaacaagatacactgagaactcatgcctccaattgtccaatcaatatttacttaaaagttcattttttatttttgttattttttattctaatcccatagcttatttaaaaatttatttatttatttttgagacggagtttcgttcttattgcccaggctagtacaatggcatgatctcggctcactacagcctctgcctcctgggttccagcaattctcctgcttcagcctcccgcgtagctgggattacaggcacacatcaccacacctggctaatttttgtgtttttagtagagacagggtttcaccatgttggccaggctggtctcgaactcctgacctcaggtgatccacccgccttggcctcccaaagtgctgggattacaggcatgagccactgtgcccagcctaaaaag

SEQ ID NO: 195147 - DNA, 601 bp, Human
caaatcaatccaaacaatttccttagaagtagagcttagaagaagccaatccaattggaatattactttaatctggtttggcaatgagtatatcaaccgataaacaaaattcttaaaaaataatttttttgttttcttaaaattgttaacattctttttagtaataacagtaaagaatttggtaagttttgtccagaaccacttaaatgattataaactccaagaataggctttactttctcagaaaacattaaaggttctttataatttacttactattatcattagtaaaataaacctrtatcactgctcctcttccaaaagctgtttctaacaaatcctttatctttggtaagtattgcaaatttttaaaaacaataatataaataaactgaggaaagtgcattgccctgtaccccaaacttggaaattcatgctgatgaatcagagatcattttttgaaatgaaaactctagcaaaaagctacacatgggtcttcactttggcactaccatgttttcatgattccaccacctttcaagtaaaatattatttaaatactgaagattagagttgcgataaatattccaggtactctggc

SEQ ID NO: 195148 - DNA, 601 bp, Human
atgtgatgctctctggcaatgcaggataacctagaaatggaagaacagaaaagaggtaacctccaaaggtagagattaccaaggtcaaagcagcagaaataaagaggcaaggaattcagagagctagcaattccaacaaacttgctgactataaggtctaatctgagaagcaaagcaaattaagttatctaagttgacacgctgggagaaaaaaatgatgggctggggatgggattagaatgaagagcttacaaatttataatgcatagatccataaatagttattgagagaagctgaggttcttgcaggcaagttaatcattcccttcctagcataacttttttttttttttttttttaagacagagtctctcaaacccctgggctcaagcaatcctcctgccttggcctcccaaagcactgggattatgggaggccaagtgcctggtccatggctctaccttcttatttacctcagtgacaatgtaactgtgagtgtgcatgtatattcacattagtgtacattttaagcacttccttatgttcaagtctttttaactgcaaggataaaagtaattatcataaaaagaaagtattatgt

SEQ ID NO: 195149 - DNA, 601 bp, Human
ccaggttcaagcgattttcatgcctcagactcctgagtagttgcgattacaggtggacaccaccacgcccagctaattttttatatttttagtagacacaacgttttaccatgttggccaggctggtcctgaactcctggcgtcaagtgatccgcccacttcagcctcccaaagtgctaggattataggagtgagccaccgcatccggccctcaatgactactttttaactaggtactactactaactccagagctgaattttggttaaaatttttattcaatcacataccaagtaaagtmtaaatgatactggagtttgcagaatcaagcaaaatttcaaaatagtttaaataagaaaatgctgaggctagcacacagacatttaggcatgccaaactaaaaaatacttgcattagactgggcatggtggctcatgcctgtaatcccagcactttgggaggtcaaggtgggtggatcacttgaggtcaagagttcaagaccagcctgcccaacatggtgaaactccatctctactaaaaatacaaaaattagccaggtgtggtggtgcatgcctctagtccccgctacttgtgggatgct

SEQ ID NO: 195150 - DNA, 601 bp, Human
ataccaatgtaagaagggttatcctggttgtccagctggtattttattagtagcctgaaaattcccctaaaaaaaaaaaaaaacaggaatttaaatccaaaaatgttaacatcaaaaggtaacaactaatagtaaaatacacaaagaaaatgtcaagtagttggcctatccgcattatcttctgttcctccaaggaatatcatatccttgcctacttaaacagaaagctttctaatttcttttttttttttttttttgagacggagtcttgctctgttgcccaggctggaatgcagtggcrtgatcttggctcactgcaagctctgcctcccgggttcacgccattctcctgcctcagcctcccaagtagctgggactacaggtgcccaccaccatgcctggctaaattttttgtatttttagtagagatggggtttcaccgtgttagccaggatggtctcgatctcctgatctcgtgatccgcccgcctcggcctcccaaagtgctgggattacaggcgtgagccactgtacccggcccgcttttttatttcttctaaagaaaaatataggctgagtgtggtgcctcacacctataatct

SEQ ID NO: 195151 - DNA, 601 bp, Human
cagagacaggaaatgtacagggtaaaacaaaaattacacaattgaatgtcataaatattggataccaatgtaagaagggttatcctggttgtccagctggtattttattagtagcctgaaaattcccctaaaaaaaaaaaaaaacaggaatttaaatccaaaaatgttaacatcaaaaggtaacaactaatagtaaaatacacaaagaaaatgtcaagtagttggcctatccgcattatcttctgttcctccaaggaatatcatatccttgcctacttaaacagaaagctttctaatttcttttttttttttttttttgagacggagtcttgctctgttgcccaggctggaatgcagtggcatgatcttggctcactgcaagctctgcctcccgggttcacgccattctcctgcctcagcctcccaagtagctgggactacaggtgcccaccaccatgcctggctaaattttttgtatttttagtagagatggggtttcaccgtgttagccaggatggtctcgatctcctgatctcgtgatccgcccgcctcggcctcccaaagtgctgggattacaggcgtgagccactgtacccggccc

SEQ ID NO: 195152 - DNA, 601 bp, Human; identical to SEQ ID NO: 20910

SEQ ID NO: 195153 - DNA, 601 bp, Human; identical to SEQ ID NO: 20911

SEQ ID NO: 195154 - DNA, 601 bp, Human; identical to SEQ ID NO: 20912

SEQ ID NO: 195155 - DNA, 601 bp, Human; identical to SEQ ID NO: 20913

SEQ ID NO: 195156 - DNA, 601 bp, Human; identical to SEQ ID NO: 20914

SEQ ID NO: 195157 - DNA, 601 bp, Human; identical to SEQ ID NO: 20915

SEQ ID NO: 195158 - DNA, 601 bp, Human; identical to SEQ ID NO: 20916

SEQ ID NO: 195159 - DNA, 601 bp, Human; identical to SEQ ID NO: 20917

SEQ ID NO: 195160 - DNA, 601 bp, Human; identical to SEQ ID NO: 20918

SEQ ID NO: 195161 - DNA, 601 bp, Human; identical to SEQ ID NO: 20919

SEQ ID NO: 195162 - DNA, 601 bp, Human; identical to SEQ ID NO: 20920

SEQ ID NO: 195163 - DNA, 601 bp, Human; identical to SEQ ID NO: 20921

SEQ ID NO: 195164 - DNA, 601 bp, Human; identical to SEQ ID NO: 20922

SEQ ID NO: 195165 - DNA, 601 bp, Human; identical to SEQ ID NO: 20923

SEQ ID NO: 195166 - DNA, 601 bp, Human; identical to SEQ ID NO: 20924

SEQ ID NO: 195167 - DNA, 601 bp, Human; identical to SEQ ID NO: 20925

SEQ ID NO: 195168 - DNA, 601 bp, Human; identical to SEQ ID NO: 20926

SEQ ID NO: 195169 - DNA, 601 bp, Human; identical to SEQ ID NO: 20927

SEQ ID NO: 195170 - DNA, 601 bp, Human; identical to SEQ ID NO: 20928

SEQ ID NO: 195171 - DNA, 601 bp, Human; identical to SEQ ID NO: 20929

SEQ ID NO: 195172 - DNA, 601 bp, Human; identical to SEQ ID NO: 20930

SEQ ID NO: 195173 - DNA, 601 bp, Human; identical to SEQ ID NO: 20931

SEQ ID NO: 195174 - DNA, 601 bp, Human; identical to SEQ ID NO: 20932

SEQ ID NO: 195175 - DNA, 601 bp, Human; identical to SEQ ID NO: 20933

SEQ ID NO: 195176 - DNA, 601 bp, Human; identical to SEQ ID NO: 20934

SEQ ID NO: 195177 - DNA, 601 bp, Human; identical to SEQ ID NO: 20935

SEQ ID NO: 195178 - DNA, 601 bp, Human; identical to SEQ ID NO: 20936

SEQ ID NO: 195179 - DNA, 601 bp, Human; identical to SEQ ID NO: 20937

SEQ ID NO: 195180 - DNA, 601 bp, Human; identical to SEQ ID NO: 20938

SEQ ID NO: 195181 - DNA, 601 bp, Human
aaaaaaaagagtttcaaccaaaatgttaacaatgaaaaatgtctccagacattgccagacgtccccaggagcagggaaaggattgctccccattgagaaccaatacattagacccaatgccaaaacatttttttctgttttcactgtcttccaggatattatattcattacattctatagacccagtgctcagggcctgtgaacatatcaaaggcctttgtatatatttgaaatcttaaaaaatgcattaactccaaaatacaaaaataaaaaataatgctctcaaaggaaaaattattcwaatacttaaaaattattttacagcaaaaaatgtgtttaattgggggcatgggaatattttagcatgttagatgagatgaaaagagagctgccattttcggcctggttttggtctgaggtcgtaggatggtgaaacaggttcagaagatcttaatcacatcaactctggatttctccaggtgatagaaatgggacttctgaaaatggacaatgcttacaagtttcccaatctccgctgccggggttgggcatgcagaaccaaccttccatccaacacagcttttcgtgggtttggctttcc

SEQ ID NO: 195182 - DNA, 601 bp, Human; identical to SEQ ID NO: 20939

SEQ ID NO: 195183 - DNA, 601 bp, Human; identical to SEQ ID NO: 20940

SEQ ID NO: 195184 - DNA, 601 bp, Human; identical to SEQ ID NO: 20941

SEQ ID NO: 195185 - DNA, 601 bp, Human; identical to SEQ ID NO: 20942

SEQ ID NO: 195186 - DNA, 601 bp, Human; identical to SEQ ID NO: 20943

SEQ ID NO: 195187 - DNA, 601 bp, Human; identical to SEQ ID NO: 20944

SEQ ID NO: 195188 - DNA, 601 bp, Human; identical to SEQ ID NO: 20945

SEQ ID NO: 195189 - DNA, 601 bp, Human; identical to SEQ ID NO: 20946

SEQ ID NO: 195190 - DNA, 601 bp, Human; identical to SEQ ID NO: 20947

SEQ ID NO: 195191 - DNA, 601 bp, Human; identical to SEQ ID NO: 20948

SEQ ID NO: 195192 - DNA, 601 bp, Human; identical to SEQ ID NO: 20949

SEQ ID NO: 195193 - DNA, 601 bp, Human; identical to SEQ ID NO: 20950

SEQ ID NO: 195194 - DNA, 601 bp, Human; identical to SEQ ID NO: 20951

SEQ ID NO: 195195 - DNA, 601 bp, Human; identical to SEQ ID NO: 20952

SEQ ID NO: 195196 - DNA, 601 bp, Human; identical to SEQ ID NO: 20953

SEQ ID NO: 195197 - DNA, 601 bp, Human; identical to SEQ ID NO: 20954

SEQ ID NO: 195198 - DNA, 601 bp, Human; identical to SEQ ID NO: 20955

SEQ ID NO: 195199 - DNA, 601 bp, Human; identical to SEQ ID NO: 20956

SEQ ID NO: 195200 - DNA, 601 bp, Human; identical to SEQ ID NO: 20957

SEQ ID NO: 195201 - DNA, 601 bp, Human; identical to SEQ ID NO: 20958

SEQ ID NO: 195202 - DNA, 601 bp, Human; identical to SEQ ID NO: 20959

SEQ ID NO: 195203 - DNA, 601 bp, Human; identical to SEQ ID NO: 20960

SEQ ID NO: 195204 - DNA, 601 bp, Human; identical to SEQ ID NO: 20961

SEQ ID NO: 195205 - DNA, 601 bp, Human; identical to SEQ ID NO: 20962

SEQ ID NO: 195206 - DNA, 601 bp, Human; identical to SEQ ID NO: 20963

SEQ ID NO: 195207 - DNA, 601 bp, Human; identical to SEQ ID NO: 20964

SEQ ID NO: 195208 - DNA, 601 bp, Human; identical to SEQ ID NO: 20965

SEQ ID NO: 195209 - DNA, 601 bp, Human; identical to SEQ ID NO: 20966

SEQ ID NO: 195210 - DNA, 601 bp, Human; identical to SEQ ID NO: 20967

SEQ ID NO: 195211 - DNA, 601 bp, Human; identical to SEQ ID NO: 20968

SEQ ID NO: 195212 - DNA, 601 bp, Human; identical to SEQ ID NO: 20969

SEQ ID NO: 195213 - DNA, 601 bp, Human; identical to SEQ ID NO: 20970

SEQ ID NO: 195214 - DNA, 601 bp, Human; identical to SEQ ID NO: 20971

SEQ ID NO: 195215 - DNA, 601 bp, Human; identical to SEQ ID NO: 20972

SEQ ID NO: 195216 - DNA, 601 bp, Human; identical to SEQ ID NO: 20973

SEQ ID NO: 195217 - DNA, 601 bp, Human; identical to SEQ ID NO: 20974

SEQ ID NO: 195218 - DNA, 601 bp, Human; identical to SEQ ID NO: 20975

SEQ ID NO: 195219 - DNA, 601 bp, Human; identical to SEQ ID NO: 20976

SEQ ID NO: 195220 - DNA, 601 bp, Human
taattttttaataattaaaaaaataataagatagggtcctgctatgttgcccaggctggtgttgaactcctgggctcaagtgacccgcccaccttggcctcccagaatgctgagattacagatgtgagccactgcacctggccaagaaatttctgatgcacaatcgggattgagaacagttcttgaacagtggtttcaaagtgaggtccttggaccagcaacatcagcatcacctggaacttgttagaaaggtaacctctcagacccccacctagatataatgaatcagaaactccagggrtggggcccagcactctgtgttttaataatcctccaggtgattctgatgcccagtagagttagagaaatgctattctagaaaatggattagtttcagattaaatgggttctgttggttaaatccttggttccacataaatctaatctattatagtaggtttgtaaactgtggattatctaaaatacattttggctatatttgtcctaaatggagtgatttttcccccctaggactggtaatgaggaacaaacacggattaatctgaattgtactcagaaggctttgatgcaggtggtagat

SEQ ID NO: 195221 - DNA, 601 bp, Human; identical to SEQ ID NO: 22943

SEQ ID NO: 195222 - DNA, 601 bp, Human; identical to SEQ ID NO: 22944

SEQ ID NO: 195223 - DNA, 601 bp, Human; identical to SEQ ID NO: 22945

SEQ ID NO: 195224 - DNA, 601 bp, Human; identical to SEQ ID NO: 22946

SEQ ID NO: 195225 - DNA, 601 bp, Human; identical to SEQ ID NO: 22947

SEQ ID NO: 195226 - DNA, 601 bp, Human; identical to SEQ ID NO: 22948

SEQ ID NO: 195227 - DNA, 601 bp, Human; identical to SEQ ID NO: 22949

SEQ ID NO: 195228 - DNA, 601 bp, Human; identical to SEQ ID NO: 22950

SEQ ID NO: 195229 - DNA, 601 bp, Human; identical to SEQ ID NO: 22951

SEQ ID NO: 195230 - DNA, 601 bp, Human
caagggctttgaattgagggtttagaaataagatgtagcttctttacttgaggggagtgggtatggaggaagagagggagtttttgtggaagcaggaaaggggtgtgggtagtgatgacagtcaagcacttattggaactcacgtatgtttcctagagagcccttcaatacagacagcagggtgccagggaaatacaagtccatcccagaagagggggaaaacaggagaagcctgaggggaagcaatataggaggccaggggcaggatggtgggaagtaccttgaccttggcatcagatgscctgagtctggagtcatctgctctctcacttggttgcgtctggacgagtacataatgtctgagcatcagttttctcatctgtgaaatggggatcatagtttctgcttatgtcctagagtttccatgctgttagtgccttgatcccccaccactttttggcaccagggaccggtttcatggaagacaatttttccatggaccgggattgggcagggaggtggtttctggatgattcaagagcatcacgtttattgtgcactttatttctattgttattacattgtgctatgcaatgaaata

SEQ ID NO: 195231 - DNA, 601 bp, Human
ggctatggccagcagacaccatgggaaggggtttggattttattctgagaacagttcattggaaagcctctgaggacttgttcctcttcatccatgtgctccctccctttgtgacctggtttctacccctctctctctattttttttttttttgaaacggagtctcgctgtgttgccaaggctagagtgcagtggcgcaatctcggctcactgcaacatccccctcctgggttcaagcgattctcctgaatgtgctgaaggaatggctggatccaaggggagcttgttgatgcctcccctstaacttcatttcggggtctccaggatgcctgtgagagtttcggcctcttccctcttccttcagtcacaagggggtcttaagtgagatggtgtgtgttcacacagccctgttcctccctatgtccctaggatctactgcagtccatggtattgagtcagcaaataaatgtagagcgaggggtcatcatcattagtgggaaaacccaggtgacacctgggacgtgttgagttctagtccctgggaggaaattagatggaccctgtttggaatactctagtggagggcagctctgacatagat

SEQ ID NO: 195232 - DNA, 601 bp, Human
ccaggatgcctgtgagagtttcggcctcttccctcttccttcagtcacaagggggtcttaagtgagatggtgtgtgttcacacagccctgttcctccctatgtccctaggatctactgcagtccatggtattgagtcagcaaataaatgtagagcgaggggtcatcatcattagtgggaaaacccaggtgacacctgggacgtgttgagttctagtccctgggaggaaattagatggaccctgtttggaatactctagtggagggcagctctgacatagatatttggactttgaaggtgtyactatctgccgttatctgccaggtcacctgtttctcctttctctttcccttttctatcccaattctggcaaatgactccttctgatgcaaatgatccttccttcttgccctagtttcccttcttaccctagtttggggtttggggtttggggtctgtagtattggtgtttcctaatgcctgtggtcttctcccatcctctcttccccgagttatttccattccatctgtctccagtgcagctctccggctgggatcctggttgacgccatgtcccagaagcaccttcagatcaaccagac

SEQ ID NO: 195233 - DNA, 601 bp, Human
ggggtcatcatcattagtgggaaaacccaggtgacacctgggacgtgttgagttctagtccctgggaggaaattagatggaccctgtttggaatactctagtggagggcagctctgacatagatatttggactttgaaggtgttactatctgccgttatctgccaggtcacctgtttctcctttctctttcccttttctatcccaattctggcaaatgactccttctgatgcaaatgatccttccttcttgccctagtttcccttcttaccctagtttggggtttggggtttggggtctgyagtattggtgtttcctaatgcctgtggtcttctcccatcctctcttccccgagttatttccattccatctgtctccagtgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaaggtgaggcgcggtggaggcagtgtgcatccggagggtgggagtgagga

SEQ ID NO: 195234 - DNA, 601 bp, Human
tccagactgaccccagaaatgtaacacctcatcttagtgagaacaaggggtgtcaaactgctttttcctttactctttttaatctgatttcttaaggtagaccttaggtcattgattttagacctttcttcttttcttttctttctttttcttttcttttttttgagacaatcttgctctgtcgcccaggctggagcacagtggcatgatttcggctcactgcagcctctgcttcccagcttcaagaaattcttgtgcctcagtctcccgcatagctgggactacaggtgcaggccaccaygcccagctgatttttttagaattctattgtagctatttaagctctcttcctaaccctgcactgtcagtgctttgtgtacactgagaccagcacaatgcctgaatattgcagctattatgtaaatacttgcaggataattctaaatgtttgtttgtttgtttgtttatttattattgcccaggctggagtgcagtggcacgatctcatctcactgcgacctctgcctctcaggttcaaactattctcatgcctcagcctcctcagtagctgggactacagacatgcaccaccatgcctggc

SEQ ID NO: 195235 - DNA, 601 bp, Human
cttagtgagaacaaggggtgtcaaactgctttttcctttactctttttaatctgatttcttaaggtagaccttaggtcattgattttagacctttcttcttttcttttctttctttttcttttcttttttttgagacaatcttgctctgtcgcccaggctggagcacagtggcatgatttcggctcactgcagcctctgcttcccagcttcaagaaattcttgtgcctcagtctcccgcatagctgggactacaggtgcaggccaccacgcccagctgatttttttagaattctattgtarctatttaagctctcttcctaaccctgcactgtcagtgctttgtgtacactgagaccagcacaatgcctgaatattgcagctattatgtaaatacttgcaggataattctaaatgtttgtttgtttgtttgtttatttattattgcccaggctggagtgcagtggcacgatctcatctcactgcgacctctgcctctcaggttcaaactattctcatgcctcagcctcctcagtagctgggactacagacatgcaccaccatgcctggctaattttttttttttgtagttttagtagatac

SEQ ID NO: 195236 - DNA, 601 bp, Human
aagctctcttcctaaccctgcactgtcagtgctttgtgtacactgagaccagcacaatgcctgaatattgcagctattatgtaaatacttgcaggataattctaaatgtttgtttgtttgtttgtttatttattattgcccaggctggagtgcagtggcacgatctcatctcactgcgacctctgcctctcaggttcaaactattctcatgcctcagcctcctcagtagctgggactacagacatgcaccaccatgcctggctaattttttttttttgtagttttagtagatacagggttktgccgtgttgtccaggctggttgcaacctctagcctcgagtgatctgcctgcctcggcctcccaaagtgctaggattataggcgtgagccacggtgcccagccaatactgacaggataattctaagagaatttcccctcatctgaatctatcccagactggccctagaagaagggcagctccttctgagaatggaaacggaagattttgggcggttattcctacccaagtccttagactgtcgacagtatttctgatcccgtgcctggcttttctgtttcctgtgcatggtggcggatta

SEQ ID NO: 195237 - DNA, 601 bp, Human
ataattctaaatgtttgtttgtttgtttgtttatttattattgcccaggctggagtgcagtggcacgatctcatctcactgcgacctctgcctctcaggttcaaactattctcatgcctcagcctcctcagtagctgggactacagacatgcaccaccatgcctggctaattttttttttttgtagttttagtagatacagggttgtgccgtgttgtccaggctggttgcaacctctagcctcgagtgatctgcctgcctcggcctcccaaagtgctaggattataggcgtgagccacggygcccagccaatactgacaggataattctaagagaatttcccctcatctgaatctatcccagactggccctagaagaagggcagctccttctgagaatggaaacggaagattttgggcggttattcctacccaagtccttagactgtcgacagtatttctgatcccgtgcctggcttttctgtttcctgtgcatggtggcggattaggtttggattcaggttgggtttggatctatcatgcagtgtcttctcagtcccatttgtcaagttcactcagcagaaacacagactattgatctgc

SEQ ID NO: 195238 - DNA, 601 bp, Human
cctcagcctcctcagtagctgggactacagacatgcaccaccatgcctggctaattttttttttttgtagttttagtagatacagggttgtgccgtgttgtccaggctggttgcaacctctagcctcgagtgatctgcctgcctcggcctcccaaagtgctaggattataggcgtgagccacggtgcccagccaatactgacaggataattctaagagaatttcccctcatctgaatctatcccagactggccctagaagaagggcagctccttctgagaatggaaacggaagattttggrcggttattcctacccaagtccttagactgtcgacagtatttctgatcccgtgcctggcttttctgtttcctgtgcatggtggcggattaggtttggattcaggttgggtttggatctatcatgcagtgtcttctcagtcccatttgtcaagttcactcagcagaaacacagactattgatctgcttttgccagggaaggctcagctgcctccagtggagtagggaaattgcttcccgtctccctggcctccttcctaaaagcttctgcaaatttccaggagagccctaagtgggtccctt

SEQ ID NO: 195239 - DNA, 601 bp, Human
gatcaccaccaccctccctgtggctgggcaggatacccgaggtagccgtgcagacacctcggatctgtccgtgcctggatgatcctcttcctgctcgatacctgcagtgagattggagccatatttctgagttctagctctgggctgttcctggctacatagagttgcttttgtctgtcccagcttgtgcatcccatgggtcagggctggggtcagagtgacgtggccctcaggggccagccaggagctcgaccaagacatgctggtgcgcgcatcttctgactcagctcaagcaaggackctgggctgttgagaaggtgatgggaagggattaatagtcccagtgtggtggagacgggctgtcgctgggagggtggggtgggcctgcggtggtggttgtaactgtggacatgtttactttcttagcctgggttattgatacacaggcgcccttgtgttccacatcccctgtgtcttacgtatttcataatggatacttttttttttttgagatggagtcttgctctgttgccttggctggagtgcagtggtgctctcggctcactgcaacctttaaccccgggttcaagcaattctcctg

SEQ ID NO: 195240 - DNA, 601 bp, Human
ggctgggcgaggtggctcacgcctgtaatcccagcactttgggaggtagaggcaggcagatcacttgaggccaggagttcgagaccagcctggccaccatggtgaaaccctgtctctactaaaaatacaaaaattagccaggcttggtaacgtacacctgtagctccagctacttggacctctagtcctaactaccaactactctgaggcaagaaaatcacttgaacccggaggtggacgtggcagtgagccaagattgtgccactgcactccagcctatgacagagcaagactctgtttaaaaaaaaaaaaaaggccaggcacagtggctcacgcctgtaattccagcactttgggaggcccaagcgggcggatcatgaggtcaggagttcgagaccagcctggccaacatggtgaaaccccgtctctactaaaaatacaaaaattagctgggcatggtggtggaagcctgtaatcccagctactcaggaggctgaggcaggagaattcctcaaacccaggaggtggaggttgcagtgagccgagactgtgccattgcactccagcctgggcaacaaaagcaagactctgtttcaaaaaa

SEQ ID NO: 195241 - DNA, 601 bp, Human
caggcagggccaaccagtgatagacactggaaaagaagttaagacagagcaatctaggctgggcacagtggctcacgcctgtaatcccagcactttgagaggctgaggtggaaggatcgtttgagatcaggagttcgaaaccagcctgagtaacatggcaaaatccaatctctactaaaaatacaaaaattagccaggtatggttgtgtgcgcctgtagtcccagctacttgggaggctaaggcagtggaatcacttgaacctgggaggtggaggttgtggtgagctgagattgcaccatygcactccagcctgggcaaaaagagcaaagctctgtctcaaaaaaaaaaagaaaaaagagcaatctgctagcgttggagatgtgtttaaggcgggggtgaggaaaggtcagcttggtaagcttctccagataagtggtccaggaaggcctttctggggagctatctgggctgagacctgaaggaggagaaggctaagagtgtttggggtgacaggaagagcaagggccaatgtccaagcctggcatgttcagcagacagccagggccaacggggcttgcatgtcctgagtgaggggagagg

SEQ ID NO: 195242 - DNA, 601 bp, Human
tcacctcccaccctgcagtcactgaagaggatcaagcgtgctgaccggcggggtgcagagtccgtgacagaggagaagttcacagtcctgtttgagtctcagttcagtgttggcagcaatgagcttgtgttccaggtgaaggtgagacccccagccctcctgcccccactgctccaggtcacccaagaggtggaggggcctgcctcaggactcctggcagcaatgccatcggacagcctgctttgactctgtgggtccctgtttgataggttataatctgggactaacccagacaatttargcaatgggctaagaagaagtcggttgtagtttttgtttgtttgcttgtgcctacattttgctgggaggggcttgtgtttggaactgtgggtgaggaaagtgggttgggaccaggtgtggtggctctcacctgtaattccagcattttgggaggcagaagagggaggactgcttgagtccaggagttcaagactagcctgggcagcatagtgagaacccgtatctacaaaaaaaagaaaaaagttgggcatggtggcctgcacctgtagtcccagctattctggaggctgaggcaggagga

SEQ ID NO: 195243 - DNA, 601 bp, Human
tctgttctcttccttctgcaggtttgtgaatgcatctgcagatgctgggggcagcagcgccacgtacatggaccaggccccctccccagctgtgtgcccccaggctccctataacatgtacccacagaagtaggtggtgttctcatggggtccgcaggggaagaactggggacttggccccaggctggactcctggagggctggcgggcaaaggatccagagctctggttaggcccaagtccaggaggagtgagatcagccaggaaaacagagcattttgaagctagacatagcagggtcragtcctcactctagtactaactgtgtgatcttgggaaaatgattgagcctctctgatgctcaagtttccttatgtgtaaaacggaggcaagaatgcttgcctcatgagaatgggatgagcattaaactgagacagtgtgggtgaagcatttccacagggaggggcttggaagggcttgatacagggtagctatgaatggggtggttgttcttgagtctggtgggaacaaggtagataattaattcccttcctcactgtggatagccagggctggatgtctgggaggtaccaccttccagt

SEQ ID NO: 195244 - DNA, 601 bp, Human
gctggactcctggagggctggcgggcaaaggatccagagctctggttaggcccaagtccaggaggagtgagatcagccaggaaaacagagcattttgaagctagacatagcagggtcaagtcctcactctagtactaactgtgtgatcttgggaaaatgattgagcctctctgatgctcaagtttccttatgtgtaaaacggaggcaagaatgcttgcctcatgagaatgggatgagcattaaactgagacagtgtgggtgaagcatttccacagggaggggcttggaagggcttgatacagggtagctatgaatggggtggttgttcttgagtctggtgggaacaaggtagataattaattcccttcctcactgtggatagccagggctggatgtctgggaggtaccaccttccagtgggaccactgaagatcccaggttccaatccggactccaccacctcccagccaggtggcccagagcaagcttcctgatatggccttggttttctcgtctataaaacggggtcaatacccactctccagttggctgtaaaaattggagtcatgtgctcaataggctcagctgttctaggtgctca

SEQ ID NO: 195245 - DNA, 601 bp, Human
aagaagcaaggggaaatctttactgtgttggtgatgtcatagaccacgatggcagcctgggccccccgatagtacatgggggccaggctgtgataccgctcctgtccagctgtgtcccagatctcaaacttgactgttgtgtcatccaggcagacagtctgtgtgaggaaggccgctgtaagagagaaggagcgtccatgggcaagagcgagttggaatccaccccacacaatcccactgttgcttctaggctctggcactcagaagcccaccactgagatgggcacagagaaccctcaasccaggagccaaagcaggcctgagtggggggtggagtttggatttttatgtatgtgtctgggggacggggtctgcacaggctttgcagacccagcccaggcaacggcaggagaagggactcctgcatgcactgagccatctcaggaccactctctgaagagcaacacagcaggggcaagagagggaaagcctaggggaagcctactccaagcacagaagggtgagcgccctcagacctcctcctccgccactcagagaacagaccagcagctagggaccgctccacccctcagtttgctcc

SEQ ID NO: 195246 - DNA, 601 bp, Human
ccaagcccagctaatttttaaatcttttgcagagacagagtcttactgtgtcgcctaggctggtctcgaactcctggcctcaagtgatcctcccactccagcctcccaaggcactgggattacagacaggagccatgttaggcccatgcctgaggcacgagaggacagcagatggaagcttccctgttgcctcctagcatggcccttcccaaagcccctgagcatcccaggcgaggccggggggagctgcttactccactccttcccccaagtctgtcatctccccacctggaattccacrgctctcttgctggccaggtctgccttgttacccgcgagtgcaatgacgatgttggggctggcctgcctctgtagctccttcacccagttcttggcccgtgcaaatgtatcctgaggagacagggacagaatgtcgaagggacagagaaggcattctgcccagggccacccattagagactctcaagctggcacagccaaattatctaagacattgccacctaaagattctgatgcaatgtccccaaacaggaaatctgcccaccccccacccaggaacagagggttaagcggcctgaaat

SEQ ID NO: 195247 - DNA, 601 bp, Human
ccaggctggagtgcagtggcacgatcactgctcactgcagcctcaatctcctggcctctaatgatcctccccacctcggcctcctgagtagcacaccaccatgcccagctaacttttgtatttttttagacatggggtttcgccacattgcccatgctggtctcgaactcctaagctcaagtgatctcccgcctcagcctgcagagtattgggattacaggtgtgtgccaccacacctggctgttttttttttttttttaaagagatggggcctcactcttgctcaggctggagtgcagtrttgcaatcactgcaatcttaaactcctgggctcaaacaatcctcgtgcctcagcctcctgagcagctgagactacaggtgcgtgccaccaagcccagctaatttttaaatcttttgcagagacagagtcttactgtgtcgcctaggctggtctcgaactcctggcctcaagtgatcctcccactccagcctcccaaggcactgggattacagacaggagccatgttaggcccatgcctgaggcacgagaggacagcagatggaagcttccctgttgcctcctagcatggcccttcccaaa

SEQ ID NO: 195248 - DNA, 601 bp, Human
tagggttagcagagacttaagtatttctttctcaataagtttaattaaaaagtcaacttacaagaaaagagaagtagaaggctagtgatccatatatacacatacccctaccaccaaagaaagagaaccagggagagacaggtgacgggcaattccttttaggcccatgctttttttattcttttcttttttttttttttgagacaggatctcactgtgttgcccaggctggagtgcagtggcacgatcactgctcactgcagcctcaatctcctggcctctaatgatcctccccacctcrgcctcctgagtagcacaccaccatgcccagctaacttttgtatttttttagacatggggtttcgccacattgcccatgctggtctcgaactcctaagctcaagtgatctcccgcctcagcctgcagagtattgggattacaggtgtgtgccaccacacctggctgttttttttttttttttaaagagatggggcctcactcttgctcaggctggagtgcagtgttgcaatcactgcaatcttaaactcctgggctcaaacaatcctcgtgcctcagcctcctgagcagctgagactacag

SEQ ID NO: 195249 - DNA, 601 bp, Human
tgggtggcaggctacaggctcagagagtgaaatgttgagactctggcccaggcttcaggaacttctcgggtgaacaaccaacatctacatctgggagtcaggtgatgatgaaaacaattttatcagaaggttaaaagtggtgaagggggctgggcgcagtggcttacgctcgtaatcccagcactttgggaggccgaggcgggtggatcacgaggtcaggagatcgagaccatcctggctaacaccgtgaaaccccgtctctaccaaaaatacaaaaaattagctgggagtggtggtgggyaccagtagtcccagctgctcgagaggctgaggcaggagaatggcgtgaacctggggggcggagcttgcagtgagtcgagatcgtgccactgaactccagcctgggtgatagagcgagactccatctcaaaaaaaaaaaaaaaaaaaaaaaaaaagagtggtgaagggaccccgcaggcccactctagaccagcagacaggtgatatgcccttgctgtggtggagagaggaggggaggagaagcaactgacctattgccatgaagatttcgttcacgttcattgcagtctttgctgatgtc

SEQ ID NO: 195250 - DNA, 601 bp, Human
agcgggcaggcaaggggggctcagttgctgcagcactggctccggctggctgggttgttctcctggaggtccacacctcggtttcggcctggagcaccagttgcattctggggctcgttcttgggaagcttcttagctgtttgggagggggaaaagtgcatttgttgggggtaccccaataactctcccagttccactggagcagattctggcctttatacccaatcagtggtaactcacatattgagggcttctgtgtgtcaggtgcattctgattgttttcaggaaactgcggcaaagwaaggttaaataacttgcccaagactacagagctaatgagtggtagagccaggatctgcaacccaggaaggaagattccagagccaaatgagctaaaaactcctaggcagtgggtaggggtagtgatggcaggctctgaaatgggtggcaggctacaggctcagagagtgaaatgttgagactctggcccaggcttcaggaacttctcgggtgaacaaccaacatctacatctgggagtcaggtgatgatgaaaacaattttatcagaaggttaaaagtggtgaagggggctgggcgcagt

SEQ ID NO: 195251 - DNA, 601 bp, Human
aaataatgtagacccaacagctgaaagcttattatggcccaggcggctatccaacagctttggaaacctaagatccaagcagaccataaacaccacttgaagactgaaaaaaatgacataagcccaagtatgatattcagtgtcacgctggccctttcaaagggcattccctgaggacactgcagagaaaatgtatggaattgtatctaggcaaagatctgtatactgcacgatgctttgggaagagcacgaatctcagagtccttgaagtttcaatccctggatactcaacaaacagccrtgtcacctgagcaggccacttactccacctatctgggcctcagtttcctcatttgtacaataaaagaatggcatcatcgctgggttcctttccagctctaacattctttgacccacttttggcactatttatttgatacgaggtatggcgggatcacagggaccaagaagaaaagaactgactctggctctttggcaaagagagaatcggtatctcttttagtctttaaaattcttgtgcttttcattaatcccgtctttctaaaagctgacacttggttttcttctttggcttttccat

SEQ ID NO: 195252 - DNA, 601 bp, Human
aattaagactttctcttctttaatataatttccaccagaagtatatactttaattggaaaaatatttatcaccatcttcatcaacatttaaaaaaatcctaaacatataaaaatattttctattcaaaaaccaacgagactccatttgggaacacaaagaaatacaagcctcaaagaaacaaaatgtcttataacaaagtggcagtggccagctcgcttttgctgtacactagttagggatgcagtctctggaatcagccccgccaagaacagtaatgtgaccttggacaaattacttaamttctctgtggccatttcttcatcttccatctgggaataatacccactcctctgagaatcacgagttaacacaaggccagagctgaaaacaatgtctgcccagcacactgtcagtgaacggtaagcattaggtaatgtttttattatcttcacacttgaaggcgttggaacattttctcaaactctgggttttgaacataatttgaaggacttgttaattgtctgctcacctctcgaaaggtggcatcataatgattagatacataatcagaatatcttcccaggtgagccatggtaagca

SEQ ID NO: 195253 - DNA, 601 bp, Human
aaaaggttaaaaatggtaaattttatgatatatatacgtaactccacaatctttaaaatggggttaaaaaaccagtttttgcctaataaactcacattttttctatctttaatgctgaaatccaaaggaaacaaagagatatttgctgtctcctctctcttctcccccatccccccaactttttttgagacagcgtctcactctgtggcccaggctggtctctaactcatgggctcaagtgaccctcctggctcagcctcccatagtactgggattataggcatgagccactgcacccagmcccctctcttttctttcttccacagtaaaaggcacactttcagtccttctgagggttgaagttctctggatacacctgctgtattgagattaaaggggaatacaatagtctttccttatctgagattttgttttctatggtttctgttacccacagtacagcatagtaagatacagtattttaagatagactacattcggccaggcacagtggctcacgcctgtaatcccagcattttgggaggctgaggcgagcaggtcacgaggttaggagatcgagaccatcctggctaacatggtg

SEQ ID NO: 195254 - DNA, 601 bp, Human
ggtgctgacggtcacacaacaatgtgaatgtgcttaatgccacggaactgtactttaaaacagtgaaaatggccgggcacagcggctcgcgcctgtaatcccagcactttgggaggccgagggcggttcacctaaggtcaggagttccagaccaccctggttaacatggtgaaaccccacctctactaaaaataccaaaattagccaggcatggtggcgtgcacctgtaatcccagctactcaggaggctgaggcaggagaattgcttgaatccaggaggtgaaggttgcaatgagctaasctccagcctgggtgacacagagaaactccatctcaaaataaaaggttaaaaatggtaaattttatgatatatatacgtaactccacaatctttaaaatggggttaaaaaaccagtttttgcctaataaactcacattttttctatctttaatgctgaaatccaaaggaaacaaagagatatttgctgtctcctctctcttctcccccatccccccaactttttttgagacagcgtctcactctgtggcccaggctggtctctaactcatgggctcaagtgaccctcctggctcagcctcc

SEQ ID NO: 195255 - DNA, 601 bp, Human
tgcaagatgtgctttgttaaacagatgcttgaaggcagcatgctccttaagagtcatcaccactccctaatctcaagtacccagggacacaaacactgcggaaggccacagggtccctctgcctaggaaaaccagagacctttgttcacttgtttatctgctgaccttccctccactattgtcctgtgaccctgccaaatccccctctgcgagaaacacccaagaatgatcaattaaaaaaaaaaaatgttaaaaataaactttaaaaaatatatgtgtttatacttaaaaaaaataaataaaaaaaaaatataaaaattagttgggcgtggtggcacacgcctgtagttgcagctactctgaaggctgaggcacaagaatctcttgaacccgggaggcagaggttgtggtgagctgagattgcgccacttgcactccaggctgggcaactgagtgagactctgtctcaaaacaaacaaaaacacccacagctctaaaggccattatatcattatatattagatattactttatcactgctaaatttcttgagagtgacaatggcattcaggttgcgtagaagaatgcccttgctgggagt

SEQ ID NO: 195256 - DNA, 601 bp, Human
gtttcacaaaatatgatgcaaacatccttgttcacctaccatgcttggctttcaatccactgggataaataatgccgcacctcaatgggaaaatgctggccatataacgcttgcatctgatgaagggcttctccttggagctgctgagcttgtatccacacagccatggtttacaatctgttgaacaaacaatcagtgctttgggcgttttttctttattttccccttacatccaccagagtaaatattcacttagttaccaaggtaaatgtttttattttattatttatttttatttttrtttttttgagacagtctcgctctgccacccaagctggagtgcagtggcacaatcttggctcactacaacctccgcctccccggttcaaatgattctcctgtctcagcctcctgagtagctgggattacaggggcacactaccatgcttggttaatttttgtatttttagtagagatggggtttcaccgtgttggccaggctggtctcgaactcctgaccttaagtgatcctcccacctcagcctcctaaagtgctgggattacaggcgtgagccaccacgtttggccaaagtaaatgttt

SEQ ID NO: 195257 - DNA, 601 bp, Human; identical to SEQ ID NO: 36836

SEQ ID NO: 195258 - DNA, 601 bp, Human; identical to SEQ ID NO: 36837

SEQ ID NO: 195259 - DNA, 601 bp, Human; identical to SEQ ID NO: 36838

SEQ ID NO: 195260 - DNA, 601 bp, Human; identical to SEQ ID NO: 36839

SEQ ID NO: 195261 - DNA, 601 bp, Human
aacagacatgaagagattctccacatccaccaccatccccagcagtcggtttatctcatcctctgacacattctccaagtgggatacgtggtcagctgcaagacagatggcagagttaggaaaaattgatagaagaaatcaacaaggcttcttgaccctcttcacagccaagcaagatacacactctgttcctccaaccagtgtgaccaacagtgagactgactgctccgatatcaaccgttgggttgcctgggcctgttctgggctgagagatttcctttctccccccttggtgcacacmcccccccaacccaatccctccttcgaggcatctttgattttttcagagatgaagctttgtggcacttgtcaccctgtccaagcaggacccagcacctgcccccagctccaagggcgctgcctgccttacccaaggggtgctcacaactgcggcacagctcactcaggttggcagctggctgctgcagatccatgcggggtgcagtggggggcttggggtttttccagccattacacttacaggtttcattggcctggaggtggaaggatcagtcaatgacctatacctctggggcaagag

SEQ ID NO: 195262 - DNA, 601 bp, Human
cgggtcatctgcaggatgcatttccgcagtagctagagagaagaggaagggggcatagaggggaggggggcagagctgcagacaacccctcaaggccccacctccttcactcacaccctcctttagtggaagctcaccttgaagaggtagaaatagacctgcttggtgtctgtgtcctcttccttgtgaacagacatgaagagattctccacatccaccaccatccccagcagtcggtttatctcatcctctgacacattctccaagtgggatacgtggtcagctgcaagacagatggcasagttaggaaaaattgatagaagaaatcaacaaggcttcttgaccctcttcacagccaagcaagatacacactctgttcctccaaccagtgtgaccaacagtgagactgactgctccgatatcaaccgttgggttgcctgggcctgttctgggctgagagatttcctttctccccccttggtgcacacccccccccaacccaatccctccttcgaggcatctttgattttttcagagatgaagctttgtggcacttgtcaccctgtccaagcaggacccagcacctgcccccagctccaag

SEQ ID NO: 195263 - DNA, 601 bp, Human
cgaacatcgtctgccgctcccggggagccaggtgactaaacttgtactgcacaaagttcagcacaccctgagaaggggtgggtgggggataaaaccaggaatgaggtgtgagcagcccgcagggccttcttagacaaaggaagatgctccctggccagggacaaggttctccttctcctctctctctcgggtgctctctatagaaaagctctgccccctccctaccaccatgcccaccctgaggttagcacaaaacacccttccttctctgaacctccccagtgttctcagcttgaggagratggagaacacaggctccccactcctccaagctgtccccaattctcctatccgctatctccaattcccctatctcacctgctcaatattaggtttctcaaatggagggctgcccagggacccctccaccacaggccgggtcatctgcaggatgcatttccgcagtagctagagagaagaggaagggggcatagaggggaggggggcagagctgcagacaacccctcaaggccccacctccttcactcacaccctcctttagtggaagctcaccttgaagaggtagaaatagacctgcttg

SEQ ID NO: 195264 - DNA, 601 bp, Human
ggagtagggggtcgagggggagacaggtgagggcggaaaccactgaacccaggctgggcctgcaagcctcccccgaagctgcccctggctgggcctacctggtgtaattgaccttgtaggtagccacgtcctcagcctgagacctctgccgaaactgggcaggtgtctcaagcttccagtagttaaggcagagcaagaacatctttgagagctcgaacatcgtctgccgctcccggggagccaggtgactaaacttgtactgcacaaagttcagcacaccctgagaaggggtgggtggggrataaaaccaggaatgaggtgtgagcagcccgcagggccttcttagacaaaggaagatgctccctggccagggacaaggttctccttctcctctctctctcgggtgctctctatagaaaagctctgccccctccctaccaccatgcccaccctgaggttagcacaaaacacccttccttctctgaacctccccagtgttctcagcttgaggagaatggagaacacaggctccccactcctccaagctgtccccaattctcctatccgctatctccaattcccctatctcacctgctcaata

SEQ ID NO: 195265 - DNA, 601 bp, Human
acaggtctgagctgatgtcatcctgtgctgtgtggccaggcagggcaccttgtcaccctgagccccctcactgccctcagtatcaaaatgggctcagactccaccccaccttgccatctcttgttcccacctgatggcagggggcactagagagccaggattagtcagtcagggttttttgaacaggggagttatggcctagattttaaaaggtgtggccgaacagaagaaaatggtacagaaaagaccagaacaggagtagaaattggtttcacttcaagcttaaggtctggtttcttgragagttgtgcagggaaggagtctgaggctgtgtccaggcccccatgggaaacaattagtaacatctactggggcgtagggtcgggtgggggcagcgttagcttgggctatgtacctgccatccccagactagtactagcaagttgcttctgggccatgggcaagtctgccaggtagacgcccagatcccaaaaggcccatggagggagaggagggaccaatccaggaagccttcctggaaaaaaggggacaacagggaggatgtgaacttggggccaaatcctggtaggccagaaggagc

SEQ ID NO: 195266 - DNA, 601 bp, Human
tcggcccctgcagaatccagactcagggagctgttgctgcccccacccatgctggggctgaagatgggggtgctgggaacaaccgctgcactgactgaagctgaggagagagagagagaagtcagggatggggggctgaagctgaggggagagagagagaagtcagggacgggggctgaagctgaggagagagtcagggacgggggtgctgaagctgaggagagagagagagaaggcagggactgggggggctgaagccggtggcaggtccctcagtgggatccagggcctccggcccagstgagctctcttccacccaggaggcttagctcagccaggcaggccagacaccctacagagcgtaccatggcacatacctggccggggaaccagctgtgtcccctctgagggtggcatggtgaagcctgactcccagattggagagtttgccccatagatctcctcctccagcatggacaggaatctgtagggaggacacagtctgtcccacaactctgttctccagggtgcagcctgggccaggcagcagagggactggaggctggtcagagacagaccctgctcttagggaactggggac

SEQ ID NO: 195267 - DNA, 601 bp, Human
cctcttctcgcctattggggaggcaggcaaggttgctcaggatcagtaaaaaaggtttgggaaggagtgaatgagggtcagaggtcaggggtcaagtatccacctggcataggctcggcccctgcagaatccagactcagggagctgttgctgcccccacccatgctggggctgaagatgggggtgctgggaacaaccgctgcactgactgaagctgaggagagagagagagaagtcagggatggggggctgaagctgaggggagagagagagaagtcagggacgggggctgaagctgagaagagagtcagggacgggggtgctgaagctgaggagagagagagagaaggcagggactgggggggctgaagccggtggcaggtccctcagtgggatccagggcctccggcccaggtgagctctcttccacccaggaggcttagctcagccaggcaggccagacaccctacagagcgtaccatggcacatacctggccggggaaccagctgtgtcccctctgagggtggcatggtgaagcctgactcccagattggagagtttgccccatagatctcctcctccagcatggacaggaatctg

SEQ ID NO: 195268 - DNA, 601 bp, Human
ccgcttggcatcctccagggtcaggttctctgggagcgtcctcttctcgcctattggggaggcaggcaaggttgctcaggatcagtaaaaaaggtttgggaaggagtgaatgagggtcagaggtcaggggtcaagtatccacctggcataggctcggcccctgcagaatccagactcagggagctgttgctgcccccacccatgctggggctgaagatgggggtgctgggaacaaccgctgcactgactgaagctgaggagagagagagagaagtcagggatggggggctgaagctgaggrgagagagagagaagtcagggacgggggctgaagctgaggagagagtcagggacgggggtgctgaagctgaggagagagagagagaaggcagggactgggggggctgaagccggtggcaggtccctcagtgggatccagggcctccggcccaggtgagctctcttccacccaggaggcttagctcagccaggcaggccagacaccctacagagcgtaccatggcacatacctggccggggaaccagctgtgtcccctctgagggtggcatggtgaagcctgactcccagattggagagttt

SEQ ID NO: 195269 - DNA, 601 bp, Human
ccatggggatgtcacccatcacacggagccgcttggcatcctccagggtcaggttctctgggagcgtcctcttctcgcctattggggaggcaggcaaggttgctcaggatcagtaaaaaaggtttgggaaggagtgaatgagggtcagaggtcaggggtcaagtatccacctggcataggctcggcccctgcagaatccagactcagggagctgttgctgcccccacccatgctggggctgaagatgggggtgctgggaacaaccgctgcactgactgaagctgaggagagagagagagamgtcagggatggggggctgaagctgaggggagagagagagaagtcagggacgggggctgaagctgaggagagagtcagggacgggggtgctgaagctgaggagagagagagagaaggcagggactgggggggctgaagccggtggcaggtccctcagtgggatccagggcctccggcccaggtgagctctcttccacccaggaggcttagctcagccaggcaggccagacaccctacagagcgtaccatggcacatacctggccggggaaccagctgtgtcccctctgagggtggcatggt

SEQ ID NO: 195270 - DNA, 601 bp, Human
ctcagctacgttaggaaatgtgttcaaggtcaggctgccagccgtggcagggccgggtccaaacccaacacaggccactgattcccagtccctgggcctcagagttgggagaagcgggagagggagtcaccagaggtctgagcagcaggagcaatgcctcccacacgtcagggccaatgaggcaccacacagatctgaggtatgcgacacacagagccagagaccctacgagtgggtctgttgtaacaaaggacagaagccaaaactatcagcatagggctactgtaataatgattagttyggctgggcgcggtggctcatgcctgtaatcccagcactttgggaggccgaggtgggtgaatcacttaaggtcaggagttagagaccagcctgggtgaaaccctgcaacatggtgaaaccctgtctctactaaaatacaaaagttagccagacgtagtggtgcatgcctgtggtcccagctacttgggaggccgaggcaggagtatcacttgaacctgggaggttgaggctgcagtgagccctgatcatgcctctgcactgcggcctgggtgagagagaccctctttcaaaaaaataaata

SEQ ID NO: 195271 - DNA, 601 bp, Human
tattaccacctttattttacagaagagaaaaccgaaactcagctacgttaggaaatgtgttcaaggtcaggctgccagccgtggcagggccgggtccaaacccaacacaggccactgattcccagtccctgggcctcagagttgggagaagcgggagagggagtcaccagaggtctgagcagcaggagcaatgcctcccacacgtcagggccaatgaggcaccacacagatctgaggtatgcgacacacagagccagagaccctacgagtgggtctgttgtaacaaaggacagaagccaaractatcagcatagggctactgtaataatgattagtttggctgggcgcggtggctcatgcctgtaatcccagcactttgggaggccgaggtgggtgaatcacttaaggtcaggagttagagaccagcctgggtgaaaccctgcaacatggtgaaaccctgtctctactaaaatacaaaagttagccagacgtagtggtgcatgcctgtggtcccagctacttgggaggccgaggcaggagtatcacttgaacctgggaggttgaggctgcagtgagccctgatcatgcctctgcactgcgg

SEQ ID NO: 195272 - DNA, 601 bp, Human
atccaggcaaagaggaagaaaggcagctgacagaggaaggggagcttatggggagaaagtgaagggtgcgggctttctaagctcactctgggctaggtgcagtgcttcctgttttacagaccgattctcaaattaaccccagaggcgagtattaccacctttattttacagaagagaaaaccgaaactcagctacgttaggaaatgtgttcaaggtcaggctgccagccgtggcagggccgggtccaaacccaacacaggccactgattcccagtccctgggcctcagagttgggagaagygggagagggagtcaccagaggtctgagcagcaggagcaatgcctcccacacgtcagggccaatgaggcaccacacagatctgaggtatgcgacacacagagccagagaccctacgagtgggtctgttgtaacaaaggacagaagccaaaactatcagcatagggctactgtaataatgattagtttggctgggcgcggtggctcatgcctgtaatcccagcactttgggaggccgaggtgggtgaatcacttaaggtcaggagttagagaccagcctgggtgaaaccctgcaacatggtg

SEQ ID NO: 195273 - DNA, 601 bp, Human
ccttgatgtagcccaggtagcggctcttgggcaccttgatgtccttggagaaaccctggggggtggatggtcatgacccagtccatccataagtatttcccaacttctgtcgtccctcacctgggagcaccagaggagtagcacgtgccacttgccacctcctgctcctgaacctcctcctggggcactgtgagggttcaaactgtccctggaaaggtcccaggtcagctgcccactcctgactcatcccgaagagtcccccagttcctccagcctgctctactggccccccagttcctcyagcctcctctactggccccccagttcctccagcctcctctactggccccccagttcctccagcctgctcttggcccccagttcctccagcttgctctactggccccccagttcctccagcctgctctactagccccccagttcctccagcctgctctagtgccccccccagttcctccggcctgctttactggccccctagttcctccaggatgctctactgacccccagttcctccggcctgctctactggccccacaggccctcattctcccctggggcaatggcagcagaggaaaga

SEQ ID NO: 195274 - DNA, 601 bp, Human
gcggggattcagctcacactccatcagcgtcgctccctcgtagtccttgatgtagcccaggtagcggctcttgggcaccttgatgtccttggagaaaccctggggggtggatggtcatgacccagtccatccataagtatttcccaacttctgtcgtccctcacctgggagcaccagaggagtagcacgtgccacttgccacctcctgctcctgaacctcctcctggggcactgtgagggttcaaactgtccctggaaaggtcccaggtcagctgcccactcctgactcatcccgaagagycccccagttcctccagcctgctctactggccccccagttcctctagcctcctctactggccccccagttcctccagcctcctctactggccccccagttcctccagcctgctcttggcccccagttcctccagcttgctctactggccccccagttcctccagcctgctctactagccccccagttcctccagcctgctctagtgccccccccagttcctccggcctgctttactggccccctagttcctccaggatgctctactgacccccagttcctccggcctgctctactggcccc

SEQ ID NO: 195275 - DNA, 601 bp, Human
agtcagtaacataaaaaccatgttcactcttgtcttttataaatgcatacttagattctctcagttctgaacatgtaacactgttaattgttgatgggataacaaaaaaatggcctcaggattttttagtaacaatgacctcttatggtatacatctatttttactatttaaatatttccccttcaaatcaggcatttaggtgggtagaaggaaggcttttacattatcattccttcttatgattgaagaaattatcaactattaacaagtatcttttttctcaaaaaatactattattayacactaatgaaaaaaattagccctcaaattttcaaaattactctttagaaggcaatcacaccaaaaagcacatatgtagctttcacccagagatgccattggcacacaaatattaacagtgaaagacagcttttgttttactagaaagacttgtacaaaaaacatcagttcatggattctacatacccaaaaaactgtcttcaaattaatttagtttggaagtttaatatcatcctgaaagttgaaatacttacttaccagttataaacagtatgaaggttgtataatgatatccaccaa

SEQ ID NO: 195276 - DNA, 601 bp, Human
tggccaggcgcgctggctcaagcctgtaatcccagcactttgggaggctgaggtgggtggatcactgaaggtcaggagttcgagactagcctggccaacatggtgaaatcccatctctactaaaaatacaaaacagctgggcatggtggtgggtacctgtaatcccagctactagggagactgatgcaggagaactgcttgaacctgggaggtggaggttgcagtgagccgagattgcgccactgcactccagactgggcaaaagagtaagaccttatctcaaaaaaaaaaaaaaaaaaaagttttattttatgaaagtgttgacttcccaatttagcttggccccaatttacctacatctttcactactaacactacctctgaaaacagaaggggatctgtgaagcaataccagaacattaggcttagaatccacaagccttggcaatctcacttttagcccctttagtcaagtcactttacctttctgagtctttgggttgcatctgtaactgagaacaatatcttataaaagtatgataaaaataatgttctgtaacatgcttcccccacctgcttgtcctcaatattcaaatcactt

SEQ ID NO: 195277 - DNA, 601 bp, Human
gattggtcttggtctcctgacctggtgatccgcctgccgtggccttccaaagtgctaggattacaggcgtgtgagccaccttgccctgctgaaaagaggcattttataagttgcaataaacaatataaaaagtcagttatactttattagaatactttagagctcagtctctggatcatgatttatactaagaatacaagggaaattatctagggttttcatctcaccaatctcatttgaggggcaaatgttgtcagctacatccaaaactgaataataattactctttccaagacaaagmggaacaacagtatgtaacatgaataggaagctttcaagcaatgaaaataaaaataatgttttggccaggcgcgctggctcaagcctgtaatcccagcactttgggaggctgaggtgggtggatcactgaaggtcaggagttcgagactagcctggccaacatggtgaaatcccatctctactaaaaatacaaaacagctgggcatggtggtgggtacctgtaatcccagctactagggagactgatgcaggagaactgcttgaacctgggaggtggaggttgcagtgagccgagattgcg

SEQ ID NO: 195278 - DNA, 601 bp, Human
cacaacattcgcttaaaagccaaagcctaattcagaggtaggtcctaattcttcaattctataaaggctaatagaggtgaggaagctgcagaagttaagcttaaagctagcagactggttcatgagatttaagaacccatttccataacataaaagggcaagataaggcatcaagtaccaatataaaaactacaacaagtttcccagacgatctacctaagataagtgatgaaggtggttgcactaaacaacaggttttcaatgtagacgaaatagccttctagtggaagaagatgccacytaggactttactagctagagaagtcaatgcctgccctcaaaccctcaacggacaggctgactcttgttagaggctaatgtagctggtgactttcagttgaagccaaggctcattcaccattctgaaagcatttaagccattctttagcacttaagaattatgctaaatctactacgcctgtgctctagaaatggaacaacaaagcctggatgacagcacatctgcttacagcacggtatactgaatattttaagtgcattattgagacctactgctcagaaaaaaaaaaaaagattcctt

SEQ ID NO: 195279 - DNA, 601 bp, Human
aatgaatttcaagcaaacaaaaatttggtataaacttccaagaacaaggttaaaactagaatgaggcgattctcttagtaagaccttatcacaagtaactgtgggaagttaacatctcatactgtcctagaatccaaaaatttgcagattaacttgaagaaaagcaatctttgaggatactttttaaaatcttttttttttttgagacaaggtcttgctctgttgtccaggctgcagtgcggcaccatcacggctcactgcagccttgatctcccaagctcaagtaatcctcccaccttaktctcccgagtagctgggactgcaggcatgcaccactgaggacactatcttattaccaatgtcctctcagcattctggtttggattcagaaatcccacaaccttatttccaacccactataaaataatcagctataagataaatgacccacagactcaacattcttgaatacaggccatcataaccactgtagtaacatgaaattacaaacaaagcaggcttaaactaaagctcataaatcatccatgctgtttttcatggaagacaattttttttttttttttgagacagagtttcgctc

SEQ ID NO: 195280 - DNA, 601 bp, Human
tctcctctgtatacatatgcaggcacatttcctgagagaagatactatgaagtgaacttaactagtgtatctagtagtttggtttttaaatgttgacattatcaaattgtcctttaaaataaaaagaacagttaactcttaagtgaaatttctaacttgtcaatctagaaaagccaaccagagctctttcttcccttcctaccaaacttcacagaccagaacaaatataattaaatactggcgataacagtggtatacagtagaagcaaccatccctcagaccggaggggggaaaaaaaaatcatccaatcaactattaagtagatcttaacaaaaatgcaaccttggaaagaaccagttttaagcatgattttggttgttttgttgttgttgttttggtctcaacttaccagctctcagatagttacaacaataaaacagactacaccagaacagtagaacaataaaagctacagatgttcatataaaagatcattttgggctgggtgcagtggctcacgcctgtaatcccaaatcccaatactttgcgaggctgaggcgagtggatcacttgaggtcaggagctccagaccagcctggc

SEQ ID NO: 195281 - DNA, 601 bp, Human
ggtttatgttgactacgctgttcttaaactcctggactcaagtgatccttcccgccttccccagcctcccaaagtgttgagataacaggcgtgaaccactgcacccagcctattctagattattactgtcatggttaatggctggaaactattcaactgagctaaaccatatgtacatacataatgtatgtaatgtacataatattctctgttaaatatttacagcaaatgttttcttgaatttctcagaaaaattcttttttttcttgaacttcttcctcgatattttttttttttttttgagacagggtctcactgttccccaagttagagtgtagggtggcaagatcaagtctcattgcagccacgacctcctgggctcaagcaactctgcccacctcagcctgagtagctgggactacaggcctgtgccaccacactcggttaattattattatttttttgtagacaaggtctcactatgttgcccaggctggtcacaaactcttggactcaagcaatatgctcactttgtcctgtcctcccaaagtgctgggattatagccacgagccaccgtgaccagctgatttaaaacatttt

SEQ ID NO: 195282 - DNA, 601 bp, Human
ctacatttattgaaccccttccacaacgccacgtgtagcaaaatggtctgcgggggatgggctggattcacccaaaaagccccaagggtgtcagggtttctacttagcccttctccacaccggcactgttctaaaggtttcatgctaattaattcattttattattccccaaaactcatcgaaggagaggtacaattgctcccgtcctatagatgagaaaacgaaggtatggggacttcccagctgtgtgaccttgtacaaaccactaagactgcgggcctctaatccaaagtcaggctcsgaaacagtttccagaatgcaccgccgcatttggcgaatgaatgaacgaccgaaccagtaatcactcctaagaccaagaaggccacatccttccccgtggggcctccttttccgaggccaaaccttcagcccaggcccgagctccggcctctaccgcctaagtcgactctcggccggcgcgttccgctctagaaggctctggcacaggcgggcggtgccgggcgccagcttctgcgggcgtgggccggccagggcgcgtgggcctggggactcggggccacggtcgtcacgtgagctcatc

SEQ ID NO: 195283 - DNA, 601 bp, Human
aggcagagacttgcttgaacccgagaggtagagattgcagggagccgagattgcaccactgcactccagcctgggcaacagagtgagactccatctaaaaaaaaaaaaaaaaaaaagagagagagaaactgaggcacaagacagtgacttgacctgtatgagaccgaccctatggctcaccagacctgtgttatgggcctaagctactctccagtgctctttccagcacagttctgagtaaagaacttaaagtcccactcatcccaaaccccctgagtacgtggtaaaatggagaaatgcrcccagacccagctgaggagcccactggtcaacttttctcagtggctaccacaggactccatggaaaacccaaagccgcagactacagaatctctgagcaccaggaggggctgcctccaagcttcggctggtcctcaaccacacatgcgcctcttccagtcactaccaccgaagacactacaccacgggaaattccatcaaaggcgaagtggacttcagtgcttcaggagcatcttcctggtaagggtagaggttggatgcccttcacctccccagcatggagttcactgtccacacctgc

SEQ ID NO: 195284 - DNA, 601 bp, Human
ctcagggcagcctgcccacccacctatcaaggggagatggcctgcgctggcagccagtacactatggtctggatcccaggcatacctggggctcctacctgacctaaggcacctcaagttccctggagcctcactgcttggcttgaccaggtagggttgagacagacagtgcttgggcaggaagcctcgggaatcaaatagacctgagttctaacccaccccaccactttctaggtatgtgactttgggcaagtcgcaacctctctactcctttttcttcagctctaatatggagaaagasagcctggattggcgtcactgtgaggactgaattagctcgttaatatacaacacttggtacagtggctggcgcttggtaagcagggaatacacacagtattttatcacaagttttcattttgtatatttattataataatggctgctaagcatgttcaaaaggtcaccctgaaccacagggtccagagtccttcatgtccacaatgaggcattgtttagctgaacaggtcctgaaagaatgcctcccaccagatcccagggaaaacggacccttataatagacactcagcaccactgtcct

SEQ ID NO: 195285 - DNA, 601 bp, Human
gtggaggttgtggtgagctgagatcgcgccattgtaatccagcctgggcaacaagagtaaaactccgtctcgaaacaaaaaaaaaaaaaagaaagaaagctagctagctatgatacagttaaatgaaaaaagtcagaaaatttgtaattccatgtaattggaggaaaacctttttacacatctttctatgttcatgaatggatgggaaagcatgtggaaggatacaagccaatctgcaaattggggctggcttagatacgcttctggagaaggaggtttagggaaggaatgcacttcaaaycgaattttcattttttgttctgcttcattatttaagctgtttgtgtatactaataatttgtttaaggataaagaatttcaatacaaaaattagccgggcgtggtggtaagtgcctgtaatcccagctacttgggaggctgaggcatgagaatcacttgaacccaaaggcaaaggctgcagtgagccaagatcgtgccactgcactccagcctgggtgacagagcgagagactccctctccaaaaaaacagcactttaaaagccaaccactgtgcctgaaattgagctgtgttgtgtccca

SEQ ID NO: 195286 - DNA, 601 bp, Human
atagcacctggcaaggaagactcacagaaaccactggctgaatggagtcaagtccactcctgggcctgaagtgacaccaccgaggacagcaaaaggatgactcaccctttcactaaaggcccccaactgccaggtagtggtagcttcccctcctttttgtgcacttcggcccatcccctgctgcactgatctgacggaactaaggaaggcccgagacagctctgccgctccgagaagttcagctttcttacagctacagacagcacccccaaaatgcccatttttacacagctctcgaacmcatttcagagacaattttatgatagaaataataatctgcattaattttctaaggcgaggactggaggaaagaaaagtcggcaacaaagcctgctttcacttaacaccctgccagggtgctgacttgaaggctgaaccctggcccccacccctcccagtcactccttccacccagatctgctccaaatcggagcctgtacagttagctactgatacacagctgtctctgcagcatccaccccccaggggccttcacaagctgagcctctagaggctgcgcatgaagcagggcagtctggca

SEQ ID NO: 195287 - DNA, 601 bp, Human
ctcagagagcagagctcagaagagcagaccggacccctcctggggcctctaggagctccgacacggccaagctcttttggggctgtggggttccacaacacaaccatgtagttggtaccagcagcacgcaagtgaacttgctggttcactaaaacatatccctatccaatgcctcactgtaaacatactggatgctggctttctcatctgtgtcttgctctcttccccatctccttgaacaccgacaatgaagcataatctcccccgttctgggcccccaagtaagcattctccccagcayagcacctggcaaggaagactcacagaaaccactggctgaatggagtcaagtccactcctgggcctgaagtgacaccaccgaggacagcaaaaggatgactcaccctttcactaaaggcccccaactgccaggtagtggtagcttcccctcctttttgtgcacttcggcccatcccctgctgcactgatctgacggaactaaggaaggcccgagacagctctgccgctccgagaagttcagctttcttacagctacagacagcacccccaaaatgcccatttttacacagctctcgaaccc

SEQ ID NO: 195288 - DNA, 601 bp, Human
agccatcttctgctatgataaaagaatcaccagaataaatgcattgataattagggaaattagctttccatcaataacaattattagatgtaattagcaaccaataaaaatcacctagcactaagactaccaggtagcttatcctcccagatgggccaagaagcccttgctgtcttgtccttcattttgtggccagagcttgagacactcaatgagtctttgttgacagatgatcaacaatttagacctctcctcctcagcatccccaggactgagcccaggcccagaacagagtaggagycaggaaatatttgcttaatgaataaactgtcaaagacacattcccatgagccagtgactttactgaattgtaggactgttgccaataaaacatatcatcttacaaaatgtcagctactaggacattaaatgtaccgaatagaaatcagagcttttcatgggaacatcattttccatgtggctctgatttcattcattcaacaaatatttatggagtacctactatatgccaggatgggcccaacttttcacaaaacttttggactttatgggaacccacttcatatttctcatagagaat

SEQ ID NO: 195289 - DNA, 601 bp, Human
gaaagttcagaacagctgacctacccaggtctcctaaacagttatcggtaaagtctcaaacatgccaactcagtctgtgagctgaaaggcaccccctctctgcaacactcaccatagcccttggtgaagacatccctggcagatttgccaagatcggcatacgtgggtggcacagccatcttctgctatgataaaagaatcaccagaataaatgcattgataattagggaaattagctttccatcaataacaattattagatgtaattagcaaccaataaaaatcacctagcactaagacyaccaggtagcttatcctcccagatgggccaagaagcccttgctgtcttgtccttcattttgtggccagagcttgagacactcaatgagtctttgttgacagatgatcaacaatttagacctctcctcctcagcatccccaggactgagcccaggcccagaacagagtaggagtcaggaaatatttgcttaatgaataaactgtcaaagacacattcccatgagccagtgactttactgaattgtaggactgttgccaataaaacatatcatcttacaaaatgtcagctactaggacatta

SEQ ID NO: 195290 - DNA, 601 bp, Human
gaatctaaaatcttttttaaaaataaaaataagccaggcgcagtggctcatgcctataattccagcactttgggaggccaaggtgggcggatcacctgaagtcgggagttcaagaccagcctgaccaacatggaaaaaccccgtctctattaaaaatacaaaattagccgagcatggtggcgggtgcctgtaatcccagctactcggtaggctgaggtaggagaatcgcttgaacccaagaagtggaggttgtggtgagctgagatcacgccattgtactccagcctgggcgacaagagcraaactccatctcaaaaataaataaataaaataaaataaaaataaataaatactcatgttccatgtgggttggacaacttaccaatccattctcagattttgttttcaaatcaagctttattaagccaaatcctaaagaaagaagaagacaactgtcaataggttaaataactagagaacagcacctctgcctccctcatggttgcttcaggatgcttttttaaaaagaagcacactcctgccacaggggctgagggcacccagtctctgctgctgctcgtggggggagctctcagctgcc

SEQ ID NO: 195291 - DNA, 601 bp, Human
aatgaatgtgaaaaccacaaaaactgccagaataaaaaaaaaaaagtaccttcttttggctttgcgggccaggtcacgacagttatttgttgatctacaacaaattcccacgttccatacaatggtcactatttgggtaatgggtacactagaagcccaaacctcaccattacacaatacatccatgtaacaaacctgcacatgtacaccctgaatctaaaatcttttttaaaaataaaaataagccaggcgcagtggctcatgcctataattccagcactttgggaggccaaggtgggcrgatcacctgaagtcgggagttcaagaccagcctgaccaacatggaaaaaccccgtctctattaaaaatacaaaattagccgagcatggtggcgggtgcctgtaatcccagctactcggtaggctgaggtaggagaatcgcttgaacccaagaagtggaggttgtggtgagctgagatcacgccattgtactccagcctgggcgacaagagcaaaactccatctcaaaaataaataaataaaataaaataaaaataaataaatactcatgttccatgtgggttggacaacttaccaatcca

SEQ ID NO: 195292 - DNA, 601 bp, Human
agaagagtcacagcctgcaccatagcactcacttggcttcacttcactcctaaacactatacttgcctttctgcaagaggcaagaccctgaatgtgggggggccaaggctaactctacaattcaaatagatatttaaagtacagatgggagtaaaggagcctgctatgtaaagaaatcttatggggaatttgttgtcagcagacagcttccttcctccctgtaactcttcagtctggacaggaaagcatctcccttccatcctggctccagggcagtacagagaaaaagcactgagctaawgctgacacagcggtaattcaaacccaaaacttctttcttccaacaattactgcacacataatttcaaagggactactaagattactttaaaaacacttatgtggttgaatgcaggtgaatttgaaaataagaagcacaaggaaaactaaaactgagacctgacccattctcctctattacccgctgctgaactgggggcctactggcatggttcccctggaccacccatcatgcagaaaatggaatgaatgtgaaaaccacaaaaactgccagaataaaaaaaaaaaagtaccttctttt

SEQ ID NO: 195293 - DNA, 601 bp, Human
ctgcaacctccatggcagaaactaggagaacactaacaaaatgcagaatcttattacaaaacacggctaaacactggtctgaatcctctattagaaagtgagctccttggcgggtaacaatcatggcctgggcacccttagatctccagatgggcacagggccaagcacaggtggcacttagaaatcgtttgttgggtaaacaccagtcctgaattaggaagtgctcattatagcatagtctgttagtgcatagatgtggatacgacccctgggaccaaatcaaaaccagaggacttaaakcgccaggtctcggagaccatattttaggtgctgtcagcccccaaaacattttgtcacaaagggcttccaccacctgcaacatcagagaacatccttgtggagaaaacagatgaaactcttacccagtgttaggtgagaaggatgaatcgaaggtcagcttcagtccacgtgcaagctgaacagaaaagaaatttgccactagatttagtcacaaggcaggctggcagatgcgaattaataaatccacatcttttcacagcagccattacctgatcttccacagtaatctcggtgcctagt

SEQ ID NO: 195294 - DNA, 601 bp, Human
gtagctgggattacaggcatgcgcccaccaggcgcagctaatttttatgtttagtagagacagggtttctccacgttggtcaggctggtctcaaacttccgacctcaggtgatttgcctgcctcagcctcccaaagtgttgggattacaggcgtgagccaccacgcccggcccacaatttttaaaaactgaaattcagtacatgcccttgaccctaacatcactatataaaacatcttccccaggtttggaagacccaccaatatgagtggaaaaaaacaagggtgtattctaaaagggartaattccttctaggcactttgaaaagcacccaggaattgaggcagactaccatgctatcatgccaagtgatggtcaagaactaacaagcctattacatctgtggccagaaggcctggggaaagtgcagcctcaggagccaccttgcagttacacccacagggtctcagtgtccctaagcagcaggaagctgggagaaggacttccatgcctgaagaaatgaggctggcaacagtgaccagttaggccctgcttccaaatgtcacccactcccgtttggtcatagccacttacatcaccag

SEQ ID NO: 195295 - DNA, 601 bp, Human
tgcacagcactgcaaaaaggcagtgctcttgcaggagaaactacagcagcgaagaggaatgagagtaaatcagccccgtaacaatggtctcttcagatcatctatagccaagctataagacgacatctccagaggataggaaccctgtgtgcccagtcacttgtgtgcactgcacacccagcacaggtctgcacttggtagatcctccctctaataaatatctgttggaaaggaaaaaaggaagaaagaaaaaaaatgaatggcaaaactgaaaaattcatagtgccatttaactacacayttaaagatgttaagttttatatgtatatcttaccacaatttttttttttttttggagacagagtctctctctgtagcccaggctggagtgcagtggtgcgatctcagctcactgcaacctctgtctcctgggttcaagcgattctcatgcctcagcatcccaagtatctgggactacaggcacgcaccatcatgcctggctaatttttgtatttttattagagatggggttttgccatgttgcccaggctggtctcaaactcctgacctcaagcaatccacccacctcagcctcccaaag

SEQ ID NO: 195296 - DNA, 601 bp, Human
cgggaggctgaggcaggagaaacacatgaatctgcccagcactttgggaggccgaggcaggtggatcacgaggtcagaagttcaagaccagcctggccaatacggtgaaacccccgtctccactaaaaatacaaaaattagccaggcatggtggcccgtgtctgtagtcccagctacttgggaggctgaggcaaaaggatcacttgaacccgggaggaggaggttgcagtgagctgagatcacaccactgcactccagcctgggcgacagagcaagactccgtccccctcaacccaaaaagaaaaaaaaccaaaaaactttcctttgtgttttatactgcatggcctggagacctctgcaaagctccctaaggtcatgggaaggaaatcgcctacaaattccaaagtgtgctatcccagggcagcaggcaaagtcccaggcagcaaattcaagcatgtgggcacatcctccagcctctcatcctatcccaggatctttccagataaccgctccctgataccatggcagagttcctggggggagagtgcacagcactgcaaaaaggcagtgctcttgcaggagaaactacagcagcgaagag

SEQ ID NO: 195297 - DNA, 601 bp, Human
tggctcacacctgtaatcccaacaatttgggaggctgagacgggtggatcgcttgagctgagaagttctagaccagcctggccaacctggtgaaacctcatctctactaaaaatacaaaaattagctgggcttggtggcacacgcctgtggtcccagctacttgggaggctgaggaaggaggattgctggatcccaggaggcagaggttgcagtgagccaggatcacaccactgcactccagtcaccatttgccaagcgtaactgttgcaggcaagaatcaccaatggatgttactatttwtgagcaaaagtatgatgagaaatagaatatctgcataatctcaaagtgtctacccacaagatacttactaattacaaagagaaaaatagtagctttacaatgaagagagttggcagacaccacttcaaaactgatcaccaaaaatgaggcctactgatatattcttcctaacatcaggtgcagagaagaatataacacaacaactacagttgccaaaaatgcataacctaaatttaatcataaggaagcatcagacaaatccaaactgagggacatcttaacaaaataattggccactct

SEQ ID NO: 195298 - DNA, 601 bp, Human
tacaaagggaaaaggaaatataaaatcaggcatcttctaaccatctcctttttcaatttttaataaaaagctgctgatgatcacaaactatgatgcctatggcagggcctctgaccagtggtgtgcaccacctgcaccagttgacatggcacccccacccactgtctcactggattctggccagggcccacaatccccaagagaaagggcagtgctggggagtggctcaggcttctctccaggtctctttctaacactgcacaccatgtctgtggagtcttcctctttcagatattattgsgatttatttttaagctatttcaacagtagtgctaatttgacaagcacccgagagaggcctgactgatttgtggttaacaagcaagctttatttgtgatggatactcagcgtgggtgctggtccttattgaggtctgtggcctcatccagatgtggtctacactccgctcctcctgggagccaggtgttttcccaggctgtaccctcagtcactttggaaagccagctttcgtttctaatctccatgatgcaccaccagaactttcctcaaatacccagtagcattatgtacatctagcac

SEQ ID NO: 195299 - DNA, 601 bp, Human
tgtacattttggcaaggtttgaaggaaaggagtaacaaccaaattatctctcaataagaaaaatccaaaactggtcaggcgtagtggctcacacctgtaatcccagcactccaaggagggcagatcacttgaggtcaggagttggagaccagcctggccaacacggaaaaaccctgtctctactaaaaatacaaaaattagcaggacgtggtggcatgtgcctgtaatcccagctattcaggaggctgaggcacgagaattgcttgaacctgggaggtggaggttgcagtgagctgaaatyacatcactgcactccagcctgagcgacagagcaagatgtctcaagaaaaaagaaaaagaaacctatcttcatctgcctgctctttggggaaagaagtctgggtttcagccaagtatgtgattggcaccaggctggttgagatgactgatgattagacagctgttgagaggctgacatttacaaagggaaaaggaaatataaaatcaggcatcttctaaccatctcctttttcaatttttaataaaaagctgctgatgatcacaaactatgatgcctatggcagggcctctgaccagtggt

SEQ ID NO: 195300 - DNA, 601 bp, Human
tcagtctctttctttggctgctcagctccctcagcagttgggagtaggtgtgcacagacctgctcaccaacagaacaagtgacaatgaaacttatgccttggaacctcaattttgttcaagttacttctgtacattttggcaaggtttgaaggaaaggagtaacaaccaaattatctctcaataagaaaaatccaaaactggtcaggcgtagtggctcacacctgtaatcccagcactccaaggagggcagatcacttgaggtcaggagttggagaccagcctggccaacacggaaaaacmctgtctctactaaaaatacaaaaattagcaggacgtggtggcatgtgcctgtaatcccagctattcaggaggctgaggcacgagaattgcttgaacctgggaggtggaggttgcagtgagctgaaatcacatcactgcactccagcctgagcgacagagcaagatgtctcaagaaaaaagaaaaagaaacctatcttcatctgcctgctctttggggaaagaagtctgggtttcagccaagtatgtgattggcaccaggctggttgagatgactgatgattagacagctgttgagaggct

SEQ ID NO: 195301 - DNA, 601 bp, Human
tggatttgtcagtctctttctttggctgctcagctccctcagcagttgggagtaggtgtgcacagacctgctcaccaacagaacaagtgacaatgaaacttatgccttggaacctcaattttgttcaagttacttctgtacattttggcaaggtttgaaggaaaggagtaacaaccaaattatctctcaataagaaaaatccaaaactggtcaggcgtagtggctcacacctgtaatcccagcactccaaggagggcagatcacttgaggtcaggagttggagaccagcctggccaacacrgaaaaaccctgtctctactaaaaatacaaaaattagcaggacgtggtggcatgtgcctgtaatcccagctattcaggaggctgaggcacgagaattgcttgaacctgggaggtggaggttgcagtgagctgaaatcacatcactgcactccagcctgagcgacagagcaagatgtctcaagaaaaaagaaaaagaaacctatcttcatctgcctgctctttggggaaagaagtctgggtttcagccaagtatgtgattggcaccaggctggttgagatgactgatgattagacagctgtt

SEQ ID NO: 195302 - DNA, 601 bp, Human
ccttgcctggcaagaatagcctaatacagccatgacgaccaaggaatgcatcatagacaatcccataaaagaaacaatgccagccgggcacagtgcctcacacctgtaattccaacacttttagaggccaaggcaggtagatcacttgagcttaggagttcaagaccagcctggccaacatggcaaaattccatctctactaaaaatacaaaaattagctgggtgtggtggtgcacacctgtagtcccagacactcaggaggctgaggcagaagaatcgctggaacccgggaggcagaggytgcaatgagccaagatcacgcctctgcagtccagcccgggtgacagagtgagactgtctcaaaaaaataaataaataaaaatttaaaaagtaaagatgcttatctaacctccctttggtcacaagttttgcaagagttttctgcaagatggtctaagacatgcacatgtctttactctaaaagcttgctatataaagaatactttctggaggatgaatgcagggatccactgtctcttggctgcttgagacatcgcttctatttgtaagtctctattaaatgtttctttctgagaaactg

SEQ ID NO: 195303 - DNA, 601 bp, Human
tcaggagttcaaggccagcctggccaacatggcaaaaccccatctctactaaaaatgcaaaaattagctgggtgtggtggcacatgcctgtaatctcatctacttgggaggctgaggcaggagaatcacttgaacccaggaggtggaggttgcagtgagccaagaccgcgccactgcactccagcctgggtagcaagaataaaactcagtctcaaaaaaaaaaaaaaaaatcatgaaacaatcatgtaaatttgaacagactagagatttgacaatattaagaaatgatccactgggcgcrgtggctcatgcctgtaatctcagcactttgggaggctggggcaggcggatcacctgaggtcgggagttcgagcccagcctgaccaacacggagaaatcccgtctctactaaaaacacaaaattagccgggtgtggtggcccatgcctgtaatcccagctactcaggaggctgaggcaggacaatcacttgaacccgggaggcggaggctgcgtgagctgagatcgcaccattgcactccagcctgggcaacaagagtgaaactccatctttaaaaaaaaaaaaaaagaaaaagaaatgat

SEQ ID NO: 195304 - DNA, 601 bp, Human
cgacagagtaagactccgtctcaaaaaaaaaaaaaaaagaattataataacgctcaaatcacatagctgtcatctttagagactaaagaaccaacctgttattttaaaaacagcaaaaggccaggtgcggtggcttacgcctataatcccaacacttcgggaggccgaggtgggtggatcacctgaggtcaggagttcaaggccagcctggccaacatggcaaaaccccatctctactaaaaatgcaaaaattagctgggtgtggtggcacatgcctgtaatctcatctacttgggaggcygaggcaggagaatcacttgaacccaggaggtggaggttgcagtgagccaagaccgcgccactgcactccagcctgggtagcaagaataaaactcagtctcaaaaaaaaaaaaaaaaatcatgaaacaatcatgtaaatttgaacagactagagatttgacaatattaagaaatgatccactgggcgcagtggctcatgcctgtaatctcagcactttgggaggctggggcaggcggatcacctgaggtcgggagttcgagcccagcctgaccaacacggagaaatcccgtctctactaaa

SEQ ID NO: 195305 - DNA, 601 bp, Human
tccagcctgggcgacagagtaagactccgtctcaaaaaaaaaaaaaaaagaattataataacgctcaaatcacatagctgtcatctttagagactaaagaaccaacctgttattttaaaaacagcaaaaggccaggtgcggtggcttacgcctataatcccaacacttcgggaggccgaggtgggtggatcacctgaggtcaggagttcaaggccagcctggccaacatggcaaaaccccatctctactaaaaatgcaaaaattagctgggtgtggtggcacatgcctgtaatctcatctrcttgggaggctgaggcaggagaatcacttgaacccaggaggtggaggttgcagtgagccaagaccgcgccactgcactccagcctgggtagcaagaataaaactcagtctcaaaaaaaaaaaaaaaaatcatgaaacaatcatgtaaatttgaacagactagagatttgacaatattaagaaatgatccactgggcgcagtggctcatgcctgtaatctcagcactttgggaggctggggcaggcggatcacctgaggtcgggagttcgagcccagcctgaccaacacggagaaatcccg

SEQ ID NO: 195306 - DNA, 601 bp, Human
ctttgggaggctgaggcaggtggatcacaaggtcagaagttcgagaccagcctggccaacatggtgaaacaccgtctctactaaaaacacaaaaattagctgggcgcggtggtgggcgtgtgtaatcccagctactcaggaggctgaggcaggagaaacgcttgaacccgggaggcagaggttgcagtgagccgagatcgcgccactgcactccagcctgggcgacagagtaagactccgtctcaaaaaaaaaaaaaaaagaattataataacgctcaaatcacatagctgtcatctttaragactaaagaaccaacctgttattttaaaaacagcaaaaggccaggtgcggtggcttacgcctataatcccaacacttcgggaggccgaggtgggtggatcacctgaggtcaggagttcaaggccagcctggccaacatggcaaaaccccatctctactaaaaatgcaaaaattagctgggtgtggtggcacatgcctgtaatctcatctacttgggaggctgaggcaggagaatcacttgaacccaggaggtggaggttgcagtgagccaagaccgcgccactgcactccagcctgggt

SEQ ID NO: 195307 - DNA, 601 bp, Human
atattttctttgctttttttttttttttttttttttttgagacggagtcttgctctgttgctcaggctagagcgcagtggcgtgatctcggctcattgcaaactccacctcccaggttcaagcgattctcctgcttcagcctcccaagtagctgggattacaggcacccgccaccacgcccagctaatttttgtatttttagtagagatggggtttcaccttcttgaccaggctggtcttgaacttctgacctcgtgatccacccgcctcggcctcccaaagtgctgggattacaggcgtragccacgacgcccggccaaaatggatattttcttggtatacatttttacgaattttaacacacgtacacagattaatgtaaccatgacgacagtcagaatatagaacagttccctccccgaaactccctcagtcactgctttgtagtcataccctccccgccccctgccaaccactagattgtccatctctatagttttcctgtgactttttagctgtaacagattccaaattaatgataaaaattcctcaaaaaatttattaatggaaatattagtttacacattaatatcactgattt

SEQ ID NO: 195308 - DNA, 601 bp, Human
taaaatgctgaagctcagatatgtgggggaaatggctaacagccattgttcctcctagaattggtactgaagaattggtgccaatgcccaatttcaaaccaaggaaaacacttcccatgccaatcagaattctacgttcaaaaacatttctatgcatgtggtatgtttcctatagctttttagtatgtttcacctcttcttaattaaacatataataaaattgatattttctttgctttttttttttttttttttttttttgagacggagtcttgctctgttgctcaggctagagcgcagyggcgtgatctcggctcattgcaaactccacctcccaggttcaagcgattctcctgcttcagcctcccaagtagctgggattacaggcacccgccaccacgcccagctaatttttgtatttttagtagagatggggtttcaccttcttgaccaggctggtcttgaacttctgacctcgtgatccacccgcctcggcctcccaaagtgctgggattacaggcgtgagccacgacgcccggccaaaatggatattttcttggtatacatttttacgaattttaacacacgtacacagattaat

SEQ ID NO: 195309 - DNA, 601 bp, Human
aataaataaatacacaggtggaactgttcaaattcatctatatgaagcacaaagaatttctgttatgcatttgggcccctgcaagcaccagggcaacccagatgagttgtgtcagctgccttcacgctggttccaaaaataaaccatacccacttgttgcttatttaaaatgctgaagctcagatatgtgggggaaatggctaacagccattgttcctcctagaattggtactgaagaattggtgccaatgcccaatttcaaaccaaggaaaacacttcccatgccaatcagaattctacrttcaaaaacatttctatgcatgtggtatgtttcctatagctttttagtatgtttcacctcttcttaattaaacatataataaaattgatattttctttgctttttttttttttttttttttttttgagacggagtcttgctctgttgctcaggctagagcgcagtggcgtgatctcggctcattgcaaactccacctcccaggttcaagcgattctcctgcttcagcctcccaagtagctgggattacaggcacccgccaccacgcccagctaatttttgtatttttagtagagatgggg

SEQ ID NO: 195310 - DNA, 601 bp, Human
gagacccaggcactgcctgattcacagagaatcctgtcttctgtagacagcccaagtatgctacaataaaacagcagcctgtcaaaaataagatttttgaatgactttagtaatatattcaaatggggaagtttcttgggcttacatgtttttaaaaaaggccagacttttcagaatatcctaaaaccaggaacacaatactgccttcctgtacagagctttcaaaaccataaacagaaggcagatgcagtggctcacacctgtaatcccagcactttgggaggccaaggcgggcagatcrcttgagctcacaagttcaagaacaacctgggcaacatggcgaaatcctgcctccacaaaaaatacaaaaattagccaggtgtggtggcatgcacctgtagtcccagctacttgcaaggctgaggtgggagtatcacttaatcccgggaggtggaggctgcagagatcgtgccactgaactccagcctgggtgagagagtgagaccctgtcaccaaaaaataataataataaataaataaatacacaggtggaactgttcaaattcatctatatgaagcacaaagaatttctgttatgcat

SEQ ID NO: 195311 - DNA, 601 bp, Human
catcagatggtcttcaagcctgcctagaccctctcaaacatctttaacataaaatcagtgtctgagttctgcctcatcattgtgggcatttccagtggaaatggcattggttaactgtgagtcagagcccacgtactttggaatccagcaaagggcttcaggacctaagaacaaaaactctagtcttcacaagacactctccctaaatcagagaatacattctaaattttcttttttttttttccccaagatgggatcttgctctgtttcccaggctggagagcagtggcaaaatcatagstcactgtaacctcaaactcctgggctcaagtgatcacaggcatgttgccaccatgcccagctaatttttaaaaaatttcttagagacagagtatttctatgttccccaggctggtcccaaactcctggcctcaagtgatcctcccgcctcagcctcccaagtagctaggattacacgtatgagccacacattgtaaattttcgtttccccatgaaattcagcgagacagacattatgcttctagaaagtacagggagacccaggcactgcctgattcacagagaatcctgtcttctgtag

SEQ ID NO: 195312 - DNA, 601 bp, Human
cctgggcaacagagcaagacattgtctcaaacaaaaaaagaaaaagccaggggagagggggtacgtggtgactcacgcctgtaatcctagcattttgggaggccgaggcagcaggactgcttgagcccaggatatagcttgggcaacagagcgagatcctgtctctataaggaaaaaaaaaaaaaagaagcagcaagtagagcactgagattctgagtgatttatttttactgctactgatgttattacttttataaacgattctaccagaaaaatggcatggaagtccgggtgcagtggytcatgcctataatcccagcactttgggaggccaaggcgggcagatcatttgaggtcaggagtttgagaccagcctggctaacatgatgaaaccctgtctctactaaaaacataaaaattagctgggcatggtggcaggtgcctgtaatcccagcaacctgggggggtgaggcaggagaatcgtctgaacccaggaggcagaggttgcagtgagctgagatctcaccactgcactccagtctgggtgacagagtgagactctggctcaaaaaataaaagtaaaaataaaaaatgttatgga

SEQ ID NO: 195313 - DNA, 601 bp, Human
accgggctggtgccatacgcctgtaatcccagctactcaagaggctgaggcaggagaatcgcttgaacctgggaggcagaggttgcagtaagccgagatcgcgccactgcactccagcctgggcaacagagcaagacattgtctcaaacaaaaaaagaaaaagccaggggagagggggtacgtggtgactcacgcctgtaatcctagcattttgggaggccgaggcagcaggactgcttgagcccaggatatagcttgggcaacagagcgagatcctgtctctataaggaaaaaaaaaaamaagaagcagcaagtagagcactgagattctgagtgatttatttttactgctactgatgttattacttttataaacgattctaccagaaaaatggcatggaagtccgggtgcagtggctcatgcctataatcccagcactttgggaggccaaggcgggcagatcatttgaggtcaggagtttgagaccagcctggctaacatgatgaaaccctgtctctactaaaaacataaaaattagctgggcatggtggcaggtgcctgtaatcccagcaacctgggggggtgaggcaggagaatcgt

SEQ ID NO: 195314 - DNA, 601 bp, Human
gccgccaaactctgtcccgtcattcctgcaaacaagcacaggacagatgctgagcttcccagggaggtgagctgcagcccagacagatccacccaagtctcccagaagacagggatgacagaaatggactgaaccaatactggtattaagggaagtcagaagttcaccaaatttcacaaaacaggtactaaattacaggaagtctgataagtatggaacaggcacctagccaggcacagtggctcacacctgtaatcccagcactttgggaggccgagatgggcagatcacttgaggtcargggtttgagaccagcctggccaacatggtgaaaccctgtttctactaaaaatacaaaaattgaccgggctggtgccatacgcctgtaatcccagctactcaagaggctgaggcaggagaatcgcttgaacctgggaggcagaggttgcagtaagccgagatcgcgccactgcactccagcctgggcaacagagcaagacattgtctcaaacaaaaaaagaaaaagccaggggagagggggtacgtggtgactcacgcctgtaatcctagcattttgggaggccgaggcagcaggactgct

SEQ ID NO: 195315 - DNA, 601 bp, Human
gtgattccacagatacccaccgagaagcaggcgtcagggtcaatctgatacttggctgctattccgaagcgcgtgttactgtttcctgctgtccaggcaagattgacagcggtctccaacttcttgttcactttctggtaaatggagccgccaaactctgtcccgtcattcctgcaaacaagcacaggacagatgctgagcttcccagggaggtgagctgcagcccagacagatccacccaagtctcccagaagacagggatgacagaaatggactgaaccaatactggtattaagggaastcagaagttcaccaaatttcacaaaacaggtactaaattacaggaagtctgataagtatggaacaggcacctagccaggcacagtggctcacacctgtaatcccagcactttgggaggccgagatgggcagatcacttgaggtcaggggtttgagaccagcctggccaacatggtgaaaccctgtttctactaaaaatacaaaaattgaccgggctggtgccatacgcctgtaatcccagctactcaagaggctgaggcaggagaatcgcttgaacctgggaggcagaggttgcagtaag

SEQ ID NO: 195316 - DNA, 601 bp, Human
aaagggtgtgctgagatctgacacccctcataagaacaaagcagagagaaggaaggcctcttaggggccagtgtccttttgctcatataaataatgaggctccttttctcttgtttttaagtgcttgctgttaagggagccaaattcggttctagtttaggagacttaaaaagggctgtccataaattacacaaaccagtacagacaccattctgcaacatgagattccctcatttcaccccaaagagatacagccgccagtgccctgtgacaacagaaatgagcccaataggatttactrcaaaaactgtgtagtagttcgagggcctgtgagcaatgccagagactctgcaagatgccaactgactattgatttcttaatatgcaatgcaggagctgaaaaggagaatgaaaagtgaggcggggcggggggaattatcaattagaaccctagatttcagagtgccccttttaacagtccgcatgatagaacaggaactggtattaatggaagaggcttaacagtaagccagtctggttcaaatccagctcccagcactttcctgctgtgtacctttgagcaagttactcacctaagttt

SEQ ID NO: 195317 - DNA, 601 bp, Human
tgttcggtcggctgtgtcctgacgggcgtgagtgtaccgttgccaaagaaggaccctgaacaccatgtgtggaaagtgggttcttaggaaactggcttggtctcagacataccaggaagggttggcaaaggtgctacaaatcagtgatgttgagaagggaccagtttaattaattcgtgaattaaatatttttaagtcccagtgctttgaaaagatttcatgatctttacaaaccatgcccattggtacagatgacctaaagtgtgaagagcctattctgagtgttttggagcagtacagytgcgcttttaaagaaattcctattcgtgtttcacactcttctcagttggtccaagttggggtgaaggtacgtggaaggtttggaggactgtggtaagtgagtgttgggtgtgaatgtaagcccagtgcaggtggggctggcaggctggaggctcgcatggctacagtggggtcaccagagggaggagagttaagtgctaggctatttcagaccaggagtgaagagggtggttctgagagctgctgcatgccaagccagtgggaatgagaagacatataggcttctttccagaagcctagg

SEQ ID NO: 195318 - DNA, 601 bp, Human
tgccaaagaaggaccctgaacaccatgtgtggaaagtgggttcttaggaaactggcttggtctcagacataccaggaagggttggcaaaggtgctacaaatcagtgatgttgagaagggaccagtttaattaattcgtgaattaaatatttttaagtcccagtgctttgaaaagatttcatgatctttacaaaccatgcccattggtacagatgacctaaagtgtgaagagcctattctgagtgttttggagcagtacagttgcgcttttaaagaaattcctattcgtgtttcacactctyctcagttggtccaagttggggtgaaggtacgtggaaggtttggaggactgtggtaagtgagtgttgggtgtgaatgtaagcccagtgcaggtggggctggcaggctggaggctcgcatggctacagtggggtcaccagagggaggagagttaagtgctaggctatttcagaccaggagtgaagagggtggttctgagagctgctgcatgccaagccagtgggaatgagaagacatataggcttctttccagaagcctaggctggaaagcctattctatggctagctctagaaatgagctc

SEQ ID NO: 195319 - DNA, 601 bp, Human
aggctctaccccgggagtgcccagctgagccgaggagacagatagagacctgaagcagagctggcgagaggagcgctgtcactgaggtgtcccgggcagagccggccccagccctggctgtgaaggggggcccactgaggagcactctgaaggccacagggtgtccaacagatgaagacagaggagggactggcaggccccaggcttccctctgaacacatcccaaacctccccactactctgcagtcagcacccaaagccccagtcatcgccatctctcacccagacagcagcaacagcrtccaggggacccctccctcacccctaacccccatcctaaatcacagtccaggcttcacgtagcagccacagggggcctttaaaaacagagtcagatcacatctctcacctgatgagaccccgcatcagcttcccattgctcttgcagtgaagtcgaagccactcatcacagccgagtgcctgggtggcccccgccagccgcccctcatcacctgcaccagcctcttgctgtctccctgacagcagtcccctccctgtcctagggggtcttacagccagcaacttctttccaccccaggac

SEQ ID NO: 195320 - DNA, 601 bp, Human
tctccaaggctctctccctctgcccttgagcccctgcctttctgggccttgcctgggctctcagctctcactctcgggcttggagctggacaagccgtggcgagagcaccccagcctccggtggctgtcccacccctcctcacacatggggccagggagcaccagccagacccggtgggaaggatgacctcttgcttttcttttggtcatttatgactgagaatcaaaatcacctccttcaaggacagagtgccctcacctagggccagggggaggttcagagccacactgctagccaatytgtttcaagaaaaattcttggtaggctgctgccagcagaagtgctgcctgttgaggcctgtcactgaatggtaaagatctgtggccaagaaccccaaagggccagattctaatccagatccatcactgcttgctgtgagacctcgggcaagattcttagcttctctgtgcttcactttcctcgtctgcgaagtctgtatgcacagcacaaagtggttgggaagactggtgggattccggcaggggtggagctctgcagactgagacactcagttggctgttactagtgggggctgccatc

SEQ ID NO: 195321 - DNA, 601 bp, Human
gggcatgagcaggggcgcctccagcctggctggcgcactcagccctactggagtatatctgcagagatggggtctgcgaaagcccacaaatcgaggcctggtccatattgcaggcaagccctgtcccgccccccaggaagtcgattgttgtagtctgagggcttgaggggcatcctgctcagcaactgggcagactcctcggcacaaagcgccattgatgctggacagtggggccctagctctagacacagacgcctagggagctgtggggctgactggtgggccctagcagtgcaaagarggaaagtgagaaccggaggggctgtgccaggggagctgggccaagggctgagaccagcctgcactgtgcttcccaagccactgccctggcatggcatggcccaggtgtctgtccagaagaaggggtgctttttctaattagcacaaatgccccatgtgaattaatggcagccctgatgttgactggtcattctgactcccaaagtattgcaggcaggagaggacgggggtaggaggaggccaaagggtcttaggtaccaggtaggatgtcctgagtccaagtagtggccccagctcctcc

SEQ ID NO: 195322 - DNA, 601 bp, Human
cagtggggccctagctctagacacagacgcctagggagctgtggggctgactggtgggccctagcagtgcaaagaaggaaagtgagaaccggaggggctgtgccaggggagctgggccaagggctgagaccagcctgcactgtgcttcccaagccactgccctggcatggcatggcccaggtgtctgtccagaagaaggggtgctttttctaattagcacaaatgccccatgtgaattaatggcagccctgatgttgactggtcattctgactcccaaagtattgcaggcaggagaggacrggggtaggaggaggccaaagggtcttaggtaccaggtaggatgtcctgagtccaagtagtggccccagctcctcccaccttcctaacctgtatgctgcagtgaccctgtgcccagccccagccagggtgccttatttagtgcagtcacattttccctaaacactggcttacacacgcctcccaccccacctgcactggactcaacttcaagggcccagctctaatacattcaatataaataactcagggcaaaatcccagaccacaggaagggcaggacagataacagtcaactatagca

SEQ ID NO: 195323 - DNA, 601 bp, Human
ggacactgtgacttgagtggtacccccttcgctgaggcctgtggttttggccaccacttttctttgacagctgggcttcctgtataccctcatcccagtgtcttcctccctcaggactcgccacactcacccaccctccttctcatttttcagcacaaggccaatcagcccccccacggtgtcccccaactctctctctacgaacatttcaacagcccacatcccacccctgcacctgcggacatcagccagaagcaaggtacaagcctgggatggggaggggcccagtgaaaccagagcytaagggccaagaccccagcttctgagaccaggtagctgggtccattttataactggagaacctggggctgtgcaaactaagggcccaaagaaaataccagaaagatggactgggggtataagggcatcagaaaactggaaaaggtggtgctaggtcaaaatgtgaaggcttcaggttgaagcctaaatcccatgggtgaccccgctgccagtatggcagcattgctgagaactgtaaaactgtagcctttcctcctctcagtgagaaaatggaaagtggtggttgtgatggctgattcac

SEQ ID NO: 195324 - DNA, 601 bp, Human
agaagcccacaccctgctgcaggcctccttcctaagggtgaattcctgcctctctggtaactgagactccacatccctgaccacctcagccgtgctgtccccacacagggaagctggaggctaggactgggacagagcagggcagagttcctagccctttttccaaggcaaagaataggcccttccttccatctgcaagtgtgtagaacagcataaggtatagccttcagccttatcccttgaaggaatgtaggtcaagaatgaagaaaaactggataaaatgggtagggagttggggagsaggtgggtggccctagggcataaaaggctggatctccatggtcttccttgggcccctctgcagcctccatgctgcaagggccccacaagccacagagatgagccagattgacaggactccctccctcccattcttcccactgcctctactgcgtacctgggtgcccacctttcctgatatcttggctctgggctcttgggctcccactggggctggctgtgccatggagaggcccactctgcctatgggggctgtagggtgtctataactggctaacactgatgttacctcttctttctg

SEQ ID NO: 195325 - DNA, 601 bp, Human
taagctgcttccctgactctgcacatgttccactgggcctgcagcccactcctttggcccctcagcccactagcatactcagcagattgggagcccaggcctcctgagaatagtagtaaatactgaacacagcgcgtggagaagaccacttgggtctaagtgcaggaggattggagagaaagacacagaatgttccagaaaggaaggacagactcaagaaggcagctctgatgccagtgggcctagcaggtcctcagcaaacagacagctcagccaccactaagggggcctggagcccatgctaccaggcctcaaagtcattatggcccatgggctccctcacttcctcttcaagatgggatccctgcctgtaccatcctgagcccttaatctgaaaaagcaaggtgacaacaacacagaaccatctggttgccaggtagccttatgacttgctatcttgtacctactgataccaaagggctggagaggctgggggagaggacccagggggtaccctgggctgtctgagggaaagggctcatgtgtttcaccatacaacagagaaatacttgtgggtgtgacaaggtttacccaacaagtg

SEQ ID NO: 195326 - DNA, 601 bp, Human; identical to SEQ ID NO: 32273

SEQ ID NO: 195327 - DNA, 601 bp, Human; identical to SEQ ID NO: 32274

SEQ ID NO: 195328 - DNA, 601 bp, Human; identical to SEQ ID NO: 32275

SEQ ID NO: 195329 - DNA, 601 bp, Human
ctaaaattctaattatgtaaggctaaagaaataccgcacgtgaacaaatatttaagtactcacccattctatgcagcattgtaataaaaagtaaaacctgaaataacctttattgcgtccactaataggacaatgtttaaacaaatgacacgtccatcatacagaatactgtgtggtcactggaaggcacatggacctgtatacactgacatgaaaagatgtggaaagaatgctgggagcgttaaaattttctgaagtacaacgtagcacaatgcatacatggtttaggctttttagaataaaaaatacttatacgcagacatttatatttacacgtataacactgtgtacagccccgaagcaatgccgaaactttcactgttgttacctccgagtggggactgggaaagcagaggttagggtcgttctctctgttttacaaacatttattggcgcatccatcaattccaggccccgaggacacagctgcgtcaacgacatcgagtccacctgctctggggacccggatgactgctataggttttgttcactgtggcgtccccagaacctgcacggcgccgggcactgagcgggcgctcac

SEQ ID NO: 195330 - DNA, 601 bp, Human
cccagcattttgggaggccaaggctagtggatcatgaggtcaggagttcgagaccaccctggccagcatagtgaaaccccatctctattaaaaatacaaaacctagctgggtgtggtggcatgcgcctgtagtcccagctacgtgggaggcgaagtcaggagaatcactcgaacccaggaggcggagggtgtggtgagctgaggttgcaccactgcactccagcctgggcaacagagcaagactccggctcaaaaaaaatcaaataagatattctgagggcaagtgacagggctggcagtrtcaggggtcagtgaggtctgaaagggtaagagggctgagctcatgggtgactgaggcagcgtagcatgggcgagaggattccacagacataagacacgcacacctgaagccaggcacatgctacaacctggaaatactttcccaagaaaagaaaaaaatttcaagaggtctggattttctacataggtggatctgcctaaactattctttctcccctgttgcacaagacatgtattttcttagctaaattctctcatcgttcaatcaatccaaacaatttaccttcccattcatccacac

SEQ ID NO: 195331 - DNA, 601 bp, Human
aactgctagcctcattcaccatcactcctgcacactcccgcaagtctttcatcaaaccaattattcagagctatctccttacccttgcacctgcagctttccagacatggaacgttcctccctcccctccagtgaaaacagccttggacactcggcccaaatcgctcctcatctgtgaaacttaccctggggcaagcagctcttgtttctctaatgtgctgtccaggccaccaagatggccctggtacactgctcagcagccacctatgactccagacagcagggtcacattttctttgamgactcgggggcattggaaatgtatttgctgaataaactgttatgggcaaaaatgacaaatataaagtccacaagcggatatcctagcccacccctcacagaaatattctgagggtaggccaggcgcagtggctcacgcctgtaatcccagcattttgggaggccaaggctagtggatcatgaggtcaggagttcgagaccaccctggccagcatagtgaaaccccatctctattaaaaatacaaaacctagctgggtgtggtggcatgcgcctgtagtcccagctacgtgggaggcgaag

SEQ ID NO: 195332 - DNA, 601 bp, Human
accttcctggtgctggcaggggacctactctcacaactctgatttccaagacaggaagttccagcaaaggctccagcttacagagaacaaaaaggcccaagatcttaacgcctgcaccaaccagtcctatcgtggttgcctcagtcatgttctggcaatttcacgaaaacaagagcatctggcatgaccaggagactggactcggcacccttggtgattgtggcagtcacctcgtcatgcaaaatgaccaacccgtcaccgtacctgcctgaccacagaatcacgtttgctttgggagacygcgtctgctgttgatctttccaggtcttccctctcctttaggaggcggcctcatccttctactggcacatctgacacttctgacagttggagctctgacgaaaagctctcatggtgggccacgtggctgggctccccacacaccaggcccagggctggctctgtgactgtcctgaggaatgcaggatgaggctcctacgcacaagcttatatctgacagaaaagacacaactgctagcctcattcaccatcactcctgcacactcccgcaagtctttcatcaaaccaattattcagagct

SEQ ID NO: 195333 - DNA, 601 bp, Human
aacactcactgtttcttgaggtttcctgtgttccagaacctggtctaatcgttctctactatgatatactgatacttcattcatcaggaaacataactccttgaacataaagaaaaagaacaaaaagcgaaagggcacctcggaatagtcaaaatatgggcctgaagccctcaccctgagctttgctcatggaagactactggccccatatgaaatccatctcattctaacaatttgatgctaacaagtttcccagccacatctgcaaactaggaaaggagagaacagggctccagacagrcctgcaagttaaggccacagtaagagaggccaaaaatataaacactcacaatgcagttttgatgtggggacacttcatagacgaaggattcttcacatttcaatggccctacgggagcctacatattaaaacagaagaccaaacattaacacccgtaataatgaccctgaaaacatccaagagaggttcagtcatgggccatcaaatgatggagtgttctagaaagacttctcatcataatggttaaaatgaaatgttttaaagtcagcctcgtggaaaattcgcttgaacattccattg

SEQ ID NO: 195334 - DNA, 601 bp, Human
agaagggcgcaccaccactcctggcctatttgcactcttttttttttttttttttttttgagataggttcttgctctttgaccaggctgaagtgcagtggcacaatcacagctcaatgtagcctcaaactcctgggctcgagcaattctcccacctcagcctcccaaatggctgggaccacaggcatgtgccaccacacccagcaatttttaaaaattttttttcgagatggagtctcactatgttgtccaggctggcattcaactcttggcctcaagcaatcctcctgccttggcctccygaagtgctgcaattacaggcatgaccaaccgcacccagcctcgtttccaccttctgatggaccttcagattgttttcattttcgggttattatgaataatgctgctatgaacattcatgtgtaggctgttctgtggacatgttttcatgtctacaaggtatgtgcctcagggtagaactgtggggtcatatggtaattcggtttgactgtgtgaggagctgcaagaatgttttcctgcagaggtcgcaccgttttacattctcaccagcagtgtgggagggttctgatttttccacatcc

SEQ ID NO: 195335 - DNA, 601 bp, Human
ttggccaggctagtctcaaactcctgacctcaagtaatccacccacgttagcctcccgaagtgctgagattgtagacatgagccactgcaccaggcccagcttccaactttttactgtaacttttgttttggggtggggtgggggtctcactatgttgcctggagtgcagtggctgtttacaggcactgtcatggtgcatggtagcctccaactggcaggcttaagcgatcctcccacctcagcctcccaagcaggtgggattagaagggcgcaccaccactcctggcctatttgcactcttttttttttttttttttttttgagataggttcttgctctttgaccaggctgaagtgcagtggcacaatcacagctcaatgtagcctcaaactcctgggctcgagcaattctcccacctcagcctcccaaatggctgggaccacaggcatgtgccaccacacccagcaatttttaaaaattttttttcgagatggagtctcactatgttgtccaggctggcattcaactcttggcctcaagcaatcctcctgccttggcctcctgaagtgctgcaattacaggcatgaccaaccgcaccca

SEQ ID NO: 195336 - DNA, 601 bp, Human
aacacttaaaaacttacgagaaacataaacacatttacaaaatttcaaacacatttttaaactattctcattctaaaattcatgtggaaaagttagtgtacataaatagccaaagaaattttgaaaaaactgaggaaattcatcaaatattaaagaacattaatataaagctacaatattaaaataaatttccagaccaggcatggctgctcacacctgtaatcccagcactttgggagggagatccaggcaggaggaggctccctcgagctcaggagctcgaggccagcctaggtaacayagggagacccccccaactctcaaaaagtaaacacacacaaaaaaaggttaaattaatttccagcagggcacaggggctcatgtttgtaaccccagtgctttggaaggccaagttgggaggaacacttgaggccaggagttctagaccagcctgggcaacatagcaagaccaacctcttatttttttttttttaatttccgctgtcacttattaagtcaaaatgaattccagatggaccatagaagtaaaaataaaagctaaaagtactgaaagaaaacatgaaagatttagtaactttat

SEQ ID NO: 195337 - DNA, 601 bp, Human
ttatgaagacagcaggtgctctgaacagcagcaagacttctcaagctttacctgttcacatggttttggttaatcaaaccatatttatttattcaaaacagatattaaattattaaaaatatgaggctgcccggcacggtggctcacacctgttatcccagcactttgggaggccaaggcaggtggatcacaaagtcaggagttcgagaccagcgtggccaacatggtgaaccctgtctctactaaaaatacaaaaattagctgggtgtggtggcgtgcacctgtaatcccagcctgggcracacagtgagactccatctcgggcgggggaaaatatgaggctgtcacaaaagtgctaatgttttccctgctgtcgatgttgaggtcacttgaaagctggtatggacacatcggatgaggaattcagtctaggggcctcttaggagccaaggcccaatgactagactaagtggacccagcaaacacagagggagggggcctgaggcacaaacacagacaaggtcctatgctcgaggcaaacaaggacgaggtacaaggtgagagccagaaggggccactgtgctgcttcacagacctggga

SEQ ID NO: 195338 - DNA, 601 bp, Human
tctaattataaggcaaggattgtcagaattggtaaaggaagacctaattacatgctatctacaagacactttaaacataaagaaaaagatacacttaagacaaatgaatggaaaaatacataccatccaaaaagtgtgtttaagaaagctggagtggctctattaatatcaagtaaaatacatttcaaaataaaaaatattattaggaaaaaagaaggatatttcagaatactacaacaaacaattcatcaggaaaatgtaatcacaagtgtgtatttgcctaataacagagcttcaacatatatgaagttaaaacggaaagaattaaagacaaaacaattccacaatcacagctggagatcttaacactcctctctcaataactgacagaatcaaaccaaaaaataaaacagaagccgggcacagtagctcacgcctgtaatcccagcactttgggaggctgaaacaggagaatcgcttgaacccgaggcagaggttgcagtgagctgagatcgcgcccctgcactccagtctgggtgacagagtaagaccctgtcccaaaaaaaaaaaaaaaaaatagccagacagtccagaagaaaaa

SEQ ID NO: 195339 - DNA, 601 bp, Human
gaggcagaggttgcggtgagccgagattgtgccattgcactccagcagcctgggtgacaagagtgaaactccgtctcaaaaaaaaaaaaaaaaaaaaagatttattcatgtatttactatttctttctttcttagaaaagagattgctctgtcacccaggctggagtgcagtggtacagtcatggctcactgcagtcttgaactcctgggctcaagggaccttcctgctttactctcctgaacagctgggactgcaggtaagcaccatcacacaggactaaattctttttttttttttttycctagagatagggtgtttccatgttgaccaggctggtcttaagctcctggtctcaagcaatcttcctaccttagcctcccaaagctgctgggattacaggtctgagccaccacgcccagcctgtgctgctcatttgaaactgctgctatatgccagcatatgacatttcccactgttaattttttggttaatgtataatttatctcaccaaattagggcaggaaaaagcttgtatttctcagtaacactctttgaagacaggaacatccatatttcttggtatgccaaagtatctatcac

SEQ ID NO: 195340 - DNA, 601 bp, Human
gcagctgcagtctcagtagctgggactccttcccatccgagttgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatcccagcactttgggaggccgaggcgggtggatcacctgaggtcaggagttcaagaccagcgtgaccaacagggtgaaaccccatctctactaaaaatacaaaattagcactgggtgcctgtaatccccgctactcgggaggctgaggcaggagaatcacttgaacccacgaggcagaggttgcggtgagccgagattgtgccattgcactccagcagcctgggtgacaagagtgaaactccgtctcaaaaaaaaaaaaaaaaaaaaagatttattcatgtatttactatttctttctttcttagaaaagagattgctctgtcacccaggctggagtgcagtggtacagtcatggctcactgcagtcttgaactcctgggctcaagggaccttcctgcttt

SEQ ID NO: 195341 - DNA, 601 bp, Human
gtttgaatgtgacaccacacacccctccccttccaccccccacatccctacccactactgccagtgcccatgcagctcctccactctgcagctgcagtctcagtagctgggactccttcccatccgagttgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatcccagcactttgsgaggccgaggcgggtggatcacctgaggtcaggagttcaagaccagcgtgaccaacagggtgaaaccccatctctactaaaaatacaaaattagcactgggtgcctgtaatccccgctactcgggaggctgaggcaggagaatcacttgaacccacgaggcagaggttgcggtgagccgagattgtgccattgcactccagcagcctgggtgacaagagtgaaactccgtctcaaaaaaaaaaaaaaaaaaaaagatttattcatgtatttactatttctttctttcttagaaaagagat

SEQ ID NO: 195342 - DNA, 601 bp, Human
gaagcactgatagtttgaatgtgacaccacacacccctccccttccaccccccacatccctacccactactgccagtgcccatgcagctcctccactctgcagctgcagtctcagtagctgggactccttcccatccgagttgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatyccagcactttgggaggccgaggcgggtggatcacctgaggtcaggagttcaagaccagcgtgaccaacagggtgaaaccccatctctactaaaaatacaaaattagcactgggtgcctgtaatccccgctactcgggaggctgaggcaggagaatcacttgaacccacgaggcagaggttgcggtgagccgagattgtgccattgcactccagcagcctgggtgacaagagtgaaactccgtctcaaaaaaaaaaaaaaaaaaaaagatttattcatgtatttactatttctttctttct

SEQ ID NO: 195343 - DNA, 601 bp, Human
agaggaataaatctgcctgaaccagataccaaacacgctagctgtacaatttccgtctttgtgtttctcctacaccctaaaggaaaaaccacaaacctcaatgtcaggctacaagatcttactgttaaactatctggtggtttggggtcgcacaaaatgggaagcactgatagtttgaatgtgacaccacacacccctccccttccaccccccacatccctacccactactgccagtgcccatgcagctcctccactctgcagctgcagtctcagtagctgggactccttcccatccgagytgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatcccagcactttgggaggccgaggcgggtggatcacctgaggtcaggagttcaagaccagcgtgaccaacagggtgaaaccccatctctactaaaaatacaaaattagcactgggtgcctgtaatccccgctactcgggagg

SEQ ID NO: 195344 - DNA, 601 bp, Human
tgggaggccaaggccggggggtcgcttcagctcaggagtttgaaattagcctgggtaacatggcaaaaccccatctctacaaaaaaacagccaggtgtggtggtgcatgcctgtagtctcagctacttgggaggatcacttgagcctgcaaggcagaggttgcagtgagccaagatcacgccactgcatttcagggtgggagatgcagccaggccctgtctcaaaaaaaaaattaaaaattaaaaaaaaaataaaccattagaggaataaatctgcctgaaccagataccaaacacgctarctgtacaatttccgtctttgtgtttctcctacaccctaaaggaaaaaccacaaacctcaatgtcaggctacaagatcttactgttaaactatctggtggtttggggtcgcacaaaatgggaagcactgatagtttgaatgtgacaccacacacccctccccttccaccccccacatccctacccactactgccagtgcccatgcagctcctccactctgcagctgcagtctcagtagctgggactccttcccatccgagttgctgcagggcctggctgcaggccctctctcccattcagg

SEQ ID NO: 195345 - DNA, 601 bp, Human
ttcctgccaagtcagtgttgagatgaaactcttggatctttgcctattggtcagataaaattttcactgtagttttcacttacatttctcttattataagcaaaactgagcactgtcccgtatttttaaatatttcctatttccttttttgttaagggactgttggtatcctctgataatttttctactacattttaaatcttcttcttattgatttgtaagagctttttatatattaaggaaattagtcgccaggagcggtggctcacacctgtaatcccagcactttgggaggccgagrcgggaggatcacgaggtcaggagattgagaccatcctggctaacacggtgaaaccccgtctctactaaaaatacaaaaaattagccaggcgtagtggtgggcgcctgtagtcccagctacttgggaggctgaggcaggagaatggcatgaacccgggagacggagtttgcagcgagctgagatggcgccactgcactccaccctgggcaacagagcaagactctgtctcaaaaaaaaaaaaaaaaggaaattagtcttttggttgtaaaagccttcctcactctaagattaaacatgatt

SEQ ID NO: 195346 - DNA, 601 bp, Human
tttctgtagagacagggattcaccatgttgcccaggctggtctcaaactcctgagctcaagtgatcccccggcctctgcctcccaagcgctgggattagagccgtaagacaccacgcccagcctaaggttatgtattttaagcagtggtagatactgccaagtcacactccacagagatcctatcagtttacgttcccacagcaatgtactaaagtgcatatcatcctacattcctgccaagtcagtgttgagatgaaactcttggatctttgcctattggtcagataaaattttcactgyagttttcacttacatttctcttattataagcaaaactgagcactgtcccgtatttttaaatatttcctatttccttttttgttaagggactgttggtatcctctgataatttttctactacattttaaatcttcttcttattgatttgtaagagctttttatatattaaggaaattagtcgccaggagcggtggctcacacctgtaatcccagcactttgggaggccgaggcgggaggatcacgaggtcaggagattgagaccatcctggctaacacggtgaaaccccgtctctactaaa

SEQ ID NO: 195347 - DNA, 601 bp, Human
acgacaataatggattgtaagctgtgacccggcaaatcaagcaaacatcggtgcacacttaaacagaggaggagcagcagctcttcatcacagcagaattccaatgaataaacacaaggaatggcagaaaacagaaagcacaccatcaggaaacaccacagcaataactggctggtgtaagttactactattttgagacagggtctcactctgttgcccaggctggatcacaatggcacaatcacagctcactgcagcctcgaccttcccgggctcaggtgatcctcccacctcagcctcytgagtagctgggactataggccgtgtattaccactcctagctaattttttttttctttttttttttgactgggtctcactctgtcgcccaggctgaagtgcagtagagtgatcttggctcacagcagcctcaaccctccggattcaagtgatcctcccacctcaaccttccgagtagctgagactacaggctcatgccaccatacccggctaatttttgtgttttctgtagagacagggattcaccatgttgcccaggctggtctcaaactcctgagctcaagtgatcccccggcctctg

SEQ ID NO: 195348 - DNA, 601 bp, Human
ctcttgtcacatggcaagctcttctctatgtgagtcctggctgtgtccagatttccctcttcttatacggataccaggaatactggagttaggccccacccccatgcagtgtgacctcatcacaacctgatacatctgaaatgacccaaataagctcacactcacaagtaccagggatgaggacgcgaacgtatctttctcttttttttttgagacagagtctcgctctgtcatccaggctggagtgcaggggcatgatctcagctcactgcaacctctgcctcctgggttcaggcgattstcctgcctcagcctccctagtagctgggattacaggcacgcaccaccatgcctggcttttatttttaaaagagacatggtttcaccatgttggccaggctggtctccaactcctgacctcaagtgatctgcccaccttggcctcccaaagtgctgggattacagacgtgagccaccatacctggcctctttttaaaaaagaataaaaatagagacaaggtttctctttgttgcccagcctggtcttgaactcctggactcaagtaaccctcccactttggcctcttaaagcactaggatg

SEQ ID NO: 195349 - DNA, 601 bp, Human
ataccaggaccctgccttggtcagtagatttgcaatacgtgatggtgtcaaggatatgtggccagccagccacgccgtgtcaaagtctaagcctaaatgaaccgcatctaactgggagcctctcctgttcttcacaaatttgtaacaagtagaaaggaaagacaacagaatatccaggaatcaaggttttaaaaatcagcatatcagccaggggtgcggtggctcacgcccgtaaacccagcactttgggaggctgaggtaggcggatcacatgaggtcaggagttcgagaccagcctggycaacatggagaaaccccatctgtactaaaaatacaaaagttagccgggcatggtggcaggcacctgtaatcccagctactcgggagactgaggcaggggaatggcttgaacttgggaagtggaggttgcagtgagccgagatcgtgccgctgcactacaggctgggtgacagagcaacattctgtctcaaaaaaaaaaaaaaattaacatatcaactttcatactcctaaaaggtacaaaaacttgccttttttttttttttttttttgagatgaagtctcactcttgttgcccaggctg

SEQ ID NO: 195350 - DNA, 601 bp, Human
tctgcgtgctgaacagtcgtcctgcctgcaagctccaggctgggtttcgcctggggcccaactgggctgtggtcctccgaggacacagaattggttttcctgaaaagacaaatatgcagaaagaatgagaattaggaagacacgagaaacaatatggtaattcgtcccatcaagggtgtctagcagaagctagcgtggacatctctaagtcgggctgttgctgaaagagaaatccacaggaccaaatgccacagtgtcagggtgtggttttggcaaggagccctcacagatgtcatcagtrtaagatactgtgtcttctcagaaccgcagaagcgaaactggagggggtgggctgctgccttcttttcagagggggtctcgctctgtcactgcgatcacagctcactgcagccccaacctcctggactcaggcaatgctcctgcctccgcctcacgagtagctgggaccacaggcacagaccaccatgcccccataattttttaaaaaattttttgtagaaatggggttttgctatgttgccaagactggtctcgaactcctgggctgaaaccatcttcccgccttggccttacaaagagc

SEQ ID NO: 195351 - DNA, 601 bp, Human
caccccaacctggagacggaagaagatcctgactctaaacaaacataaaaaccttccaggtcaggctgggtgcggtagctcatgcctataatcccagcactttgggaggccgaggcaggcagatcacacgaggccgggagtttaagatcagcctgaccgacatggagaaactctgtctctattaaaaatacaaaattagccaggcatggtggcacatacctgtaatcccagctactcgagagactgaaggcaagagaattgcttgaacccgggaggcggaggttgcagtgagctgaaatcrcaccactgcactccagcgtgggcaacaagagcaaaaccccatttcaaaaaaaaaaatcttcccggtcatcaaaaacaaggaaagtctgagaaactgtcacagccaagaggagctaaggggccaggacaactaaatgtcatgtgggatgctgggagagaaaaaggacatgaggtaaaaactaaggaaacctgaatagacttgtgttaagaataatatatccataccggttgattaactgtaaccaatgtaatatactaacatttctttttttttttttttgagacgagtttcactcttgtt

SEQ ID NO: 195352 - DNA, 601 bp, Human
cccttgctcttggacctcccagcctctagaactgtaagcaatagggttctgttgtttataaattgcccagtctaaggtattcggctatagcagcctgaatcacaatacagaccaacgcgctggtgaacacacaaggccttactgaccatgggctcctccttcctcaaagcccagtcagactcccatctgcagatcctcgctcaacatgcccataatgtagccacagccccagcttgctctgctatgatgtgcagaccaccttaaataaaagagctcactccaagcctccacatctatgaaytgggacaaaggccctcagaaacagttttctgaacttccttctaggaagttcctttctaaagacttcctctccaggacagcctgcaggagccatgggagcccactagcaccaggcgccagtgctgtctccattggcaaagcaagggtggtcagtgccactcagcaaataatccacagcaagcagcaggccagggagactggccagctgtcagccttcccattgtaggcagcacaggcagaatgggtgccaaaaccacatcaccaccagttactgcagtgcacacatgtgtgcatgtttcac

SEQ ID NO: 195353 - DNA, 601 bp, Human
cagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctggtggctctctcaatccagcagaatgatctgactgaggacaccaggaagcaggtgttgggaacgcagctctgcacgcggcacctactcccaccctaccaccatgggaacagcgggcacagacgcctctcctgcgggaaggcagagcccttgcgwtggagcctctatctggcctatcctgttgcagctgctctgctctgagtgccagtgtcacccaaatccatatattaagacctaagtcccaaggggatggcactgggaggggggccttggggaggtgatcaagtcacgacggctccactctcatgaatgggagtagggcccttagaaaacaggcttgagggagcttgcctgccccttccaccttctgtatgaagatgcaagaggcactgcctgagtcaaagggccctcgccagatgcccaatctgctggccccttgctcttggacctcccagc

SEQ ID NO: 195354 - DNA, 601 bp, Human
agcagcttggcctcaccagagaaaacaggaagggacagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctggtggctctctcaatccagcagaatgatctgactgaggacaccaggaagcaggtgttgggaacgcagctctgcacgcggcacctactcccaccctaccaccatgggaacagcgggcacrgacgcctctcctgcgggaaggcagagcccttgcgttggagcctctatctggcctatcctgttgcagctgctctgctctgagtgccagtgtcacccaaatccatatattaagacctaagtcccaaggggatggcactgggaggggggccttggggaggtgatcaagtcacgacggctccactctcatgaatgggagtagggcccttagaaaacaggcttgagggagcttgcctgccccttccaccttctgtatgaagatgcaagaggcactgcctgagtcaaagggccctcgccagatgcc

SEQ ID NO: 195355 - DNA, 601 bp, Human
gcactccagcctgggtgacagagtgagactccatctcaaaaaaaaaaaaagaaaaaacgaaaagactaattctagtcatagcagcttggcctcaccagagaaaacaggaagggacagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctggtggctctctcaatccagcagaatgatctgactgaggasaccaggaagcaggtgttgggaacgcagctctgcacgcggcacctactcccaccctaccaccatgggaacagcgggcacagacgcctctcctgcgggaaggcagagcccttgcgttggagcctctatctggcctatcctgttgcagctgctctgctctgagtgccagtgtcacccaaatccatatattaagacctaagtcccaaggggatggcactgggaggggggccttggggaggtgatcaagtcacgacggctccactctcatgaatgggagtagggcccttagaaaacaggcttgag

SEQ ID NO: 195356 - DNA, 601 bp, Human
aggaggcagagactgcagtgaactgagattgcgccactgcactccagcctgggtgacagagtgagactccatctcaaaaaaaaaaaaagaaaaaacgaaaagactaattctagtcatagcagcttggcctcaccagagaaaacaggaagggacagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctgrtggctctctcaatccagcagaatgatctgactgaggacaccaggaagcaggtgttgggaacgcagctctgcacgcggcacctactcccaccctaccaccatgggaacagcgggcacagacgcctctcctgcgggaaggcagagcccttgcgttggagcctctatctggcctatcctgttgcagctgctctgctctgagtgccagtgtcacccaaatccatatattaagacctaagtcccaaggggatggcactgggaggggggccttggggaggtgatcaagtcacgacggctccactct

SEQ ID NO: 195357 - DNA, 601 bp, Human
ggcctgtgcagctgaggagcacaatgtccccttttatttaatttgaatgcatttacatttaaactgccacatgcagctggtggccgctacacaggacagcagaccaacctcgagagaaatacaacaaaagacgtaacgtgggggtcaagtcacagttagggtgggttttttgtttgttgttgttgttgttgttgtttttgagatggagtgtcgctctgtcgcgcaggctggagtgcggtggcgtgatctcagctcactgcaacctctgcctcccgggttcaagtgattctcccgcctcagyctcccgagtagctgggatgacaggtaccaccaccacgcccagctaatttttgtatttttagtagagacggggtttcaccgtgttagccaggatggtctccatctcctgacctcgtgatccacccgcctcggcctcccaaagtactggggttacaggcgtgagccaccgcacccgacctagtgttttcatcttacagatgaggagactgaagtaagtgctttgcccagagctggaaaagggcgaccgctggaggttcccaggctgttggtctgagtccaaatgtgttgctctgcctcacag

SEQ ID NO: 195358 - DNA, 601 bp, Human
gtagaaacccactccaaactggccgatgatcttgctgctggcctcagcctggttctgcagagcatccaggaaggcctgtggggcagaggccagttagtgaggcagcctcccctccagagagcagacactcccaacaccgtggctcttctgcgagcaccgctaagaccccttcatcctgaaaacagccacaccgagtacttttccaccccattctacacgtgaagagctaagtcacagagaggtgacacattagccctaggacaaccagctggcagcagtgggacaagtgtgttttccattwgattcccaaagctcacagtcctgcctgtcccagacaggtggaggcctgtgggtcacacctgggggtggggaaagagcagcttgaataagctctttcccttgaataagctccttccataggaaggccaggagtgaggagaggctccaaactggcttccatattcaagtctcctggactctacactttgtgggaaaaagagtagaaatcacgcgcatgcgtctgtaagcaccgcacagcacttcatttttctactataatactgccaaaggtcctaaggccaaagtcaagtaaaatacacac

SEQ ID NO: 195359 - DNA, 601 bp, Human
aggcaaggaaaggaaaagccaggtggatgtgacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggtctggggcackgtgggggactggcccagctccaaatcgggtgccagatgcccaggggcaaaaacaaaggccagggggacaggcgccccctaagaagagcagaaaaccatctccgaagcacaggaggggggaatcccccggcagggccatgttgatgccttggcctaagtttactctgagccccgctcccatggaattaaacaggaatgttagttttgggagagtggggagtcaagctgagcacagtgcacacactgtggagcagaaatggcatcacggagggaggacgcctcggctggctggaagcggctc

SEQ ID NO: 195360 - DNA, 601 bp, Human
gaactaaggcaggcaaggaaaggaaaagccaggtggatgtgacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggyctggggcacggtgggggactggcccagctccaaatcgggtgccagatgcccaggggcaaaaacaaaggccagggggacaggcgccccctaagaagagcagaaaaccatctccgaagcacaggaggggggaatcccccggcagggccatgttgatgccttggcctaagtttactctgagccccgctcccatggaattaaacaggaatgttagttttgggagagtggggagtcaagctgagcacagtgcacacactgtggagcagaaatggcatcacggagggaggacgcctcggctggctg

SEQ ID NO: 195361 - DNA, 601 bp, Human
agcccccctcccagtcccgcagcggctcggcccttcacggctctgcctgtgcaccctacgtgcaggtagaaccagggaaaatgcctgctgacctggtggcctccaggccacacatggatcccagagtgagcctgggcccgggctcccgctcacctcgcacccgggcctcgctggaaaactccttgcagtcggatttcaggtggatgatgatttttgtcccggttctaactcccgaagcttcggcgatttcaaacactccagaactaaggcaggcaaggaaaggaaaagccaggtggatgtkacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggtctggggcacggtgggggactggcccagctccaaatcgggt

SEQ ID NO: 195362 - DNA, 601 bp, Human
cgatgctacgcagccctggcgggcagcccccctcccagtcccgcagcggctcggcccttcacggctctgcctgtgcaccctacgtgcaggtagaaccagggaaaatgcctgctgacctggtggcctccaggccacacatggatcccagagtgagcctgggcccgggctcccgctcacctcgcacccgggcctcgctggaaaactccttgcagtcggatttcaggtggatgatgatttttgtcccggttctaactcccgaagcttcggcgatttcaaacactccagaactaaggcaggcaargaaaggaaaagccaggtggatgtgacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggtctggggcacggtgggg

SEQ ID NO: 195363 - DNA, 601 bp, Human
gaggccccggctgctgcgagactgcaatgtcagcttgtggctggaacatggctttctgggctgactcctgggggtactcagggcctccctgagtgtccagcaggacacaaagagggaaggccacgcccacatcctgggacaggactgcgccaaacccccaggtgcactaaaggccaagggccacgcagaggaaggaggaggaggtccgcctcagccaggccagcttcctcccagtcccagcaggagctcgatgctacgcagccctggcgggcagcccccctcccagtcccgcagcggctcrgcccttcacggctctgcctgtgcaccctacgtgcaggtagaaccagggaaaatgcctgctgacctggtggcctccaggccacacatggatcccagagtgagcctgggcccgggctcccgctcacctcgcacccgggcctcgctggaaaactccttgcagtcggatttcaggtggatgatgatttttgtcccggttctaactcccgaagcttcggcgatttcaaacactccagaactaaggcaggcaaggaaaggaaaagccaggtggatgtgacactgggacataccctgcatgggactc

SEQ ID NO: 195364 - DNA, 601 bp, Human
gtacttcgttaccacatctggaagggacaaaagaaaaaccacactgcatctacaatgcttgtggaaacgcaagctttgcagcagctccaggatgagcgccagcctgctgggaagggtcctccatgctgtgtacacttcacaggtacagaaacagggcacagtggggacacctgtcctccccccagtctcacgggggcagcagcggagcccacgtgagaaccagagctgtggaggccccggctgctgcgagactgcaatgtcagcttgtggctggaacatggctttctgggctgactcctgrgggtactcagggcctccctgagtgtccagcaggacacaaagagggaaggccacgcccacatcctgggacaggactgcgccaaacccccaggtgcactaaaggccaagggccacgcagaggaaggaggaggaggtccgcctcagccaggccagcttcctcccagtcccagcaggagctcgatgctacgcagccctggcgggcagcccccctcccagtcccgcagcggctcggcccttcacggctctgcctgtgcaccctacgtgcaggtagaaccagggaaaatgcctgctgacctggtgg

SEQ ID NO: 195365 - DNA, 601 bp, Human
tgcaggcctgagccagtgcagcgcctggccctggacaggctcctgggacagacgggcggtggtctcaggcgtagacccctctccagccccaccgctgggctatgccgggtagtgcaggggagacacacaaggctctggggcaggagctcctcaggacaacatgtcaggaggaccagccgggacctgagggggcctgtgggagaggatgacgctgcccagcaggggcgagctgacgaatacagtgtgggccgtgagagcgatgacgacccacgctgcaccgcagctgagccgcgagggggawgtcagtcactgaggacagcatgccgtgtgactccatccaggagaaacgtctggaacaggcagcacaatggacagaaaggagaccgtggctgctgggactgggggaggggcagtggggaaagggctgctttttggggtgatgggatgttctggaattgatgcggggtggctgcacagctctgtggctgcactgaacaccatggctgcacactgatgtggtgagccagctgggatgggcgttacgcctcagtgaaccctgacccctgaccccggctgcccggtgcacaggggcagggctgtg

SEQ ID NO: 195366 - DNA, 601 bp, Human
accctcctcagcctcccaaagtgctgggataacaggcgtgagccaccacacccagcactacctatgtttttcatgccctcacactgccatgttaatcatgtgacatctgcagagctgatgccacaggggacaacagagtcaccctgagggccgtgggactgccacagtgcctcaccatgtcgggcacgtagaagatgctgcggatgttgagcggtgcgtccgtcttatagtgcagggtgtagcggggcttgtcgtgagcctgcgcgacgtagcggtagaactcctcatgttgccactcacsgacatccttggggtccatcatccagatggcctggaaacggagatcggcggggagggcgtcgtgttcaccacgcacgtcttctccaccaccgtgcaggcctgagccagtgcagcgcctggccctggacaggctcctgggacagacgggcggtggtctcaggcgtagacccctctccagccccaccgctgggctatgccgggtagtgcaggggagacacacaaggctctggggcaggagctcctcaggacaacatgtcaggaggaccagccgggacctgagggggcctgtgggagaggatga

SEQ ID NO: 195367 - DNA, 601 bp, Human
ccagcccagggacattgtacctggaacctcccctcctgtggccactcctgggcagggtgatggggatggacaaggtggggacaactccagcaccagcaataataatccgggagtcagccccaagccctctcttcactgaagtgaactgaaacattgggcagatcaccagtaacccacaggcgcactcgaagtgcacagggtcagtacaccaaagagcacgactctaacgaccacagaacagtcgctgctgtggggcggggatgcatcctgttgaggtcagcacaactgctgccctgtggtyatgtcggcagcaagtcggggtcctgctgtcagaagccagcacggctgtgtggggaaacaagcactgaggcccccttttcattgattatataacatctctttagtcagcaaggaaaataccttttatatagttatatcttccgaccaagtaaccccacccctagtattctatcctaaggaaatacagctgcaggtaaagatttcagaacaggccaggcgcggtggctcacacctgtaatcccagaactttgggaggccgaggcaggcagatcacaaggtcaggagatcaagaccatcccgg

SEQ ID NO: 195368 - DNA, 601 bp, Human
tagcttcaaaatacctataacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgccygccacagccaggaatgcagctcccttactgagcaggaccacccctctgtgactcagtttccacaactatgagtgaggactcacggctcccctcacaggatgaaacacgtgtttatgcaggctcagcacagttctcagtggagaagaaatactcaggaaacacattcaggatggggagaggaacgcagccgcctcggcccgcagggacgccaggagctccctctccacagggcctggcccctgcctccacttcatccgtgagcttcccagatgaggccagacgtgtcctcagttcagtggg

SEQ ID NO: 195369 - DNA, 601 bp, Human
tttcatgaagaatgtgacatttacatagcttcaaaatacctataacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgrgcactaccagtgggccagcatgcctgccacagccaggaatgcagctcccttactgagcaggaccacccctctgtgactcagtttccacaactatgagtgaggactcacggctcccctcacaggatgaaacacgtgtttatgcaggctcagcacagttctcagtggagaagaaatactcaggaaacacattcaggatggggagaggaacgcagccgcctcggcccgcagggacgccaggagctccctctccacagggcctggcccctgcctccacttcatccgtgagcttcccagatgagg

SEQ ID NO: 195370 - DNA, 601 bp, Human
ggattacaggagtgagccattgcgcccagcctaatttttctattttttaagtagagacggggttttaccatgttggctaggctggtctcgaactcctgacctcaggtgatctgcctgcctcggcctcccaaagtgctgggattacaggcgtgagccaccgcgcccggccaacacataaatattttaagtaaataaatgaatgtattgagagtttcatgaagaatgtgacatttacatagcttcaaaatacctataacatctgttaattacaaagggaaggacatccttgtttgttggaaaygcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgcctgccacagccaggaatgcagctcccttactgagcaggaccacccctctgtgactcagtttccaca

SEQ ID NO: 195371 - DNA, 601 bp, Human
gtaactcctgacctcgtgatccacccgcctcggcctcccaaagtgctgggattacaggagtgagccattgcgcccagcctaatttttctattttttaagtagagacggggttttaccatgttggctaggctggtctcgaactcctgacctcaggtgatctgcctgcctcggcctcccaaagtgctgggattacaggcgtgagccaccgcgcccggccaacacataaatattttaagtaaataaatgaatgtattgagagtttcatgaagaatgtgacatttacatagcttcaaaatacctrtaacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgcctgccacagccaggaatg

SEQ ID NO: 195372 - DNA, 601 bp, Human
tctggtcaatgaagaatttgatcagcctctgctgtaaaacgtcccggagtttcctacagaaaagaaatgcatttaatacatacaagcagcctctatgaaatacaaatggccagagggtacgaaaaaatgttcagccccgctaagaatcaaagaagtgaaaacaacaaggtaccgttattggccaaactgaaaaagactgagcagaaagacagaaaccctgggcagtggccggacaggaggcagcagggtggagggcagacaccccctggaggcagtaggagaaccgatgcccccagagacaagatacccacgcccggaaaacccttccaacctttgagccagttgttccaattataggaactgcaccttaggaaacatgtgagcacaccaagatttatgtaccaggattttcactgtggcacataaaatataacaattatgaacaacctcatgttcaagaatataggctaaaattatgtaatgctaaatggccataaaaaaaaaaaactgcatcttttaataatcctcaatgacatgagaaagttagctgtgttgaaagaaaacccagaaaaatcccaatgtgggtaaattacagtacgtc

SEQ ID NO: 195373 - DNA, 601 bp, Human
gggatgaaatgttctggggttacagtggaggcagccacaccacactgtgaatgcactaaatgccactgaattttacgtgttaaaaggtgaattctgtgaatctgatgctatgtaagttgtatctcaataaaaaatggacaaaaaatgtttatggaacaaatgtttcgtttttcagccatccactattggattaactgaacgactggcccctgtagcatagtatttggagactgatatccagtacatgatgaatagtccctcaacagacactgagaccacccacttccccacccacgggatyggagtccttggcttgtcccacctgtctgtggctccccagcccccaacatcctctgaggggagacagtgtgtgcacgccctcttcctgccactccctgggctgcaccttcacacagcagtgaggctgagcccttcagagcacagcacagcactggtgggagggtaaggatgtgcctggaaggtgccagaggcccagaagcctggccttccatttcctgaccctggtggcagcagcagcagcagccagggtacccagctgcaccgtcgccacatcaggggacacctccaccagcttcctcag

SEQ ID NO: 195374 - DNA, 601 bp, Human
tgtgagctcctgagggctggggtagcatgtcccttgtttggaacccccacgtcctcagccattgcagctcccactcaggatgctggtttttcagttctcagttcacacctgctctggagcagggctgggagaaagacacggccttcctgcctcagcggcactcccgagcaacacgtgccgagcagggacccacagggtctccacctgacaccaagggcttctgctgctgctggaaggacacccaacgggccaggtactgggagccaccagctggccagcctgttagggacactgcggccargtggtggtccatccccgggaaagcctcaccttcacgttggtgacacgcgaccccagcacatttctcatccaggccatgagctcctccgtctccttctctgataggcactcggcggctgcggaagagcaggcgacagggagctcaggcctgcatcccaactccccggcttccatgggggccacgcagcatgcttccagctcccacctcctctcccaccaggatggagacacaagctagcaagatgcttttcatctaaaagtaaaacctcaaaggatgcttcaggttgcctgaggcccatac

SEQ ID NO: 195375 - DNA, 601 bp, Human
cttacggctcagccactgtcagggctggggggttctcggtgcaccctggaagcagctcccaccaccggggccacagagaaacccacacaagccccagacacgtggacaagaatactcagagcagcctggctctccacaacttctgaccaagaaccaccggaggcccagcagagcagaacggagcagtctgctgtgccgaggtgggtttctgcagcggacattattcggctatgaaaatgaacttgtggcagcccctctgcatgggcaaccctcatgccaagtgagcaacgtgagacttcarcaaacaccaagatccacgtacaaagctcaaaacaggcaaaactgagcatgtccaggacacgcacaggtggcaaagccataaagcaaaacgaggacatggtcacaggctgggatgtggctaacctcccaggtgacacctggggatggtaaggggctggccaggttccatttcacatgggtgcagcctaaactgcatacagctccttatagttacccacatgtccacaggcctcacgcacttttcttctgtgtcacattccacaacaaaagaacaccacacacaggattctggggaatccca

SEQ ID NO: 195376 - DNA, 601 bp, Human
tatggttgtaaaatgacaaaagaaaaaaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacwtgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactgtaaaaagaaagaaactcaaaagatacctaaaggcaggtgaaaagacatttacaacagataa

SEQ ID NO: 195377 - DNA, 601 bp, Human
ccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacatgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactg

SEQ ID NO: 195378 - DNA, 601 bp, Human
agccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgggaggccaaggctgcagtgagctctgatggcgccactggtacactccagcctaggtgacagagcaagaccctgtctccaaaagtgaagtggcaacagacagaaacgagcacttctgcagctatctcacaaaactagtttgscaccaaaactagttaaagtgacctggtgtccgcctcactgagctgctccagcagaggcacaggcattctgcatactggcgctgctgtgcactgacagccataagccaagtcagcctttccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggaggctaaggcaggtgga

SEQ ID NO: 195379 - DNA, 601 bp, Human
tgcagaaatacaaaagccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgggaggccaaggctgcagtgagctctgatggcgccactggtacactccagcctaggtgacagagcaagaccctgtctccaaaagtgaagtggcaacagacagaaacgagcacttctgcagctatctcmcaaaactagtttggcaccaaaactagttaaagtgacctggtgtccgcctcactgagctgctccagcagaggcacaggcattctgcatactggcgctgctgtgcactgacagccataagccaagtcagcctttccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggagg

SEQ ID NO: 195380 - DNA, 601 bp, Human
cccaagctagagtgaaatggcatgatcttggctcaccgcagcctcctggtttcaagaggttctcttgcctcagcctcccaagtaactgggattacaggcacccaccaccacccccagctagtttttgtatttttagtagagatgaggtctcgaactcctgacctcaagtgatccacccgcctaggcctcccaaaatgttgggattacaggcgtgaggcaccgcacccaacctaacagaggaaacacttcaaatgcacatcctcacatttctagtctacgtagctggaaaaaaaggacattyttaatatgctaatgtggaggtcacctagttaccctaagggagaaaagcaaggcaaggacccactgcacagcaagttcccccttggaagcccacgggcgcagctgcccacaaatgcacataatctctgcagaaatacaaaagccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgg

SEQ ID NO: 195381 - DNA, 601 bp, Human
caggaagagaggacccatcctgccacaggacccagaaaaaaagcccaacacacactcgggttaagaaatacctttaaatttaggtaaataaagctcaaggaggtggggctgtcatctgtggtgtcagtccttctggccccctggctgtcagtgtcgctccagggccttgacaagcagctcattcaagcggcccaccatggccctagggtcgtcaacaagtccagcagcaatcatggcgttctcgtatatctgaaaggcaagaggagaaacccattatgaggggcatggggcaccttttcatttttttttttttgagacagagtctcactgttgccgaggctggagtgcagaggcacgatctcggctcactgcaacctcaggtgatccccccgcctcccaaagtgctgggattacaggcgtgagccaccacgcctggccatttttccgtttttaaaacagaatttggctgggcacggtggctcacgaggtcaggagattgagaccatcctggccaagatggtgaaaaccccatctctactaaaatacaaaattagccaggcgcatgcctgtagtcccagctactcgggaggctgaggcaggg

SEQ ID NO: 195382 - DNA, 601 bp, Human
acaatgtatagctccaaagtaggccatatcataaattaagatttacctatgtcttgtactgtactcagagttttaaaattatgcctacggaatatgacagactgacatatagttggatttaggtggaggatatgcttgtatttattgtacaattccctcaacttttctgtatgtatgagaattcttttaataaaaagttggggaagtcttaacataaaacaagactgtgtgtacattatgattatacctatgttgaaacacaccagtagaaagactcactggtgtggtggtggtagtcccrgttactcaggaggctgaggggagaatcacctgagcccagtaggtcaaggctgcagtgagctatgatgatgccactgcacctcaaccaggtgacagagtgagactctgtttcaaaacaaacaagacacaccgcacattgtttccatatatcaggtttgcctaaaaagtatcacaactgtacatttgttgacactaattctgcaaacgcaatcttgctcactgcaacctctgcctcccgggttcaagtgattctcctgcctcagcctccagagtagctgggattacaggcatgcgccaccac

SEQ ID NO: 195383 - DNA, 601 bp, Human
atgtgtgtgtgcacataggcttaccaggtgtgaatcgtcccccaaagctaaagagatgaaggacatgcttttcccaaagcaaacaacctgaacacacaaaggctgtgatttcttacccagtaacatcatttccccgacactgctgtcatcttccttctctgacgtgagttgttgagtaggatccaagctcacacattcttcctggcagtgaaatacattcaaatcctcaaagaccaccagctcctgaaagagcaagaggcccctttcatcttagtaactgaggttcactgacagccctacyggtaagaaaagctgacacacaaagatcaagggaagggatagcaagagggacctataaatcccacagaggtgcagcaaagacaggacagccaggctgagaagggctcaaggaaaaagcagaagaaaaacacccaagaaggccaactcctaagaatgtgtttttacacacaggttggccaagcacggaaggtgatggattcaggcagtaaatgggaaaaccaaacccacctcagggttagctttcaaatacagagacactgtctcttgttccttttggactcctttgggcagaagcttcacc

SEQ ID NO: 195384 - DNA, 601 bp, Human
tgctcattaagtgttaaacattactttcaccaatagtggaatatattttcacttaggctagtagtcttcacatctattgaacatcaaaaaggggagggggattacaagagttagtcatgtgttcaatgaaaacattcaaatatacctgttgagaacagagttcagaaaatgggttcagaacagtttctatatccacagtttctatgtctgcaggttttccctacctctcccctcactgcccccaagatacagggaaaaatggccacccacccacagctggagttctgtggcaaggctctgmtacattgaataaaacaaaagtaaaataaaatgtgtgtgtgcacataggcttaccaggtgtgaatcgtcccccaaagctaaagagatgaaggacatgcttttcccaaagcaaacaacctgaacacacaaaggctgtgatttcttacccagtaacatcatttccccgacactgctgtcatcttccttctctgacgtgagttgttgagtaggatccaagctcacacattcttcctggcagtgaaatacattcaaatcctcaaagaccaccagctcctgaaagagcaagaggcccctttcatct

SEQ ID NO: 195385 - DNA, 601 bp, Human
tcctttgcaaaaattggttaaatgttactgtttcaattatcatcacctataaattgatggctccccaatccctatatcctcacatctgaactccaatccccaatttccaaatatctggaggataatctcattttatttcccatcatggattcaatctcatccaaaatcaattccaccttcttcactactctgccccgggtccaaatcttacctcagtcttgcgatagctcattatacctataaaaatttcacactgcttatcgtttgatgaatgacttgtcttacaaaccaaattggaagrttacaaaaggcaagaatataacatcttcgtaacctgatgaatacaattccagaacccaatcctgcctgaggaaaaaactagtacatttatgaaatgctggtaaatgactaagcttaagccaccagcttcagggtacgggtggaggaagtggggaacagagggtgaggattgggtcttaggggccctgaagtgcatagtcgaagtgatcttggaggcaatatatccactaaccagtcacccaaaataaatgccagctctgcccaagactcaggaaaaactcagtgttaataaatctgatct

SEQ ID NO: 195386 - DNA, 601 bp, Human
ggcacctgtagtcccagctactcgggaggctgaggcaggagaatggcatgaaccgcagggggcggagactgcaggaagccaagatcgcaccactgcactccagcctaggtgacagcgagactccgtctcaaaaaaaaaaagaaggaaacttccaaattcaaacaagagcgaaactctgtctcaaaaaaataaataaataaataaagacagagaaatctgagccccagtgatggaggtggggcctagtcggaggtgtctgcatcatgtgggtagatcgctcatgaatggcttgatgccacckcaaaataataagtgatttctcactcttagttcactaacaatgtggctgtttaaaagagcctggcaccttcctactctctttcttcctctcttgccatgtgaagtctgctctccttcaaccatgagtagtttcttgaagccctcaccagaagcagacgctgacgccatgcttcttgtacagcctacagaaaactgtgagccaaataaacctcttttctttataaattacccagcctcaggtattcttttatagcagcacaaaatgtactaagacagttgcttaagagttttaaattttcca

SEQ ID NO: 195387 - DNA, 601 bp, Human
catggggactggatttcaacacgagatttggaggggacaaatatccaaactatatcagcaaccttgcgtcagaggggtaaagacaaattaaaattgcatattttttctagaaaacattatacagaccttcatattcataggttctgcatctgaggattcaaccaaccaaggattgaaaatatttgagagaaaaaaaaaggatggttttgtctgtacatattcagtttttttgtcattccctaaacaatttagtataacaactatttatgtagcatttactttgtattaggtattataattratctagaaataaaatatatggtaggatatgtgtggagtatatgtaaatgctacaccattttatataatgaatttgagcatccatggattttggtatctgagtgggggtcctggaaccaatcccccatgaataccaaggacaagtgtatatcagaatttatggtataacctaaagtgatgctcataagagagctcatggctgtaaaaacatgtattaatttagaaaaatgagaataataaagcctctgattcaaagttagaaaaacaataggataaatttaaaagaatgaaggtattaata

SEQ ID NO: 195388 - DNA, 601 bp, Human
ctttatttcccactaccttagtgaatggtctcattttttcccatgagagtacttaagacaaataaatgttcttatttttaagttttctgattactctgttctacctataaggaagtatctgttaactattttgttaaatgttcttataaaggagaggcttcaattttgtcaagtatcttttcagtaactatacaagtaaacaaatgatttttctcctttatatataagaaatattaatagatttgtattatttctgtttttttaattattttttttgagatggagtcttgctctgtccccyaggctggagtacaatgatgtgatctcagctcactgcaacctctgcctcccgggttcaagtgattctcctacctcagcctccagagtaactgggattacaagcacgcaccaccacacccagctaacttttgtatattttttttttagtagagatggggttttgctatgttggacaggctggtctcaaactcctgacctcaggtatcacccgcctttgcctcccaaagtgctgggattacagccgtgaaccactgtgcccagcatggggactggatttcaacacgagatttggaggggacaa

SEQ ID NO: 195389 - DNA, 601 bp, Human
gtttctggaggcctccccagccatgctgaactgtgagtcaattaaacctgtttcctttataaattaccaagtctcggacaattctttataccagtgtgaaaatggacgaatacaccaactttatcacacactaaactcccatgtgtatttgaggctatttcgggactttctgagatcacagtcttgttccaagggaaaaatgctattggtattgttgaaaaaaaacacatcaaattaataaatcaacaagaggagaaatgacctttttatgatattgtctccctagccaaaaacatagtatttttttttttgctttcgttgaaatctactcttgtcctttagccttgttttaaagtttcctcataaatttgcacatttcttgagtttattcctaagtatttaaactttcatgtttctattctaatggggccttccactgtatcttctaaatgaccccatttatatatgtgaaagccaatgatttctgtttattcactttatttcccactaccttagtgaatggtctcattttttcccatgagagtacttaagacaaataaatgttcttatttttaagttttctgattactctgttctacct

SEQ ID NO: 195390 - DNA, 601 bp, Human
gtcatgggcgggggggccttcccccatgctattctcatgatagtgagttctcatgagatctgatggttttataaggggctcttccccctttactcgtacttctccctcctgctgccttgtgaagatgatgccttgcttcctcttgcctttgccatgattttaagtttctggaggcctccccagccatgctgaactgtgagtcaattaaacctgtttcctttataaattaccaagtctcggacaattctttataccagtgtgaaaatggacgaatacaccaactttatcacacactaaactsccatgtgtatttgaggctatttcgggactttctgagatcacagtcttgttccaagggaaaaatgctattggtattgttgaaaaaaaacacatcaaattaataaatcaacaagaggagaaatgacctttttatgatattgtctccctagccaaaaacatagtatttttttttttgctttcgttgaaatctactcttgtcctttagccttgttttaaagtttcctcataaatttgcacatttcttgagtttattcctaagtatttaaactttcatgtttctattctaatggggccttccact

SEQ ID NO: 195391 - DNA, 601 bp, Human
taacaccttttatcaaaaagtccccctttatggttaggctttgtgtcctcgcccaaatctcatcttaaattgtaatcccacatgtcaaggagacatcaggtgaaggtaactgagtcatgggcgggggggccttcccccatgctattctcatgatagtgagttctcatgagatctgatggttttataaggggctcttccccctttactcgtacttctccctcctgctgccttgtgaagatgatgccttgcttcctcttgcctttgccatgattttaagtttctggaggcctccccagccatrctgaactgtgagtcaattaaacctgtttcctttataaattaccaagtctcggacaattctttataccagtgtgaaaatggacgaatacaccaactttatcacacactaaactcccatgtgtatttgaggctatttcgggactttctgagatcacagtcttgttccaagggaaaaatgctattggtattgttgaaaaaaaacacatcaaattaataaatcaacaagaggagaaatgacctttttatgatattgtctccctagccaaaaacatagtatttttttttttgctttcgttgaaat

SEQ ID NO: 195392 - DNA, 601 bp, Human
cttaatttgcacttctttttgctcctgtcacgcaggctggagtgcagtggcgtgatctcggctcactgcaacctccacctcctgggttcaagtgattctccttcctcagcctcccgagtagctgggattataggcatgccccaccacatccagctaatttttgtatttttagtagagatggggttttgccatgttggccaggctggtctcaaaactcctgacctcaggtgatccacctgcctcggcctcccaaagtgctgggattacaggcgtgagccaccatgccccagccttttgtacrtatttgaatctgtcaatcttttctttcaaggcttctgggcttttgagtcttaattacaaaaaccttcctatcccatggttataaaggaatcactcatattttctaaatgtgctttttatatttgttttaaacatttaaaatctttgatccatgtggactttttcttggtatgtaaagtaaggtactaatttatcaagtggctgtcagtcgtcctaacaccttttatcaaaaagtccccctttatggttaggctttgtgtcctcgcccaaatctcatcttaaattgtaatcccacatgtca

SEQ ID NO: 195393 - DNA, 601 bp, Human
cttatacagggactataccattttatatgcccaccagcaatatacctgtttctcaacaacctcaccatcaatgtgtttttatttctataaatatgaaatacgcaaaatgttaattcactagaggcttaatttgcacttctttttgctcctgtcacgcaggctggagtgcagtggcgtgatctcggctcactgcaacctccacctcctgggttcaagtgattctccttcctcagcctcccgagtagctgggattataggcatgccccaccacatccagctaatttttgtatttttagtagaratggggttttgccatgttggccaggctggtctcaaaactcctgacctcaggtgatccacctgcctcggcctcccaaagtgctgggattacaggcgtgagccaccatgccccagccttttgtacgtatttgaatctgtcaatcttttctttcaaggcttctgggcttttgagtcttaattacaaaaaccttcctatcccatggttataaaggaatcactcatattttctaaatgtgctttttatatttgttttaaacatttaaaatctttgatccatgtggactttttcttggtatgtaaa

SEQ ID NO: 195394 - DNA, 601 bp, Human
ataatctactgggttaaggcttttataaatgtatatctttgtcaatgatttcttgtctaaataatttttaactcaactcttcctctttaactacacttggactgcttccaaccttgtgtttttacaaacaataccacagtgaataatcttctttgtacatcatttcgaatgtgttctgttgctatatctgtaggtcagatttccagaattgaactcctggaacaaaggataagatgggtagttacagatgcaattacccttatacagggactataccattttatatgcccaccagcaatayacctgtttctcaacaacctcaccatcaatgtgtttttatttctataaatatgaaatacgcaaaatgttaattcactagaggcttaatttgcacttctttttgctcctgtcacgcaggctggagtgcagtggcgtgatctcggctcactgcaacctccacctcctgggttcaagtgattctccttcctcagcctcccgagtagctgggattataggcatgccccaccacatccagctaatttttgtatttttagtagagatggggttttgccatgttggccaggctggtctcaaaactcct

SEQ ID NO: 195395 - DNA, 601 bp, Human
cagcatattcatacaaaagtttattattggccaggcgtggtggctcacacctgtaatcccagcactttgggaggtcaaggcgagcagatcacccaaggctgggagttcaagaccagcctgaccatcgtggagaaaccctgtctctactaaaaatacaaaataagctgggcatggtggcacatgcctgtaatctcagctactagggaggctgaggcaggagaatcacttgaaaccggaaggcagaggttgcagtgagccgagatcgcgccattgcactccagcctgggcaacaagagcgaawctgtctcaaaacagaaaaaagtttattatttggcaattaaagagattactacaactaatgaagctttgggattagaagtcagtagtgtttctctttgtgtaggaaaggaagtagtgagtgggtacagggcacaaaagggatttttgggatgctaagaaaagtccattttgggtggtgcttagtgtgtacattttgtgaaaacttgagctatatatttacaattggtaggctttttctatatttccattatacttcagaaaaaagtcagtgtaagcagattataaagactgggtaacaaag

SEQ ID NO: 195396 - DNA, 601 bp, Human
accacttgtaggttttcactatattaaatattatcacactattatagcactaaataatatcataatgtcttacaatgagaaaattgaaacaattccaataagcaaaattaaagagggcacagcatattcatacaaaagtttattattggccaggcgtggtggctcacacctgtaatcccagcactttgggaggtcaaggcgagcagatcacccaaggctgggagttcaagaccagcctgaccatcgtggagaaaccctgtctctactaaaaatacaaaataagctgggcatggtggcacaygcctgtaatctcagctactagggaggctgaggcaggagaatcacttgaaaccggaaggcagaggttgcagtgagccgagatcgcgccattgcactccagcctgggcaacaagagcgaatctgtctcaaaacagaaaaaagtttattatttggcaattaaagagattactacaactaatgaagctttgggattagaagtcagtagtgtttctctttgtgtaggaaaggaagtagtgagtgggtacagggcacaaaagggatttttgggatgctaagaaaagtccattttgggtggtgctta

SEQ ID NO: 195397 - DNA, 601 bp, Human
cattttctacaggttccctctcaggatcttcaccttcaggattactgccattgactgctgaaacaaagagagaatttaacaacttctgagagatatcacaacaccaggcaggaaaaaacaagtcaggtttcttatgccacagccaccttgaacgtcaatctggggagtggcggatactgccgtcgcactccttttccatacttattgagggtgggatacataactgataaatctttccatctaccacaatgcaagcacactttaaagaaataaaatgagtgggatttcactgaaagacttsaaatgtttgttctcttcataggtgttaattactcgacaagttcatattcaccttatactctgtagagcactcaggtaaggactagggatgaagactatacatctatacagggaaccactcatcatcttgaaggagtctggtaactgaatagtaagacgaaccacttgtaggttttcactatattaaatattatcacactattatagcactaaataatatcataatgtcttacaatgagaaaattgaaacaattccaataagcaaaattaaagagggcacagcatattcatacaaaagttt

SEQ ID NO: 195398 - DNA, 601 bp, Human
ggggaaaacggatatactttcaatagacacaagtcactctttgccttccaagtaagcagactccagattcatcttcaaagtgttgggaaaggggatctgtgacctgtacattatcatataacttcaaaaaggaaagctccttagtccaaaaagcctagatgctgaggtatagcccttgaaatgttttcttccctgtgaattttctagcaatttgaggttttagctaagatgggcatttatccaattttggcaataatgagatttttacacatttatacctttttaggcagcttgggaattcagaactacttatgaaagctctcaggttgaggcagcaccatcagacccagaaagggttcccagtattacttctgctttcgggtcttacaggctgagtgggttttctcatgccgggtacagtttgacagccgaccaaatcttctcccacattttttgcaaccatatggtctctcagcctcatgactctgcagatgaagcacaaactcctcattctttgggaaggttttcccacattctggacacttaaatatcttctcccttatatggattccttcatgacgactccgatgagaattctgac

SEQ ID NO: 195399 - DNA, 601 bp, Human
atcgcaccacacgatcagtccgtaaaggcaccgctggccttgcttctaggcagaggacaggaaggtatggatatcaagaggctgaagacaattaatacccactacaatgaagacacctggaaacctgtctcttgagaggcaatgtgagctaaccactggagacgtaatttctaatcatacaacactttgccttgtgaggtagtgaccaccccattgccaaaggtctgatgacagcatagaggggacctaagcatatggtaaggttattgatgagacatggatccaagccaactttttcctgcctccaggttgacccttcctctctgggtcttggggtttccttcgtagcacatgagatctgggctcaacagagggacaagattctgaagagcttttctagtggtggggctggatggccctgcctgagtaatccaaacttcttttagcaagggagaagcatgagacggctgctggagagatcaacagcagaacaaaatacaataagaacagtagacacctaaattatgttgtgaaaaggaatctgtaaaagtcagttttatcacaaattgtaaatattattgaaattgattgcaaatttaga

SEQ ID NO: 195400 - DNA, 601 bp, Human
tcgctttgctggctttacagggtacttcctgttggcctgaaatacaatgttggtaaagacagtttttctgtggcctttctctgttgtggaggatttgttgtttttaaattacgattcaggactgaactgtatcatagaatgtccttctttcagaatgctttgtgccaaaacaagaaacctcagaattacatgttaataacaacaaacaaaacaaaaaagaccaataggcagaaggcaagaaacaaaaactattctttgtagatggtgtcattttaccaaaagttaacagaactaaaccaasaaactattgaaaattaacaacagtgagatgactatacaaatatataattaaaaataactttcccatgtaaaagcaataatcaactataaaaatataatggaaaaaactacaataacaaaattgtgtaaaacaagtgaagaaaattagaaaaattttcacaggaatataatactctaataaatagaaaggcatgtttctggatgggaaacatacactataatttttcccaaatagcttataggatttctttattccaatcaaaacaccaatgtataacttttggaaacctaaagcaagcaa

SEQ ID NO: 195401 - DNA, 601 bp, Human; identical to SEQ ID NO: 20762

SEQ ID NO: 195402 - DNA, 601 bp, Human; identical to SEQ ID NO: 20763

SEQ ID NO: 195403 - DNA, 601 bp, Human
gatctacaaacttaaaaataaaactactcataaattcacaaaataggtattcaatgacttggcaatttccaaacatatttaataattacaccctcttcatttttgaaattcgagtaatacagcatacaaagtacagcttacaaaacgttctcattgtcctgtgggccaacatatttaatttaacgtactgccgcccagctccaccgtcccacagtctccaaggacagagctcacaacacctgggccctaaaaatgccaaggtggcaagcagggggttacacccacagccccgtccactgasaccttcagactcaagagcgagtgccaccgccctaaacggaaagacactcatcacggcagcatctttcaagtgaacagaaagtgtagtttctgaccttgttaacatagtccttaaagtgctctaggttaggggaattctcgggtgaaaatagttttcgtctacatccataaaatcttcaacagcaaagttagtaaaataaagaaaaatcagaagaaagatgatgttcccttgccagagaacaaatacataaaagatacaggagctcagatcacaagccagagaaagagaatgccaactgga

SEQ ID NO: 195404 - DNA, 601 bp, Human
taaaacttttataaatatacaatgtacacaaatgtcaagaaaagttaacttaccaaatttacactatttgaggtttaaaaaaaaaaaaacacaaactcactctagcattttttttttttggctctgtgtctgagacccctgatctacaaacttaaaaataaaactactcataaattcacaaaataggtattcaatgacttggcaatttccaaacatatttaataattacaccctcttcatttttgaaattcgagtaatacagcatacaaagtacagcttacaaaacgttctcattgtcctstgggccaacatatttaatttaacgtactgccgcccagctccaccgtcccacagtctccaaggacagagctcacaacacctgggccctaaaaatgccaaggtggcaagcagggggttacacccacagccccgtccactgagaccttcagactcaagagcgagtgccaccgccctaaacggaaagacactcatcacggcagcatctttcaagtgaacagaaagtgtagtttctgaccttgttaacatagtccttaaagtgctctaggttaggggaattctcgggtgaaaatagttttcgtct

SEQ ID NO: 195405 - DNA, 601 bp, Human
aaggacagtttccaaaagggccaggaagttgtgtagacatactctattcctggagtcctatccacaaaggtttgtaaaatgagctcaagaaaacaaaatcgtggtctcagagaaagagctaaaggaaagaatatcacttttaaaaaatcagcagctaagctaagccttctatcttccctactccctacagtactaaaacttttataaatatacaatgtacacaaatgtcaagaaaagttaacttaccaaatttacactatttgaggtttaaaaaaaaaaaaacacaaactcactctagcattttttttttttggctctgtgtctgagacccctgatctacaaacttaaaaataaaactactcataaattcacaaaataggtattcaatgacttggcaatttccaaacatatttaataattacaccctcttcatttttgaaattcgagtaatacagcatacaaagtacagcttacaaaacgttctcattgtcctgtgggccaacatatttaatttaacgtactgccgcccagctccaccgtcccacagtctccaaggacagagctcacaacacctgggccctaaaaatgccaaggtggcaag

SEQ ID NO: 195406 - DNA, 601 bp, Human
taactatgtgtgtgaaagggtcttctacaaactgtgctgtcatctcaatttagctttgtaaggacagtttccaaaagggccaggaagttgtgtagacatactctattcctggagtcctatccacaaaggtttgtaaaatgagctcaagaaaacaaaatcgtggtctcagagaaagagctaaaggaaagaatatcacttttaaaaaatcagcagctaagctaagccttctatcttccctactccctacagtactaaaacttttataaatatacaatgtacacaaatgtcaagaaaagttaayttaccaaatttacactatttgaggtttaaaaaaaaaaaaacacaaactcactctagcattttttttttttggctctgtgtctgagacccctgatctacaaacttaaaaataaaactactcataaattcacaaaataggtattcaatgacttggcaatttccaaacatatttaataattacaccctcttcatttttgaaattcgagtaatacagcatacaaagtacagcttacaaaacgttctcattgtcctgtgggccaacatatttaatttaacgtactgccgcccagctccaccgtcc

SEQ ID NO: 195407 - DNA, 601 bp, Human
ggatcctgctccacgatcacggatcctgctccacatccacagtgccaggtgcacagtcagtgccaggggcacgacacagatttcagagtgaaggaatgtgcagaaatcatgaaactacccttctgcaaagcctgttcggataaatttgaatgagaggagcttccttctgtgctcccaggctagttctagaagccccttctcattctatggatgcccattcctgcagggccgctactggctgctttttaaccctgggatcagaaaagggggtaagagggaaaggctaatacacccagtattggggttttttttgtttttgttgttgttgttttttaagacagagttgctctgtcgcccaggctggtgtgcagtggcgcagcctcggctcactacaaccttctcttcccgggttcaaacaattctcctgcctcagcctcccgtaatacccaatattgtatagagaaaacatctgccaccagcccaaaggcagaggctaaaatcgatcttacatgtagataagcttaactatgtgtgtgaaagggtcttctacaaactgtgctgtcatctcaatttagctttgtaaggacagtttccaaaaggg

SEQ ID NO: 195408 - DNA, 601 bp, Human
tctactaaaaatacaaaaattagccgggcgtggtggcgcacacctgtaatcccagctatttgggaggctgaggcaggagaaccgcttgaacctgggaggcagaggttgcagtaagctgagatcacgccatggcattccagcctgggtgacacagccagactctgtctcaaaaaaaaaaaaaaaagaatgcagtgcaggtcaacacagaatttccaagcaaggagactgagctctgctaacgggttagcatcccagtggcaagggttgcaggcttaggtggggacaagctaacgggggaagraaggggaacacctgagcatgcaactgaaccccaaaccaacacctggctagggttctgtcagctggcaggcccgtgctcagggttaatggggcgcccagatttccggcatgagacaggtgtttgtttgcagaggctaacgcatacagaatgcctccgtccactgtcggtctgtcggcccaccagacagggtctacataggaactcctctaaggcaaaggtctcgatcacagaggtggccaacaggtgacaatctgcccaaatgcataccagcgggtctcctccccaagttgctccacaagc

SEQ ID NO: 195409 - DNA, 601 bp, Human
tgcagaaacataattactatctaaccaagctggccagaagacaaaaatcttgaaacttcttgacttgctctaattgttccttctccatgtttcccttccttaggcattctacctgaaaagacagccctcccttccttcttcatcccattggcaattcagcaaaccttaaccttctcttgctttaccagaggttacttctactcgaaagcttgtcttcagaattaacagctgtgtccttgtcactgtaagccaggtctcaaagagcctgaacaaatggtcactgggggcagcttgagtgtcractctactgctgttttctgtctcccaccccagctgtggaggggaactgtgtgcctcatctcatctctgccatttgctatctgagaggctgtatttccacgtgcataacagatcctgctcaagaatgcaggtcaaggctgggcgtggtggctcacgcctgtaatcccagccctttgggaggctgaggctggtggatcacctgaggtcaggagttcaagaccggcctggcctacatggtgaaaccccatctctactaaaaatacaaaaattagccgggcgtggtggcgcacacctgtaatcc

SEQ ID NO: 195410 - DNA, 601 bp, Human
acaagtgcaatgctagcaaaggctggggaaaatgagacaaaaaacctgatttccaagagcagacaagttttacaaggggcagtcttcttcgctgaagttgactaaaatttagccacgggttggcttggctggtgtggttcactgggtacatccacaagactacaagaatatcactgctgtctgcagtcttcccaggggaggaccaccctacccttggcccacaccacggatggcggccccacatccaccctctgatgcagcccagtcccttcccttctgttccgcggcagcaccggtgccyggccacttcccttgccagttcccttcctgtttcaaaaactctcatctcttcacaaaattccctccagggatgctagttcctgttggaaaaggtcttgaggtgtgtcacaggcaaagtacaaatgatatgcccagggccagatggatgacaggcccctaagctcagctagtccagagtcaggaggggacctgcagaattctaatggtgaatgattacactcttacagttttggaattccagcaaaaacaccaatactaaaatcaccaaccaagacaaagacgagacttacggcccacgcag

SEQ ID NO: 195411 - DNA, 601 bp, Human
gagatttgcaaaaatgtatggcagtgccacccttctcatcaaattttttcattttacaaaatatagttacttttataaaaatgttacttacattaacatgcaatgggtgaaatgaattactattttgaaataaatttagaaaagatttttaagcttctcagtttgtttcaatttctaatactgtaaatatcaatagacaacctatataaataatgcacataagcctgggaaacatagggagacgtcatctctacaaataatttttaaaattaggccgggcatggtggctcacacctataaycccagcactttgagaggctgaggcgggcagatcacttgaggccaagattttgacaccagcctggccaacatggtcaaacaccatttctactaaaaatacaaaaaaaaaaaaattggccgggcatggtggcatgcatctgtaatcccagccacacgggagactgagacacgagaattccttgcacccaggaggcagaggttgcagtaagttaagatcacaccactgctctccagcctgggcaagagtgagactccgtctcaaaaaaaaaaaaaaaaaaaattagttggatgtggtggcatg

SEQ ID NO: 195412 - DNA, 601 bp, Human
gtttctttgtttgtttgtttgtttttgagatggagtttcgctcttgttgcccaggctagagagcagtggcatgatctcagctcaccgcaacctccgcctcctggattcaagcaattctcctacctcagccgcccgagtagctgggaccacaggcatgtgccaccatgcctggctaattttgtgtttttagtagagacggggtttctccatgttggtcaggctggtctcgaactcccgacctcaggtgatccgcccgcctcggcctcccaaagtactgggattacaggcgtgactcactgcrcccagccatgtgtttgttttttgaggcagagtctcgctctgtcgcccaggctggaatgcagtggtgccatctcggctcactgcagcctccgcctcccaggttcaagtgattctcctgcctcaacctcctgagtagctgggattacaggtgcccaccaccacgcctggctaattatagtatttttaggagagacggagcttcaccgtgttggccaggctggtctccaactcttgacctcaggtgatccacccacctcggcctcccaaagcgctggtattacaggcacgagccatggccagc

SEQ ID NO: 195413 - DNA, 601 bp, Human
tcacagtccctagtgtgttctaggtttcggtactgaacgacacaagatgtgcgccagattgagcgcaggaagaaagaaacaccctttagtgcaatacgaaatgtgactcagccagcggggagcgttagttattgatggaatggctgtccaccatcgagtcactatgcaaatacgtgcttttcttgcattatcccagttgattctcccaacgaccctctgacagagacaccatcattcctataaattgcagcgcccctaggtagcttgcccaaagtcccacagttaggaaaccatacaaccsagaattaagcccgaatgtatcagaaatcaaaatccaagcacccaaccattcaagggtgagcccttccaaaaaaaatttacagaaacaaagttgatggttgtttctttgtttgtttgtttgtttttgagatggagtttcgctcttgttgcccaggctagagagcagtggcatgatctcagctcaccgcaacctccgcctcctggattcaagcaattctcctacctcagccgcccgagtagctgggaccacaggcatgtgccaccatgcctggctaattttgtgtttttagtagagacgggg

SEQ ID NO: 195414 - DNA, 601 bp, Human
cctgctgaacccccgagggttttcagtaaagaggctgccaagttcggcagctagagtttaaccagggcgagctatcagtattttgtattttggacacttgccctttttagtacgagaaactgacacaatcacagtccctagtgtgttctaggtttcggtactgaacgacacaagatgtgcgccagattgagcgcaggaagaaagaaacaccctttagtgcaatacgaaatgtgactcagccagcggggagcgttagttattgatggaatggctgtccaccatcgagtcactatgcaaatamgtgcttttcttgcattatcccagttgattctcccaacgaccctctgacagagacaccatcattcctataaattgcagcgcccctaggtagcttgcccaaagtcccacagttaggaaaccatacaacccagaattaagcccgaatgtatcagaaatcaaaatccaagcacccaaccattcaagggtgagcccttccaaaaaaaatttacagaaacaaagttgatggttgtttctttgtttgtttgtttgtttttgagatggagtttcgctcttgttgcccaggctagagagcagtggcatg

SEQ ID NO: 195415 - DNA, 601 bp, Human
tttttttttttttgagacagagtcttgctctgtcacccaggctgagtacagtggtgcaatcacagctcactgcagcctcgaccacctgggctcaaacgatcctcccatctcagtctgccaagtagcttggaatacaggcacatgccaccatgcacggctaattatttattatttttagagacagggtctcactatgttgcccagactggtctcgagctcctggactcaagcgatcctcctaccttggccttccaaagtgctgggattatagacatgaccactgcacctggcctgtacagaytatttgatcactgtctacttccctttctaggcgtcatgccccaagagggcaggggccacccctctatctccagaacctagtcctcgccttgccaatggtaggaacccattcaatatttaatgaataaacaaatgagtttacagtaggatacagtacagttgaaaaaaaccactctagttcaaaccacggccaatagctggagttgcacagctgaagatctgcttataattcctcaaccatcgaggggcccatcatcttaagaacctccaggctctggggaactgaagcagcctaggaacg

SEQ ID NO: 195416 - DNA, 601 bp, Human
actcagtctcaggtagcatcttttttgtttgtttgtttctgagatggggtctcactctgttgcccaggctggagtacagtggcgcgatctgggctcactgcaacctccaccttctaggttccagcgattctcctgcctcagcctcccaagtagctgaaattagaggcgtatgccaccacgcctggctaattttttgtatttttagtagacacggggttttgccatgtcggacaggctggtctcgaactcctgagctcaagtgatccgcccgcctcagcctccgaaagtgctgggattacargcgtgagccatgcacctggcctcaggtagcaactttatagcagtgttagaatggtctgatacaggtggaagctacagtgagccgagattatgccactgcactccaacctgggcaaaggagtgagactcttgtctcaaaaaaaaaaaaaaaaagaaaagaaaaaaacaaactcagtctgtaaatggtatagaaagggaaagaaccaagcaaataaaagcatctaaacacacacggctcccaggatcctaggatttcacagtggctgagacagcaggatacgtgagggcagggtacatgaca

SEQ ID NO: 195417 - DNA, 601 bp, Human
tccttcatcttctgccatgattgtaagtttcctgacgcctccccagccatgcagaactgtgccaattaaacctgctttctttataaattactcagtctcaggtagcatcttttttgtttgtttgtttctgagatggggtctcactctgttgcccaggctggagtacagtggcgcgatctgggctcactgcaacctccaccttctaggttccagcgattctcctgcctcagcctcccaagtagctgaaattagaggcgtatgccaccacgcctggctaattttttgtatttttagtagacasggggttttgccatgtcggacaggctggtctcgaactcctgagctcaagtgatccgcccgcctcagcctccgaaagtgctgggattacaggcgtgagccatgcacctggcctcaggtagcaactttatagcagtgttagaatggtctgatacaggtggaagctacagtgagccgagattatgccactgcactccaacctgggcaaaggagtgagactcttgtctcaaaaaaaaaaaaaaaaagaaaagaaaaaaacaaactcagtctgtaaatggtatagaaagggaaagaaccaagcaaa

SEQ ID NO: 195418 - DNA, 601 bp, Human
cccaggttgaaacaattctcctgcctcagtttcccgagtagctgggattacaggtgtgcgccacgacacccggctaatttttgtatttccagtacagacagggtttcaccatgttggccaggctggtctcaaactcctgacctcaagtgatccacccgcctcagcttcccaaagtgctgggattacagacgtgaaccaccacgcccggcctttttattgtttttttatcacgatttacctacattcacagacacctgcccctcaacaggcattagtgggaagatacagaaagaaattctayattgctctcaattgtaggaatgcaaattaaagcttccaaggaactcgaagatgcacaaaccgtttcttgggtggcattatttcctcatagaaacatgcatatactattcattttcttttcaaaaaagatgagggtaaactttagctcagtctctctgaataaacatatcagacaaacagaattaatgagattttaatacctataatttctcaactctttaaaaaggttactaaaagggtatgaaagttatcaaagaccactggggttgcatgaagaggactcagcagccaacttaaaggg

SEQ ID NO: 195419 - DNA, 601 bp, Human
caggtcatctacattttggtttgggatttttttttattgttttggttttgttttgttttgctttgttttgtttttggagacagagttctcaccgtgtcacccaggctggagtgcagtggtgtgatctcagctcactgcaacctctgcctcccaggttgaaacaattctcctgcctcagtttcccgagtagctgggattacaggtgtgcgccacgacacccggctaatttttgtatttccagtacagacagggtttcaccatgttggccaggctggtctcaaactcctgacctcaagtgatmcacccgcctcagcttcccaaagtgctgggattacagacgtgaaccaccacgcccggcctttttattgtttttttatcacgatttacctacattcacagacacctgcccctcaacaggcattagtgggaagatacagaaagaaattctacattgctctcaattgtaggaatgcaaattaaagcttccaaggaactcgaagatgcacaaaccgtttcttgggtggcattatttcctcatagaaacatgcatatactattcattttcttttcaaaaaagatgagggtaaactttagctcagtc

SEQ ID NO: 195420 - DNA, 601 bp, Human
caagcccggctaatttttgtatttttagtagagatggggtttcactatgttggccaggttggtctcaaactcccgacctcaggtgatccgcccgcctcggccttccaaagtgctgggattacaggcatgagccactgtgtctggcctgtaatattcattcatttattcattcattcattcagccaatattatcaggcatgtattatatgcctggctatattcccagcactaggaacacagcaggaagtaaaacatggaaaattcctgctcttaagatacattccagtggcgtggaaacagrttataaacaaaataagtcaaatacatatgatgcaagatggaaaagagagtggccggcccatcgttccaggaggcactgttgagagcaaggctcctactaagggatttcctagagttgggccttctagaacattccgcagctgtcctgggggatggagtttgctgcaggactcctcagtctgcaaacaggtcatctacattttggtttgggatttttttttattgttttggttttgttttgttttgctttgttttgtttttggagacagagttctcaccgtgtcacccaggctggagtgca

SEQ ID NO: 195421 - DNA, 601 bp, Human
tcctcagtctgcaaacatgtcatctacgttttggtttgggattttttgttttgttttgttttggtttttggtttttttttttgagacagaatctcactctgtcacccaggctggaatgtagtggtgcaatctcagcaacctctgcctcccgggttcaagtgattctcctgtctcaatttcccgagtagctgggactacaggtgcacgccaccaagcccggctaatttttgtatttttagtagagatggggtttcactatgttggccaggttggtctcaaactcccgacctcaggtgatccrcccgcctcggccttccaaagtgctgggattacaggcatgagccactgtgtctggcctgtaatattcattcatttattcattcattcattcagccaatattatcaggcatgtattatatgcctggctatattcccagcactaggaacacagcaggaagtaaaacatggaaaattcctgctcttaagatacattccagtggcgtggaaacaggttataaacaaaataagtcaaatacatatgatgcaagatggaaaagagagtggccggcccatcgttccaggaggcactgttgagagcaag

SEQ ID NO: 195422 - DNA, 601 bp, Human
cacagcggtcctgagggatggggtttgctgggctgggggaggactcctcagtctgcaaacatgtcatctacgttttggtttgggattttttgttttgttttgttttggtttttggtttttttttttgagacagaatctcactctgtcacccaggctggaatgtagtggtgcaatctcagcaacctctgcctcccgggttcaagtgattctcctgtctcaatttcccgagtagctgggactacaggtgcacgccaccaagcccggctaatttttgtatttttagtagagatggggtttcacyatgttggccaggttggtctcaaactcccgacctcaggtgatccgcccgcctcggccttccaaagtgctgggattacaggcatgagccactgtgtctggcctgtaatattcattcatttattcattcattcattcagccaatattatcaggcatgtattatatgcctggctatattcccagcactaggaacacagcaggaagtaaaacatggaaaattcctgctcttaagatacattccagtggcgtggaaacaggttataaacaaaataagtcaaatacatatgatgcaagatggaaaag

SEQ ID NO: 195423 - DNA, 601 bp, Human
tatttattcattcatttatcagcaaatattatcacacatatattatatgcctggctatattcccagcgctaggaacacagcaggaagtaaaacatggaaaattcctgctcttaagatgcattccagtggcgtggaaacagattataaacaaaattaagtcaaatacatatgatgcaagctggaaaagagagtggctggcccatagctccaggaggcactgttgaaagcaaggctcctactaagggaattcctggagttgggccttctggaatgttccacagcggtcctgagggatggggtwtgctgggctgggggaggactcctcagtctgcaaacatgtcatctacgttttggtttgggattttttgttttgttttgttttggtttttggtttttttttttgagacagaatctcactctgtcacccaggctggaatgtagtggtgcaatctcagcaacctctgcctcccgggttcaagtgattctcctgtctcaatttcccgagtagctgggactacaggtgcacgccaccaagcccggctaatttttgtatttttagtagagatggggtttcactatgttggccaggttggtctcaaac

SEQ ID NO: 195424 - DNA, 601 bp, Human
gattacaggtgcccaccaccatgcccagctgatttttgtatttttagtagagatggcatttctccacgttggccaggctgttcttgaactcctgacctcagctgatctgcctgccttggcctcccaaagtgctgggattacaggcatgagccaccataccaggcttatatttacttatttattcattcatttatcagcaaatattatcacacatatattatatgcctggctatattcccagcgctaggaacacagcaggaagtaaaacatggaaaattcctgctcttaagatgcattccastggcgtggaaacagattataaacaaaattaagtcaaatacatatgatgcaagctggaaaagagagtggctggcccatagctccaggaggcactgttgaaagcaaggctcctactaagggaattcctggagttgggccttctggaatgttccacagcggtcctgagggatggggtttgctgggctgggggaggactcctcagtctgcaaacatgtcatctacgttttggtttgggattttttgttttgttttgttttggtttttggtttttttttttgagacagaatctcactctgtcacc

SEQ ID NO: 195425 - DNA, 601 bp, Human
attactataaagaaaaggaggccaggcgctgtggctcacgcccgtaatcctagcactttgggaggccaaagtgggacgatcgctcgaggccccgcaacacagcaagacccccatctctaataagaaaaaaaaaagggagaagaaagaaaaggaaaaatgcagacaagccagaaaataaaattgaggagattaatacaatataataatcaggcactgcagatcacacctggaacaccgcctcacccaggcaaaggaggaaaagctttcatgtgtgctcatcatttgagcaaaaaggaagaamacacacacagaaactcaggagatccagaagagacactctgaacaaagaaaatggaaatgacagggaaccaaatgatccacatcagggattttaagagggaaattatgcttctgaatgaaaaaaataaaatcattcaaaactttttataaatctttgacaaaatccaagagtttcctttcaatgttgatgacatttaattttttttttttttttttgagacagtctctgtcacctaggctggagtgcaatggcgcaatctcagctcactgcaacctctacttaccaggttcaagcgattct

SEQ ID NO: 195426 - DNA, 601 bp, Human
agctgacaactaaaaacctgcacaaaggctgactccttagccctttccatcaaacgatatctgcaggctgaacgagcttaattacttgttggtttggttttttaatgtaacgaagtaaaaaccaggagcaaatgtgatacaggaaagcacaccaacagctacatacatggatagcaaaagaagccaaaaaaattattttttaaaatgtaagaactggaaaaacagaatgatctcagtttttttaaaaaagcaaagattcctatttttatagagaaattgctatattagtaaaagccaaatcagaggcaaaaataactgagtcatcaagaaaattacctcttatttggcacagtccatttttatgaaagtgctttatctatttcagaaacataaaatcaaatgtttgaattggttaaaacagaaaattatctgattgactaaaagagaaaatcctctgctcttcagaaaactcaaccatccagaaagtgctatcactgacatttatatctaacaacatggcaaatgaggttggtttcatattcaaccatttgctgtccccgaagctctctattaaggatctggctgatcagaaaacttaata

SEQ ID NO: 195427 - DNA, 601 bp, Human
agtgagctgagatcgtgccactgcactccggtctaggcaacagagcaagaccctgtctcaaaaaacaaacaaacaaaagaaccaagtaggaagaaatgtggccagttcctcctgggcagtgttgtacagaacacaccaaatttctacagtgactcctaccagacgtttcttgggaaagtaagcaaagtcctttcctgaaattctggtaaattttcataaaaatcaatacttccctaatttaacattcacattttagcttacagtataactagttatagaattgttcattaattctaattgwctttcgattatacaatctaatatctaatttccattttctatttctagtacataagcaaaagaaatgcccttttggtcttatggaaaacgtgtcctatttaataagacacaaatttgattcaaatttctctttctcctcctcccccttaataatacactaaaaataactgtaataacatcttacacatcctgaacgcctgtacctagcaacctcacttactcagactatagctgacaactaaaaacctgcacaaaggctgactccttagccctttccatcaaacgatatctgcaggctgaa

SEQ ID NO: 195428 - DNA, 601 bp, Human
ccttaatcctgggtagttttacctacccacaggcttgaattacatcctaacaaacagtaaaccacacttgctgggactccgtgggcccgagggctgcttaacagcttggcaggcatccccggcagccactgtgacccagctgccctacaggccattccaagctcccccaacaagggcacttttcaggtgaactcatacaaatgtgtgccgagcgatacccctgacttggaggggactccagctgaggtcagccctggagcaggccccccacgccctatggatacttccaagcccaacttakcaaatacagctggaggcgtccaacctcacccagttgttcaaggagggaccttgccccttcctttgcctttaaggatgaacagattttttttctacttagaaactcaatgtgttcctcttctatcctaaacactactgatgttcggtaatgcagacatgtttacatgctatttcttgttttaacaacatgaaaacaaaataaaaatgaactatgaactgatgacagtgtttgggagttgagctttttctgtggccaacgctgcttttaaaaacgttctatattaaggaagtgctgtgggaa

SEQ ID NO: 195429 - DNA, 601 bp, Human
agagagaattcatatactgtgtaattctctcgtttatagtttataattcagggaggtttcgcacacagagttgtgcaaccatcaccatagcccattcgagaacattttcatcaccccgaaaggaaaccccatccatacccatcggcggtcacctcccatttcccttcagtttccccagccctggccatcactaatctactttgtgtgtatggatttgcctgtagttctagagttcctagaaatggaatcatataaaacgtggcatttgggtttttgttttgttttgttttgagacagagattgctctgtcacccaggcaatctcagctcactgcaacctccacctcctgggctcaggtgatcctcccgcctcagcctcccgaggggctgggaccacaggtgcatgccaccatgcctggctaatttttgagttgacaggattttgacatgttgcccaggctggtctcgaactcctgggctcaagcgatcgaaacgtggcctttgtggtctggcttttttcactgggcatgttttcagtattcgtccacgttgtcacatgtatcagaactccattcctttttaaggctgaatcgtatgctatc

SEQ ID NO: 195430 - DNA, 601 bp, Human
tagagagaattcatatactgtgtaattctctcgtttatagtttataattcagggaggtttcgcacacagagttgtgcaaccatcaccatagcccattcgagaacattttcatcaccccgaaaggaaaccccatccatacccatcggcggtcacctcccatttcccttcagtttccccagccctggccatcactaatctactttgtgtgtatggatttgcctgtagttctagagttcctagaaatggaatcatataaaacgtggcatttgggtttttgttttgttttgttttgagacagagwttgctctgtcacccaggcaatctcagctcactgcaacctccacctcctgggctcaggtgatcctcccgcctcagcctcccgaggggctgggaccacaggtgcatgccaccatgcctggctaatttttgagttgacaggattttgacatgttgcccaggctggtctcgaactcctgggctcaagcgatcgaaacgtggcctttgtggtctggcttttttcactgggcatgttttcagtattcgtccacgttgtcacatgtatcagaactccattcctttttaaggctgaatcgtatgctat

SEQ ID NO: 195431 - DNA, 601 bp, Human
tccaaagcttcttcattctcccctaatcaaggtgctgctccttcttcaaatcctgccatcctaggagctcacctgaaccctattccattctgatactgcgccctacatcccaacaagttatgtcttttacctgcattctattaatgtgaaatccactctggctttcttggtgagcgtttctacatttacctgcacccctcatgaagcagggagtttcctcttttatggtgaggttttgttttgtatggagattcgtttgttctgtaacatctccttctttaagaacaaggaaggccgggcrcggtggctcacgtctgtcatcccagcactttgggaggctgaggcaggcagactggttgagaccaggagttcgagaccagcctggccaacacagcaaaaccctgtctctattaaaaatacaaaaaattagccacatgtggtggcacatgcctgtaatcccagcttcttgggaggccgagacatgagaattgtttgaacccaagaggtggatgctgtagtgagctatgatcacattgctgcactccagcctgggcaacagagcgagattccatctcaaaaagataaaaaaaaaaaaaaaaaa

SEQ ID NO: 195432 - DNA, 601 bp, Human
aggaactgtacacttaaactgctgaattgtgtgacatgtgaattacatctcaataaagctttcttttgtttgttttgtgtttttctttttgacacagggtctcaccctgtcacccaggctgggtgacaggtgaattacatctcaataaagctttcttttgtttgttttgttttgtttttgtttttgacacagggtctcaccctgtcacccaggctggaatgcagtggcacaatctcggctcacagcaacctccgcctcctgggttcaagtgattctcctgcctcagcctcccaagtagctrggattacaggcacccaccaccacgcccagctaatttttatatttttagtagagacagggttttaccatgttggccaggctggtctcgaactcctgacctcaagtgatctgcctgcctcagcctcccaaagtgctgggtttacaggcatgagccaccgggcccagcctcaataaagcattttttaaaaaatgaaatgttggctgggcacggtggctcacacctgtaatctcaacactctgggaggccaaggtgggggtattgcttgaggccaggagattgaaaccagactggacaacacag

SEQ ID NO: 195433 - DNA, 601 bp, Human
atacagcccacccgcagtaagtagctggagcagggtaagttcaccccaatggggcttccctcccctttccagtaactaaggaggatgtggcacatggccccgccttggccaaagggagctgagagatgtctgcttagtttccatgctagtaaaataagacatgcaggattggaaaagcccctcttctttactagatatcactgtgtcattcggaatggctgcagccactttgtgccacaagggaagacatctcccacgtggcaaagacagcagagagcaaagatgaaaagcacctggggtmctggaaatgtcatcacacctctgaattaatcaaccctggaactgccatacttcttgttacatgagatagtaaatgcgtttttttgtttgtttgttttaggtaattttagttaggttttcgttaactcacaacaaaaaccatcttaaccaatataacatgcttattttatcaaaacataaagtcttttttttagaaaaatcacctatacataagttttctgtttgtgtgggatacaaaagtgtctttccactagtgtggctataataaaaaagacgaacagcagcaagtgtttatggagac

SEQ ID NO: 195434 - DNA, 601 bp, Human
acccacgcatggacgcacacgcacacacaccatgcatgcgcacatacagcccacccgcagtaagtagctggagcagggtaagttcaccccaatggggcttccctcccctttccagtaactaaggaggatgtggcacatggccccgccttggccaaagggagctgagagatgtctgcttagtttccatgctagtaaaataagacatgcaggattggaaaagcccctcttctttactagatatcactgtgtcattcggaatggctgcagccactttgtgccacaagggaagacatctcccacrtggcaaagacagcagagagcaaagatgaaaagcacctggggtcctggaaatgtcatcacacctctgaattaatcaaccctggaactgccatacttcttgttacatgagatagtaaatgcgtttttttgtttgtttgttttaggtaattttagttaggttttcgttaactcacaacaaaaaccatcttaaccaatataacatgcttattttatcaaaacataaagtcttttttttagaaaaatcacctatacataagttttctgtttgtgtgggatacaaaagtgtctttccactagtgtg

SEQ ID NO: 195435 - DNA, 601 bp, Human
acgcacgcacacacatgcacacccacgcatggacgcacacgcacacacaccatgcatgcgcacatacagcccacccgcagtaagtagctggagcagggtaagttcaccccaatggggcttccctcccctttccagtaactaaggaggatgtggcacatggccccgccttggccaaagggagctgagagatgtctgcttagtttccatgctagtaaaataagacatgcaggattggaaaagcccctcttctttactagatatcactgtgtcattcggaatggctgcagccactttgtgccayaagggaagacatctcccacgtggcaaagacagcagagagcaaagatgaaaagcacctggggtcctggaaatgtcatcacacctctgaattaatcaaccctggaactgccatacttcttgttacatgagatagtaaatgcgtttttttgtttgtttgttttaggtaattttagttaggttttcgttaactcacaacaaaaaccatcttaaccaatataacatgcttattttatcaaaacataaagtcttttttttagaaaaatcacctatacataagttttctgtttgtgtgggatacaaa

SEQ ID NO: 195436 - DNA, 601 bp, Human
ccacacacctaccttccttaccagcagaagcctgattctgcttggggtatctcccttctacctgcttaggaaggagatgcacacacgcacacacacacatgcatgcatgcacacaggcacacccatgcaagcacgcacacacacatgcaggcacacccacgcatgcacgcacacatatatgcacacccatgcacacccatgcatgcatgcacacatatatgcacacccacgcatgcacgcacgcacacacatgcacacccacgcatggacgcacacgcacacacaccatgcatgcgcacayacagcccacccgcagtaagtagctggagcagggtaagttcaccccaatggggcttccctcccctttccagtaactaaggaggatgtggcacatggccccgccttggccaaagggagctgagagatgtctgcttagtttccatgctagtaaaataagacatgcaggattggaaaagcccctcttctttactagatatcactgtgtcattcggaatggctgcagccactttgtgccacaagggaagacatctcccacgtggcaaagacagcagagagcaaagatgaaaagcacctggggtcc

SEQ ID NO: 195437 - DNA, 601 bp, Human
aggttgcacgttgctcacagcagatcatgaagccatctccacctcctgctgtcaccatcctcagaaccagcagtggctccatggctccctgactccagaggagctggccgcacaggagaccctctgtcattcctgcagaacagctaatgctttgcagagctccagatgtaagtttaagaaatacgtttgttataaggtttcttaacaagacacatcagtgatatctaagactcttaacaggtgactattaaagaaataaatctcttccacatattaaaaccacattcatcctgacagtcayagcccagctcgaaagccttcgagagtgcttttacctcccaccacatcaaatctagatttcttcctttcatcctgacacccacatgttcaacatcacagcacatgcggggagcccccagggtgcaggaggggaggagggcgctgtgtctgcaggggcgtgtgggtaaaagcaagagagggtgtaacggtgggtggggggagggtgctgtgtctgcaggggcgtgtgggtaagagcaagaggggggcagcaggggaggagggcgctgtgtctgcagtggcgtgtgggtaagagcaagaaagg

SEQ ID NO: 195438 - DNA, 601 bp, Human
aatgtttttttaatcttctttttgcttatctgtcttttctaaaacaccaaaaacatgttttacttttataataaaaaattaataaaaataagatggtcaccccctttgccatctgcctaaacagagagcttcaaaagtcacacattccttaaagctgcagtatttacaaaggaaagaaaaaccttcaagcaatctaaaaagctcaaacaggaaatgattaaactatggcatattaattcaaagaaatactatattatgtagatgcacaggaaaatccccatgaaatagcaacagaaaactsaaacacaaaatgaccaacatcaattttaacaaagaaaaaaattaccacctgtacctaagaatttaaagaagttaacagaggtaatttttcttttctttactttttttttgagacagtcttgctctgttgcccaggctctagtgcagtggcatgctcttggttcactgcaacctccatctcccaggctcaagtgattctcctgccttagcctcccgagtagctgagactacaggcgtgcgccaccacacccgattaatttttgtatatatatatacattttttgatagagatggggttttg

SEQ ID NO: 195439 - DNA, 601 bp, Human
aatggtgttaatggtgtttaatggtgttaatggtgtttcatatgacaccattatatctatatatatttatatgcattgatatatatttgattttgaataaatatttgatatatatcgtatatgcactgaaaaagtctaaaaacctcatgttgaaacattcaaaatggctatctctagttggtaaatgtttttttaatcttctttttgcttatctgtcttttctaaaacaccaaaaacatgttttacttttataataaaaaattaataaaaataagatggtcaccccctttgccatctgccwaaacagagagcttcaaaagtcacacattccttaaagctgcagtatttacaaaggaaagaaaaaccttcaagcaatctaaaaagctcaaacaggaaatgattaaactatggcatattaattcaaagaaatactatattatgtagatgcacaggaaaatccccatgaaatagcaacagaaaactcaaacacaaaatgaccaacatcaattttaacaaagaaaaaaattaccacctgtacctaagaatttaaagaagttaacagaggtaatttttcttttctttactttttttttgagacagt

SEQ ID NO: 195440 - DNA, 601 bp, Human
ttaagtggaaaggtattcatgatccatgaatggtgtttaatggtgttaatggtgtttaatggtgttaatggtgtttaatggtgttaatggtgtttcatatgacaccattatatctatatatatttatatgcattgatatatatttgattttgaataaatatttgatatatatcgtatatgcactgaaaaagtctaaaaacctcatgttgaaacattcaaaatggctatctctagttggtaaatgtttttttaatcttctttttgcttatctgtcttttctaaaacaccaaaaacatgtttyacttttataataaaaaattaataaaaataagatggtcaccccctttgccatctgcctaaacagagagcttcaaaagtcacacattccttaaagctgcagtatttacaaaggaaagaaaaaccttcaagcaatctaaaaagctcaaacaggaaatgattaaactatggcatattaattcaaagaaatactatattatgtagatgcacaggaaaatccccatgaaatagcaacagaaaactcaaacacaaaatgaccaacatcaattttaacaaagaaaaaaattaccacctgtacctaaga

SEQ ID NO: 195441 - DNA, 601 bp, Human
tataatgcaaagtgctgccaattaaactatgacataccattaaattatacaatgcatcctgatgtgagggatggctggattattaacagtttcatattgtgatatacaatgattcaaagctggaaacaatctacatttccaacaagagatatttcctgaataaattatagtacatccccagaataaaatctaagtcatttaaaatgatgatacagatgtatgtacagacttggccaggcatggtggctcacgcatgtaatcccagcactttgggaggccaaggtgggtggatcacctgagstcaggagttggagaccatcctggccaacatgttgaaaccccgtctctactaaaaatacaaaaattagctgggtgtggtggcggacgcctgtagtcccagctactggggagtctgaggcaggagaatctcttgaacccgggaggcagaggttgcagtgagccgagatcatgcccctgcacttcagcctggatgacagagcaagactctgtctcaaaaaaataaaataaaataaaataaacaaagatgtacatacagatttaagtggaaaggtattcatgatccatgaatggtgtttaatgg

SEQ ID NO: 195442 - DNA, 601 bp, Human
taaccatgatactaaaggtagaaaccataaacaatgattgatagataagaccaacataaagattttaaatttccacatatcaagaaatatcacgattgaaagacaaattagaaaatgggaggcattttacaacatatatggaagacaaagatttaagatacttacataaataaagaactttcacaaatcaataaggaaaagacaaccaattcacaagcaactcatgaagaaatacaaaagggcaacacacatatgaaaaagagatttggccccactactaattatcgtgggcaaagacaayggcaaataaggatattcatcacactgttataattgacaatattatatttcatcgagtctaagatgccaatgatgatgtttcattactttttgttctattaaaatataatgcaaagtgctgccaattaaactatgacataccattaaattatacaatgcatcctgatgtgagggatggctggattattaacagtttcatattgtgatatacaatgattcaaagctggaaacaatctacatttccaacaagagatatttcctgaataaattatagtacatccccagaataaaatctaagtca

SEQ ID NO: 195443 - DNA, 601 bp, Human
gtctcaaaaaaagaaaaaaaaaaaaaaaaaaaaacataaaagtattagaagaaaatataggttaatattttacatagttctcaggtggggaaggcttttctaaccatgatactaaaggtagaaaccataaacaatgattgatagataagaccaacataaagattttaaatttccacatatcaagaaatatcacgattgaaagacaaattagaaaatgggaggcattttacaacatatatggaagacaaagatttaagatacttacataaataaagaactttcacaaatcaataaggaaaasacaaccaattcacaagcaactcatgaagaaatacaaaagggcaacacacatatgaaaaagagatttggccccactactaattatcgtgggcaaagacaacggcaaataaggatattcatcacactgttataattgacaatattatatttcatcgagtctaagatgccaatgatgatgtttcattactttttgttctattaaaatataatgcaaagtgctgccaattaaactatgacataccattaaattatacaatgcatcctgatgtgagggatggctggattattaacagtttcatat

SEQ ID NO: 195444 - DNA, 601 bp, Human
gtgagaccctgtctcaaaaaaagaaaaaaaaaaaaaaaaaaaaacataaaagtattagaagaaaatataggttaatattttacatagttctcaggtggggaaggcttttctaaccatgatactaaaggtagaaaccataaacaatgattgatagataagaccaacataaagattttaaatttccacatatcaagaaatatcacgattgaaagacaaattagaaaatgggaggcattttacaacatatatggaagacaaagatttaagatacttacataaataaagaactttcacaaatcartaaggaaaagacaaccaattcacaagcaactcatgaagaaatacaaaagggcaacacacatatgaaaaagagatttggccccactactaattatcgtgggcaaagacaacggcaaataaggatattcatcacactgttataattgacaatattatatttcatcgagtctaagatgccaatgatgatgtttcattactttttgttctattaaaatataatgcaaagtgctgccaattaaactatgacataccattaaattatacaatgcatcctgatgtgagggatggctggattattaac

SEQ ID NO: 195445 - DNA, 601 bp, Human
aaggtgggaggattgcttgaactcagaagtttgagaccagactgggcaatataatgagacctccatctctacaaaatacttaaaaattagccaggtgtggtggtgtacacctgtagtcccagctacttgggaggctgaggtgggaagatcacctaagcctaggaggtcaaagctgcagtgagatcacaccactgcactccagcctgcctagagtgagaccctgtctcaaaaaaagaaaaaaaaaaaaaaaaaaaaacataaaagtattagaagaaaatataggttaatattttacatagtyctcaggtggggaaggcttttctaaccatgatactaaaggtagaaaccataaacaatgattgatagataagaccaacataaagattttaaatttccacatatcaagaaatatcacgattgaaagacaaattagaaaatgggaggcattttacaacatatatggaagacaaagatttaagatacttacataaataaagaactttcacaaatcaataaggaaaagacaaccaattcacaagcaactcatgaagaaatacaaaagggcaacacacatatgaaaaagagatttggccccactact

SEQ ID NO: 195446 - DNA, 601 bp, Human
gaactgcaagcaactcaaatattcatcaactgataaactgattttttaaaatggtggtatatccagtccaggcacaatggttcatgcttgttatcccaacactttgggaggccaaggtgggaggattgcttgaactcagaagtttgagaccagactgggcaatataatgagacctccatctctacaaaatacttaaaaattagccaggtgtggtggtgtacacctgtagtcccagctacttgggaggctgaggtgggaagatcacctaagcctaggaggtcaaagctgcagtgagatcacrccactgcactccagcctgcctagagtgagaccctgtctcaaaaaaagaaaaaaaaaaaaaaaaaaaaacataaaagtattagaagaaaatataggttaatattttacatagttctcaggtggggaaggcttttctaaccatgatactaaaggtagaaaccataaacaatgattgatagataagaccaacataaagattttaaatttccacatatcaagaaatatcacgattgaaagacaaattagaaaatgggaggcattttacaacatatatggaagacaaagatttaagatacttaca

SEQ ID NO: 195447 - DNA, 601 bp, Human
tccaattttttaaaatgagatataaaaactgaaaaggaggggattttaaatttatatgattttctgccaagaaaaatctaaggctatctgatttttaaaaatcagacacaggccaggcgcggtgactcacacctgtaatcccaacactttggaaggctgaggtgggtggattacttgaggtcaggagtttgagaccagcctggccagcatggcaaaacgccatctctactaaaaatacaaaagaaattagccaggcgtggtggtgcacacctgtaatcctagtacttgggagtcttcggcggaattgcttgaacccaggaggcagaggtggtagtgagccaagatggtgccactgcactccagcctgggcaataaagtgagactctgcttcagaaaaaaaaaaaaaaattcagacacaataagcattcaattaagtgtccagttacaaagaaaaataacatgttcagcttcatagtttcttataaagttaaacacactcatcatacaacccagtcactccactcctatgcatttaaccgaaacaaataaaaatatacatccacggaagacttgtgaatgttcacagcaactctattcataa

SEQ ID NO: 195448 - DNA, 601 bp, Human
ctgaagaaggagaatcgcttgaacctcagaggtggacgttgcagtgagccgagatcacgccattgcattccagcctgggggacaaggttgagacttcgtctcaaaaaaaaaaaaaaaagaatcagcctcctttctgtacacgctttccacagctagcatgcggactcactggactacagggtgtaagatgaggccaactgtaagccctatacagggaagttacagttttgttcaaaactcactcacaattgggaacagcctgagaccatgcctgcatggaacagcacagccttgtcccccyccgaggacacttcctgtgacatctggagagatgagcagattcacgaggcccaggagggttttcaggtggtctttctggctgtagagagatcaaacacacccttccccaacgtcctttaggagtaaatgaccaatttagcaacaatgagcactcaagaagtacgccagcattctctttattatgattatttcctgcacattacatcatgccttcttttcttacagcgggaaaacacccacacacacgcacacaggtatatgcacacacacacatcaaaagttactgtaactcctaagcaga

SEQ ID NO: 195449 - DNA, 601 bp, Human
attaaggagccattaattagtttcaaagagaaccaaatggcatcaataattttttttttagacaaggtcttgctctgttgcccaggctgcagtgcatcaataattaagaatcagcctcctggctgggggcggtggctcacgcctgtaatcccagcactttgggaggccaagggaggaggatcacctgaggtgaggagtccgagaccagcttggccaacatggtgaaaccccgtctctactaaaaatacaaaaattagccgggcatggtggcaggcacctgtaatcccagctactcaggggrctgaagaaggagaatcgcttgaacctcagaggtggacgttgcagtgagccgagatcacgccattgcattccagcctgggggacaaggttgagacttcgtctcaaaaaaaaaaaaaaaagaatcagcctcctttctgtacacgctttccacagctagcatgcggactcactggactacagggtgtaagatgaggccaactgtaagccctatacagggaagttacagttttgttcaaaactcactcacaattgggaacagcctgagaccatgcctgcatggaacagcacagccttgtccccc

SEQ ID NO: 195450 - DNA, 601 bp, Human
gcaaatctacaactccttccacttaaaaattcaacaaaataagagatttagatttttgcatttttgtgtgcccaaagaaaaaggctccagttttctgtttcgtgttccatcagcttacataacctaactcgtcccacacaaagacagacgaatgatttttcttgcagatgaaatattcccaagctctcacctctaaggtctaagtggatcttgtgataaccagcacaaagtgaggctggggatttgaaaagaaaataccagaaatggttaccaaaaactgacaagagcacccaaacagcawctgtgatcgctagaagatgcactgacaaattaaggagccattaattagtttcaaagagaaccaaatggcatcaataattttttttttagacaaggtcttgctctgttgcccaggctgcagtgcatcaataattaagaatcagcctcctggctgggggcggtggctcacgcctgtaatcccagcactttgggaggccaagggaggaggatcacctgaggtgaggagtccgagaccagcttggccaacatggtgaaaccccgtctctactaaaaatacaaaaattagccgggcatggtggca

SEQ ID NO: 195451 - DNA, 601 bp, Human
ttagtgcccaatttctcaggtttatgcctagttgctaatctgtgacatctctgttagaaaagctaacaagagcctaaaagaaaaattcaagtcagctccaggactgatggtggcaaatctacaactccttccacttaaaaattcaacaaaataagagatttagatttttgcatttttgtgtgcccaaagaaaaaggctccagttttctgtttcgtgttccatcagcttacataacctaactcgtcccacacaaagacagacgaatgatttttcttgcagatgaaatattcccaagctctcrcctctaaggtctaagtggatcttgtgataaccagcacaaagtgaggctggggatttgaaaagaaaataccagaaatggttaccaaaaactgacaagagcacccaaacagcaactgtgatcgctagaagatgcactgacaaattaaggagccattaattagtttcaaagagaaccaaatggcatcaataattttttttttagacaaggtcttgctctgttgcccaggctgcagtgcatcaataattaagaatcagcctcctggctgggggcggtggctcacgcctgtaatcccagcacttt

SEQ ID NO: 195452 - DNA, 601 bp, Human
accatcacacctgtgaacagccactgtactgcagcctgtgcaacacagcaagacccccgtcttacaaaacaaaaatgcaaaacaaaattagtgcccaatttctcaggtttatgcctagttgctaatctgtgacatctctgttagaaaagctaacaagagcctaaaagaaaaattcaagtcagctccaggactgatggtggcaaatctacaactccttccacttaaaaattcaacaaaataagagatttagatttttgcatttttgtgtgcccaaagaaaaaggctccagttttctgtttcrtgttccatcagcttacataacctaactcgtcccacacaaagacagacgaatgatttttcttgcagatgaaatattcccaagctctcacctctaaggtctaagtggatcttgtgataaccagcacaaagtgaggctggggatttgaaaagaaaataccagaaatggttaccaaaaactgacaagagcacccaaacagcaactgtgatcgctagaagatgcactgacaaattaaggagccattaattagtttcaaagagaaccaaatggcatcaataattttttttttagacaaggtcttgc

SEQ ID NO: 195453 - DNA, 601 bp, Human
taaattttaagtctggaagagttcataggggttctattatcctgaaatgcatcgctgttatttctttaagtgacagatatctagttaatgaggagaaaaggcaggcacaaaagcacaacgtgatgacagagcaaatgcaaaataacagctgggtggcgtagcacatgcctgtggtcccagctacttgggaggctgaggtgggaggatcacttgagcccacgagttcgaggctgcagtgcgctaccatcacacctgtgaacagccactgtactgcagcctgtgcaacacagcaagacccccrtcttacaaaacaaaaatgcaaaacaaaattagtgcccaatttctcaggtttatgcctagttgctaatctgtgacatctctgttagaaaagctaacaagagcctaaaagaaaaattcaagtcagctccaggactgatggtggcaaatctacaactccttccacttaaaaattcaacaaaataagagatttagatttttgcatttttgtgtgcccaaagaaaaaggctccagttttctgtttcgtgttccatcagcttacataacctaactcgtcccacacaaagacagacgaatgattttt

SEQ ID NO: 195454 - DNA, 601 bp, Human
ataaattttaagtctggaagagttcataggggttctattatcctgaaatgcatcgctgttatttctttaagtgacagatatctagttaatgaggagaaaaggcaggcacaaaagcacaacgtgatgacagagcaaatgcaaaataacagctgggtggcgtagcacatgcctgtggtcccagctacttgggaggctgaggtgggaggatcacttgagcccacgagttcgaggctgcagtgcgctaccatcacacctgtgaacagccactgtactgcagcctgtgcaacacagcaagaccccygtcttacaaaacaaaaatgcaaaacaaaattagtgcccaatttctcaggtttatgcctagttgctaatctgtgacatctctgttagaaaagctaacaagagcctaaaagaaaaattcaagtcagctccaggactgatggtggcaaatctacaactccttccacttaaaaattcaacaaaataagagatttagatttttgcatttttgtgtgcccaaagaaaaaggctccagttttctgtttcgtgttccatcagcttacataacctaactcgtcccacacaaagacagacgaatgatttt

SEQ ID NO: 195455 - DNA, 601 bp, Human
taatcccagcactttgggaggtagaggtgggaggagcacttgaggccaggagttcaagaccacgctgggcaacatagtgaggatctgcctccgcaaaaaaaaaaaaacaaaatttaaattaaaaaaacaattagccgggcatggtggtgtatgcctatattcccagctacttgggcgacagaggcgggtgggtcgcttgagcccaggaggtcgaggcttcagtgagctacgatcatgccattgtaccccagtctggatgacagggcaatacccagtggcaaaaaaaaaaaaaaaaaaaaaaagaaaacacactagcaaattgtctacaaagtggaaggttaaaaagtgatcgaggggaaaaaaaagcagttcggtatttctttacatagacaattcaaaaggttgttctgaatctcacaaagatttattgaaagttgttacacttttaagtactactttatggccgggtatagtggctcacacctgtaatcccaatacttttgagaggctgaggcaggaggatcgcttgagcccaggagttcaaggccagcctgggcaacatggtgagaccccgtctccacaaaaaaatagaaaaattagc

SEQ ID NO: 195456 - DNA, 601 bp, Human
tttggaggcatactgataaaaaatgtactttgtaaatttcgggcaatcacttaaaataagtgagaaaaaatatataagaaataaatcgatagaagagataaaaatagaatcatgacaaaaatctggctgggcacagtggctcatgcctgtaatcccagcactttgggaggtagaggtgggaggagcacttgaggccaggagttcaagaccacgctgggcaacatagtgaggatctgcctccgcaaaaaaaaaaaaacaaaatttaaattaaaaaaacaattagccgggcatggtggtgtaygcctatattcccagctacttgggcgacagaggcgggtgggtcgcttgagcccaggaggtcgaggcttcagtgagctacgatcatgccattgtaccccagtctggatgacagggcaatacccagtggcaaaaaaaaaaaaaaaaaaaaatagaaaacacactagcaaattgtctacaaagtggaaggttaaaaagtgatcgaggggaaaaaaaagcagttcggtatttctttacatagacaattcaaaaggttgttctgaatctcacaaagatttattgaaagttgttacacttttaagta

SEQ ID NO: 195457 - DNA, 601 bp, Human
ggatagtagctaccatattgtatagtctagatataaaacatttccatcattgcaggaagtttcatcaaacggcattgctctaaaaggtaattttctgtaaaaataacatgttatgaggtttataatatatataaaatacattattatgacactattagcatcataaacatttacaaggttctcatagaaccttgtagtaacttacagttatgaagaattcttacgaggttcttatataataaatggtataatatttggaggcatactgataaaaaatgtactttgtaaatttcgggcaatsacttaaaataagtgagaaaaaatatataagaaataaatcgatagaagagataaaaatagaatcatgacaaaaatctggctgggcacagtggctcatgcctgtaatcccagcactttgggaggtagaggtgggaggagcacttgaggccaggagttcaagaccacgctgggcaacatagtgaggatctgcctccgcaaaaaaaaaaaaacaaaatttaaattaaaaaaacaattagccgggcatggtggtgtatgcctatattcccagctacttgggcgacagaggcgggtgggtcgcttg

SEQ ID NO: 195458 - DNA, 601 bp, Human
aaattcagttgttttcaggtactcaatggtcacacatggatagtagctaccatattgtatagtctagatataaaacatttccatcattgcaggaagtttcatcaaacggcattgctctaaaaggtaattttctgtaaaaataacatgttatgaggtttataatatatataaaatacattattatgacactattagcatcataaacatttacaaggttctcatagaaccttgtagtaacttacagttatgaagaattcttacgaggttcttatataataaatggtataatatttggaggcakactgataaaaaatgtactttgtaaatttcgggcaatcacttaaaataagtgagaaaaaatatataagaaataaatcgatagaagagataaaaatagaatcatgacaaaaatctggctgggcacagtggctcatgcctgtaatcccagcactttgggaggtagaggtgggaggagcacttgaggccaggagttcaagaccacgctgggcaacatagtgaggatctgcctccgcaaaaaaaaaaaaacaaaatttaaattaaaaaaacaattagccgggcatggtggtgtatgcctatattc

SEQ ID NO: 195459 - DNA, 601 bp, Human
ctgtaatcccagtgctttcgaagaccaaggcaggaggatcgcttgagtccaggagttcaagtccagcctgggcaacatagagagatcctttctctttaaaaagaaaaaagcgaagtgcagtggctcacacctgtaatcctatcactttgggaggccgaggcaggaggactacttgaccccaggagttccagaccagcctgagtaacataagaccccatctacacacaaaaatacataaaaatgagctgggtgtgatgatgcatgcatgtagtcctagctactcaggagtctgagatgggargattactttgagcccagaaggtcaaggcttcagtgagccatgatcagaccactgcactccagtcttggcaacagagagagtctccgtctcaaaaaataaaataataataataataaaaaccaagataaataatataaccacaacttttcttgacccatcaaagaggcggggttacaaagtaaccaagtagtagccaggcgtggtggctcacacctgtaatcccggcactttgggaggcccaggtgggcagatcacttgaggccaggagttcgaggccagcctggccaatatggtaatatc

SEQ ID NO: 195460 - DNA, 601 bp, Human
atttttagaaacctggaatgtcattccacctaacagaaattaaaactggctgggcctggtggctcacacctgtaatcccagtgctttcgaagaccaaggcaggaggatcgcttgagtccaggagttcaagtccagcctgggcaacatagagagatcctttctctttaaaaagaaaaaagcgaagtgcagtggctcacacctgtaatcctatcactttgggaggccgaggcaggaggactacttgaccccaggagttccagaccagcctgagtaacataagaccccatctacacacaaaaayacataaaaatgagctgggtgtgatgatgcatgcatgtagtcctagctactcaggagtctgagatgggaggattactttgagcccagaaggtcaaggcttcagtgagccatgatcagaccactgcactccagtcttggcaacagagagagtctccgtctcaaaaaataaaataataataataataaaaaccaagataaataatataaccacaacttttcttgacccatcaaagaggcggggttacaaagtaaccaagtagtagccaggcgtggtggctcacacctgtaatcccggcacttt

SEQ ID NO: 195461 - DNA, 601 bp, Human
ttctccaaattatgacctggaaaaaaaacttgcagctagtaactggaaaactgggtaacatatatttataaaagacaaacacacatgtatttcttatatgtggcttttctctaccagtaaagaataggatgtggatgaaagtttcaaataatattatgttataaaccttatataattactgaactcaacaaaacttttgaaaaataaccaagtagaagttatttttagaaacctggaatgtcattccacctaacagaaattaaaactggctgggcctggtggctcacacctgtaatcccastgctttcgaagaccaaggcaggaggatcgcttgagtccaggagttcaagtccagcctgggcaacatagagagatcctttctctttaaaaagaaaaaagcgaagtgcagtggctcacacctgtaatcctatcactttgggaggccgaggcaggaggactacttgaccccaggagttccagaccagcctgagtaacataagaccccatctacacacaaaaatacataaaaatgagctgggtgtgatgatgcatgcatgtagtcctagctactcaggagtctgagatgggaggattactttga

SEQ ID NO: 195462 - DNA, 601 bp, Human
ttttagaaaattttctctgccttaaaaagtatataatgcggccaggcatggtggctcacacttgtaatcccagcactttgggaggctgaggcaggtggatcacttgagggcaggagtttgagaccagtctgcccaagatggtgaaaccctgtctctactaaaagtacaaaaaaattagccaggcgtggtggcacatgcctgtaatcccagccactcaggagggtgaggcacaagaattgcttgaacccgggaggcaaaggttgcagtgagttaagattgcgctactgcactccagcctcgrcaacagagtgagactctgtctcaaaaaaatatgtatgtgtgtgtatgtgtgtgtgtgtgtgtgtgtgtgtacttttaaggcattctcttttgtacttttaaaattactagtaaggacatacatttccatatcactcactgtttgttgtatagaaaataagctttatcgttataattttcacgcatatatttttctccaaattatgacctggaaaaaaaacttgcagctagtaactggaaaactgggtaacatatatttataaaagacaaacacacatgtatttcttatatgtggcttttc

SEQ ID NO: 195463 - DNA, 601 bp, Human
ggttaagggaaaaaccgtggcaataattttttttttcctctttcacttttgggatttgaggtcttcaaataagtttttctaattgtagggaaaacaaagtcttttaataattaccattaatgatttataatttaagcagtttaggaaataaaaaatgcatagaacatgatattctcatacccagacaagctcatatcccacctgcacccctttacagtcaaggatgattttgcatctcctttcctcacttaagtgccttttttgccaactaggataactcatataatgaatttttgccaastaggaaaactcatataatggctttttttaaatctggtttttctaataataaaatcatatctgttgcaaaaaaaaaacaaagcaaaaaaaatattagtacaagttcctctaatcccactgtaaagaacacgcgctatatataaatttgtatatatccttcaatgcatgtattattatctctctagacccacattattaaacacgctattttatggaaaatgagatcatgttttacatatggtacagttgcttgcttttttcaattcacagttcatggccgggcacggtggctcacacctgt

SEQ ID NO: 195464 - DNA, 601 bp, Human
tgtggtgactgaactaactctatgttgcacttttggtgaaaaactgcaacatagaatttaattaattctttaattaaatgggttaagggaaaaaccgtggcaataattttttttttcctctttcacttttgggatttgaggtcttcaaataagtttttctaattgtagggaaaacaaagtcttttaataattaccattaatgatttataatttaagcagtttaggaaataaaaaatgcatagaacatgatattctcatacccagacaagctcatatcccacctgcacccctttacagtcawggatgattttgcatctcctttcctcacttaagtgccttttttgccaactaggataactcatataatgaatttttgccaactaggaaaactcatataatggctttttttaaatctggtttttctaataataaaatcatatctgttgcaaaaaaaaaacaaagcaaaaaaaatattagtacaagttcctctaatcccactgtaaagaacacgcgctatatataaatttgtatatatccttcaatgcatgtattattatctctctagacccacattattaaacacgctattttatggaaaatg

SEQ ID NO: 195465 - DNA, 601 bp, Human
cctattttccctaatggaataatacttactacttggaaagcatcattcatctcctctcaagatcctcacagcaacaccatgttgccagaagggcaggtgcgaaatctgaaataatggcagaagtcgaatgtcgcacgtcaatgtacagcctcccatcgaggcccatggctttatttttatgtatttatttatttattgagacggagtctcactctgtcacccaggctgcagggcaatggcgctattttggctcactgcaacctccacctcccggatttaagcaattctgcctcagcctccygaacagctgggattacaggcatgagccaccacacctggctaatttttgtatttttagtagaggcggggtttcgccatgttggccaggctgatctcgaactcctgacctcaggtgatctgcccgcctcggcctcccaaagtcctgggattacaggcgcccactgccacacccggctcagttttgtatttttagtagagactgggtctcaccatgttggacaggctggtctcgaactcctgacctcaggtgatctgcccgccttggcctcccaaagtgctgggattacaggcgtgagcctcc

SEQ ID NO: 195466 - DNA, 601 bp, Human
actgagtacaaatgagtggtgctctaagatcaaagcaccagggtctttaaaatgatcttcactctccccgcaacctgccccgaacacgtgcatgctcctttcactttcaattccaaactgcacccttctaacgctggccgaaagggaaagtaagccctgttttcgtttcctttcaaatacttgatgctttccaattttattcctattttccctaatggaataatacttactacttggaaagcatcattcatctcctctcaagatcctcacagcaacaccatgttgccagaagggcaggtgygaaatctgaaataatggcagaagtcgaatgtcgcacgtcaatgtacagcctcccatcgaggcccatggctttatttttatgtatttatttatttattgagacggagtctcactctgtcacccaggctgcagggcaatggcgctattttggctcactgcaacctccacctcccggatttaagcaattctgcctcagcctcccgaacagctgggattacaggcatgagccaccacacctggctaatttttgtatttttagtagaggcggggtttcgccatgttggccaggctgatctcgaac

SEQ ID NO: 195467 - DNA, 601 bp, Human
acctgagagttgattatactactctcttcacttttgtttatgtttgaaatcatccataataaagtgttgttttttgtttttgagagacagggtctcactctgtcactcgggctggagtacaatggcacaatcagagctcactgcagcctcagtttcctgggctcaagcaatcctcccacctcagtctccccattagctgggactccaggtgggtaccactatgcccagctaatttttttaatttatttgtttatagagacagggtctcaccatgttgcccaggctggtctcaaactcctgractcaagcaatcctcccacctggacctcccaaagtgctgggatcacaggcatgagccactacatttggccagcaacgtggtttttgtttgcttacaaaaaaaaaagaagactacacaaaagaaaaaaatgtacaactaattcaagggctgccttaattattcctcactctttaccctcggcccacatcatttccctacaggctgatccttgcccagtccactcctgattcatggctggtgaataggtgagggaggaaaatggagagagcgaatacacagagtgacagagggaggagaagt

SEQ ID NO: 195468 - DNA, 601 bp, Human
aaaagacacagattggaaaacaagtaaaactcttcatattcactagctctatatatagaaaatcttcaggagtctacaaaaaactactagaactaataagcaagtttaacatgttcataagatacaaaatcaatatcaggaaatcaactgttttgtgtataccagcaatgaacaatccaaaaacaaaattaagaaataattccatttgtaatagcatcaaaattagtaagttaaaattacaaaactttgttgatacattaaataatatctaaataaatgtaaggagataccaggttcttgsattgaaggactcagtattgttaagatggcatttcttcccaaattgatcaacagattcaacaagacccagcaagctttttgtagaaattaacaagaaaggttatgagtgggtaactgaagctgggtaacgtgtacctgagagttgattatactactctcttcacttttgtttatgtttgaaatcatccataataaagtgttgttttttgtttttgagagacagggtctcactctgtcactcgggctggagtacaatggcacaatcagagctcactgcagcctcagtttcctgggctcaagc

SEQ ID NO: 195469 - DNA, 601 bp, Human
aatagttaaacagaaaatcagcaaggatatacagactttgaacagcattgtcaaccaacctgacgtaactaacatctgtagaccatgtcaagcaacaacaaatagaatatatattcttttcaagtgtacatatcgcattgtctagaatgaatcatgggctaggtcataaaacaagtatcaataaatttaaaagaattaaaatcatataaagcatgttctctaccaaaatgaaatttttaaaaatcaagaacagaaataaatttgtggactccccaactacttagaaattagaaaacatatmtaaaggattcaaaggtcaaagaagaaatcacaagggaagtttaaaaatacttcaaactggatgaaaagaaaaacacagcagatcaaaatttaggatgcagctatgagaagtacttagggagaaatttataatgttaaaagcctgtatcaggaaaaaaaaaagaaaagtctcaagttaataaactgagcatcagcagggaacagtggctcacacctgtaatctcaacactttggaaggccaagctgggacgatcgctcaagcccaggagttgaagaagagccttggtaatatagtgagacc

SEQ ID NO: 195470 - DNA, 601 bp, Human
catctcaagaattaaaaaataaaatgaagaagaaaaatgaccaaatcttgagttagagcggtggtgttctgtgatgctttggcttgaggggctcccctccttcccctcagctcacccatgctgctacatctaccagggtgggacgagctgtgaaaattggtggctccactgctggaggggttgacttgatttggaggagagcacatgcccaaaggcactgacataaaccacggtgatttcctgtaaacaacaggaaatgtacagaaggtcaacatctcagccaccctgagcctgcaatgcyggttgtggcaaccaacagatcaggagaccagccaaaaacctagccggaagatacagagaataagggagctatcacgggcagtggtaaagtccctgaagtcccacacattcttcgtgctctggaaggctgcacacaggcaggaaagactgaagagggccctggttatccactcatccttggctaaagtgaggcctaccccacgcacaaaggaggccagaaaaggcctggcaaaaaggaaaaaccaagacaggctcgtataatatatgcctgaattctgaacatgtccctaaacgtacacac

SEQ ID NO: 195471 - DNA, 601 bp, Human
gaaaaacaaaaaagtcagcctggcgtggtgatgcacacctgtagtctcagccactcaggaggctgaggtgggaaaatctcttgagcctgggagcttgaggttacagtgaactatgattgtgccactgcacgccagcttgagtgacagaggaaggcctcatctcaagaattaaaaaataaaatgaagaagaaaaatgaccaaatcttgagttagagcggtggtgttctgtgatgctttggcttgaggggctcccctccttcccctcagctcacccatgctgctacatctaccagggtgggaygagctgtgaaaattggtggctccactgctggaggggttgacttgatttggaggagagcacatgcccaaaggcactgacataaaccacggtgatttcctgtaaacaacaggaaatgtacagaaggtcaacatctcagccaccctgagcctgcaatgccggttgtggcaaccaacagatcaggagaccagccaaaaacctagccggaagatacagagaataagggagctatcacgggcagtggtaaagtccctgaagtcccacacattcttcgtgctctggaaggctgcacacaggcaggaa

SEQ ID NO: 195472 - DNA, 601 bp, Human
gtgctagaacctggaaggcagaggctgcagtgagccgagatcatgccactgcactccagcctgggcgacacagcgagaatccatcgcaaaaaaaaaaaaaaagaaaaaaaaagaaggaaagaaagttagaagaaaaaaccaaaaagatgacctggggagaggggaagaacttctggaataatgaagtgagaagcttggcaaaacctctcctcaaaaagtaacaacaaaactagacaagtcggtcaaaaacaaccaccacagggttggaaatcaaccaaagacatacaaaaaattgaaaaaygtttattcaagaaaaactacgcagctgggcatggtggctcccacctgcaattgtagcactttgggaggccgaggcaggaggattgcttgaggctgggagtcagagaccagcctgggcaacatatcaagaccccgtctcaacgaaaaacaaaaaagtcagcctggcgtggtgatgcacacctgtagtctcagccactcaggaggctgaggtgggaaaatctcttgagcctgggagcttgaggttacagtgaactatgattgtgccactgcacgccagcttgagtgacagaggaaggcctca

SEQ ID NO: 195473 - DNA, 601 bp, Human
aaaattagctggtggcgggtgcctgtaatcccagcaacctgggaggctgaggcaggagaagtgctagaacctggaaggcagaggctgcagtgagccgagatcatgccactgcactccagcctgggcgacacagcgagaatccatcgcaaaaaaaaaaaaaaagaaaaaaaaagaaggaaagaaagttagaagaaaaaaccaaaaagatgacctggggagaggggaagaacttctggaataatgaagtgagaagcttggcaaaacctctcctcaaaaagtaacaacaaaactagacaagtckgtcaaaaacaaccaccacagggttggaaatcaaccaaagacatacaaaaaattgaaaaatgtttattcaagaaaaactacgcagctgggcatggtggctcccacctgcaattgtagcactttgggaggccgaggcaggaggattgcttgaggctgggagtcagagaccagcctgggcaacatatcaagaccccgtctcaacgaaaaacaaaaaagtcagcctggcgtggtgatgcacacctgtagtctcagccactcaggaggctgaggtgggaaaatctcttgagcctgggagcttgag

SEQ ID NO: 195474 - DNA, 601 bp, Human
gccaaggtggcaagatcacttgaggtcaggggttcaaaaccaccctggccaacacggtaaaacccccgtctctactaaaaatacaaaaattagccaggcatggtggcgtgcacctgtagtaccagctactcaggaggctgaggcaggagaatcacttgaacctgggaggcagaggttgcagtgagccaagatcgccccactgcactccagcctgggaaacagagaaactcttgtctccaagaaaaaaaaaaaaaaaagaagaagaattgaaatttgaactccaagcaatgtgacaccagakctcaggcccggaaccccatgctacactgactcttgttgagagaacactccaagatgtaatcatgcctacaatgacgttgcagggggaagtgactgatccactactttcctggagaacctgggaaggtatgtgtgatcaggaggataaaaggccagggaacaagaaaactgcagagaggagacccagcaggcaagatgctgcaaaaggtgcagcggaactgagtccaccgaggagctaaaaatccctccgtcttagaattctgtccttgccaggaaagggctcctcatctcctgattgcta

SEQ ID NO: 195475 - DNA, 601 bp, Human
aggagtgatttcttgttcattctgaataaggatgacgacaccaggaagcggaggcccggggagcatttacggcgtgttctcgatgtgtgagcactgtggccagcacgttccaacccagtgctccaagagttgctcccagccccacttcagagatgagaaaaccaaggcccagggaacccaaggtcacaaaggactctaagaaggagagttgagtaatcccagcactttgggaggccaaggtgggcagatcgcttcaggtcaagagttcgagaccagcctggccaacatagtgaaaccccayctctactaaaaatacaaaaattagccaggcgtggtggtgggcacctgtaatcccagctacttgggaggtcgaggcagaagaatcgcttgaacccaggaggtggaggttgcagtgagccgagatcgtgccactgcactccagcctgagtgacagagtgagactctgtctaaaaaaaaaaaaaaagagagttgaggctgggcgcagtggctcatgcctgtaatcccaacactttgggaggccaaggtggcaagatcacttgaggtcaggggttcaaaaccaccctggccaacacggtaaaac

SEQ ID NO: 195476 - DNA, 601 bp, Human
ctctgtttctttcccaacaccagcctctcttttcacgcactatctccccgccagccctgctccctgcattctgtaggaaatgcttggctcctacagtggttgacgaataccaaagcttctgtgagcacgccagagggcccccacaaagctctctcctctgtctgaaacattactctgaaggagtgatttcttgttcattctgaataaggatgacgacaccaggaagcggaggcccggggagcatttacggcgtgttctcgatgtgtgagcactgtggccagcacgttccaacccagtgctscaagagttgctcccagccccacttcagagatgagaaaaccaaggcccagggaacccaaggtcacaaaggactctaagaaggagagttgagtaatcccagcactttgggaggccaaggtgggcagatcgcttcaggtcaagagttcgagaccagcctggccaacatagtgaaaccccatctctactaaaaatacaaaaattagccaggcgtggtggtgggcacctgtaatcccagctacttgggaggtcgaggcagaagaatcgcttgaacccaggaggtggaggttgcagtgagccgaga

SEQ ID NO: 195477 - DNA, 601 bp, Human
caaggcggccacacccaggttgcctgttctgaagctgtctcaagacagtgaccatcacccaggctgaggtccaggatgatgtgagtgcaaattgctaaagctctccttcaggtgccaggcctgccatgacacatggcgagtcctagcagaggtcagaccaacaactcagttctttcaggtaacctgtactgatgaaacccccccccacccccgccaatcttactcttctgttatttcatgtctatgaagggttttggcataaaaaaaacaaaaagcctcattttaaaaaaatctacaattrtttaggtttttgtttaaagagaagcgtctggttctgttgcctaggctggagtgccgtggtgcaatctcggctcactgcagcctccaacccctggcctcaagcaatactcctgcctcagcttcctgagtagctgggactgtccatcttttttttaataacagctttattgagatataattcacataccgtacaattcatctgtttccagggtacaattcagtggtgtctagcatattcacacagggctgtgcaaccatcaccaccatcaacctagaacactttcatcaccccagaaagaaa

SEQ ID NO: 195478 - DNA, 601 bp, Human
tagtaagacttcaacaaatatgtgctgttgttataattcggagtgacgatggaggtgcagaggtttacctgtgtttttattatctctggttgacaaggcggccacacccaggttgcctgttctgaagctgtctcaagacagtgaccatcacccaggctgaggtccaggatgatgtgagtgcaaattgctaaagctctccttcaggtgccaggcctgccatgacacatggcgagtcctagcagaggtcagaccaacaactcagttctttcaggtaacctgtactgatgaaacccccccccacccccgccaatcttactcttctgttatttcatgtctatgaagggttttggcataaaaaaaacaaaaagcctcattttaaaaaaatctacaattgtttaggtttttgtttaaagagaagcgtctggttctgttgcctaggctggagtgccgtggtgcaatctcggctcactgcagcctccaacccctggcctcaagcaatactcctgcctcagcttcctgagtagctgggactgtccatcttttttttaataacagctttattgagatataattcacataccgtacaattcatctgtttcca

SEQ ID NO: 195479 - DNA, 601 bp, Human
attccttatcaaagatgcctgagcctgcaagacagctcccacaagtacaagcgctgcaacgactgggtgactgcgcgtctctggcaagcggttttgaagccacttccttagctcccatagacaggcagtgctggaaacacacatgcagggagctcccagccggtgttgtgcgatacagaacccgaaagctgcgccctccccgcaaggaggttgtctatagaaaattctgtgacatcaggattcttcaataatctcttcaacatcagctctcaacatatttatagaagatctccaggcccascagttttcctacctgtgcaaaatgctgtggcttcaaagtaatgttttgttgtgttttgttttgtttttgagacgagtctcactctgtcatccaggctggagtgcagtgatgcaatctcagctcactgtaacctccgctcccgggctccagggattctcctgcctcagcctcccaagtagctgggacgataggcgtgcaccaccacacttaggtaatttttgtatttttagtagagatggtgtttcaccatgttggccaggctggtctgaaaatgctgacctcaagtgatccacccacctc

SEQ ID NO: 195480 - DNA, 601 bp, Human
gatcaggccattgtactccagcctgggcagcagagcaagactctgtctcaaaaaggaaaaaaaaaaaggccagacgcggtggctcacacctacaatcccagcactttgggaggccggggtggggggatcacgaggtcaggagatcgagaccatcccggctaacacggtgaaaccccgtctctactaaaaatacaaaaaaattagccaggcgtggcgccgggcgcctgtagtcccagctacttgggaggctgaggcaggagaacggcatgaacccagaaggcagagcttgcagtgagccgasatggtgccactgcactccagcgtgggcgacagagcgaggatccgtttcaaaaaaaaaaaaagataccttttgggaacaattccccagcagaacaaaggtgccacttctaagtatgaggaattccttatcaaagatgcctgagcctgcaagacagctcccacaagtacaagcgctgcaacgactgggtgactgcgcgtctctggcaagcggttttgaagccacttccttagctcccatagacaggcagtgctggaaacacacatgcagggagctcccagccggtgttgtgcgatacagaac

SEQ ID NO: 195481 - DNA, 601 bp, Human
tgtcgcccttccccccgcccccgacgaagatcccagctttgtttacatatttgtggtgcacaaaaatagaaatggactaaacaaaattcccgattttcccaaactgtggtggattgcagaaaccaagacttcgcagggctcggttctgaaatgattttcactcaaaccatcttcctgaaactcttcctattactctctgcccatttcgcaaaccttcttgctggaggtattagatacgggaagcacctgtagtaatcaacaagtatggctctgattaaatggatttttttctttttttttktttgagacggactctcgctctgtcacccaggctggagtgcagtggcacaatctcggctcactgcaagctccgcctcccgggttcaagcaattctcctgcttcagcctcccgagtagctgggactacaggtgcccgccaccatgcccggctaattttgtattgttagtagagacgggtttcactgtgttagccaggatggtctaaatctcctgacctcgtgatccacctgcctcgacctcccaaagtgctgggattacaggtgtgagccactgtgcccagccgaaatggatattttgaaaa

SEQ ID NO: 195482 - DNA, 601 bp, Human
gctcacaatatttactgagtgcatacttgtggaattaattaatttaaatagcagagacaatgggatcaggaaacacatggaaataccgatgaccagtattagatgtcagggttctgtcgcccttccccccgcccccgacgaagatcccagctttgtttacatatttgtggtgcacaaaaatagaaatggactaaacaaaattcccgattttcccaaactgtggtggattgcagaaaccaagacttcgcagggctcggttctgaaatgattttcactcaaaccatcttcctgaaactcttcytattactctctgcccatttcgcaaaccttcttgctggaggtattagatacgggaagcacctgtagtaatcaacaagtatggctctgattaaatggatttttttctttttttttttttgagacggactctcgctctgtcacccaggctggagtgcagtggcacaatctcggctcactgcaagctccgcctcccgggttcaagcaattctcctgcttcagcctcccgagtagctgggactacaggtgcccgccaccatgcccggctaattttgtattgttagtagagacgggtttcactgtg

SEQ ID NO: 195483 - DNA, 601 bp, Human
attctattatagatggctcacgaaagcaggattagcgtctgttttgttcactgatgcaaccacagagccgagaatagtgcctggctcacaatatttactgagtgcatacttgtggaattaattaatttaaatagcagagacaatgggatcaggaaacacatggaaataccgatgaccagtattagatgtcagggttctgtcgcccttccccccgcccccgacgaagatcccagctttgtttacatatttgtggtgcacaaaaatagaaatggactaaacaaaattcccgattttcccaaastgtggtggattgcagaaaccaagacttcgcagggctcggttctgaaatgattttcactcaaaccatcttcctgaaactcttcctattactctctgcccatttcgcaaaccttcttgctggaggtattagatacgggaagcacctgtagtaatcaacaagtatggctctgattaaatggatttttttctttttttttttttgagacggactctcgctctgtcacccaggctggagtgcagtggcacaatctcggctcactgcaagctccgcctcccgggttcaagcaattctcctgcttca

SEQ ID NO: 195484 - DNA, 601 bp, Human
actcctgcccttccctgatgagctctcaagcacttaccagcgacacgctacatatttttctaatgcatgtgtcaatttcttgactcgcccattctattatagatggctcacgaaagcaggattagcgtctgttttgttcactgatgcaaccacagagccgagaatagtgcctggctcacaatatttactgagtgcatacttgtggaattaattaatttaaatagcagagacaatgggatcaggaaacacatggaaataccgatgaccagtattagatgtcagggttctgtcgcccttcccyccgcccccgacgaagatcccagctttgtttacatatttgtggtgcacaaaaatagaaatggactaaacaaaattcccgattttcccaaactgtggtggattgcagaaaccaagacttcgcagggctcggttctgaaatgattttcactcaaaccatcttcctgaaactcttcctattactctctgcccatttcgcaaaccttcttgctggaggtattagatacgggaagcacctgtagtaatcaacaagtatggctctgattaaatggatttttttctttttttttttttgagacggact

SEQ ID NO: 195485 - DNA, 601 bp, Human
ctttctcggtaataaaacacagcattttagaaatttgcaagggtcttctggatagggcattacccagaggagcaaggatttccctggccactctggttacagttgcaaccagcagccccaggcctcttgccacccttgccccgccccaccccacatccctcacccccactccacaaactcctgcccttccctgatgagctctcaagcacttaccagcgacacgctacatatttttctaatgcatgtgtcaatttcttgactcgcccattctattatagatggctcacgaaagcaggattascgtctgttttgttcactgatgcaaccacagagccgagaatagtgcctggctcacaatatttactgagtgcatacttgtggaattaattaatttaaatagcagagacaatgggatcaggaaacacatggaaataccgatgaccagtattagatgtcagggttctgtcgcccttccccccgcccccgacgaagatcccagctttgtttacatatttgtggtgcacaaaaatagaaatggactaaacaaaattcccgattttcccaaactgtggtggattgcagaaaccaagacttcgcaggg

SEQ ID NO: 195486 - DNA, 601 bp, Human
tctatcaagaagggcaggagtggacagcctgcactttgatgtttcccttttttggagactgaaaataacatttttaaaaaactgccaaccggcaaggtcacaaaatatttttggatggcacggggaccgattgcaaagctgtggttcacatcagatgcggaggcctgggacgcagccagtgagccccattgcacaatatcctgctcatgccaacttcaaaagttatttgcctcggagagctcccagacgactctttctcggtaataaaacacagcattttagaaatttgcaagggtcttcyggatagggcattacccagaggagcaaggatttccctggccactctggttacagttgcaaccagcagccccaggcctcttgccacccttgccccgccccaccccacatccctcacccccactccacaaactcctgcccttccctgatgagctctcaagcacttaccagcgacacgctacatatttttctaatgcatgtgtcaatttcttgactcgcccattctattatagatggctcacgaaagcaggattagcgtctgttttgttcactgatgcaaccacagagccgagaatagtgcctg

SEQ ID NO: 195487 - DNA, 601 bp, Human
atggtggctctcacctgtaatcccaacactttgggaggctgaggcaggcagatcacgaggtcaggggattgagaccatcctggttaacacagtgaaaccccgtctctactaaaaatacaaaaattagccgggcgtggtggcgggcgcctgtagtcccagctactcgggagactgaggcgggagaatggcgtgaacccgggaggcggagcttgcaatgagcagagatcacgccactgaactcccacctgggcaacagagcaagactccatctaaaaaaaaaaaaaaaagaagaagaagtaargatgtgctcaaagaatgacatgaacacatcaaaagaacacaggggccagcttggaggcgctgcttttggccaaatctgggacaatctgggtatcgaagcaaatgataatggtaatgaattataacccaatgggtaaaataggagtctatgagtgtattgataggaaggagagaaagacagcaggcaagctccagcttgcagtggaatgccaactaatcaatgcaaaagaaacaatgcaactagaaacatcaccatttggcaatgctcatactaattccctcaggcaagaatcatcccagg

SEQ ID NO: 195488 - DNA, 601 bp, Human
cgcctgtaatcccagctacatgggaggctgaggcaggagaattgcatggacccaggaggcagaggtttcagtgagccatgatcacgccattgcactccagccggggcaacagagtgagattccatctcaaaaaaaacaaaaacaaaaacgaaaaaacctggccaggcatggtggctctcacctgtaatcccaacactttgggaggctgaggcaggcagatcacgaggtcaggggattgagaccatcctggttaacacagtgaaaccccgtctctactaaaaatacaaaaattagccgggcrtggtggcgggcgcctgtagtcccagctactcgggagactgaggcgggagaatggcgtgaacccgggaggcggagcttgcaatgagcagagatcacgccactgaactcccacctgggcaacagagcaagactccatctaaaaaaaaaaaaaaaagaagaagaagtaaagatgtgctcaaagaatgacatgaacacatcaaaagaacacaggggccagcttggaggcgctgcttttggccaaatctgggacaatctgggtatcgaagcaaatgataatggtaatgaattataacccaatggg

SEQ ID NO: 195489 - DNA, 601 bp, Human
agggttcccatagacggcactctagtagggctgctcaagtccctcctcacaatccagaggatctcacctaggcagggcccatggtcactccccaggagaagagccaggaatgtccccatcaagcaaaacccctggtctccagctcacaactcaaaacccaagcaaatgaaggaaaagctcctgggaccatcaggactcataacgaccaagggtcagtcatggtatcaggaaatcgtaatcctggctcagaaaggttttaaatacagggaagcagaaggctggggcagcaaaggacactactaagagcaagcgactcacagggctcacccggaaggcattacaaactggaattcctaaaagagtggttgccaagctcacccagaagaggaggtcccactggtccctgagtctgctccaaacggccacgcacagcgtgggcatcctctcccctgctttccattgctgtacagaacctgacctgggaccagagagaagagggtccagggaaatgctgctgaaggcttcgtctctgcagtggagagaaagtcggaaggggcagcacccacccctagctgcccatagatgaccaggcacaggcacc

SEQ ID NO: 195490 - DNA, 601 bp, Human
gatctcgaactcctgacctcaggtgatccgcccgcctcggcctcccaaagtgctgggattacaggcgtgagccaccgcatccggccagagtgtgttgttttctcattgcagtccctaacttgccctgaaccctcccttacccaggtagccacgaagcatctggtgactgaggcctgggagtgagccctggaggttctggctgacgctctgccgtgacccacttggggcttctgtgacgtccccttcagcctgacaagaggacccagttctcctctgtgctcaccctgaacaaaacaggtcstagtctgggaagggcgccaaagagagatcttttcactggtttctgttccctgtcatttttgggggagggtgggctggggaacacaaacacccaataattggaaattgtcagacatacaaaaaagaaatgtaattagtcataaaccctattttaaggttatatttgcactgccattttaaaatgagaaaacactaataacattaaaatgaagtctttgttaaaagtaaccatgcattgttcaaatttccatttgttctttgtttgacaatgaaaaatcattctaaattagttccatacact

SEQ ID NO: 195491 - DNA, 601 bp, Human
tcgcagaagcaatcagcacagtgcccagcactgaaccacggcacacagtgcccagcactgaaccacaacacccagtgcccagcactgaaccatagcacatgcgcattccccccacgcccccgaacttatattcgtcaccatatgttgtgcagatccacgaatgggcagagtcacaattctcacatgagctttgtaaataaggaaaaactgcatgggccagcacacgttgcttgtgtgtgtgtgtcctaagcactgatgacaaatgcagaaccaacaacattcccactcatccagaggaaaycgtgagttctcaatgagcaggctgggagtagcttagtagtcatttccaaagcactgtgaaacttgtctacttcatgaaaaagtactgaggctgttttacagccctttaacttaaatctagtaattgtgcctatcagagttctgaagaaaataagactcaataatctaagctactagttcacgcagatcatcttaaagcaagattttccacagacctcacatatcgaggtgacatgatccttttctaaaatgaaagagcttcgctagagcccagaagttcgagaccagcctgggcaacata

SEQ ID NO: 195492 - DNA, 601 bp, Human
ctcctgcctcggcctcccaaagtgctgggatcacaggtgtgagccacggcaccaggtctgaatttgtgattcgtgttaatgacgaacctgagctgagccttaagtatctgtccggagtcgcagaagcaatcagcacagtgcccagcactgaaccacggcacacagtgcccagcactgaaccacaacacccagtgcccagcactgaaccatagcacatgcgcattccccccacgcccccgaacttatattcgtcaccatatgttgtgcagatccacgaatgggcagagtcacaattctcacrtgagctttgtaaataaggaaaaactgcatgggccagcacacgttgcttgtgtgtgtgtgtcctaagcactgatgacaaatgcagaaccaacaacattcccactcatccagaggaaatcgtgagttctcaatgagcaggctgggagtagcttagtagtcatttccaaagcactgtgaaacttgtctacttcatgaaaaagtactgaggctgttttacagccctttaacttaaatctagtaattgtgcctatcagagttctgaagaaaataagactcaataatctaagctactagttcacgc

SEQ ID NO: 195493 - DNA, 601 bp, Human
cacctggctaaactttttttcatattttttgtagagttgggggtcttcctatgtttcccgggctggcctccaaatcctgggctcaagtgatactcctgcctcggcctcccaaagtgctgggatcacaggtgtgagccacggcaccaggtctgaatttgtgattcgtgttaatgacgaacctgagctgagccttaagtatctgtccggagtcgcagaagcaatcagcacagtgcccagcactgaaccacggcacacagtgcccagcactgaaccacaacacccagtgcccagcactgaaccwtagcacatgcgcattccccccacgcccccgaacttatattcgtcaccatatgttgtgcagatccacgaatgggcagagtcacaattctcacatgagctttgtaaataaggaaaaactgcatgggccagcacacgttgcttgtgtgtgtgtgtcctaagcactgatgacaaatgcagaaccaacaacattcccactcatccagaggaaatcgtgagttctcaatgagcaggctgggagtagcttagtagtcatttccaaagcactgtgaaacttgtctacttcatgaaaaagtactgaggc

SEQ ID NO: 195494 - DNA, 601 bp, Human
catatagtaaaacttacattttggagatctggatttctccattataaacctatggaatcaaatcatttaaaatctagttaccagagaaacctcggtttaatattaacaaacatacttcctttaaccacgagccactttaatgtatatcagttttatctctggagcttcatagatcccaacagagaaggctgatctattttcagagaaacatagcaagagagtgtcacttctgaaccattatacatttaaacaatctctctacatgtagagcctgcatctaaatcccagcaatttttcaggrcctagctctgaggccacatcagcactccaggcaggcggagggactctccaccccgcctcttttgcccccagaaaataaatctttccccagaccaacaatccacttcccggcctcacagcaacgggctcccggctcccgcacgtgactgccaactctttacgagatgaggctgtgctggctcggtatggttgataagacaagcatgcaagaaatatttattaatgcaaactcgtataaattcgtatcatctgagtttatgggaatgaggataaatcacaaaagcattataaagtgaggctt

SEQ ID NO: 195495 - DNA, 601 bp, Human
ctctactaaaaatacaaaaattagccaggtgtggtggtgtgtgcctgtaatcccagctactccggaggctgaagcaggagaatcgcttgaacccaggaggcggaggttgcagtgggctgagatcgcaccactgcactccatcctgagcaacagagtgagactccatctcaaaaaaaacaaaaaaacaaaaaaacaaaaaaaaaattctaaaacactaggtttatgaagtaaataataaaattctgtgataggacggagccattttcttccaggctatttaccaaacacagcaaaggaaatmaaaaaaaggcttcccatatagtaaaacttacattttggagatctggatttctccattataaacctatggaatcaaatcatttaaaatctagttaccagagaaacctcggtttaatattaacaaacatacttcctttaaccacgagccactttaatgtatatcagttttatctctggagcttcatagatcccaacagagaaggctgatctattttcagagaaacatagcaagagagtgtcacttctgaaccattatacatttaaacaatctctctacatgtagagcctgcatctaaatccc

SEQ ID NO: 195496 - DNA, 601 bp, Human
ctcacacctataatcccagcactttgggaagccgaggcaggaggatcacttgaggtcaggagttcgagaccagcctggccaacatggtgaaaccccatctctactaaaaatacaaaaattagccaggcatggtggcacgtgcctgtaatctcagctgcccgtaatctcatctacttgggaggccgaggcaggagactcacttgaacatgagaggcagaggttgcagtgaaccaagattccgccactgcattccaacctgagcaacagagcaagactacatctcaaaaataataataataamcaatgtggagtcttttattctttgcctagaattttctgtgcattgctggaatgagtatatccagaattcattccaaagttaattaagaaaagtacagttaggctttggtaaaacagtctgccaaaatttaacaaaaaagagaaggagaagaaaagttcattaaaaaataacatcactaggaactctgcaaccttgagtggggcacttaagtgccacagacctcagtttcttccttttttgttgtttttttatttttgttttctaggcagacattgaatgctagtttcttcctttttaaaa

SEQ ID NO: 195497 - DNA, 601 bp, Human
ctttgggaggccgaggcgggcagatcacgaggtcaggagatcgagaccatcctgactaacacgctgaaacctcatctgtactaaaaatacaaaaaattagccgggcgtggtggcgggcgactgaagtcccagctacttgggaggctgaggcaggagaatggcgtgaacccgggaggcggagcttgcagtgagcccagatggcgccactgcactccagcctgggcgacagagcaagactctgtctcaaaaacaaacaaacaaaaaattaaaactcttccctgtggggttgctttaaaaatcrtataatgtgttatatgtaaacataaagcattataacaagacagaggaatacaccactggagcaaaatcagaagcggttccctcgttttttcacaatgtggagtctggcccggcgcggtggctcacacctataatcccagcactttgggaagccgaggcaggaggatcacttgaggtcaggagttcgagaccagcctggccaacatggtgaaaccccatctctactaaaaatacaaaaattagccaggcatggtggcacgtgcctgtaatctcagctgcccgtaatctcatctacttggga

SEQ ID NO: 195498 - DNA, 601 bp, Human
tgggcccaagccatcttcccacctcggcctcccaagtagctgggacctcagggatgtgccactgcccccagctaagttttttttttttttttttttttgagacggagtcttgctctgtcgcccaggctgaagtgtactggtgtgatttcgactcactgcaacctctgcctcccgggttcaagcagatctcctgcctcatcctcctgagtagctgggactacaggcgtccgccaccactcctggctaatttttgtttttttagcagagacgggggtttcaccatgttggccaggctggtctygaactcctgaccttatgatccatccacctcagcctccgaaagtgctgggattacaagcgtgagccacggcgcccagctgactcagctgtttttaaattcttttgtagagacagggttttcctatgttgcacaggctggtctcaaactcttgggcttaagcaattctcccgcttggcctctcaaagtgctgggattacatgtgaaccagcatgtctggccttcaattcatttctaaaaagagaggaaaaatatatggcttcttccccgccccattgttatttgattcaattatttacaaaa

SEQ ID NO: 195499 - DNA, 601 bp, Human
agcaaattccatcttcatatactactgctttaatgccaagctaatacttaaaaaagaaaatgggcaaagaaaaagaaaaagttgatgattcatgagtctaaacaattttttgtttttatttatctgattttttttgttttttttttttttgagacaaggtttcaccgtgttgcccatgctggagtacggtggagtaatcacagctcactaaagcctcgatcacctgggcccaagccatcttcccacctcggcctcccaagtagctgggacctcagggatgtgccactgcccccagctaagttttttttttttttttttttttgagacggagtcttgctctgtcgcccaggctgaagtgtactggtgtgatttcgactcactgcaacctctgcctcccgggttcaagcagatctcctgcctcatcctcctgagtagctgggactacaggcgtccgccaccactcctggctaatttttgtttttttagcagagacgggggtttcaccatgttggccaggctggtctcgaactcctgaccttatgatccatccacctcagcctccgaaagtgctgggattacaagcgtgagccacggcgcccag

SEQ ID NO: 195500 - DNA, 601 bp, Human
atatttccttctggttttgatttgcatttctctgtgatgagtgatgctgagcattttttattgtaatgctcttgactaactgtgccacgtttacaactgtctttgagcggagacctgtactacagagtcctacacagggttaaggaggagcatcagaaggcagtgaacagacgtgaggcctatcagctggtactagaaaagagacaatccatttaaggctttgactcatttttgaaacctatgtgctatggtctaaatgtcccccaaaattgacgtgtttaaacttcatcacgaagggatrgtattaagtggggtcttactggcacagtggctcaacacctgtaatcccaacagtttgggaggctgaggtggaagaatcacttgagtccaggagtccaagaccagcctaggcaacacagcgaagactccgtctctacaaaaacaaaattgtttttaatgagccagacgtggtggcacacgcctgtggtctcagctacaagggaggctgaggtgggaggatcgcctgagcccaggaggtccaggctgcagtgagccgtgattgcacccctgcactccagcttgggcgacagagtacgattct

SEQ ID NO: 195501 - DNA, 601 bp, Human
gtgtggctgaggtgggaggatcatttgagcccaggaggtcaaggctgcagtgagctatgattgtgccactgcactctaacctgggcaacagagcaagactcttctctaaaaaataaaaataaaaaataatcataataataatgaccttcagttccatccatgttattgtaaataacagggttttgttccccttgatggctggacagtatcccactgcatatacatataccacagtttctttacccatccattcgatgatggccacattgattccatacctttgctattgccaacattgctrtgatgaacatacaagtgcaggtatccctttgatagatcgatttcttttcctctgggtagatatctagtagtgggattaataatagccattgtgcccagtaagaccccacttcttaatattattctcatataattctaatagccattctgactggcataaggtgatatttccttctggttttgatttgcatttctctgtgatgagtgatgctgagcattttttattgtaatgctcttgactaactgtgccacgtttacaactgtctttgagcggagacctgtactacagagtcctacacag

SEQ ID NO: 195502 - DNA, 601 bp, Human
tagcagtaaagaaaaaaaaatgtgcggaactgttctagatctagatcttgagtgtcctcttttaggaaaagatcatccctgattggatcctggatgaacaccataaaagctctaaaggatactgttagatgctggggaaatttgaacatgaactatatattttataagagtattctgtcaatgttatatttcttgagtaggataatttgttttgtctgtacaggagaatgtccttgttcataggagatacatgctgaagaatttaagggtgcagggccacaatgtctgcaatttagtcagttaacggttcaatggctcagcaaagaaaaaagaggacaaatatagatacacacacatacacatatgcacatacatatgtgtgtactgtattatatcccattcagggttcttgcacaaatgtgtgtataattatattcacacatacatatatacacacctacactgagacagccaaagaaatttggcaaaatgttaaccacgggtcaatcaggtgaagtgggatattagtgttcattatactattatttcaacttttctgtaggtttgaaatttatcaaaatgaaaagttgcgaaggccagg

SEQ ID NO: 195503 - DNA, 601 bp, Human
acgagggaggcttctgggatattctgtttcatctgggtgctggtttagtggatgtgttccttttgtgataattcttcaaactgtacacttatgcattttatgcatgcatattacacttcaatgcaaaatttattttaagaaacaggaaaccaaactcttcaaaaatgccaatagcagtaaagaaaaaaaaatgtgcggaactgttctagatctagatcttgagtgtcctcttttaggaaaagatcatccctgattggatcctggatgaacaccataaaagctctaaaggatactgttagaygctggggaaatttgaacatgaactatatattttataagagtattctgtcaatgttatatttcttgagtaggataatttgttttgtctgtacaggagaatgtccttgttcataggagatacatgctgaagaatttaagggtgcagggccacaatgtctgcaatttagtcagttaacggttcaatggctcagcaaagaaaaaagaggacaaatatagatacacacacatacacatatgcacatacatatgtgtgtactgtattatatcccattcagggttcttgcacaaatgtgtgtataat

SEQ ID NO: 195504 - DNA, 601 bp, Human
cagaagtcaggacatggttacctttagaaggaggaagtgggtagcgttgggagggacacgagggaggcttctgggatattctgtttcatctgggtgctggtttagtggatgtgttccttttgtgataattcttcaaactgtacacttatgcattttatgcatgcatattacacttcaatgcaaaatttattttaagaaacaggaaaccaaactcttcaaaaatgccaatagcagtaaagaaaaaaaaatgtgcggaactgttctagatctagatcttgagtgtcctcttttaggaaaagawcatccctgattggatcctggatgaacaccataaaagctctaaaggatactgttagatgctggggaaatttgaacatgaactatatattttataagagtattctgtcaatgttatatttcttgagtaggataatttgttttgtctgtacaggagaatgtccttgttcataggagatacatgctgaagaatttaagggtgcagggccacaatgtctgcaatttagtcagttaacggttcaatggctcagcaaagaaaaaagaggacaaatatagatacacacacatacacatatgcacatac

SEQ ID NO: 195505 - DNA, 601 bp, Human
gttccatttgtacgaaattcaaacacaggcaaacgcaatttatggtgccagaagtcaggacatggttacctttagaaggaggaagtgggtagcgttgggagggacacgagggaggcttctgggatattctgtttcatctgggtgctggtttagtggatgtgttccttttgtgataattcttcaaactgtacacttatgcattttatgcatgcatattacacttcaatgcaaaatttattttaagaaacaggaaaccaaactcttcaaaaatgccaatagcagtaaagaaaaaaaaatgtgyggaactgttctagatctagatcttgagtgtcctcttttaggaaaagatcatccctgattggatcctggatgaacaccataaaagctctaaaggatactgttagatgctggggaaatttgaacatgaactatatattttataagagtattctgtcaatgttatatttcttgagtaggataatttgttttgtctgtacaggagaatgtccttgttcataggagatacatgctgaagaatttaagggtgcagggccacaatgtctgcaatttagtcagttaacggttcaatggctcagcaaag

SEQ ID NO: 195506 - DNA, 601 bp, Human
atacacactgcaggttccatttgtacgaaattcaaacacaggcaaacgcaatttatggtgccagaagtcaggacatggttacctttagaaggaggaagtgggtagcgttgggagggacacgagggaggcttctgggatattctgtttcatctgggtgctggtttagtggatgtgttccttttgtgataattcttcaaactgtacacttatgcattttatgcatgcatattacacttcaatgcaaaatttattttaagaaacaggaaaccaaactcttcaaaaatgccaatagcagtaaagaaaaaaaaatgtgcggaactgttctagatctagatcttgagtgtcctcttttaggaaaagatcatccctgattggatcctggatgaacaccataaaagctctaaaggatactgttagatgctggggaaatttgaacatgaactatatattttataagagtattctgtcaatgttatatttcttgagtaggataatttgttttgtctgtacaggagaatgtccttgttcataggagatacatgctgaagaatttaagggtgcagggccacaatgtctgcaatttagtcagttaacggttcaa

SEQ ID NO: 195507 - DNA, 601 bp, Human
gcaagtcacgtcttccatgacggcagggaagagagagagtgtgtgcaggggaactcctctttataaaaccatcagatcaactggacgtggtggctcacgcctgtaatcccagcactgtgggaggccgaggtgggcatatcacctgagctcaagagttcgagaccagcctggccaacatggtgaaaccccatctctactagtaaaacaaaaattagctgggtgtggtggtccatgcctgtaatcccagctacttgggaggctgaggcaggagaatcgcttgaacccaggaggcagaggttgyggtgagccaagatcatgccattgcactccagcctgggtgacaagagcaaaattccgtttcaaaaaaaaaaaaaagaaaaaaaacccatcagatctcgtgagacttattcactatcacgagaacagcatgggaatgacctgcccccacgattcaattacctcccactgggtccctcccacaacatgtgggaattgtgggagtcacaattcaagatgagatttgggtggggacacagccaaatcatattaaaaggtcaacccttgggaaagatttttggggggtgattaaactgttctgtat

SEQ ID NO: 195508 - DNA, 601 bp, Human
cctctacagggtattaaggctccagaaaattctctaatcagccacttgctcctgctcgagcctgctcccactccgtggagtgtactttcatttcagtaaatctgtgcttcccttgcttcgttttctcgttgctttgtttgtgcattttgtccaattctttgttcaaaatgccaagaatctggttaagaacccagacaacttgtagtcaagaccctccactggtaacacccataaagggtgtattagtctgttttcacactgttcataaagactttataattatccgagactgggtaattaygaaggaaaggtttaactggcttgcagttccccatggctagggaggcctcacaatcatggcagagggcaaggaggagcaagtcacgtcttccatgacggcagggaagagagagagtgtgtgcaggggaactcctctttataaaaccatcagatcaactggacgtggtggctcacgcctgtaatcccagcactgtgggaggccgaggtgggcatatcacctgagctcaagagttcgagaccagcctggccaacatggtgaaaccccatctctactagtaaaacaaaaattagctgggtgtgg

SEQ ID NO: 195509 - DNA, 601 bp, Human
caggtcttcaggtgtaacgttgcaacttcacttcaacctctgattggtcgcctcctgcaaccaatcagactggtcacaggccactccttcacttacatagggtgtaaccaagtaaccaatgggaaacctctacagggtattaaggctccagaaaattctctaatcagccacttgctcctgctcgagcctgctcccactccgtggagtgtactttcatttcagtaaatctgtgcttcccttgcttcgttttctcgttgctttgtttgtgcattttgtccaattctttgttcaaaatgccaaraatctggttaagaacccagacaacttgtagtcaagaccctccactggtaacacccataaagggtgtattagtctgttttcacactgttcataaagactttataattatccgagactgggtaattatgaaggaaaggtttaactggcttgcagttccccatggctagggaggcctcacaatcatggcagagggcaaggaggagcaagtcacgtcttccatgacggcagggaagagagagagtgtgtgcaggggaactcctctttataaaaccatcagatcaactggacgtggtggctcacg

SEQ ID NO: 195510 - DNA, 601 bp, Human
aactgaatcaaaaggaaaaccatacccaggtaacaaaaggatcagaggctactactccctttgcacctcgtggcagatgaaaaatggaaagtacctctgattggttccctcccgcaaccaaccagactggtcccaggccaggtcttcaggtgtaacgttgcaacttcacttcaacctctgattggtcgcctcctgcaaccaatcagactggtcacaggccactccttcacttacatagggtgtaaccaagtaaccaatgggaaacctctacagggtattaaggctccagaaaattctctartcagccacttgctcctgctcgagcctgctcccactccgtggagtgtactttcatttcagtaaatctgtgcttcccttgcttcgttttctcgttgctttgtttgtgcattttgtccaattctttgttcaaaatgccaagaatctggttaagaacccagacaacttgtagtcaagaccctccactggtaacacccataaagggtgtattagtctgttttcacactgttcataaagactttataattatccgagactgggtaattatgaaggaaaggtttaactggcttgcagttccccatgg

SEQ ID NO: 195511 - DNA, 601 bp, Human
atcctgcaatgaccatacgcccagaaaccccaatcatggatatttaccctagagaaatcaaaccttatgtttacaaaaaacgctgtacgcaaatgtttgtagcggcactattcataattgccaaaacctggaaaccaacctaatgtccttcccaggatgaatggataaacacactgtggtccctccccacaatggggcactactcagcatcacaaggaatgaactagagacccatgcagcatccaggacgaatctcaatagctctagactaagtggaagaaaccagtcttcaaagggtacrtgctgtgtggttccattttaatgacaggctcccaaaggcaaaactacagggaatggatagttgttgctgggtcggcaggggcctggaggcagggaacttaaggccgattcaccctgactttttagaactgaatcaaaaggaaaaccatacccaggtaacaaaaggatcagaggctactactccctttgcacctcgtggcagatgaaaaatggaaagtacctctgattggttccctcccgcaaccaaccagactggtcccaggccaggtcttcaggtgtaacgttgcaacttcacttcaac

SEQ ID NO: 195512 - DNA, 601 bp, Human
gcttcctgcaatagagaatacccaacatgcggtttggacagagtcagggacgtcctttctgaagaaatgagactgaagtggagatatcacagtgagatggaggcaattgcggtggtgtaggtctggggaaggcacgagggatgcagggatcagcatggaaaggacggtcccagcatgctcacgtggctgaaaggtggcaactgttcccgatgcagactgagggaagaaagtgtggcatgagaggaggctggggaggtgggccaggccctgggagccattaagaggtttctgcctggccagstgcagtgattcacacctgtaatcccagcactttgggaggccgaggtaggcggatcacttgaggtaaggagttcgagaccatcctggctagcatgatgaaaccccgtgtctactaaaaatacaaaaattagccaggcggggtacatgcctgtgatcccagctacttgggaggctgaggcacgagcatcgcttgaacccaggaggtggaggctgcagtgggccgagattacgccactgcactccagcctgggggacggtaggagactctgtctcaaaacgacaagaggcatctgacttacat

SEQ ID NO: 195513 - DNA, 601 bp, Human
tttatgggttctatgggagcacccgctgcaggccacgctagacgctggtgataaaactgtgaacatggcgtccatcacctgactcagtggtaggaaccagtggcagggagaatccacaagcaaggacccgagtcaccagctgtgattaagagccaggaagaaagcaaaagcttcctgcaatagagaatacccaacatgcggtttggacagagtcagggacgtcctttctgaagaaatgagactgaagtggagatatcacagtgagatggaggcaattgcggtggtgtaggtctggggaagscacgagggatgcagggatcagcatggaaaggacggtcccagcatgctcacgtggctgaaaggtggcaactgttcccgatgcagactgagggaagaaagtgtggcatgagaggaggctggggaggtgggccaggccctgggagccattaagaggtttctgcctggccaggtgcagtgattcacacctgtaatcccagcactttgggaggccgaggtaggcggatcacttgaggtaaggagttcgagaccatcctggctagcatgatgaaaccccgtgtctactaaaaatacaaaaattagc

SEQ ID NO: 195514 - DNA, 601 bp, Human
atccgttaagaatgagattagacctattctaaatcctactaacaccttacattgactctgtcttattaatctcagtactgtagtacctgggggaaggcgcagcaccgtggacactcagaaacgtcaagaatcaaatcacatctctacaacggtggtccatctgcaaacagcgtggagatcaaggaagggcagaacaaagtactgaaagtgctgtcatttctctggagggtgaattacacagaccaactttcttcacataataagaaacaagaagttgtttgtttatgggttctatgggagyacccgctgcaggccacgctagacgctggtgataaaactgtgaacatggcgtccatcacctgactcagtggtaggaaccagtggcagggagaatccacaagcaaggacccgagtcaccagctgtgattaagagccaggaagaaagcaaaagcttcctgcaatagagaatacccaacatgcggtttggacagagtcagggacgtcctttctgaagaaatgagactgaagtggagatatcacagtgagatggaggcaattgcggtggtgtaggtctggggaaggcacgagggatgcagggatc

SEQ ID NO: 195515 - DNA, 601 bp, Human
cctattcattctttcaacacataataagctcctgaaatccgttaagaatgagattagacctattctaaatcctactaacaccttacattgactctgtcttattaatctcagtactgtagtacctgggggaaggcgcagcaccgtggacactcagaaacgtcaagaatcaaatcacatctctacaacggtggtccatctgcaaacagcgtggagatcaaggaagggcagaacaaagtactgaaagtgctgtcatttctctggagggtgaattacacagaccaactttcttcacataataagraacaagaagttgtttgtttatgggttctatgggagcacccgctgcaggccacgctagacgctggtgataaaactgtgaacatggcgtccatcacctgactcagtggtaggaaccagtggcagggagaatccacaagcaaggacccgagtcaccagctgtgattaagagccaggaagaaagcaaaagcttcctgcaatagagaatacccaacatgcggtttggacagagtcagggacgtcctttctgaagaaatgagactgaagtggagatatcacagtgagatggaggcaattgcggtgg

SEQ ID NO: 195516 - DNA, 601 bp, Human
ccaccccctgcagctgactcatctgcatagtgagacttcctgacacaaatggaggtgacaatattcgttcccccatcatatcccagaaattcccttattgccgacatccattctgggtttttactgcgcttcacacgaggacaattccaggctgaagtggcaggtcccagcaccagactccacttcatcagaacacttctgttagagtctttgaaacgcatgaaatcccctttagggtccataataacgccttctggaaactcgacggcaagccactcaccctcagccctatcagaccccrtggctccttacatttctgtgacatacttaatttgcaatgtcctcttttccatcatgaaataaaattaaattcatggacaacataacctttaatcactgagaccataaaggacacctccagcagctgactagccttccctcagccacctttgtgcccagcctaagggcagggtggcaccggagcctccatgcttcaaaggtggccaccagggcccatccccctttccatgcttctccctgcccagagagaaacagcctgaggacaggttaaagactaaatacaaccaggcatggtggctca

SEQ ID NO: 195517 - DNA, 601 bp, Human
ctccactttctaccagcctcctccaggtccctactgccttgggaggccccctacccacctgccaacctatcccctcaccatctaccggcaccaagtctgtgtgagcacactgtagatacacgagctccgtcccaactcagagctaggagagtatcagaggccaaacgcctgccccctgcttctgggctccaccagcagcctgggaggccaccccctgcagctgactcatctgcatagtgagacttcctgacacaaatggaggtgacaatattcgttcccccatcatatcccagaaattccyttattgccgacatccattctgggtttttactgcgcttcacacgaggacaattccaggctgaagtggcaggtcccagcaccagactccacttcatcagaacacttctgttagagtctttgaaacgcatgaaatcccctttagggtccataataacgccttctggaaactcgacggcaagccactcaccctcagccctatcagaccccgtggctccttacatttctgtgacatacttaatttgcaatgtcctcttttccatcatgaaataaaattaaattcatggacaacataacctttaat

SEQ ID NO: 195518 - DNA, 601 bp, Human
gaagccttagcctcaggcaaattcatgaaccaggtagaatctaattcaggtcactttggccaatctccactttctaccagcctcctccaggtccctactgccttgggaggccccctacccacctgccaacctatcccctcaccatctaccggcaccaagtctgtgtgagcacactgtagatacacgagctccgtcccaactcagagctaggagagtatcagaggccaaacgcctgccccctgcttctgggctccaccagcagcctgggaggccaccccctgcagctgactcatctgcatastgagacttcctgacacaaatggaggtgacaatattcgttcccccatcatatcccagaaattcccttattgccgacatccattctgggtttttactgcgcttcacacgaggacaattccaggctgaagtggcaggtcccagcaccagactccacttcatcagaacacttctgttagagtctttgaaacgcatgaaatcccctttagggtccataataacgccttctggaaactcgacggcaagccactcaccctcagccctatcagaccccgtggctccttacatttctgtgacatactta

SEQ ID NO: 195519 - DNA, 601 bp, Human
agcttgaccttgcttgacatacattatttctaaaaaatgttttaaatgtgaatatttagaagatacaccatattttctgctttttatatactataaattttactatgtgagtttaaaaagtggttggtaaaacacacacccaagctctctgatctttcacacccattaaaagcagcacatgtattaaacacactgctgcacaatgggcgtgccatgggtgctctccaaccgcattgggcttgaatgtttaactaggcctgaagccacagtgctaacaagatctggcagagaccgacaaggscacgccggcagcaggtgtttcaggaaaggtattactccaccatcccttgcgctgaagccttagcctcaggcaaattcatgaaccaggtagaatctaattcaggtcactttggccaatctccactttctaccagcctcctccaggtccctactgccttgggaggccccctacccacctgccaacctatcccctcaccatctaccggcaccaagtctgtgtgagcacactgtagatacacgagctccgtcccaactcagagctaggagagtatcagaggccaaacgcctgccccctgcttct

SEQ ID NO: 195520 - DNA, 601 bp, Human
cagcactttgagaggctgaggcgggtggatcacttgaggccaggagttcgagaccagcctggccaacaaggtgaaaacccctctctactaaaaaatatacaaaaaattagctgggcttggtggcacacgtctgtagtcccagctgcttgggaggctgaggcaggagaatggcgtgaacccaggaggcggagcttgcagtgagctaagatcgcgccactgcactccagcctgggcgacagagcgagactccgtctcaaaaaaaaaaaaagaaagtggaatagaaacagttactctatcgaayaaaatagcagataatgttttagaataaagaaacaaaagagctggaaacatttgaacgttttcaaaaaaaaccctataagtgggatgagatactggttcacaactctaatttagagcctatataaacacattagcttgaccttgcttgacatacattatttctaaaaaatgttttaaatgtgaatatttagaagatacaccatattttctgctttttatatactataaattttactatgtgagtttaaaaagtggttggtaaaacacacacccaagctctctgatctttcacacccattaa

SEQ ID NO: 195521 - DNA, 601 bp, Human
tacaaagtggaataagccaggcgtggtggctcacgtctgtaatcccagcactttgagaggctgaggcgggtggatcacttgaggccaggagttcgagaccagcctggccaacaaggtgaaaacccctctctactaaaaaatatacaaaaaattagctgggcttggtggcacacgtctgtagtcccagctgcttgggaggctgaggcaggagaatggcgtgaacccaggaggcggagcttgcagtgagctaagatcgcgccactgcactccagcctgggcgacagagcgagactccgtctcaaaaaaaaaaaaagaaagtggaatagaaacagttactctatcgaacaaaatagcagataatgttttagaataaagaaacaaaagagctggaaacatttgaacgttttcaaaaaaaaccctataagtgggatgagatactggttcacaactctaatttagagcctatataaacacattagcttgaccttgcttgacatacattatttctaaaaaatgttttaaatgtgaatatttagaagatacaccatattttctgctttttatatactataaattttactatgtgagtttaaaaagtggt

SEQ ID NO: 195522 - DNA, 601 bp, Human
gcgccactgcactccagcctgggcaacacagcaagactccatctcaaaaaaagaaaaagaaaaagaaaaagaactttctatgaacttcccgtgatgatgggtacatcctgtagccgtccagttctgtggcctccaggcacatgtggctactgaccactcgaaatgtagctagtatgaacaaggaattaattttttaatgatttcaattataatttaaattttaaacagctacatgaggctggcagctatgtaggaagcagtgaagatccacatccttccttattggtgaaaggaatgaatyggaaacagaaagttcttttttacctttattaaataaacgtgaagtcataagaactactaaaagaaaatgggtgggataaaagtaaaactaaatatgaaatcagtaagtattcactgttatttattatagatgacatttagacgcaaatacgagagggagagtaccctgtatattaatagcagggatagccaattacaaagtggaataagccaggcgtggtggctcacgtctgtaatcccagcactttgagaggctgaggcgggtggatcacttgaggccaggagttcgagaccagcctgg

SEQ ID NO: 195523 - DNA, 601 bp, Human
gaagagatacatgccaggcatggtagctcatgcctataatcccagcactttgggaggccaaggtggaaggatcacgtgaggtcaagagtttgagaccagcctggccaacatggtgaaaccctgtctccactaaaaatacaaaaattaaccgggcgtggtggcgggagcctgtaatcccagctactcgggaggctgaggcatgagaatcacttgaacccagtgggtgaaggctgcagtgagctgagatcgcgccactgcactccagcctgggcaacacagcaagactccatctcaaaaaaaraaaaagaaaaagaaaaagaactttctatgaacttcccgtgatgatgggtacatcctgtagccgtccagttctgtggcctccaggcacatgtggctactgaccactcgaaatgtagctagtatgaacaaggaattaattttttaatgatttcaattataatttaaattttaaacagctacatgaggctggcagctatgtaggaagcagtgaagatccacatccttccttattggtgaaaggaatgaattggaaacagaaagttcttttttacctttattaaataaacgtgaagtcataaga

SEQ ID NO: 195524 - DNA, 601 bp, Human
caaacggagagctagctcataaaacagtgacctggagcttcagtcagcagccctcactcccaaaaggggtgaggagtcttcagaaactcccctgtcttatggcagaaagctgagctctgcacagaccctggaaaaaccactgttgtcaaaggagagatggaagtgggcagaaagcccaggaaggagggttccagactagtggaggtactagcctcaaacaagacagctgagtacttagagaagaagagatacatgccaggcatggtagctcatgcctataatcccagcactttgggaggcmaaggtggaaggatcacgtgaggtcaagagtttgagaccagcctggccaacatggtgaaaccctgtctccactaaaaatacaaaaattaaccgggcgtggtggcgggagcctgtaatcccagctactcgggaggctgaggcatgagaatcacttgaacccagtgggtgaaggctgcagtgagctgagatcgcgccactgcactccagcctgggcaacacagcaagactccatctcaaaaaaagaaaaagaaaaagaaaaagaactttctatgaacttcccgtgatgatgggtacatcctgt

SEQ ID NO: 195525 - DNA, 601 bp, Human
tttagtacagttggggtttcaccatgttggccaggctggtcttgaactcctgacctcaagtgatccacccgcctcggcctcccaaagtgctggaattacaggcgtgagccaccgcgcccggctgatgctgaacatgcgtgactaaccttccgcgggagcagtcatgccgctgccttcaccacctgttgcttctgggaaatgtggatccaggctgctggctctctcccagatcgtatctgcagcacaggcacatgcttgctgtgaatttccacacttgtcagatcacccggttttcaacttrttttctagttttctctcttttgaagagtattttgcacactggctggggcagaggctgacagtttcccagactgtgttttcttgtttacagagcacatgcagacttgctcgagtcatctaacggagaaacccaaaaacctccattttctcctgagatatctctgctatctctaatttcacttcagcagcactggtggctgaaatactatggactatgtatttcggacttcctttttctgaacttttctggaagaatcgcagttgtgtgtgtgtgtgtgtgtgtgtgtgtgtgtgtgttttg

SEQ ID NO: 195526 - DNA, 601 bp, Human
actgacacctcctgtgggcatcttcagctggaagaaaggccaccgaggctgcggagccacctcgcctgtaaacatcatatcatgcaaaggaaaagctctaagttgcggaatattcttctctttttttttttttttttgagatggagtctcgctctgttgcccaggcaggagtgcagtggcatgatctcggctcactgcaacctctgcctcccgggttcaagcaattctcttccacagcctcctgagtagctgggattacaggcacctgccaccatgcccggctaatttttgtgtttttagyacagttggggtttcaccatgttggccaggctggtcttgaactcctgacctcaagtgatccacccgcctcggcctcccaaagtgctggaattacaggcgtgagccaccgcgcccggctgatgctgaacatgcgtgactaaccttccgcgggagcagtcatgccgctgccttcaccacctgttgcttctgggaaatgtggatccaggctgctggctctctcccagatcgtatctgcagcacaggcacatgcttgctgtgaatttccacacttgtcagatcacccggttttcaacttgttttc

SEQ ID NO: 195527 - DNA, 601 bp, Human
ttatagaaagaagagaaaggaaaaactaaatttaaaatctgagactaggtagccactaaatacttgaaaacaaaaaaagggaatacactgaaaatggaaataaagctgtatgatgtttagttaaagaagccagtcccaaaaggccacgaactaggtgatcccctttatatgaaatgtctggcatagggagatctgtagacacagaaagcagatgagtggctgccatgggtttaggagagagagggtgtaactgctaacggatgcagggttactttttggggtgacgaaaatgtaaaattasgttgtggtgatggttgcacaacaccatgaatacactaaaaaccaccaaatcatacacttgagagggtgaattgcatcatatgtgaattatacttcaataaagctgtttttttgaaaaagaaaaggaagctgggtgtggtggtgcatttctgtgatctcagctacttgggaggctgaggcaggaggactgcttgagcccaggaaatgaaggctgcagtgagctatgactgtgtcactatgctccagcctaggtgatagggtgagaccctgtctcaaatataataataatattaataataca

SEQ ID NO: 195528 - DNA, 601 bp, Human
tgagtgacgatctggacccacaagaagagagtcatatgcattcaagtccaagtgtctatgggctgttcagaagcaacaaatggcacttcaacaatgagttgcagacaacaaaatggaaatgaaggtctgcaataactattaagaatcctgtaacagagcagagtttaaataatgggaagaggctatgaaacaagagagctggggaaagataccagaactgaaacagaccaccagctgatcaccttttatttgtgaaatgacagcaccaaatgcaccagatgccacagacgggagggagggrgataggtcacgtcggcagagggagggggtcaggtcacacctgcagcagggacgggggtcccagaccgtgttcttgtccctagagagctaacagctcatccgtaggtttctaagaggtgctgattcaagcacacagtgtagatgatgaaaaatagattatagaaagaagagaaaggaaaaactaaatttaaaatctgagactaggtagccactaaatacttgaaaacaaaaaaagggaatacactgaaaatggaaataaagctgtatgatgtttagttaaagaagccagtcccaaaaggcc

SEQ ID NO: 195529 - DNA, 601 bp, Human
acgacacccagcacacccagcacacccagcacaccagcgaacagcccaccaggtgctatcgctgtcattcatttgctcattcgctcgttcatgcacccagcagactaaatgtttactgagtacttaccgaaggttaggatctgggctaagggttgaaagaaataaataggttaaaaaagaaaaaaagccacctaggtgactttcactccaatgcttgacctcagttcccttgtctagataatggaaatgctggccggcgcggtgactcacgcctataatcccaggactttgagaggccgargtgggcggatcacttgaggtcgggagttcaagaccagcttggccaacatggcaaaaccctgtctctactaaaactacaaaaattagccagctgtggtggcaggtgcctgtaagtcccagctactcgggaggctaaggcaggaaaatctctcgaacccgggaggcagaggttgcagatagccgagatcacgccactgcactctagcctgggtgacagaatgagaccctgtctcaaaaaaaaaaaagaaaaagaaaacgaaaatgctgtgatatgatggtcatatcatagcacagggctgtt

SEQ ID NO: 195530 - DNA, 601 bp, Human
tgaattagggtttactagcacgagccttcacaaagactgtagaaatgagtctctgagagacgacacccagcacacccagcacacccagcacaccagcgaacagcccaccaggtgctatcgctgtcattcatttgctcattcgctcgttcatgcacccagcagactaaatgtttactgagtacttaccgaaggttaggatctgggctaagggttgaaagaaataaataggttaaaaaagaaaaaaagccacctaggtgactttcactccaatgcttgacctcagttcccttgtctagataayggaaatgctggccggcgcggtgactcacgcctataatcccaggactttgagaggccgaggtgggcggatcacttgaggtcgggagttcaagaccagcttggccaacatggcaaaaccctgtctctactaaaactacaaaaattagccagctgtggtggcaggtgcctgtaagtcccagctactcgggaggctaaggcaggaaaatctctcgaacccgggaggcagaggttgcagatagccgagatcacgccactgcactctagcctgggtgacagaatgagaccctgtctcaaaaaaaaa

SEQ ID NO: 195531 - DNA, 601 bp, Human
ctgctaaatgctacattccagaatgctaacatagggagagtccaggagtccacacacttcagagaccttcgcctcccacctctaagaaacctcttgaattagggtttactagcacgagccttcacaaagactgtagaaatgagtctctgagagacgacacccagcacacccagcacacccagcacaccagcgaacagcccaccaggtgctatcgctgtcattcatttgctcattcgctcgttcatgcacccagcagactaaatgtttactgagtacttaccgaaggttaggatctgggctragggttgaaagaaataaataggttaaaaaagaaaaaaagccacctaggtgactttcactccaatgcttgacctcagttcccttgtctagataatggaaatgctggccggcgcggtgactcacgcctataatcccaggactttgagaggccgaggtgggcggatcacttgaggtcgggagttcaagaccagcttggccaacatggcaaaaccctgtctctactaaaactacaaaaattagccagctgtggtggcaggtgcctgtaagtcccagctactcgggaggctaaggcaggaaaatc

SEQ ID NO: 195532 - DNA, 601 bp, Human
ttttgtatttttagtagagatggggtttcaccgtgttagccaggatggtctcgatctcctgacctcatgatccgcccacctcagcctcccaaagtgctgggattacaggcgtgagcgaccgtgcctggcttggcttcttatcttctgtattccgagttaataaatgccccactgctaaatgctacattccagaatgctaacatagggagagtccaggagtccacacacttcagagaccttcgcctcccacctctaagaaacctcttgaattagggtttactagcacgagccttcacaaagrctgtagaaatgagtctctgagagacgacacccagcacacccagcacacccagcacaccagcgaacagcccaccaggtgctatcgctgtcattcatttgctcattcgctcgttcatgcacccagcagactaaatgtttactgagtacttaccgaaggttaggatctgggctaagggttgaaagaaataaataggttaaaaaagaaaaaaagccacctaggtgactttcactccaatgcttgacctcagttcccttgtctagataatggaaatgctggccggcgcggtgactcacgcctata

SEQ ID NO: 195533 - DNA, 601 bp, Human
cagccaaatgggaatgacaggcatcccctgagtgaccacattcccctgttttggcctttttttttttttttttttttgagacagagtctcgctgtgtggcccaggctggagtacagtggctccctcagctcactgcaagctctgcctcccgggttcacgccattctcctgcctcagcctcccgagcagctgggactacaggcacccaccactatgcctggctaattttttttgtatttttagtagagatggggtttcaccgtgttagccaggatggtctcgatctcctgacctcatgatcygcccacctcagcctcccaaagtgctgggattacaggcgtgagcgaccgtgcctggcttggcttcttatcttctgtattccgagttaataaatgccccactgctaaatgctacattccagaatgctaacatagggagagtccaggagtccacacacttcagagaccttcgcctcccacctctaagaaacctcttgaattagggtttactagcacgagccttcacaaagactgtagaaatgagtctctgagagacgacacccagcacacccagcacacccagcacaccagcgaacagcccac

SEQ ID NO: 195534 - DNA, 601 bp, Human
aggcagagcccagctgcctaatcacaaacgcctgagaaatacatcaggacaggttactgagttcaagcccagcgaaagtcttaagtcaggagactctgcaggcgacatgatttaatgaataaccacacacatggaccctggggtccaagttcattagaatggctcttttgcagcagaaggtccaaaaaaaaaaaaaaaagacagctaaatgatttaagtgtagtgtaaacaggagaataattaatatgatttcttatattctttcctggttatccattgattttaaacctcaacaacagcratgtcttttatcagcttaattttacaaaggctacagagaggggtgggcatttcctaatgggctcctgtctgacgggggaatttgtctatggctgtgtgcgtggaggttaacgcagttaacgttcttaagtattcttaagtatagtgtcacttctttgaaaactaaaactgcactttgcacatagtggtgatcaggtttggtgacccaagtataggaagagtgactgacaaagcccattttggaaaagagtgatgggcgaggcccatttctggcctcatttgtcccagtctctttctgtgg

SEQ ID NO: 195535 - DNA, 601 bp, Human
atgatcctactagctttacgaaggtcaaacacacctccgtgtccacaacgagcaaaatcgggaagtaaattatctttttatttatgcttcaatatggaaagctaaatttaaagtgaaaccttttgtcagaaccagaagggttatcaccctgacaggtaaggcagagcccagctgcctaatcacaaacgcctgagaaatacatcaggacaggttactgagttcaagcccagcgaaagtcttaagtcaggagactctgcaggcgacatgatttaatgaataaccacacacatggaccctgggktccaagttcattagaatggctcttttgcagcagaaggtccaaaaaaaaaaaaaaaagacagctaaatgatttaagtgtagtgtaaacaggagaataattaatatgatttcttatattctttcctggttatccattgattttaaacctcaacaacagcgatgtcttttatcagcttaattttacaaaggctacagagaggggtgggcatttcctaatgggctcctgtctgacgggggaatttgtctatggctgtgtgcgtggaggttaacgcagttaacgttcttaagtattcttaagtat

SEQ ID NO: 195536 - DNA, 601 bp, Human
tgcaaaactgttaaatcaataattgctcctgatttgtttctgacttgagtttttctttaggaagcgctgaatgaccaacccatagtgataacatgatcctactagctttacgaaggtcaaacacacctccgtgtccacaacgagcaaaatcgggaagtaaattatctttttatttatgcttcaatatggaaagctaaatttaaagtgaaaccttttgtcagaaccagaagggttatcaccctgacaggtaaggcagagcccagctgcctaatcacaaacgcctgagaaatacatcaggacaggttactgagttcaagcccagcgaaagtcttaagtcaggagactctgcaggcgacatgatttaatgaataaccacacacatggaccctggggtccaagttcattagaatggctcttttgcagcagaaggtccaaaaaaaaaaaaaaaagacagctaaatgatttaagtgtagtgtaaacaggagaataattaatatgatttcttatattctttcctggttatccattgattttaaacctcaacaacagcgatgtcttttatcagcttaattttacaaaggctacagagaggggtgggcat

SEQ ID NO: 195537 - DNA, 601 bp, Human
cacctgtgcagggcactgtgtgggccatcctgggaagcctccattctggggccacgggcagcaggggggcgggaggagaaagaagagccacataggaggcatgaggcgtaggacaagccagggagccggtggaaatgccagccacagcgggtgggaagttgggaggcacgggagtcaggaaataacagtggaaacgggaaacctactccccacaaactgctggcgagaggcaaggctcccattacaagcaaccaagcgtgatgggcgagggcctggctgctggagggggcctcggagtcgrgtccaggtccgccccctaatcccgtgatctaagtgagctgcttcatctctgcctctcagtttcctcatctctaaggggagggcaggagcagagctagtgagctgcttcatcgctgcctctcagtttcctcatctctaaggggaggacaggagcagggctagtgagctgtttcatcgctgcctctcagtttcctcatctctaaggggaggacaggagcagggctagtgagctgcttcatcgctgcctctcagtttcctcatctctaaggcgagggcaggaggagggcttaccgcacggctc

SEQ ID NO: 195538 - DNA, 601 bp, Human
cctcaggaaggaaggggctgtggctcgaatgtgtcccctccaaagttcaggcgttgtggagtgagagtcttaaggaagcagggctttaagaggtgacgaggccaggagggctcctcccctgcgatgggatcaggcgcctgcataaaggggcttgctgtaaggggctctctcgcttgccctccagtttccttctcccttccagaagatgcagccctccccagacacctgaacctgctggtgccttgatcttggacttcccagcctcctgaagcatgaggacagaaatttccgtgctgtatasattacccagcctatgctgttctgttattgcttcacaagcagatggagacggacggatcagcaccctccacacggagaactgaaagacggggcgaggtcagcccggcaatagcaaaccaggccaggggcgggggtggctgacaccaggcaggggggttactagaacaggtcatgaaaggccctctacagaggtggcctgcagcaggcatagctaaaggatggcttggagctcagtgtggctggagcagagaacgtgtggagggaatggccagggctgagccacagcacctgtgcagggcac

SEQ ID NO: 195539 - DNA, 601 bp, Human
gacatttttttgatgggaggtaggaaaagttgcggctgaaggatgaggttttccattatgtctgtggctggccctgcaaggtgctgttggctcagggtgcccctgcctgaggctacggctccccatgcacaagggctgccctgggagcatgaactgggctgcctctgaaacccaggaaggggccctcacccaggtgactgcgcacctgctccctgtgtggctccgggactgcaagagaaagtcaagatggcctctcctagaagtgcgtggcaactgaagctgagagaggctgagcagggargcctgaagagctggagcacgacgggacagccagcacattcacagcgctcagcacggcagtccacggggagcacggagtggcagcggcggcctctgctcacaagctgggcacgtgcctcaagcacatctccaacgtctgctgttgcttttttgtactgggattactgagtcactcttaattcatcaaacatttattaagcacttcctgtttactacacactgatgggtgcagggacgatgtgtgactattttggccgagatcgtgacctgtgtggagcccattacctgaagaggggccaag

SEQ ID NO: 195540 - DNA, 601 bp, Human
ggagaccgcagtccccacatactgagagaggagggacatttttttgatgggaggtaggaaaagttgcggctgaaggatgaggttttccattatgtctgtggctggccctgcaaggtgctgttggctcagggtgcccctgcctgaggctacggctccccatgcacaagggctgccctgggagcatgaactgggctgcctctgaaacccaggaaggggccctcacccaggtgactgcgcacctgctccctgtgtggctccgggactgcaagagaaagtcaagatggcctctcctagaagtgcrtggcaactgaagctgagagaggctgagcagggaggcctgaagagctggagcacgacgggacagccagcacattcacagcgctcagcacggcagtccacggggagcacggagtggcagcggcggcctctgctcacaagctgggcacgtgcctcaagcacatctccaacgtctgctgttgcttttttgtactgggattactgagtcactcttaattcatcaaacatttattaagcacttcctgtttactacacactgatgggtgcagggacgatgtgtgactattttggccgagatcgtgac

SEQ ID NO: 195541 - DNA, 601 bp, Human
gggggtctcactgtgttggccaggctggtctcgaactcctagactcaagtgatccgcccatcttggcctcccaaagtgctgggattgcaggtgtgagccaccacacctggtccaatgaaaatctttcactcttacttagctcctgaacttttgtgcatttttttctccaacaaaaacccacatcccaatttatgcacaggatcaatcacgactgtaacatgtatacactgaaatggaaacgtgaactggaatacgacgcaggagtgaagccatctttatactaatttctcggacctgtccyaggcgacaccagactgactttgtaacttcactttgccagagttaaaaaatgcaacctatgtggactcaagagaggacaatgagctgccagggcttatacccgccttcatcaaagaagtacacgcaaggaggcctgtcctggggctgctctaagggtctccttcccatgactcctgagtgtggcccacaagtcaccaggtggcagggtggtgacaggagccactgacagccagtgtgactgtggatggccactctggagaccgcagtccccacatactgagagaggagggacatttttttg

SEQ ID NO: 195542 - DNA, 601 bp, Human
gagaatttgccaagagtcctagaaacacgtaaagacagcctagaacgtagccaggtcatagctgagaatcaaaagacttagatatttttagatgccaactggccccaagaaactcttcatgttttgttttgttttgttttgtttttcctttagagatagggtcttgctctgttgcccaggctggagcgcagtggtgcaaccatggctccctacagcccccacctcctatagcctcagcctcctgagtagctgggactacaaacgtccgccactatgtccaactatttctttctttcttttytgagatgggggtctcactgtgttggccaggctggtctcgaactcctagactcaagtgatccgcccatcttggcctcccaaagtgctgggattgcaggtgtgagccaccacacctggtccaatgaaaatctttcactcttacttagctcctgaacttttgtgcatttttttctccaacaaaaacccacatcccaatttatgcacaggatcaatcacgactgtaacatgtatacactgaaatggaaacgtgaactggaatacgacgcaggagtgaagccatctttatactaatttctcggac

SEQ ID NO: 195543 - DNA, 601 bp, Human
aaagcaccgtctgttgaaacgcagctccgtcttgctctctggagaggactcactcctggaaagttgagagtaaagtgaaaatgtgaataggtcatagtttacgacggacgtccacgatctctccagagagatgcggcctcagggagaccgtgggcccccgagacacaccactcacccacgttacgttttcttggagtaatggctgcatgtttcatgttttaccttcagggttaaaataagcattaaaaagttcctccatgaaagggtcccaggacctccctgtgaaggcagcaaagcagaytggttgaccctagacactgctttggtttatttccatctgtgaataccagtccagtgagtaccttcctaacggtcagtctagacgtcatggcagcttccggtactgaccatcttacctgtgtcagaggctgcaaaactaccccgaaaaacaagaccctaccagggaccaagaggccattaaaacctccccagactcagagctgttgagcatctatttcctgttggattcaaacactcaccccaggaacattcagcttttgttaagctgaggtccacatgcattttattgtctcacaaaatc

SEQ ID NO: 195544 - DNA, 601 bp, Human; identical to SEQ ID NO: 18345

SEQ ID NO: 195545 - DNA, 601 bp, Human; identical to SEQ ID NO: 18346

SEQ ID NO: 195546 - DNA, 601 bp, Human; identical to SEQ ID NO: 18347

SEQ ID NO: 195547 - DNA, 601 bp, Human; identical to SEQ ID NO: 18348

SEQ ID NO: 195548 - DNA, 601 bp, Human; identical to SEQ ID NO: 18349

SEQ ID NO: 195549 - DNA, 601 bp, Human; identical to SEQ ID NO: 18350

SEQ ID NO: 195550 - DNA, 601 bp, Human; identical to SEQ ID NO: 18351

SEQ ID NO: 195551 - DNA, 601 bp, Human; identical to SEQ ID NO: 18352

SEQ ID NO: 195552 - DNA, 601 bp, Human; identical to SEQ ID NO: 18353

SEQ ID NO: 195553 - DNA, 601 bp, Human; identical to SEQ ID NO: 18354

SEQ ID NO: 195554 - DNA, 601 bp, Human; identical to SEQ ID NO: 18355

SEQ ID NO: 195555 - DNA, 601 bp, Human; identical to SEQ ID NO: 18356

SEQ ID NO: 195556 - DNA, 601 bp, Human; identical to SEQ ID NO: 18357

SEQ ID NO: 195557 - DNA, 601 bp, Human; identical to SEQ ID NO: 18358

SEQ ID NO: 195558 - DNA, 601 bp, Human; identical to SEQ ID NO: 38778

SEQ ID NO: 195559 - DNA, 601 bp, Human; identical to SEQ ID NO: 38779

SEQ ID NO: 195560 - DNA, 601 bp, Human; identical to SEQ ID NO: 38780

SEQ ID NO: 195561 - DNA, 601 bp, Human; identical to SEQ ID NO: 38781

SEQ ID NO: 195562 - DNA, 601 bp, Human; identical to SEQ ID NO: 38782

SEQ ID NO: 195563 - DNA, 601 bp, Human; identical to SEQ ID NO: 38783

SEQ ID NO: 195564 - DNA, 601 bp, Human; identical to SEQ ID NO: 38784

SEQ ID NO: 195565 - DNA, 601 bp, Human; identical to SEQ ID NO: 38785

SEQ ID NO: 195566 - DNA, 601 bp, Human; identical to SEQ ID NO: 38786

SEQ ID NO: 195567 - DNA, 601 bp, Human; identical to SEQ ID NO: 37409

SEQ ID NO: 195568 - DNA, 601 bp, Human; identical to SEQ ID NO: 37410

SEQ ID NO: 195569 - DNA, 601 bp, Human; identical to SEQ ID NO: 37411

SEQ ID NO: 195570 - DNA, 601 bp, Human; identical to SEQ ID NO: 37412

SEQ ID NO: 195571 - DNA, 601 bp, Human; identical to SEQ ID NO: 37413

SEQ ID NO: 195572 - DNA, 601 bp, Human; identical to SEQ ID NO: 37414

SEQ ID NO: 195573 - DNA, 601 bp, Human; identical to SEQ ID NO: 37415

SEQ ID NO: 195574 - DNA, 601 bp, Human; identical to SEQ ID NO: 37416

SEQ ID NO: 195575 - DNA, 601 bp, Human; identical to SEQ ID NO: 37417

SEQ ID NO: 195576 - DNA, 601 bp, Human
ggattccaaaagctggcatgcttgaaatactcaaaaggggcactcactgattctcttgccctcagtaccctcttcctgccaaaccactgccaggctgacctggccagccaggatccactcattactctgtgcgtcatttcatcatttcttccaaccatacacgggctcctgtagcatttgtataatcaaacataaattccaaagtctggcaaagaaggccctatattaactaaccctattgctactttagagggcttccttatacagatcctcttgggcagactttggctcctacatcatgtgttcattccattcttcagatctttacccagaatgaaaacctgctattccaaaatcatcaatttatttcataaattaatctatttactgcacaaataagtactgggtccctatcacgtatagggtactgggtatagataataaactaaacagatacaatctctgtcttaaatccccttgaggatgcaacctatctttttctttccaaatctaatccaaaccattcagcatagtgctatgaatgtggtgtgtgtgtgtgtgtgtggtattaactgactataataaccttcaaatttggtga

SEQ ID NO: 195577 - DNA, 601 bp, Human
atgaaaacctgctattccaaaatcatcaatttatttcataaattaatctatttactgcacaaataagtactgggtccctatcacgtatagggtactgggtatagataataaactaaacagatacaatctctgtcttaaatccccttgaggatgcaacctatctttttctttccaaatctaatccaaaccattcagcatagtgctatgaatgtggtgtgtgtgtgtgtgtgtggtattaactgactataataaccttcaaatttggtgactcctgggaggggtttgaaaaatgaccatgaayacaaatattctctcataagagtccttttctttattcttcatcccagcattatagcttttgtttctttacacatttttcttattcccctgcaggctttttactatttcctcccttcctgcctggagaatgacaagagacatcacaatgctttggcagcctcagaagtcagaagcacacagtggaggatgatgcccatttctggctggtaccaatgttgtatttcagaactggaggcacgatggggtccaagatcctcccctgcttttaggtggggacacagcagggacaggcgacacttta

SEQ ID NO: 195578 - DNA, 601 bp, Human
aatttaaaagcaaacatataaagctgcttagcctccaagacaaaaataaaaaacttaagagtaatggtttcaaccacaacatctcagataaaacaattttaaaaaatggctctgactctcgtgggtgctccaggcccatggcatgaattatataagagaaaggcagggccagcagtctagacagaggccactgtgtctacaagctaaaaaagaaaacagcaaaatatgcaaaccaggaaggagccatatcctcagcaggattacatttttctaaacaggtacaatctgtccgcctgcagawagcattttctaggaaaattcattattcagaggcaaacagccaggagaggggaaagtacacaaatacagcttactgctatctcctacttcatttggtcaaaattcaaggctcccaatcagaaaaacaggaaaacattttaagtttcatttatatgatcccaggcaggtatttcaaaatatgagactatcctctatagaatgtaatcatttattctataacatctgtaataatgtgtaggcaattaaaggtgataagtgaaggaagacagtacaagattataatgtactacaatctacaggt

SEQ ID NO: 195579 - DNA, 601 bp, Human
atctcagataaaacaattttaaaaaatggctctgactctcgtgggtgctccaggcccatggcatgaattatataagagaaaggcagggccagcagtctagacagaggccactgtgtctacaagctaaaaaagaaaacagcaaaatatgcaaaccaggaaggagccatatcctcagcaggattacatttttctaaacaggtacaatctgtccgcctgcagatagcattttctaggaaaattcattattcagaggcaaacagccaggagaggggaaagtacacaaatacagcttactgctatytcctacttcatttggtcaaaattcaaggctcccaatcagaaaaacaggaaaacattttaagtttcatttatatgatcccaggcaggtatttcaaaatatgagactatcctctatagaatgtaatcatttattctataacatctgtaataatgtgtaggcaattaaaggtgataagtgaaggaagacagtacaagattataatgtactacaatctacaggtattgctttcaacatcagacataggacaaggcattatgttgactatggattcctagtagcaactccatcagtgactcatga

SEQ ID NO: 195580 - DNA, 601 bp, Human
aaacattttaagtttcatttatatgatcccaggcaggtatttcaaaatatgagactatcctctatagaatgtaatcatttattctataacatctgtaataatgtgtaggcaattaaaggtgataagtgaaggaagacagtacaagattataatgtactacaatctacaggtattgctttcaacatcagacataggacaaggcattatgttgactatggattcctagtagcaactccatcagtgactcatgaaaaatgtgctgttgttcacattcatttcaccctcaaaaattcatacttgsaatttcccatgagtgtcttttttataaagacactgatggccaaaagtcagatgccacagcagttggcgtaagcaggtcatcctcacctctttttgaccttcacactcatgattttggatgactgctatgtttcaaggtcatcttacccagcctatcttcgcaaccacagactatcatcaccttccccatctcccttctaacttgcaaatgtgatgttctttacatacttagggcacatgcacactcttctgttactcaggtttcgatgaccagaatggcactgagcactgctgctcttga

SEQ ID NO: 195581 - DNA, 601 bp, Human
aaaaattcatacttggaatttcccatgagtgtcttttttataaagacactgatggccaaaagtcagatgccacagcagttggcgtaagcaggtcatcctcacctctttttgaccttcacactcatgattttggatgactgctatgtttcaaggtcatcttacccagcctatcttcgcaaccacagactatcatcaccttccccatctcccttctaacttgcaaatgtgatgttctttacatacttagggcacatgcacactcttctgttactcaggtttcgatgaccagaatggcactgakcactgctgctcttgatctgagcactatctttcattactttgtgctatttttctttttaaaatatgaaatattaaaaaaaactgaaaacaaaaaaagacccagtccctaccacctagatttaacaaatctgttaatattttcccacgtgcttcagatctcattccagaaaataaagtattacagacacagctgacaccttcttgccctctaccattcctgctccttcttttcaaacacaactccaacttcatttagtgtgtgtccagctgaaatatacagctggctggggctcatgtaaca

SEQ ID NO: 195582 - DNA, 601 bp, Human
ttataaagacactgatggccaaaagtcagatgccacagcagttggcgtaagcaggtcatcctcacctctttttgaccttcacactcatgattttggatgactgctatgtttcaaggtcatcttacccagcctatcttcgcaaccacagactatcatcaccttccccatctcccttctaacttgcaaatgtgatgttctttacatacttagggcacatgcacactcttctgttactcaggtttcgatgaccagaatggcactgagcactgctgctcttgatctgagcactatctttcattaytttgtgctatttttctttttaaaatatgaaatattaaaaaaaactgaaaacaaaaaaagacccagtccctaccacctagatttaacaaatctgttaatattttcccacgtgcttcagatctcattccagaaaataaagtattacagacacagctgacaccttcttgccctctaccattcctgctccttcttttcaaacacaactccaacttcatttagtgtgtgtccagctgaaatatacagctggctggggctcatgtaacatagatctggtcaacaagataaacatcaagcctgggaa

SEQ ID NO: 195583 - DNA, 601 bp, Human
agcagttggcgtaagcaggtcatcctcacctctttttgaccttcacactcatgattttggatgactgctatgtttcaaggtcatcttacccagcctatcttcgcaaccacagactatcatcaccttccccatctcccttctaacttgcaaatgtgatgttctttacatacttagggcacatgcacactcttctgttactcaggtttcgatgaccagaatggcactgagcactgctgctcttgatctgagcactatctttcattactttgtgctatttttctttttaaaatatgaaatattaaaaaaaactgaaaacaaaaaaagacccagtccctaccacctagatttaacaaatctgttaatattttcccacgtgcttcagatctcattccagaaaataaagtattacagacacagctgacaccttcttgccctctaccattcctgctccttcttttcaaacacaactccaacttcatttagtgtgtgtccagctgaaatatacagctggctggggctcatgtaacatagatctggtcaacaagataaacatcaagcctgggaaagcagccctttcaaatcaaaaagcaaagcctcatta

SEQ ID NO: 195584 - DNA, 601 bp, Human
agtgtgtgtccagctgaaatatacagctggctggggctcatgtaacatagatctggtcaacaagataaacatcaagcctgggaaagcagccctttcaaatcaaaaagcaaagcctcattaggaaaaaaccccttgcttcctgcatgtgccatatgaagtgtggatgtaaagcctagtgatacggcatctactttgtcaccaagaggcaacaaccctgaggtacactctcctgttaatgcatgctgaggttatgtccagtttagggctactaaggaaatccaaaggacattcttgtacagawctttttatggaactgattttcatctcttgagtaaatacctaggagtgaaattcctgggtcatggagtaggtgtatgtttaatttttcaagtaaatgacaaacagttttccaaagtggttatatagcattttatactcccacatattaagttggatatctaataaaaatatcttccctcttgaataataatcttactcttaatttttatgttaagagttaggaccagtttattaatttccatgaaaaattctttggatattttgattaaaattttattgaacatacagatgattattttag

SEQ ID NO: 195585 - DNA, 601 bp, Human
tttccaaagtggttatatagcattttatactcccacatattaagttggatatctaataaaaatatcttccctcttgaataataatcttactcttaatttttatgttaagagttaggaccagtttattaatttccatgaaaaattctttggatattttgattaaaattttattgaacatacagatgattattttagggagaactaataacatttatgatatggatgtacttttaacaattaaataaatggtcaagttcaatttgctattgatttatgtattatttttgcatttgtgtttttwaaaaaaagatagggctataattttctcatactgccctcacgtaatgctggtattagggttacactagcattccataaggaactgaggaacttttccattcaattatctggaaaagtaaatgtaacacagaagctgctttttatttagttttattatttttaattaattttttttgacaaggtcttgctctgccacccaggctgaagtacagtagcatgatcagaactcactgcagccttgacctcctgcacttaagtgatcctcctgcctcagcctcccatgtagctgggaccacaggca

SEQ ID NO: 195586 - DNA, 601 bp, Human
ctcatactgccctcacgtaatgctggtattagggttacactagcattccataaggaactgaggaacttttccattcaattatctggaaaagtaaatgtaacacagaagctgctttttatttagttttattatttttaattaattttttttgacaaggtcttgctctgccacccaggctgaagtacagtagcatgatcagaactcactgcagccttgacctcctgcacttaagtgatcctcctgcctcagcctcccatgtagctgggaccacaggcatgagccatcacgcccagctaatttrtgtatttttagtacagacaggttttcaccatgttgctcaggcttatctcaaactgctgagctcaagccatccgttcacctcagcctcccaaagtgacgagattacaggcatgaaccaccgtatccagccagctattttttaaaaggataaaacttgtctctaaaactgtctatggaataagtgcctttattgtagctatacattttgactaccaatgtaatttagttaatgattataggtctattctatttgcttgagtaaacttttacaacttattattttcctagaaaattgtacagt

SEQ ID NO: 195587 - DNA, 601 bp, Human
tctttgtttatttcaggtgttgaaaacttagtctgcaaggactttgttttttacggttatgctggttgtttccccgtgcctttttcttaaactttatggaatttgcaaatacattttgtgatgtttcctgaaggtttatagactacagaagcttataagcatgcagttttgaagattatgtcctccttcacaccaaaagtagtttttgttttccaaagtatgtctaactggcctttcaaagatcaatcatttttaacccactaaaaactttctcacctgtttcctcctgttttaccctggkttcttattctctgtgttggacagcctctgatatcactttcagaacttaaaactagtttgaaacatctctatgaaatatctctacttggtaaattaaacagcaccattattaacctttgctttgtaacctatgtctcttattagagtatcactgacaatcggatggttgtggtagctcacacttataatcccagcactttgagaggctgtgataggaggatctcttgagcccaggagttcaagcccagcctgggcaacatagtgagaccctgtctcaacaaagaattaaaataaaaaaaat

SEQ ID NO: 195588 - DNA, 601 bp, Human
tgtgttggacagcctctgatatcactttcagaacttaaaactagtttgaaacatctctatgaaatatctctacttggtaaattaaacagcaccattattaacctttgctttgtaacctatgtctcttattagagtatcactgacaatcggatggttgtggtagctcacacttataatcccagcactttgagaggctgtgataggaggatctcttgagcccaggagttcaagcccagcctgggcaacatagtgagaccctgtctcaacaaagaattaaaataaaaaaaattagccaggcatwgtggcgcatgcctgtagttccaactactccagaggttgaagtgaaaggatcacttgagcccgggaggtcaaggctacagtgagctgtgactgcaccactgccatgctccagcctgggcaacaaagtaaggccctgtctcaaaacaaaacaaaaagaatttcactgaggataaaccagtcttttctttcctcaacttcataatggtattaattttcatctcaaaaaatacttgtaggcatagcttagaaagtacaatattatctttcagagatttattttccttacaggactttcctatat

SEQ ID NO: 195589 - DNA, 601 bp, Human
ttcccttttcgtcattttgaagtcaaccagctatggcttctataaacaacctgttacatattatattttgtgctactgtaaatttaaataagaatgaatttacaacacgactgttgaaaatcaacatgagaacttagatttgccttatcttccccctttctccttatttctctgcagttcatcatcattgataataatcccaaccaaaagcaaaacaccagacccatagagattttataaagcaataaaagaactgtatatcagcaaagttattatggttcattagaaacagcggccatgsgaaaaatgccatcaaaagttgccaagtttctgaaatttttattttaaaagattcttcgaacactaaacattttgctgacattgccttgttcatactgcaatgcttatcattagaactgcaaatgacagacagctacctggttttaaaagcccccaatatgacacagggtagactgagaaacttttcccctcatttctaatccttcctttaggtcacaatgctatgggacttgaattcttcttgaaaaagctttgctttcggctgggattcttataaaaatgatgaactgcagagaaatac

SEQ ID NO: 195590 - DNA, 601 bp, Human
atgtcatttttgaggcaaaagaaaaaaccgtgaaaaataaaccccaattatacctaaaaatctaagctgctttattagatcccaaaataaatattaaggcttacattaaaatattaagttaacattaaatatgcagctgtattcaatatgtaaagagatatttataaaacgcctctgttaagaactttagaaacaaaagatattttagagatcatctaatctcaaggttctcaaatttcaatacatagactagtgccagactaggtgtgtaagaaatatcaaggtggtttaaggacatgcyccctagtccttcccaagagagtctcattcagcagatctgggctggttgcctgaaactatgtaacgtatacaagaatccagatgatactggtgtgcagccagacttcacaaacactggcttaatctaactgggaagccaagctccagaaagctgaagtgccttaccaaagtctcaataggcttgttaatggcaaagccagaacaggagcccacgtctgcaaataccatgtccaccgctctttaaaagacaacagttgcctatttgtcttccatgccaattctgtatgtgactctggcataa

SEQ ID NO: 195591 - DNA, 601 bp, Human
attatacctaaaaatctaagctgctttattagatcccaaaataaatattaaggcttacattaaaatattaagttaacattaaatatgcagctgtattcaatatgtaaagagatatttataaaacgcctctgttaagaactttagaaacaaaagatattttagagatcatctaatctcaaggttctcaaatttcaatacatagactagtgccagactaggtgtgtaagaaatatcaaggtggtttaaggacatgccccctagtccttcccaagagagtctcattcagcagatctgggctggktgcctgaaactatgtaacgtatacaagaatccagatgatactggtgtgcagccagacttcacaaacactggcttaatctaactgggaagccaagctccagaaagctgaagtgccttaccaaagtctcaataggcttgttaatggcaaagccagaacaggagcccacgtctgcaaataccatgtccaccgctctttaaaagacaacagttgcctatttgtcttccatgccaattctgtatgtgactctggcataaactgccagtacaatgaatgcatctccagagaccaaatgggcccagc

SEQ ID NO: 195592 - DNA, 601 bp, Human
ttggcacatatttgtcttatacatggattaaaaacaaaagcattcacaaatagttaaacctaattatagggagtggcaaatctcatctacaaagcttctatctcaagaaaaagaacagtacagggtggattttccctccctcatcaggtgagttgaccttattttcaatatgcagagattccacattcgcaccacttttgaaagttggtggaaaaggaagttgggcaatgcctcccttagattggtagctggggagagaattatctatctttaaaaaactaaaataaaaacaggccaggcrcggtggctcacacctgccatgccagcactttgggaggccgaggcaggcggatcatgaggtcaggagatgaagactatcctggccaacatggataaactgtctctactaaaaatacaaaaattagctgggtatggtggcacgtgtctgtaatcccagctactcaggaggctgatgcaggagaattgtttgaactagagaggtggagtttgcagtgagctgagatcacgccactgcactccagcctggcgacagagcaagactccgtctcaaaaaaataaaaataaaaaataaaaacaaaac

SEQ ID NO: 195593 - DNA, 601 bp, Human
caaaaattagctgggtatggtggcacgtgtctgtaatcccagctactcaggaggctgatgcaggagaattgtttgaactagagaggtggagtttgcagtgagctgagatcacgccactgcactccagcctggcgacagagcaagactccgtctcaaaaaaataaaaataaaaaataaaaacaaaacttcataaccctagtcttggtcatagatacagacaaaataaaacataaatcaaaagcaagagtaatggcaagcattacccatgaaaagaaaacttaaaactgccaaattgtaggasgcagagcagcaccaagtgcacaggcttggaatcctggctctactgcatgacatgggcaaatcatgcaacatcttctagcttcaactttctcatctgcaaagcaggggcgagggcctgctgggagaaccacgtggcatgattctgccaagtgtaaaaggatacaaatatgggggtcgatcaccacaataacacaagtccagaggagtttccatcacagtggaaactcctgagtgttgtgtccatcttgtaaaggctaagtttctgtagtgatctttgaaagttttgtaatcctgtgaccca

SEQ ID NO: 195594 - DNA, 601 bp, Human
tccaactacaaaaatggacataaacgctcaacaactacatgctaaatttataatgttttaaaaatagaaaatgtaaaaacattagaaatttgtagcataaactggaaactggtcagtttacataaaaactgaagtataattgataccatattgttttggaagttatatcaaaataagtgctatttgtccttgaaatcaggcctaggaacatttaaagcttatgaagtgcaatacatgccacttgcatcttactgacttcatgaagcttttaaaatttgtgcagtgattacactaacaaggyagccgggtataaaaacatagaaagttaaagaaattaaacactgctgatgtagttgattatactacttccttaaactatgtcatgtcataggcatctaacaaacctaatgatgctaaccttcggttgaagagagctgttacattttagaaaacgtgaaactaaaagcagaagagttactcatttcaagtttttcccacaacattctctaacccgcttttccaattaacaactggctaatgaatgatctcccaaagcagtgcccaagttttaaatgctgtatactctattgtcaatctccct

SEQ ID NO: 195595 - DNA, 601 bp, Human
tgataccatattgttttggaagttatatcaaaataagtgctatttgtccttgaaatcaggcctaggaacatttaaagcttatgaagtgcaatacatgccacttgcatcttactgacttcatgaagcttttaaaatttgtgcagtgattacactaacaaggcagccgggtataaaaacatagaaagttaaagaaattaaacactgctgatgtagttgattatactacttccttaaactatgtcatgtcataggcatctaacaaacctaatgatgctaaccttcggttgaagagagctgttayattttagaaaacgtgaaactaaaagcagaagagttactcatttcaagtttttcccacaacattctctaacccgcttttccaattaacaactggctaatgaatgatctcccaaagcagtgcccaagttttaaatgctgtatactctattgtcaatctccctttagagattcccaatgcataccagcaagaaaaggtgctgagaagccctgtgagaacatttccccaacatctgaccatagatccctacattactgaatggttcttgatagcccctggggttactgtcccacccagccccat

SEQ ID NO: 195596 - DNA, 601 bp, Human
catgtcataggcatctaacaaacctaatgatgctaaccttcggttgaagagagctgttacattttagaaaacgtgaaactaaaagcagaagagttactcatttcaagtttttcccacaacattctctaacccgcttttccaattaacaactggctaatgaatgatctcccaaagcagtgcccaagttttaaatgctgtatactctattgtcaatctccctttagagattcccaatgcataccagcaagaaaaggtgctgagaagccctgtgagaacatttccccaacatctgaccatagawccctacattactgaatggttcttgatagcccctggggttactgtcccacccagccccatcacacacacagtcacttccagattcctggaaattgatgaacatgcaaaatttctcccaaattttcagattgaatagggttgctaattttttactttgctaggtgagagtatgtgaaaaacaacatagttttataaaatacaaaataaaaaaagaataaaataaaaacatgcaagtgaaatccttctggaaattgcaaaatgctctctggatagatttatttttacagtgaaccctaatagg

SEQ ID NO: 195597 - DNA, 601 bp, Human
ttgttcagagacacctaaatgacttctcatcaaatgtggatttgaaacctagagcatatcctggcatgcctggggttggtaagggtcaatgaagtaaaggtcattatcaagctcactcacactcagaggcttataagttctgatactgaaaacactttcaccaaagcccaatctgaccttcaaaattagtgacttccccaggcagggacgtcacctttctggattcctagggcgtggcatgaaaagccagctcctcacctcacctctctttgcctattaacccattcccatatttttattkccttcttgactttctcattctccttccaataacctttctcctgggtcatctgcaaacctccaaatcccactggaaatatatgcctatatatcgttaagctttttgcggaacaggtaatctacttctttggcttaacgaataccaatttctctcccatgaacccaatttcccacaaagctctccggagtgaaggctgcatgatctctcacacccccacccccatctttagacttcttcacttttaaagtcgtgttgtccagttaatactactgtcccctgtggagaagctggagcctggct

SEQ ID NO: 195598 - DNA, 601 bp, Human
gttctgatactgaaaacactttcaccaaagcccaatctgaccttcaaaattagtgacttccccaggcagggacgtcacctttctggattcctagggcgtggcatgaaaagccagctcctcacctcacctctctttgcctattaacccattcccatatttttatttccttcttgactttctcattctccttccaataacctttctcctgggtcatctgcaaacctccaaatcccactggaaatatatgcctatatatcgttaagctttttgcggaacaggtaatctacttctttggcttaaygaataccaatttctctcccatgaacccaatttcccacaaagctctccggagtgaaggctgcatgatctctcacacccccacccccatctttagacttcttcacttttaaagtcgtgttgtccagttaatactactgtcccctgtggagaagctggagcctggcttagagcaccttgtttcttcctcctggccttcatgtccattaggatgactcagaaaggctgtggcctcagtttctctactaattctacacaaatgacctttaccatcatcccactttttgaacacgtatacaccatg

SEQ ID NO: 195599 - DNA, 601 bp, Human
tccctgcagctctgccatccctttcatctcttacatctgtttttgatgccaccaatgttcctgcaatatcttctcctttccaccctgcctcttacctaaggctgtcaccctgagtgcaggcagacctctactttgcaacctgcatggtgaatcctggcccaatggatctcacatcataatgctcctcagctaatagccttttcttttggctttacctgcaaaaattgtttctaggaaagtaatttcatccattattaataaaacctcattttcaagtaaattagaggaagaacaacagtcygaatttttaaggaaatgttttaattcaagttctatagaagttaccagcatcctgaaaaatagtaattgctagagtctttttaaggaaaagattaagatgctttgtaattagtataataatttatatgaaaataatgagttccactgttcttatgacaaattctgatttaacaaggataataaagttgcactattctagaaaacagacaaaaggttaaataaaatcctatattttaacagctttcaggcaacagactactgaatggcttcaagaaaaattattaccttactgaaaaacatt

SEQ ID NO: 195600 - DNA, 601 bp, Human
tttgatgccaccaatgttcctgcaatatcttctcctttccaccctgcctcttacctaaggctgtcaccctgagtgcaggcagacctctactttgcaacctgcatggtgaatcctggcccaatggatctcacatcataatgctcctcagctaatagccttttcttttggctttacctgcaaaaattgtttctaggaaagtaatttcatccattattaataaaacctcattttcaagtaaattagaggaagaacaacagtccgaatttttaaggaaatgttttaattcaagttctatagaagytaccagcatcctgaaaaatagtaattgctagagtctttttaaggaaaagattaagatgctttgtaattagtataataatttatatgaaaataatgagttccactgttcttatgacaaattctgatttaacaaggataataaagttgcactattctagaaaacagacaaaaggttaaataaaatcctatattttaacagctttcaggcaacagactactgaatggcttcaagaaaaattattaccttactgaaaaacatttttgttaattccctcaaacggatacaatacttattctccct

SEQ ID NO: 195601 - DNA, 601 bp, Human
caacctgcatggtgaatcctggcccaatggatctcacatcataatgctcctcagctaatagccttttcttttggctttacctgcaaaaattgtttctaggaaagtaatttcatccattattaataaaacctcattttcaagtaaattagaggaagaacaacagtccgaatttttaaggaaatgttttaattcaagttctatagaagttaccagcatcctgaaaaatagtaattgctagagtctttttaaggaaaagattaagatgctttgtaattagtataataatttatatgaaaataaygagttccactgttcttatgacaaattctgatttaacaaggataataaagttgcactattctagaaaacagacaaaaggttaaataaaatcctatattttaacagctttcaggcaacagactactgaatggcttcaagaaaaattattaccttactgaaaaacatttttgttaattccctcaaacggatacaatacttattctccctaaaaatgttggggtggcccgatctaatggccactataactgctttcatactcgcctcgattccatgttatattaaccatacaaatgtaagaatg

SEQ ID NO: 195602 - DNA, 601 bp, Human; identical to SEQ ID NO: 37418

SEQ ID NO: 195603 - DNA, 601 bp, Human; identical to SEQ ID NO: 37419

SEQ ID NO: 195604 - DNA, 601 bp, Human; identical to SEQ ID NO: 37420

SEQ ID NO: 195605 - DNA, 601 bp, Human; identical to SEQ ID NO: 37421

SEQ ID NO: 195606 - DNA, 601 bp, Human; identical to SEQ ID NO: 37422

SEQ ID NO: 195607 - DNA, 601 bp, Human; identical to SEQ ID NO: 37423

SEQ ID NO: 195608 - DNA, 601 bp, Human; identical to SEQ ID NO: 37424

SEQ ID NO: 195609 - DNA, 601 bp, Human; identical to SEQ ID NO: 37425

SEQ ID NO: 195610 - DNA, 601 bp, Human; identical to SEQ ID NO: 37426

SEQ ID NO: 195611 - DNA, 601 bp, Human; identical to SEQ ID NO: 37427

SEQ ID NO: 195612 - DNA, 601 bp, Human; identical to SEQ ID NO: 37428

SEQ ID NO: 195613 - DNA, 601 bp, Human; identical to SEQ ID NO: 37429

SEQ ID NO: 195614 - DNA, 601 bp, Human; identical to SEQ ID NO: 37430

SEQ ID NO: 195615 - DNA, 601 bp, Human; identical to SEQ ID NO: 37431

SEQ ID NO: 195616 - DNA, 601 bp, Human; identical to SEQ ID NO: 37432

SEQ ID NO: 195617 - DNA, 601 bp, Human; identical to SEQ ID NO: 37433

SEQ ID NO: 195618 - DNA, 601 bp, Human; identical to SEQ ID NO: 37434

SEQ ID NO: 195619 - DNA, 601 bp, Human; identical to SEQ ID NO: 37435

SEQ ID NO: 195620 - DNA, 601 bp, Human; identical to SEQ ID NO: 37436

SEQ ID NO: 195621 - DNA, 601 bp, Human; identical to SEQ ID NO: 37437

SEQ ID NO: 195622 - DNA, 601 bp, Human; identical to SEQ ID NO: 37438

SEQ ID NO: 195623 - DNA, 601 bp, Human; identical to SEQ ID NO: 37439

SEQ ID NO: 195624 - DNA, 601 bp, Human; identical to SEQ ID NO: 37440

SEQ ID NO: 195625 - DNA, 601 bp, Human; identical to SEQ ID NO: 37441

SEQ ID NO: 195626 - DNA, 601 bp, Human; identical to SEQ ID NO: 37442

SEQ ID NO: 195627 - DNA, 601 bp, Human; identical to SEQ ID NO: 37443

SEQ ID NO: 195628 - DNA, 601 bp, Human; identical to SEQ ID NO: 37444

SEQ ID NO: 195629 - DNA, 601 bp, Human; identical to SEQ ID NO: 37445

SEQ ID NO: 195630 - DNA, 601 bp, Human; identical to SEQ ID NO: 37446

SEQ ID NO: 195631 - DNA, 601 bp, Human; identical to SEQ ID NO: 37447

SEQ ID NO: 195632 - DNA, 601 bp, Human; identical to SEQ ID NO: 37448

SEQ ID NO: 195633 - DNA, 601 bp, Human; identical to SEQ ID NO: 37449

SEQ ID NO: 195634 - DNA, 601 bp, Human; identical to SEQ ID NO: 37450

SEQ ID NO: 195635 - DNA, 601 bp, Human; identical to SEQ ID NO: 37451

SEQ ID NO: 195636 - DNA, 601 bp, Human; identical to SEQ ID NO: 37452

SEQ ID NO: 195637 - DNA, 601 bp, Human; identical to SEQ ID NO: 37453

SEQ ID NO: 195638 - DNA, 601 bp, Human; identical to SEQ ID NO: 37454

SEQ ID NO: 195639 - DNA, 601 bp, Human; identical to SEQ ID NO: 37455

SEQ ID NO: 195640 - DNA, 601 bp, Human; identical to SEQ ID NO: 37456

SEQ ID NO: 195641 - DNA, 601 bp, Human; identical to SEQ ID NO: 37457

SEQ ID NO: 195642 - DNA, 601 bp, Human; identical to SEQ ID NO: 37458

SEQ ID NO: 195643 - DNA, 601 bp, Human; identical to SEQ ID NO: 37459

SEQ ID NO: 195644 - DNA, 601 bp, Human; identical to SEQ ID NO: 37460

SEQ ID NO: 195645 - DNA, 601 bp, Human; identical to SEQ ID NO: 37461

SEQ ID NO: 195646 - DNA, 601 bp, Human; identical to SEQ ID NO: 37462

SEQ ID NO: 195647 - DNA, 601 bp, Human; identical to SEQ ID NO: 37463

SEQ ID NO: 195648 - DNA, 601 bp, Human; identical to SEQ ID NO: 37464

SEQ ID NO: 195649 - DNA, 601 bp, Human; identical to SEQ ID NO: 37465

SEQ ID NO: 195650 - DNA, 601 bp, Human; identical to SEQ ID NO: 37466

SEQ ID NO: 195651 - DNA, 601 bp, Human; identical to SEQ ID NO: 37467

SEQ ID NO: 195652 - DNA, 601 bp, Human; identical to SEQ ID NO: 37468

SEQ ID NO: 195653 - DNA, 601 bp, Human; identical to SEQ ID NO: 37469

SEQ ID NO: 195654 - DNA, 601 bp, Human; identical to SEQ ID NO: 37470

SEQ ID NO: 195655 - DNA, 601 bp, Human; identical to SEQ ID NO: 37471

SEQ ID NO: 195656 - DNA, 601 bp, Human; identical to SEQ ID NO: 37472

SEQ ID NO: 195657 - DNA, 601 bp, Human; identical to SEQ ID NO: 37473

SEQ ID NO: 195658 - DNA, 601 bp, Human; identical to SEQ ID NO: 37474

SEQ ID NO: 195659 - DNA, 601 bp, Human; identical to SEQ ID NO: 37475

SEQ ID NO: 195660 - DNA, 601 bp, Human; identical to SEQ ID NO: 37476

SEQ ID NO: 195661 - DNA, 601 bp, Human; identical to SEQ ID NO: 37477

SEQ ID NO: 195662 - DNA, 601 bp, Human; identical to SEQ ID NO: 37478

SEQ ID NO: 195663 - DNA, 601 bp, Human; identical to SEQ ID NO: 37479

SEQ ID NO: 195664 - DNA, 601 bp, Human; identical to SEQ ID NO: 37480

SEQ ID NO: 195665 - DNA, 601 bp, Human; identical to SEQ ID NO: 37481

SEQ ID NO: 195666 - DNA, 601 bp, Human; identical to SEQ ID NO: 37482

SEQ ID NO: 195667 - DNA, 601 bp, Human; identical to SEQ ID NO: 37483

SEQ ID NO: 195668 - DNA, 601 bp, Human; identical to SEQ ID NO: 37484

SEQ ID NO: 195669 - DNA, 601 bp, Human; identical to SEQ ID NO: 37485

SEQ ID NO: 195670 - DNA, 601 bp, Human; identical to SEQ ID NO: 37486

SEQ ID NO: 195671 - DNA, 601 bp, Human; identical to SEQ ID NO: 37487

SEQ ID NO: 195672 - DNA, 601 bp, Human; identical to SEQ ID NO: 37488

SEQ ID NO: 195673 - DNA, 601 bp, Human; identical to SEQ ID NO: 37489

SEQ ID NO: 195674 - DNA, 601 bp, Human; identical to SEQ ID NO: 37490

SEQ ID NO: 195675 - DNA, 601 bp, Human
gtgcaagtccactgatgtagaattcagtttcaaactgagacactgcaaacaaaagggatacaggagtcatcatcaacaggggcaaacagcagcacacatctggagggacacaatgactgtgaatgctagtggacccctttttaaaagctaacgtaaaggggacaccgttgaacatactttcataactcagcactgcaagtgcttcacaacgatcaatcctggaaacgaatatgtgggaaagtagacttgcaaattcccatcacaaacaaaaatgaatccaacaataatagcagcatgaatrgtcaagggtgacactgtgcttaggtagtttaaaatgacatagactacatgaagatgctttgaaacccataaaaagaaatataaaccattattagtaacagtaataattttttaaaattcctgagttcgtttttctcaattggggcattatagtagtacaaaggtcacaaagaatgttatctgtaattatgaaacactattttggagaagagggatattatttaaagaacttgaagttaaaaaaagatgcataaatacagattactttatgatgaaacatcagtatttcttaagtgaaata

SEQ ID NO: 195676 - DNA, 601 bp, Human
ggcaaacagcagcacacatctggagggacacaatgactgtgaatgctagtggacccctttttaaaagctaacgtaaaggggacaccgttgaacatactttcataactcagcactgcaagtgcttcacaacgatcaatcctggaaacgaatatgtgggaaagtagacttgcaaattcccatcacaaacaaaaatgaatccaacaataatagcagcatgaatggtcaagggtgacactgtgcttaggtagtttaaaatgacatagactacatgaagatgctttgaaacccataaaaagaaatrtaaaccattattagtaacagtaataattttttaaaattcctgagttcgtttttctcaattggggcattatagtagtacaaaggtcacaaagaatgttatctgtaattatgaaacactattttggagaagagggatattatttaaagaacttgaagttaaaaaaagatgcataaatacagattactttatgatgaaacatcagtatttcttaagtgaaataaaggctagagaaaaataataaatttctctttcctttaaaaaaaaatccatttaaaatcaagaagacatattgcatcactt

SEQ ID NO: 195677 - DNA, 601 bp, Human
acatagactacatgaagatgctttgaaacccataaaaagaaatataaaccattattagtaacagtaataattttttaaaattcctgagttcgtttttctcaattggggcattatagtagtacaaaggtcacaaagaatgttatctgtaattatgaaacactattttggagaagagggatattatttaaagaacttgaagttaaaaaaagatgcataaatacagattactttatgatgaaacatcagtatttcttaagtgaaataaaggctagagaaaaataataaatttctctttcctttaaaaaaaaatccatttaaaatcaagaagacatattgcatcacttaagaagtatgtgactttaattgcactggaccccaaagatctgacagaaagctcagaagtacacatattattattatatgattctaattattagctgctataaaatataaaagatcattgttttaagagactgagattgggagtggcttgtttcagagcagaagctaactgatacagtagtggtattacagagatccttccagaaatcatactctacacttcacagattcatttgggagtaaactcttgttctgaccc

SEQ ID NO: 195678 - DNA, 601 bp, Human
cacttaagaagtatgtgactttaattgcactggaccccaaagatctgacagaaagctcagaagtacacatattattattatatgattctaattattagctgctataaaatataaaagatcattgttttaagagactgagattgggagtggcttgtttcagagcagaagctaactgatacagtagtggtattacagagatccttccagaaatcatactctacacttcacagattcatttgggagtaaactcttgttctgacccaccacattttctaagtttcttcattcagatcatctccayggttctgtggtattagctgcagatttagttaacttccacactcttttcccaatgaggggacctcaatgtatcatactggaaccaatactgaatgctgagtaaggaaatttgggttataacttccactaaattgaacttgaacaagtcattttaacatttcccaactataagagaaaggaatgacagtagaaataaaattcataatacagatgaaatactgaattttcctttgtccccctctttctttcccttgcagattacttagtgttccttgtctctgctgacctttaatgatcctcc

SEQ ID NO: 195679 - DNA, 601 bp, Human
ctttatatttcaaattttcagtggacgaatggaagtttcagtttatttactttcactaaaattctattctattccacgtaaaaatgactctattaatttaaataaaatattttgttctcctaaaggagactcagtttgaatacaggtggctgtcagttctaatactacagaagctcattttcaacctgattatctggaaaagataaatcacaaagaaaataaacataaattctgctagagaggaaatacatgaaaacagggagcaaaagctggacagggtgtttttttttttggtttttgtttttttttttttggagtgaaaaatgcaggcagagttcctaaaggtagccacaaaagacagtggctttacttcagatcaaggtcatctagaaagccagctgaggctcagctcgcgggccctgcagggagtgcgctatgttcacctagatgatggccttatactatggtgggcattacagctgaggcacagccttcctcctcctgatggaggtggaaggacttctgcattctgctttattcaggaggataaaagcattcctagacatgctagaaataactcaagaaaaaagacagagattct

SEQ ID NO: 195680 - DNA, 601 bp, Human
aaaagacagagattctagcagagtaagaaagagaggttcaaaaggactatattcacaggaaaattctattcagcaaggtcttctagatccagaatgaggatgagatgaatacgattctgtacacggtcctcatccaaaagggaggctagaggccccttgattagctgccccatggaaatataatgtgggccaaaacacaaatgacatatgtaatttaaaatttcccagtagccacgtgctatagcttggatgtgtggccctgcccaaatctcatgttgaactgtaatccccagtgttggasgaggggcctggtgggaaatgattagatcatgggaacggatttctcatgaatggtcatttctcatgactgttttagcacaatcctcttggtactgtcctcacgacagtgagttctcacaagatctggtggtttagaagtgtgtggcatctacccctgcctcttgctcctgccctggccatgtgaggtgccttctcccacttcgtcttccaccatgatttaagtttcctgaggcctccccagaagccaaccagatgccagcatcatgcttactgtatagcctgcaggactgtgagaattaaa

SEQ ID NO: 195681 - DNA, 601 bp, Human
tatgaaaaatatggcagcttgctttctgagatttcctggctcagctcctccctggtgttatctggacctgtttcttttgtttctattgtccctgtctcattcaggctttattctgctcccagcagtgtctcctcagtggagagaggaggcctggctgctccacagtgtgagttgccaggggtagctgggctgcccagcctctcacacctaactgcaggtcctgggcccagttctcagagcagcctcttggcctttccagtgaatgccaactggctatcttggagttcccctggcctcaagyctgctagatgaccacttgctcccctctgctttctctcacacagatgctgatatcaccctgcagcgatcagtgttttattttcccattaatttgtgtcttggggctctcaggactacctttgtcactaagttttgttgtaaatgttgtctgtgggtttttggttttgtgacctagttgttctgcttttatgggaggactaggtagtttgaaaaattatgctgccactgccactacattcccagaatcttctaaccacaaaattttcacatattgctgttatacatgttttaatacatcaac

SEQ ID NO: 195682 - DNA, 601 bp, Human
cagtgtctggccctcgatagcatacacaccatcagttgcataatgaatgccatatgattggtataaaaattaacaagaaagaactttctcattccttgggtctcataatctctgagggttacaacttaattcaatgaagagtgactgaggctgggtgcggtggctcacgcctttaatcacagcaatttgggaggccgaggtggacggatcacttgaggtcaggagttcgagaccagcctggccaccatggtaaaaccccgcctctattaaacatataaaaattagctggcagtggtgacarcgtgcctgtagccccagctacttgggaggctgaggcaggagaatcgcttgaacccgcgagcacccaggaggcagaggctgtagtaagctgagatcctgccactgcacaccagcctgggtgatagagcgagactctgcctcaaaaaaaaagaaaaaagagtaactgagtatcaattacacgagacagtcttctagatgcatcaagatgactaagacctgaccctaacttaaaggagattgtgagtctgaatatttaaagaaataattaggccaggtgtggtggctcacgcttgtaatccca

SEQ ID NO: 195683 - DNA, 601 bp, Human
ttaaaaaaaaaactgtttaaaaccctaatggatattagattacaaaggataaaaatcaaaatttgtttaaagtaaaaaaccatcctccaataattcccaactaggttatctcacttcttatctgtgtattcaaacctatgagacaacattaaatcaatatttttattacttgtacctctgtcatatatgtttatagatacattttattgagaaatgcaattataaaacattatcaatctcctcggaatcattcagtaaacccttatttacatcttccccaaattgtctttaaattacaaaktttataaaacacaattttcagatcttctgattttaaaagaaaccactatttttctctctcactgtaactaaatataatactaatattaataatagctcccatttaatgaacattactatgctgtgaggcagtatgctaaatatttacatacaatattgcttttcaccacaaccaccctatggttattttagagagggaaggaggctcagaggggttaagtaacttgactaaagtcacttaagtggaagataagagaagtaggaatctgaagtcctatttttcccaaccataagtcactct

SEQ ID NO: 195684 - DNA, 601 bp, Human
tattgagaaatgcaattataaaacattatcaatctcctcggaatcattcagtaaacccttatttacatcttccccaaattgtctttaaattacaaattttataaaacacaattttcagatcttctgattttaaaagaaaccactatttttctctctcactgtaactaaatataatactaatattaataatagctcccatttaatgaacattactatgctgtgaggcagtatgctaaatatttacatacaatattgcttttcaccacaaccaccctatggttattttagagagggaaggagkctcagaggggttaagtaacttgactaaagtcacttaagtggaagataagagaagtaggaatctgaagtcctatttttcccaaccataagtcactctagaaaatgtaagtcagggccgggtatggtggctcacgcctgtaatcccagcatgttgggaggccaaggtgggaggatttcttgagcccagtttgataccagcatgggcaacaaagggagaccacatctttacaaaaaattaaaaaattagccaggcatggtggtgcacgcctgtagtcccagctacttagaaggctgaggtggg

SEQ ID NO: 195685 - DNA, 601 bp, Human
ttcattgtcttatattcatttatgaaaatgcattgagggccctttatgatagatagtgtcttattcccaagagattctggccccttagtcaccagatattagtattttataatcaactggatgtaatacccacagacttttcaataagtttagacattctgtcagcatgaccacttatcactgaaaatacatttggaaataacggcacttcaacagcttcaggctgtgctaagaagcagacacattaaagtaaaactgacttcacaatgctttacatcagcaaattatggagaagatctgmtacatgaagtgaaattgaaaagaatggctaatggacaaaataacaaaaacattcaaatcagacaggagccgaacagtacacacagataaaaaactgctgaaaacaaatttagtttgcaatttaattccgtattttataatcaatattcagcaaactattgtcaattaaatgacaacactaagctgataggattatctcatctaccaaattttagtctcctgaaacagcactgatgaggaatatttagtgagtatattacagcacattgcttagacaaaagaaaaggaaaggcattgccaa

SEQ ID NO: 195686 - DNA, 601 bp, Human
ctgacttcacaatgctttacatcagcaaattatggagaagatctgatacatgaagtgaaattgaaaagaatggctaatggacaaaataacaaaaacattcaaatcagacaggagccgaacagtacacacagataaaaaactgctgaaaacaaatttagtttgcaatttaattccgtattttataatcaatattcagcaaactattgtcaattaaatgacaacactaagctgataggattatctcatctaccaaattttagtctcctgaaacagcactgatgaggaatatttagtgagtatrttacagcacattgcttagacaaaagaaaaggaaaggcattgccaatgacctgctaatcacaaggttcaaaccaaatgttacactttattttataaatataaaactaccttgttgcatcaactaaacttaagctaaacactaaaaaatagcaaacaagggcttttcttctttttaaaagggctgaaagaagcataatctaagtttggttccctttccttagaaacaattccaaaggtcacccaaggcaatcaggttctataaattatctaaaaatgtggaggagaagcaatgaagaaaagc

SEQ ID NO: 195687 - DNA, 601 bp, Human
gtatctgaatgtctggaacaagactctgtaaacaaaggccaggggctgggtagaggaaacatgggaagcactgtgtgacaccatgattacaagcaacaactttacggctaggcacacctaagtgcaaaaactgccttgtttatgaataatcttgagcaggttacctaacccttctgaacatcagcttcttcacttacaccatggggatagtagccgctacccactcgcatactgggaagattagatgaccttctgtttgcaatgtattcagcactgtgcttggtggtggttgttatataasgaacaatatatatttgttacttcaggtgcttcagatttcttaccattacttattatggagaaacttcattaattccactcctaacaacaaaaacctgagtctacactactgagcggggaaagagttgttacatccctcccaaaaggaggaatgaatagatgaacagatacgtaataaagcaaatatagtaaaatcttaactgcagaatcctggaggttctattcactacaaagttcttttctttaatgaaaatttcataacaaaatgttagaaaaaaaattcaatgcagaacagattatt

SEQ ID NO: 195688 - DNA, 601 bp, Human
gctaggcacacctaagtgcaaaaactgccttgtttatgaataatcttgagcaggttacctaacccttctgaacatcagcttcttcacttacaccatggggatagtagccgctacccactcgcatactgggaagattagatgaccttctgtttgcaatgtattcagcactgtgcttggtggtggttgttatataaggaacaatatatatttgttacttcaggtgcttcagatttcttaccattacttattatggagaaacttcattaattccactcctaacaacaaaaacctgagtctacastactgagcggggaaagagttgttacatccctcccaaaaggaggaatgaatagatgaacagatacgtaataaagcaaatatagtaaaatcttaactgcagaatcctggaggttctattcactacaaagttcttttctttaatgaaaatttcataacaaaatgttagaaaaaaaattcaatgcagaacagattattacagaaatttatactgaactatctataacagaacagaaaaccatacatacctagatcctcaagtaaaaacaccttgaagaatgccagctgtcatcatttctattga

SEQ ID NO: 195689 - DNA, 601 bp, Human
ccttctgaacatcagcttcttcacttacaccatggggatagtagccgctacccactcgcatactgggaagattagatgaccttctgtttgcaatgtattcagcactgtgcttggtggtggttgttatataaggaacaatatatatttgttacttcaggtgcttcagatttcttaccattacttattatggagaaacttcattaattccactcctaacaacaaaaacctgagtctacactactgagcggggaaagagttgttacatccctcccaaaaggaggaatgaatagatgaacagatrcgtaataaagcaaatatagtaaaatcttaactgcagaatcctggaggttctattcactacaaagttcttttctttaatgaaaatttcataacaaaatgttagaaaaaaaattcaatgcagaacagattattacagaaatttatactgaactatctataacagaacagaaaaccatacatacctagatcctcaagtaaaaacaccttgaagaatgccagctgtcatcatttctattgagactcagactaagagatgaaaccacatcactcctgggcacacacacacaaagatcccactact

SEQ ID NO: 195690 - DNA, 601 bp, Human
tgccattttcacctcatttaccaaagaacagtggctcacactattcagggctaaaggaaattgtaatccagacctcctaatatttccctttctgttatcctacttaaggactcttatccaaactattttgcctcctgctgtggaaatggcttatattcttaaaggtttactcttaagaggggaaaaaatggtacttaaccattaaccatagtagtaaaatgtcagtaatgtgatactgttagtatccacatatggtctatttcacgtaaattacagtacagatgaaccacactgcaataaygtgatcccagggttctaggctaatagggccaccactgagccagctatcagcagtcacagagttgggatgaaagtctgcatagtgataataaccatcatggtttagtgagcatctactgtgtgccaagtaccatgttaggcacatttcttatgccatgtctaattcccacacccatcctaaaagatagatattatcacctccatttaacaggtgagaaaaggatggtcaagaaggttaagtaacctcatcaagatcacacacttcagcaaacttccttgcctccctggaagctttctggtg

SEQ ID NO: 195691 - DNA, 601 bp, Human
tcaagaaggttaagtaacctcatcaagatcacacacttcagcaaacttccttgcctccctggaagctttctggtggttctgtagagttagattctatccatttttaacgctatagtagtaagatcctggacaagtcatttacctcctaagcctcaatttcttcatctatagaataaaaagcaaactacctgcacttaaagagttcctgtgaggataaagtgagttactgcagtttatgtaagcagcacaatgccctccacctagtacatgatcaataagtatcagctaaggaaagaagatkacaattgctacatttttatacctctctggcaattaaaaatatccaaatactaatctctcaggacattgcattgagatgttgagaggcttttgtttttctttttattttctagtaggcaaggaaagaagaaaaagatattgaaacaattatctatatagtctagtcataaatcttgtctcttatcttggtcctcagtttttctcagcactgctacattcttcatatacctactgtccatacactaagcaatctgaactatgtagttatactcctaaagttaaaaaaaaagattaaaactct

SEQ ID NO: 195692 - DNA, 601 bp, Human
gacattgcattgagatgttgagaggcttttgtttttctttttattttctagtaggcaaggaaagaagaaaaagatattgaaacaattatctatatagtctagtcataaatcttgtctcttatcttggtcctcagtttttctcagcactgctacattcttcatatacctactgtccatacactaagcaatctgaactatgtagttatactcctaaagttaaaaaaaaagattaaaactctaccaccaacttctgacttcaagtacaaaatagcccagatttaaatgttataaccacattagycatgtgggtaatgtatgtctttctatttacagaaatacaatcatgtgcaaataatttatttcaacttcaccttggcagaataacccatcaaattgatattacccatccaccaagcaaatgggcaaatgaacttttcagctgactcataatatggcaattttttttctcagaataattttttcaaactaaattataaaagtcatggtacatcatccagggcatacttctcctgaacagctgtttcccagagtcactgattcattcaactcaatattaagcaccttctatgtgcaagtattg

SEQ ID NO: 195693 - DNA, 601 bp, Human; identical to SEQ ID NO: 37491

SEQ ID NO: 195694 - DNA, 601 bp, Human; identical to SEQ ID NO: 37492

SEQ ID NO: 195695 - DNA, 601 bp, Human; identical to SEQ ID NO: 37493

SEQ ID NO: 195696 - DNA, 601 bp, Human; identical to SEQ ID NO: 37494

SEQ ID NO: 195697 - DNA, 601 bp, Human; identical to SEQ ID NO: 37495

SEQ ID NO: 195698 - DNA, 601 bp, Human
ggatgagtgttgaagttactacaaggccaagccacaaggtggcaccaaaacaccaagattcatggaaaataatgcacattagttaatcaaaagatttgtatcgcaaaagttcttcaaatgattgtccgggaactaatttattttgtaaattgggaaatcaaaacctcttttaagtttttcactgaaaataagatattagtcacagattaaactgtaatagaaacagtctatgtttttcatttgactcaaataattgaacaatgacttttgaacagtaattcatgtcacaaaataaaaaaamaattggaattaagcttctttagaaatttcatagtatctagggtctttattttaacgggaagattctatcattcaaaaaacctgctggataaattttaatataaaatataactggtcaaaaacctctacgattaataaagatgtaattctaggaagtcatacattattaagaacacaataaatatttttcttgacatattccatttaaatcctttaagaaaagacatttatacagtatgtaacttaaggtatgcaatcctgaaacacatgtttatcctttcaaagcaaatgctgacaacag

SEQ ID NO: 195699 - DNA, 601 bp, Human
ataattgaacaatgacttttgaacagtaattcatgtcacaaaataaaaaaaaaattggaattaagcttctttagaaatttcatagtatctagggtctttattttaacgggaagattctatcattcaaaaaacctgctggataaattttaatataaaatataactggtcaaaaacctctacgattaataaagatgtaattctaggaagtcatacattattaagaacacaataaatatttttcttgacatattccatttaaatcctttaagaaaagacatttatacagtatgtaacttaaggyatgcaatcctgaaacacatgtttatcctttcaaagcaaatgctgacaacagattccataacagaattactaaaattcctaccactacaagcaatttcagtctaccttagtatattttatgtcctctacccaccccaaaagaggcaggggaaacaggttaacaggggaaagagagtaaattcacattttatttgtatttcctgtatatctttctcaatagactaatacaggcagaggaagcacaaaataaaatccctaaaattaaatatgatgtccatcatcacaagtaagcaaagtacag

SEQ ID NO: 195700 - DNA, 601 bp, Human
gaaacacaaagggttgggtccccaagcatgtagccagcactgtagctgtcccaggtaggaaggaaagcaggcactctgacaaaaggcaggcacctatggaaaaatcctgcatttaaaagaatacaaattatccagggagtaatccccaacttgtgactccatatgaataacaagacattcaaaaaaaacaaaagaacttaaaagtaaaatctaattcttatcatcataattctcatgtaacaacaaaattaagaaattaataacgaagaatgagagaaagaacaatacaaaacaaaaatgrtacaaaaaacattctcaatctttgggtaaaagaggaattcatatggtaaccagagtactttgaaaatgagaaatactataaacctaaactttatgggatacaatcaaagttgtaaaaaaaaggaaaatctagatttaaaagttaataatgaacatgacatgtcgctacacaacaaaacaaaaacatttcattgagggatacgaaaggagaactcaataaacagaaaggcacattattcatggatagtaagactccaattctcactaaagagcttaagtctcattaaattaacctataatt

SEQ ID NO: 195701 - DNA, 601 bp, Human
tgaacctaggaggaggaggttgcagtgagccaagattgtgccattgcactccagcctgggcaacaagagcaaaactctgtctcaaaataaataaataaataaataaaaattcactggaacttaaagaagtaatgtttgaggcatattgaacatgtattagaatgaatttacataaactgtatatacttttcaaataaaacattaacttcttcagaaaactgttaattaaatcttgttgcagttcctaccaaaatgcaagctcactccaatggaccctttctgttatacttggtgtgctccragctatgggaggaagcagaggtggcagaactctggcctccttttgcctcctactctacctcccaaaacaagaaactaaaaacttccagcagaggggaggaggcaaaggaaggacagacgaattctgaatccaggccatctcaggattgagtcccaaaaaccttgtggaccctgctctgacatgcaattaaaagagcaaagaagcttctcccaatgacatttctacaatgcagacaggcacatgccattctatgcaactgatgtgtgctcaaaaatggaggggggctaaaaattaacctct

SEQ ID NO: 195702 - DNA, 601 bp, Human
atctcaaaaatttaaagaacccaatgactaattcacacaatcaacacagccttgcttttagaaagggctcacttctatggatcccatatccaggcatgtaatgtcagtctatttccctttgctgaaggccagcagatagaatttgtgcacaacttgccaaaaatttgaaagctgcttttaaggttagccttcctctattaggtttaagtaattgcagctcttttatttcagagacacgaactggccacacgtttggcctgaacggtaatttctgaaatgtgtctgcaggcctgcagaaggytctctggattgccacagcgcctacttctccaggctctctcgcatgtggcctgcttctctccttgatgttacctgcctggccccgtcgaacatttatttctgcctttcctctccaccctactttattcttcactcatgagtccacttttcctatcctacatagtataaaaccttaaatgcctgctagtaattatggagtcatttctatatctctgaaactctcatgcaggatttgctttgatttgacatagagtttcatacagaagggagaatggccaaatgatccactctccattggctt

SEQ ID NO: 195703 - DNA, 601 bp, Human
cgaactggccacacgtttggcctgaacggtaatttctgaaatgtgtctgcaggcctgcagaaggctctctggattgccacagcgcctacttctccaggctctctcgcatgtggcctgcttctctccttgatgttacctgcctggccccgtcgaacatttatttctgcctttcctctccaccctactttattcttcactcatgagtccacttttcctatcctacatagtataaaaccttaaatgcctgctagtaattatggagtcatttctatatctctgaaactctcatgcaggatttgctttgatttgacatagagtttcatacagaagggagaatggccaaatgatccactctccattggcttttttatcctaatctctgtgaatttcaagcagaaacatattttctgacaagaatgccaaggaaagctttgctttggtgatttaagaaaacatgaactccttttcttacaaacattctatactaatttaactacctcaaaactacctgcctgtacttcactgacatttaataatatccattttttccttccagtcataaaactgcccacagacctactgagcacgaatgttctacaaa

SEQ ID NO: 195704 - DNA, 601 bp, Human
cagcttctctaaacaccaccaacagctctactgtgtccatcaagatagaatataaacatgtgggaagaaaaagagaacttcccaaatatattatttccttaaattcagtggttattttctgaacaagttataatgcttcaatctcctttatctgaatttaacatgtttaaaaccagttcagtatagacaaaatgttggtacgacggaaaacctctgtgcacaagggttcctagagcccactcaaatgccacttgcttacaaacaatattttagtaaacaccattcctatgcaacacagacttttttttttaacttgtattttaatttcaggggtttatgtgcaggtttgttatgtaggtaaactcgtgccacaggggtttgttgtacagattattttgtcacccaggtattaagcctactatccattagttattttttctgatcctctcccttctcccatcctccatcctccaataggccccagtgtgtgttgttcccctctatgtatccatgtgttctcatcatttagctcccacttacaaatgagaacatgtggtatttggttttccgttcctgcattagcaacacagactttggacat

SEQ ID NO: 195705 - DNA, 601 bp, Human
cgcctgtaatcccagcacttcaggaggctgaggtgggcggatcacaaggtcaagaaatggagatcatcctggccaacatggtgaagctccgtctctactaaaaatacaaaaattagctgggcgtggtggtgcacgcctgtagtcccagctactcgggaggctgaggcagaagaatcacttgaacctgggaagcagagattgcagtgagccgagatcgcgccactgcactccagcctggcaacagagtgagagtctgtctcaaaaaaacaaaaacaaaaacaaagtaaagcccaaaagttgaaaaaaaaaaaaatcaggagactatctgcagaagaaaatgagtcaaatgaacccaatttcaagcattataatccactttcttaccatctctatgaaaaactggcattaactggacacactggtcagcattgatagctttcatggaagtggcagaactgatggttttggggcagactcacatctacatggtaacatatgttcatcctctctacacacttcagggtctactctaaagcctcatttagactcctatataatgcctccctgggaacaacaataattattccagatttggccaaaa

SEQ ID NO: 195706 - DNA, 601 bp, Human
cctcatttagactcctatataatgcctccctgggaacaacaataattattccagatttggccaaaattggagaaaaggctgcaggctgttcagtaagcagcaataatttgtgctcaaactgacagtaaatatcaagtggacagccttcattgtcctggcttctatggtaatattaaaagctgccctgagcaaggaatacaatcagacaaatcacaaaggaagctacagaactagctaataaataaaaatgttcaaaatcactaaaaattcaaatatactataaaatagaaaaatggagtayctttatatatcagattggcaatgagcatgtggtaaaataggtactcacacatagctgatgtaaactggtgtaagttttctggaatacaattttacttggcaacacatattaaatgcctaaaaaattatcataacctttgattcagtaattccaatcctaagaatcaatggtaggaaaacattcagaggaacagatgaaaggccaaagatttcaaggttcaccacatcatgatttatgacagccaaacactggatataacctaaaggtccaaagacagaagaatggttaagaaaatcaaat

SEQ ID NO: 195707 - DNA, 601 bp, Human
ctggcttctatggtaatattaaaagctgccctgagcaaggaatacaatcagacaaatcacaaaggaagctacagaactagctaataaataaaaatgttcaaaatcactaaaaattcaaatatactataaaatagaaaaatggagtatctttatatatcagattggcaatgagcatgtggtaaaataggtactcacacatagctgatgtaaactggtgtaagttttctggaatacaattttacttggcaacacatattaaatgcctaaaaaattatcataacctttgattcagtaattccartcctaagaatcaatggtaggaaaacattcagaggaacagatgaaaggccaaagatttcaaggttcaccacatcatgatttatgacagccaaacactggatataacctaaaggtccaaagacagaagaatggttaagaaaatcaaatagatccataagatagaatattatgcaactattcaataacactgagctaagaatagacatcaataatgtagggaatttcatatgatgtacagtgataagttaaaacaagatctaaaataattgagattactctaaacattcctttactttttatt

SEQ ID NO: 195708 - DNA, 601 bp, Human
ggcactgacacagctaattcactattgttagacagcttgtaccaattttcactgttacaaatatcaagaaaattggctgaaactgagttagaaaattaaaaggaaaacaaacaaaccatacaggtcgagggggatccaaaaggcttaaagacaaataaaggactgtaaatttaccccatagtgttgtatgtgaatatacaaatacactcattttcctgtcaagtcactattctgactaatggtcttattaactatattctacctacaccatcctatctatatgcttttggaagcctaccaycatttctgaaatcaagatcctgtgtacacacagcacctaacatgaagcatgacacaaagttgtattcaggaagcagattcaaaccaaatactcctgtgaaatgactgtgatttagtttgtaccacgacaccaactaacaatgactgcaattgtgaccccttgctttatacagccttctcttaaagcaaaagagagaaagagaacctctgtgttaatgaatcagctgatgttaaatcccacaagaatatctaatgaacacctctgaactggcaatgacacttgcagtccttgctcaaaata

SEQ ID NO: 195709 - DNA, 601 bp, Human
aaatatcaagaaaattggctgaaactgagttagaaaattaaaaggaaaacaaacaaaccatacaggtcgagggggatccaaaaggcttaaagacaaataaaggactgtaaatttaccccatagtgttgtatgtgaatatacaaatacactcattttcctgtcaagtcactattctgactaatggtcttattaactatattctacctacaccatcctatctatatgcttttggaagcctaccaccatttctgaaatcaagatcctgtgtacacacagcacctaacatgaagcatgacacaargttgtattcaggaagcagattcaaaccaaatactcctgtgaaatgactgtgatttagtttgtaccacgacaccaactaacaatgactgcaattgtgaccccttgctttatacagccttctcttaaagcaaaagagagaaagagaacctctgtgttaatgaatcagctgatgttaaatcccacaagaatatctaatgaacacctctgaactggcaatgacacttgcagtccttgctcaaaatacttaagaataagcacaggactctccatatgcaaaagaagatattatcagcaaggagca

SEQ ID NO: 195710 - DNA, 601 bp, Human
ctcaccggattatctagattctaaaaagatttgtagccaggggactgggagctattggcagatgctggccaaaagggcacagactttcagttctaagatgaataaattcggggatctaatgtacgctatggttactatatttaataatgccatattaaatacttaaaatttaccaatggattttaagtattctcatccccaaagaaatggtaactatgtgaggcaactgataatgttaattagcttgaacgtggcaatcacttcacaataaatactaaatacatttggtatatatcaaatyatcattgtataacttaaatatgtataatttggctgggcatggtggctgacgcctgtaatcctagcactttgggaggccgaggcaggcggatcacgaggtcaggagtttgagaccagcctggccaacatagtgaaaccccgtctctactaaaaatacaaaaatatatatatatgtatattttatatatatatataatataaaattttaatttgtcaattatacctcaataaagctagaaaaaaataaaaatgttgataacatgggcaaaagaaataaaatttaaaaacaatcttaataata

SEQ ID NO: 195711 - DNA, 601 bp, Human
gctgggcatggtggctgacgcctgtaatcctagcactttgggaggccgaggcaggcggatcacgaggtcaggagtttgagaccagcctggccaacatagtgaaaccccgtctctactaaaaatacaaaaatatatatatatgtatattttatatatatatataatataaaattttaatttgtcaattatacctcaataaagctagaaaaaaataaaaatgttgataacatgggcaaaagaaataaaatttaaaaacaatcttaataataattttttaaatatttacagttttataaaaagyttcccatattgaatcctccctcaaaaaggattcaaaatccaatttattatttgcagaccactgctggaagcttatagaagctggctgacactaccatctctgtccttcaggtaaaatttgccatttcaaattttcctcatttcattcactccagtcctttccttgtttgctgactgacattttccagcttacaaagcaacttgcccctgcggccaggtcccctcattctatcccaccgtaacgccaaacagctgactatctgatttctaaaaatgaactccactgcaaacagcatcgcga

SEQ ID NO: 195712 - DNA, 601 bp, Human
agcttcccatattgaatcctccctcaaaaaggattcaaaatccaatttattatttgcagaccactgctggaagcttatagaagctggctgacactaccatctctgtccttcaggtaaaatttgccatttcaaattttcctcatttcattcactccagtcctttccttgtttgctgactgacattttccagcttacaaagcaacttgcccctgcggccaggtcccctcattctatcccaccgtaacgccaaacagctgactatctgatttctaaaaatgaactccactgcaaacagcatcgygacaatttaatgatttgtcaaagtagtagaaccagttattataaagtgtatttcagtgttcaaaagtaaaggtcctatgaagctaaagcttacctgctgacagggaaagctggacaattaaaaaaaaaaatccagacaacattcacttgacagatttatttctaaaatagaaacttcatttgccatgctcctgtattaaaattcttgctacacaagaaggttacacttacaaaaaaaattcattggttcacgtgtttgaaagctctctccaatggcacttttaagagatgtgctttctct

SEQ ID NO: 195713 - DNA, 601 bp, Human
cgacaatttaatgatttgtcaaagtagtagaaccagttattataaagtgtatttcagtgttcaaaagtaaaggtcctatgaagctaaagcttacctgctgacagggaaagctggacaattaaaaaaaaaaatccagacaacattcacttgacagatttatttctaaaatagaaacttcatttgccatgctcctgtattaaaattcttgctacacaagaaggttacacttacaaaaaaaattcattggttcacgtgtttgaaagctctctccaatggcacttttaagagatgtgctttctcttttttttttttcaagatggaaacaaaacagaatatggaataagctttttatgctcatgtgtcaagcactggagtccataaatccagctatggcattcaactactaagaagataccttgaaaacctaaaataaaagtttatgccagacagaactatagcctcctagtcctagtccctggtggataaagagctatctctgaacacctaagaagccagaactttgaaaaggaaatagctgtcaaactacagtttcagggtttcttctgttacattgctatgttctgcaatgtatgttgcatac

SEQ ID NO: 195714 - DNA, 601 bp, Human
tcttaatgtaaccttctaaatgcctttagtttttaacatcagatatatttcttaatgaaattagaaaaatacatcctaaaatacctcaactaaataaatctatttcaaaacaaacaaaacacgctaatgtcaaaaacatgaagcataaataatctttacaagtacataccacacaacatgtagaaaaaggaaattctctggagatttctgcaaaccacaccaagctgatacacattttgaaaatctccatttaaccatatgcaaacagatcattatagtttatcaagaaaatggtactttytagtacttagtaaatacatatttacatgataaaatttaatggatccaaataaatcaaagtttgtatgttacaagtcattaaattgcggacacagttacatgtttctaaagcctttaacataagtaaaataaattataatggcttttttaaataaattattctaaatcacaaactattatcacacttttaaaagacttgttttgtcatacacacacacacacacacacacacccctccatatatacagatagatagatatatctcattcatatatatatatatcttctgtagtaagtggaa

SEQ ID NO: 195715 - DNA, 601 bp, Human
cacagttacatgtttctaaagcctttaacataagtaaaataaattataatggcttttttaaataaattattctaaatcacaaactattatcacacttttaaaagacttgttttgtcatacacacacacacacacacacacacccctccatatatacagatagatagatatatctcattcatatatatatatatcttctgtagtaagtggaaataatttgcttgtattaccctagggtgctttgattgtactgggaataaaaacaggttttccttaaagaatgatgatatataatggctttytaaagggaaagaaccccaaaccaaagttttaagagtagacagtctttgacttatgattatttgacttaatgatttttcaactttatgatggtacctatacaatgattaaatttttcactttcagtcttcaataaattacattatatattcaatgctttattataaaataggctttgtgttaaatgattttgcctaactgtagtgttctgactacaattaaggtaggctaggctaagatgtgatgttcagtaggttaagtatatcaaatgcatttttgacttaacaatatttttaacttac

SEQ ID NO: 195716 - DNA, 601 bp, Human
aatgaatattggtgagaatgtagacaattaaaaccctcatatatttctgatgagaatgtaaaatggaacaatcactttgggaaacggtttggcaattcttcaaaatgtccaacatagagttactatatgattcaacaattccatactcaagagaaatgaaaacacacagccacaaaaagctgtacaaaaatgttcatagcagcattattcataatagccaaaaagtagaaacaatccaaatgtcaatcaagcgacaaacggatgaataaaacatgatagatctatacaatgaaatatcatytggacataaaaaggaatgaaatacggatacatgccacaacattgatgtacctagaaaaataaggaaagaagttagacacaaaggccatatattacatgattccatttatatgaaatatccagaataggaaaacttatagagaaagaaaatagattagtggttgcctagggatgagaggaggggaggaaggaagatggggagtgactgctaataggtgcaaggtttctttttggggtgacggaagtgttctaaaattagcttacgttgatggttacacagcactgtaaatatattaaaaac

SEQ ID NO: 195717 - DNA, 601 bp, Human
tatcacaatgtccaactttctataaattccaagctcttcccatgttatcttaccaacaattagatgctagattactctgttgttcctgcactgctcatggatctactcaatggactctgacccagactgctgcatgcacactgtcctttctacggatgtctgcaaatgatatcaaatgctaagtaaaaggatgaagaatatgttactgacagttaacccagacatcctacagggagacaagacactcatgcagcagaattaatgtggcaaacttgataagactacaggtatcccttgcagmagaaaagcaattattaaacttcacgaatacactgattattaaagaacacaggccgggcgtggtggctcatgcctgtaagcccagcactttggaaggccgagcggatggatcacaaggtcaggagatcaagaccatcctggctaacacagtgaaaccccgtctctactaaaaatacaaaatattagccaggcatggtggcaggcgcctgtagtcccagctactcgggaggctgagggaggagaatggcgtgaacccggcaggcagagcttgcagtgagccgagatcgcgccactgcactct

SEQ ID NO: 195718 - DNA, 601 bp, Human
attccaagctcttcccatgttatcttaccaacaattagatgctagattactctgttgttcctgcactgctcatggatctactcaatggactctgacccagactgctgcatgcacactgtcctttctacggatgtctgcaaatgatatcaaatgctaagtaaaaggatgaagaatatgttactgacagttaacccagacatcctacagggagacaagacactcatgcagcagaattaatgtggcaaacttgataagactacaggtatcccttgcagcagaaaagcaattattaaacttcacraatacactgattattaaagaacacaggccgggcgtggtggctcatgcctgtaagcccagcactttggaaggccgagcggatggatcacaaggtcaggagatcaagaccatcctggctaacacagtgaaaccccgtctctactaaaaatacaaaatattagccaggcatggtggcaggcgcctgtagtcccagctactcgggaggctgagggaggagaatggcgtgaacccggcaggcagagcttgcagtgagccgagatcgcgccactgcactctagcctgggcgacagagcaaaactct

SEQ ID NO: 195719 - DNA, 601 bp, Human
attactctgttgttcctgcactgctcatggatctactcaatggactctgacccagactgctgcatgcacactgtcctttctacggatgtctgcaaatgatatcaaatgctaagtaaaaggatgaagaatatgttactgacagttaacccagacatcctacagggagacaagacactcatgcagcagaattaatgtggcaaacttgataagactacaggtatcccttgcagcagaaaagcaattattaaacttcacgaatacactgattattaaagaacacaggccgggcgtggtggctcaygcctgtaagcccagcactttggaaggccgagcggatggatcacaaggtcaggagatcaagaccatcctggctaacacagtgaaaccccgtctctactaaaaatacaaaatattagccaggcatggtggcaggcgcctgtagtcccagctactcgggaggctgagggaggagaatggcgtgaacccggcaggcagagcttgcagtgagccgagatcgcgccactgcactctagcctgggcgacagagcaaaactctgtctcaaaaaaaacaaaaacaaaaacaaaaaaacataaaccaaca

SEQ ID NO: 195720 - DNA, 601 bp, Human
cagtgagccgagatcgcgccactgcactctagcctgggcgacagagcaaaactctgtctcaaaaaaaacaaaaacaaaaacaaaaaaacataaaccaacacagcaaaatctctcctccaaatcttcagtcctaccacatggacatcaacactcatattatctctggtatgttcttttattctaataccttcaagaaataggggacaactgtaaaatctctaactcttgaaattggaaattgaaaatcaaaactgcatcaaaacatgctagggaaatatttaaaccaaagtgatttatcaayattttaagtgtatagcagattattaagaaggcagcagacatcttagaacctgaccttccagccccggtcaagcagctccaaccaatatcccaattgaaccctcatgagcaaccttcagccagggcctaacagctaagccactcttgaattttctaagtatgagataataaatgtttgttgttttaagtcatttaaaacaaaaagcagtgaccattcccagtgagaattaaataaaatgtaattctttattcagccaggcatggtggctcatgcctgtaataccaacgctttgggaggccg

SEQ ID NO: 195721 - DNA, 601 bp, Human
agcaaccttcagccagggcctaacagctaagccactcttgaattttctaagtatgagataataaatgtttgttgttttaagtcatttaaaacaaaaagcagtgaccattcccagtgagaattaaataaaatgtaattctttattcagccaggcatggtggctcatgcctgtaataccaacgctttgggaggccgaggtgggctgatcacctgaagtcaggagtttgagaccagcctggccaacatggtaaaaccccatctctactaacaatacaaaaatcagctgggtagggtggtgggcwtctgtagtcccagctactcaggaggctgaggcaggagaattccttcaactcgggaggtggaggttgcagtgagccgagatcatgccactgcaccccaacttgggcaacagagcaagactccgtctcaaaaaagaaaaaaaagaaaaattatttattcttactgagtttttaataagaacacctgggtttaaatttcagctatgtgaacttatgctattatcactgtgatggttaataacaagtgtcaacttgattggattgaaggatgcaaagtattgctcctgggtgtgtctgagggtg

SEQ ID NO: 195722 - DNA, 601 bp, Human
ttggctttatgttgtggaatggaatcaggatctaccaacctgccactcattacaacgagtcatgtaatgaccagaaggttttcccgccctatcattctattaactattgaaccaagggaaaatgacagataagtatcataaaacatttaaaagcattcagtagctgggcctcaaagcagccattccatagctctatactactacagaaatagctatagactacttccttttcactggctccaaaccgaatagtaaataatattcggagttccagtatggtgatagcatttagtataaaaayagtctttaaaatatctctaagtaataaaaacagaaaaaaaactaatttgacttattctataagcagacagattctttaatttgagaatttactacatctataaacagaaaaatgttaatatatgaaagtttttctctcttatttctctttacattttttaagagacagggtcttgctctttcacccaggctggagtgcaatggcacaattatagctcactgcaacctcaaactcctaggttcaagtgatcctcccacctcagcctcttcaatagctaggactagaggcataccaccacac

SEQ ID NO: 195723 - DNA, 601 bp, Human
aaagaaatgtagcaagaggctgggcgcagtggctcacgcctgtcatcccagggctttgggaggccgaggagagcagatcacctgaggtcaagagttcaagaccagccaggccatgtctttagtagagacatggcaaaaccccaactctactaaaaatacaaaaattagccaggcacgatagtgggcatccgtaatcccagctactcgtgaggctgatgcaggagaaccacttgaacccaggaggcggaggctgcagtgagccaagatcacgccactgcactccatcctgggcgacagagcragactccgtctcaacaaaaaaagcaatgtagtgagaaacactgaagccacaactcccccaagagatgatgatcatcagatttcattacatttgtctttctcgaatttctcctaatgaatagccagacataaaaacattaaggataaattacagagtaagcacacaacacccctcaaggctacatatcaaggtagagacacacagcacttaccttcttccctccggtcacaaactgcttgcaactggatctcacgaaatgtgggtgcacagcaataatctacaagagaaacagaacccaac

SEQ ID NO: 195724 - DNA, 601 bp, Human
aaaaattagccaggcacgatagtgggcatccgtaatcccagctactcgtgaggctgatgcaggagaaccacttgaacccaggaggcggaggctgcagtgagccaagatcacgccactgcactccatcctgggcgacagagcaagactccgtctcaacaaaaaaagcaatgtagtgagaaacactgaagccacaactcccccaagagatgatgatcatcagatttcattacatttgtctttctcgaatttctcctaatgaatagccagacataaaaacattaaggataaattacagagtaarcacacaacacccctcaaggctacatatcaaggtagagacacacagcacttaccttcttccctccggtcacaaactgcttgcaactggatctcacgaaatgtgggtgcacagcaataatctacaagagaaacagaacccaactctggtttaggagtcatggccaatgcacagaatgaaaacccctgacacagttcaagcagcatgatctaaaaattatcctgaaaccttggtaggaagtaatatattcaaatcatattttacaacaactgatgacatctgagttttcttcttacgtgaaaa

SEQ ID NO: 195725 - DNA, 601 bp, Human; identical to SEQ ID NO: 37496

SEQ ID NO: 195726 - DNA, 601 bp, Human; identical to SEQ ID NO: 37497

SEQ ID NO: 195727 - DNA, 601 bp, Human; identical to SEQ ID NO: 37498

SEQ ID NO: 195728 - DNA, 601 bp, Human; identical to SEQ ID NO: 37499

SEQ ID NO: 195729 - DNA, 601 bp, Human; identical to SEQ ID NO: 37500

SEQ ID NO: 195730 - DNA, 601 bp, Human; identical to SEQ ID NO: 37501

SEQ ID NO: 195731 - DNA, 601 bp, Human; identical to SEQ ID NO: 37502

SEQ ID NO: 195732 - DNA, 601 bp, Human; identical to SEQ ID NO: 37503

SEQ ID NO: 195733 - DNA, 601 bp, Human; identical to SEQ ID NO: 37504

SEQ ID NO: 195734 - DNA, 601 bp, Human; identical to SEQ ID NO: 37505

SEQ ID NO: 195735 - DNA, 601 bp, Human; identical to SEQ ID NO: 37506

SEQ ID NO: 195736 - DNA, 601 bp, Human; identical to SEQ ID NO: 37507

SEQ ID NO: 195737 - DNA, 601 bp, Human; identical to SEQ ID NO: 37508

SEQ ID NO: 195738 - DNA, 601 bp, Human; identical to SEQ ID NO: 37509

SEQ ID NO: 195739 - DNA, 601 bp, Human; identical to SEQ ID NO: 37510

SEQ ID NO: 195740 - DNA, 601 bp, Human; identical to SEQ ID NO: 37511

SEQ ID NO: 195741 - DNA, 601 bp, Human; identical to SEQ ID NO: 37512

SEQ ID NO: 195742 - DNA, 601 bp, Human; identical to SEQ ID NO: 37513

SEQ ID NO: 195743 - DNA, 601 bp, Human
aaaaagccatgtcacctctaaaagtgatttcagacatgcagttggagcctaaacatatgcaagcttttaggtgaagcacagatgataagaaagtcaagggagtggactctcttttaagaaaatttggttgtaaaaacaagaagcaaagggtctcagggacatatatggtctatagttattgggatgaagagtcttctctggagaagaggaagaggccaaaggtgtagaaagagggaatcacgtggggatatgtctaatggagcctctgacagtaacatactgtgctttcctttctccagcrgcctccatttgggctgggctgctttacctggatgccaacatgcccttttctctttgtgccaagcatatcctgatgctacacagactcagaaaggggggcagaactcaccctggggaagagcctatactctcagcctcttagtgtttgaacctctatactaggtgcggcaggcacttttcatcagcacctttccccagtgaagaaaataggacgcttgaaacccccaagagggtctctcacccccgctcccatagaagactgaccaccatccacaactgcagtcataaagtacacttgacc

SEQ ID NO: 195744 - DNA, 601 bp, Human
cggacgtggtggcaggcacctgtagtcccagctactaggaagatcgagaccatcctggctaacacggtgaaaccccatctctactaaaaatataaaaaattagccaagcgtggtggtgggcacctgtagtcccagctactgggcaggctgaggcaggagaatggcatgaacccaggaggtggagcttgcagtgagccgagatcgcgccattgcactccagcctgggtgacagagcgagactctgtctcaaaaaaaaaaaaaaaaaagctaaaggaaagatatggtctgcatatacttttayatatacatatgtataagaatatgtatataggctactataggtaagatattcatatatcttatgtgaatatatagcttttattcattaaaagctaatctaaatttatatgtacaagaaccatatataaattgttagatattattattattagcaattaaattccttttttccttaagccagtttgggttgagctttctgacacctgcatgtagcaggatcctgactaattcaaccacgcaaaagagaaaccagacaaaaccaaccaatagatgtaagcagatatacataaaacatcaacaa

SEQ ID NO: 195745 - DNA, 601 bp, Human
gagattgagaccatcctggcaaacatggcgaaaccccgtctctactaaaaatacaaaaaaaaaaaaaaattagccggacgtggtggcaggcacctgtagtcccagctactaggaagatcgagaccatcctggctaacacggtgaaaccccatctctactaaaaatataaaaaattagccaagcgtggtggtgggcacctgtagtcccagctactgggcaggctgaggcaggagaatggcatgaacccaggaggtggagcttgcagtgagccgagatcgcgccattgcactccagcctgggygacagagcgagactctgtctcaaaaaaaaaaaaaaaaaagctaaaggaaagatatggtctgcatatacttttacatatacatatgtataagaatatgtatataggctactataggtaagatattcatatatcttatgtgaatatatagcttttattcattaaaagctaatctaaatttatatgtacaagaaccatatataaattgttagatattattattattagcaattaaattccttttttccttaagccagtttgggttgagctttctgacacctgcatgtagcaggatcctgacta

SEQ ID NO: 195746 - DNA, 601 bp, Human
cccagcactttgggaggctgaggcgggcagataacgaggtcaggagattgagaccatcctggcaaacatggcgaaaccccgtctctactaaaaatacaaaaaaaaaaaaaaattagccggacgtggtggcaggcacctgtagtcccagctactaggaagatcgagaccatcctggctaacacggtgaaaccccatctctactaaaaatataaaaaattagccaagcgtggtggtgggcacctgtagtcccagctactgggcaggctgaggcaggagaatggcatgaacccaggaggtggarcttgcagtgagccgagatcgcgccattgcactccagcctgggtgacagagcgagactctgtctcaaaaaaaaaaaaaaaaaagctaaaggaaagatatggtctgcatatacttttacatatacatatgtataagaatatgtatataggctactataggtaagatattcatatatcttatgtgaatatatagcttttattcattaaaagctaatctaaatttatatgtacaagaaccatatataaattgttagatattattattattagcaattaaattccttttttccttaagccagttt

SEQ ID NO: 195747 - DNA, 601 bp, Human
aaaaccctagaagaaaacctaggcaataccactcaggacataggcatgggcaaagactctatgactaaaacaccaaaagcaattgcaacaaaagccagaattgacaaatgggatctaattaaactaaagagcttctgcacagcaaaagaaactatcatcagagtgggagaaaatttttgctatctatccatctgacaaagggctaattatccagaatctaaaaggaacttcagcaaatttacaagaaaaaaacaaccccatcaaaaagtaggcgaaggatatacaatttttcatgataagcttttactaacatattttttaactgcacacataaaaatgttaaacaaatattaaatatgtgattatttatataaacctgggatggagaaggtctttcagggacgcctctgtgaatatcatttattttgccacccagtgtccactccccattctgtactctaagttccctacctcctccactaagagtccatatcgttcaggggaatcttcattcctggctttcgcactggctcatgactcaggcccaattcaaccagtccaacccgtggtcttggcccttgctctcagagatgttttttct

SEQ ID NO: 195748 - DNA, 601 bp, Human
aaacctaaaaccataaaaaccctagaagaaaacctaggcaataccactcaggacataggcatgggcaaagactctatgactaaaacaccaaaagcaattgcaacaaaagccagaattgacaaatgggatctaattaaactaaagagcttctgcacagcaaaagaaactatcatcagagtgggagaaaatttttgctatctatccatctgacaaagggctaattatccagaatctaaaaggaacttcagcaaatttacaagaaaaaaacaaccccatcaaaaagtaggcgaaggatatacartttttcatgataagtttttactaacatattttttaactgcacacataaaaatgttaaacaaatattaaatatgtgattatttatataaacctgggatggagaaggtctttcagggacgcctctgtgaatatcatttattttgccacccagtgtccactccccattctgtactctaagttccctacctcctccactaagagtccatatcgttcaggggaatcttcattcctggctttcgcactggctcatgactcaggcccaattcaaccagtccaacccgtggtcttggcccttgctctc

SEQ ID NO: 195749 - DNA, 601 bp, Human
cttccttacaccttatacaaaaattaactcaagatggatcaaagacttaaatgtaaaacctaaaaccataaaaaccctagaagaaaacctaggcaataccactcaggacataggcatgggcaaagactctatgactaaaacaccaaaagcaattgcaacaaaagccagaattgacaaatgggatctaattaaactaaagagcttctgcacagcaaaagaaactatcatcagagtgggagaaaatttttgctatctatccatctgacaaagggctaattatccagaatctaaaaggaacttmagcaaatttacaagaaaaaaacaaccccatcaaaaagtaggcgaaggatatacaatttttcatgataagtttttactaacatattttttaactgcacacataaaaatgttaaacaaatattaaatatgtgattatttatataaacctgggatggagaaggtctttcagggacgcctctgtgaatatcatttattttgccacccagtgtccactccccattctgtactctaagttccctacctcctccactaagagtccatatcgttcaggggaatcttcattcctggctttcgcactggc

SEQ ID NO: 195750 - DNA, 601 bp, Human
ctatactacaaggctacagtaaccaaaacaacatggtactggtaccaaaacagatatatagaccaatggaacagaacagagacctcagaaataacaccacacatctacagccatctgatctttgacaaatctggcaaaaataagcaatggggaaaggagtccctatttactaaatggtgctcggaaaactggctagccatatgcagaaaacagaaactggaccccttccttacaccttatacaaaaattaactcaagatggatcaaagacttaaatgtaaaacctaaaaccataaaaaccytagaagaaaacctaggcaataccactcaggacataggcatgggcaaagactctatgactaaaacaccaaaagcaattgcaacaaaagccagaattgacaaatgggatctaattaaactaaagagcttctgcacagcaaaagaaactatcatcagagtgggagaaaatttttgctatctatccatctgacaaagggctaattatccagaatctaaaaggaacttcagcaaatttacaagaaaaaaacaaccccatcaaaaagtaggcgaaggatatacaatttttcatgataagtttttac

SEQ ID NO: 195751 - DNA, 601 bp, Human
tcccttattattattattagtattagtattagtattagtattatttttgagatggagttcgctctgtcgcccaggctgcagtgcagtggcacaatcgcggctcactgcatcctctgccctcccggttcaagcgattcttctgcctcggcctcccgagtatcctgctcactacagtcatggtaaaaaaaaaaaaaaaaatgtttaaaggcagtgcttcactgatttaaatattgtatagaggtcaaagagagttaagaccaaataaatgccactggatttcacaaatagaagaagatgggcaaaaaaataaataaataaaaataataaaaaaataaatcccagagagatcaagtatttaaataaaaaggcatttcgttaaacatggcaggctgactgcatgtgcttatttccatctcattccaaagcccaactaaggcgacagtaaaggaataaaaaattatgaacatacaaggacaagaacaggaaagccagcattagtgaatacaagagttccatacattttacagatgctaaaaaagatgaaagaatggaaacaagtcagcagaatggaggaaactataagaaaaaaaaaagtgtgcct

SEQ ID NO: 195752 - DNA, 601 bp, Human
aatctttacatcttttgtcccttttacaggagcccactgggccacttattttctcagaagttctatgcaggtggcccctagtgtaaatggctagaaagtcttttaaaattgtgtttggacagtaaggtggaaatttccagactttaaaatatcagaaaaatgcatcattttaagaaagattctttcccttctctacttattttctcctaaggtacttcacaatatttcctgtttgaaatttagtcatatatatgaatgtatgtaatatatgtaactatatatttgtatgtatgaatacatacacacacacacacacacacacacacacgcacaaacacatccccttagatgaactgcaatggcccaaaagatagtcaacttacaggaatggataccagaggtcctctagggtagtgtttttcaaattgtgggcttagaataaatttagtatgtcccaaagataattttctcaaaagtggaagagtagagtggaatgaaatagataattctaggcacaatgtgtgaggatattgaatctttcctaactttggaacacgggcactatgagcaaatcttgggggagggggaatttgtatgtgta

SEQ ID NO: 195753 - DNA, 601 bp, Human
gatctctagatgccatgaaatggacaactagaaaaagtcataggctgtggtgactcaaaaactgaattaccttaagaaattttgttatcccttaaataacagatcaaaataattattttagagatgtgtgacaaggaacctggagtggcagaaggcgtgcaccacgcatttatgttgaaactatcacaatacttgggccaaatcctgagggacctagaaaatctgagtcttcaagggcaaggaccataaccaaaccaagaataaaccatgctgggtgcccaggtgccagcagctctgtcayccactgatgacttaattctccttcctgctcttcaagttttgcagaaatatttaagccaagagtcccttaatactttagactcattgttggtgtttatgctttttaagtcacagatctttttgaaaacctgataaaagttacaggcacccagaaaaaagttataagatgttgcatatatcttgaggtatcataagtaatacttagtagctcctaactatggaatggaaaaaaaaaactggaattgtaaaactactaaggggagtatgaaacatttcctcaataatccaaaccagttagcag

SEQ ID NO: 195754 - DNA, 601 bp, Human
gcacagtcttttccacttcaatttaaggaagcaaggtgtgagaggaatgtgtgttaccccaagggggctgatctacacccaaactctacagggcatcatctaatgtacgttggaaataaatgtagacttcccctggtcacctctgatagagggttcctctcatttacctgggccacctctaaacagagatctctagatgccatgaaatggacaactagaaaaagtcataggctgtggtgactcaaaaactgaattaccttaagaaattttgttatcccttaaataacagatcaaaataatyattttagagatgtgtgacaaggaacctggagtggcagaaggcgtgcaccacgcatttatgttgaaactatcacaatacttgggccaaatcctgagggacctagaaaatctgagtcttcaagggcaaggaccataaccaaaccaagaataaaccatgctgggtgcccaggtgccagcagctctgtcacccactgatgacttaattctccttcctgctcttcaagttttgcagaaatatttaagccaagagtcccttaatactttagactcattgttggtgtttatgctttttaagtcacag

SEQ ID NO: 195755 - DNA, 601 bp, Human
cagtttaagttgctgggatataactactgtgcaaccaaaaagagctgattatcacatcagtttgccccactttaggaaagtccagtatattaaagaaaaccctctccaaagttaaaaagaaggtaactggaaggtcccagcgatataagtataatgacacgtaaagcaatgaatgaaatgtaaaggcataaaaccttttcaggtgccagaccacttggaattactcccctacactacatgacacctgacattctctcaactcaatattgcagaataacttcaccagaactgatgaaaagawcattgcactgcaaagtcaaatgagacttccgagatcaattccatacttaactagctaagtagtctcaagcaaattgcctaaccattcatctctgtgcttcagtctgttcatctgtaagatagggataataatagcacctacttcataggttcactacgagggtgaaatgagttaatatatgggactgctcatcacagagcctagcaggggaaacacccaattctttattctaactggacttggcacaagaattaagataccttgagtgcaaattttccattacccttcattaagtctaaa

SEQ ID NO: 195756 - DNA, 601 bp, Human
gatggatcatgtaaaattgactgaactggaaagctctggaaaagcacctggaaagatgaaaattgagctattgaagtaagcttaaattaagtggaaatcagaattcttggcatatggaagttgctaagaagcagatatagaacacgcatgagttctctgatggcctgggaaacatctgccctttggagaaatcggccctttgccaattggtagagcacatgcatccaggctttgctctcatctttctcagtctgtaaggtcatatttggaggcacatctttatttctggtgttcaacttargatgagctgtaaaggttttgtaagatgttcatcttgtaagaaatgaaattaactcagatactcaagcattctttatgatttttccaaaccatctttcgaggcactaaggccccgaggtagaagtgcctctttcccagatcccacaagaccttaggcatcagatttattaaagcagtttaagttgctgggatataactactgtgcaaccaaaaagagctgattatcacatcagtttgccccactttaggaaagtccagtatattaaagaaaaccctctccaaagttaaaaagaaggtaact

SEQ ID NO: 195757 - DNA, 601 bp, Human
tccaaccaattagactaaaagtacctgacaatgcttccaaggaggtcttaactaaagagatcaatctttttaacagataatcgggataatttctaagcaatcaagcacctgctcattatccgctgttctgagcggagagtatttctccaccgtgcctgaatcatctctgaacctttcataaaatgctctccacttccacagtatgcagcctcagacagtaggtgcaaaattcaatttttacaagtgaaagtatattcttaagttgaactgtatgagattgctgatatttgacaaattttgwttcacaaaaaaatggcaatttcaaacggttcaaagtaaaccttaggacagaggtttagctgcaggaataaaagccaaaaaaaaaaaaaatagcagcttctgtagatatagaagtctcctgcttcctcatgcaactgtgctagtgtaaggaacccaggatgccacagcagttccatagtacagaggacccatgctcctccatgctcatattcctgctgtactcaacatgtgacatggcaggagtccaccccatagtctaaaggtcacagccccacctcccaccatgacatccacatccaaa

SEQ ID NO: 195758 - DNA, 601 bp, Human
actctaactgcaaccttaaaaaaaaagcatcattttctgcattttgctaaagtcgaaacattggttcagagagacttgaccaagaccacacagctgagaagtgagaaggtcaggatttgaatccataattgactcattccaaaggtcttcccatcattctgaactgcttccaaataaattgtaccaaaatctttctgtaattctagcatttcagcttatattttaccaaagtcaccctttctaaaacgtcttggccaactccaaatagtccccttatagcatcatcatacctaccacggcrtaggacccaatacaggtagaactttcacctcacaattcaagtagaaatactgcccaggggccaaattgtaaagctctgtattgaggtggctgccttccaaccaattagactaaaagtacctgacaatgcttccaaggaggtcttaactaaagagatcaatctttttaacagataatcgggataatttctaagcaatcaagcacctgctcattatccgctgttctgagcggagagtatttctccaccgtgcctgaatcatctctgaacctttcataaaatgctctccacttccacagtatg

SEQ ID NO: 195759 - DNA, 601 bp, Human
ggaaggttaaaagcatataaatatagccctaatttgccaccttgagaaagacattgaaatccaaagaaaataaaaatagctaccatttacattctatggaaatactacataccgtgccagtacttaaaatattagttctgactctaactgcaaccttaaaaaaaaagcatcattttctgcattttgctaaagtcgaaacattggttcagagagacttgaccaagaccacacagctgagaagtgagaaggtcaggatttgaatccataattgactcattccaaaggtcttcccatcattctkaactgcttccaaataaattgtaccaaaatctttctgtaattctagcatttcagcttatattttaccaaagtcaccctttctaaaacgtcttggccaactccaaatagtccccttatagcatcatcatacctaccacggcataggacccaatacaggtagaactttcacctcacaattcaagtagaaatactgcccaggggccaaattgtaaagctctgtattgaggtggctgccttccaaccaattagactaaaagtacctgacaatgcttccaaggaggtcttaactaaagagatcaat

SEQ ID NO: 195760 - DNA, 601 bp, Human
tgttatatactacgtgttcaaagtttaaacaaggtgcttccccatttggttcaaatagatatgtgggttatacacttagatcctcttttatgccatctattctaaaggaaggttaaaagcatataaatatagccctaatttgccaccttgagaaagacattgaaatccaaagaaaataaaaatagctaccatttacattctatggaaatactacataccgtgccagtacttaaaatattagttctgactctaactgcaaccttaaaaaaaaagcatcattttctgcattttgctaaagtcraaacattggttcagagagacttgaccaagaccacacagctgagaagtgagaaggtcaggatttgaatccataattgactcattccaaaggtcttcccatcattctgaactgcttccaaataaattgtaccaaaatctttctgtaattctagcatttcagcttatattttaccaaagtcaccctttctaaaacgtcttggccaactccaaatagtccccttatagcatcatcatacctaccacggcataggacccaatacaggtagaactttcacctcacaattcaagtagaaatactgcc

SEQ ID NO: 195761 - DNA, 601 bp, Human
tgcctcagcctcccaagtagctgggattataggcatgtgccactacacccggctaattctgtatttttagtacagacggggattttccatgttggtcaggctggtcttgaactcctgatgtcaggtgatccacccacctcggcctcccaaagtgctgggattacaggcatgaaccaccgcacccggcctgtttttgtctttttacaaatatcactgtgaaaatgccactggagtttcacagggggctttggagcttcaatagagggcaaggctggtgtcttttacatcttacccacataayacagtccttttctacagcctaaacagttttctcaaagggcctcagaaacactgatatggatagattatccatatgaaagaagagcgagagaggaaatgtctttctatcttggtcttatctaaagatggttctctgcaggaaggggaatcagggtttttcaaaaggtccagtgggtctctttccccatggttgaagatgagggtacccgagagccagtagatgatgtcaaatggtctgtccccatctgcagttctgggacacctctttagaacacttgggtgtgaccaaaggaaatatgtg

SEQ ID NO: 195762 - DNA, 601 bp, Human
gaaaagaaaaaagaaactcagtgagttacagaaaacacaaatccacagaggggcacatacaaataaaaagccaattttgttgacattttattctaataaaagtataaaacactagtcttggattattaaaaaaatagaacctaccatgttttgagaacttactatattccaggcactatgctagacttttacttgcactatctactaatctttcagttatcctttaagttaagtgttttacaaatgttacaaatgaggaaagtgaaatttagggagactccattgccaaataacaagtaaytggaagagacacattttaaacatgtgtctatccatcttgatttgccctataaataaataaaaaggaatgtaaaacatttagtaacatagcaaacaaaaaaaatcatttaatttcaacttatgagctcatagagacaagagttaaggagtataaggacagagcagcagaatgagagaatagaaaggaagaaaaacagagaagtgaatggtacccagacattagatcaaatatcaagtttaatgatccagcaatcccactctgggtatttatccaaaagaactgaaaacagaatcttgaaaa

SEQ ID NO: 195763 - DNA, 601 bp, Human
aaaaaaaaaaaaaaaaagaaagaaagaaagaaagaaagaaagaaagaaagaaaagaaaagaaaagaaaagaaaagaaaagaaaagaaaaaagaaaagaaaagaaaagaaaagaaaagaaaagaaaagaaaagaaaagaaaagaaaagaaaagaaaagaaaagaaaaaagaaactcagtgagttacagaaaacacaaatccacagaggggcacatacaaataaaaagccaattttgttgacattttattctaataaaagtataaaacactagtcttggattattaaaaaaatagaacctacmatgttttgagaacttactatattccaggcactatgctagacttttacttgcactatctactaatctttcagttatcctttaagttaagtgttttacaaatgttacaaatgaggaaagtgaaatttagggagactccattgccaaataacaagtaattggaagagacacattttaaacatgtgtctatccatcttgatttgccctataaataaataaaaaggaatgtaaaacatttagtaacatagcaaacaaaaaaaatcatttaatttcaacttatgagctcatagagacaagagttaa

SEQ ID NO: 195764 - DNA, 601 bp, Human
ctgacatcaaacaggagaaagaaggctgagggctgcaagaagtgatggtggaaggcctggcccccagacactgtcatctgtggtgtgattcatggttttaacccacatgtgcagtacacatcagcaatcgaaattatgcaatgaccatgttcttcaacctgtccatttcccctaggcaagcccacattaggaatattcctacagaagaattagggcaaaggagatatgagagttctaagcaacacaacgggcagtttaaatgagctagtgtctttttgttgctatatgaacgtgctttacrtagtcaatgataaatcatcatgaggcaaagagcgatattttaagccaaagcaaagctttggtaaaagcccagtgggctcttggccccaatcccatttgctggaaaggtgagatgactgtgagaagagggtgatcatttgatcacaaggcggagggaggggccagttgctgaaatcagctctctgtgttcaggctcgactcggataaataggaactgttttcagagccagctaatagtatcaaagtcagcacaagcaggaatatgcacgcagcacacaggagggcaagagcagagctggtt

SEQ ID NO: 195765 - DNA, 601 bp, Human
taatgctgctgtgaacattcaagtccgagtttttgtttgaacacttgttttcaattcctttgagaaatccccatgtttttcatcattacagtgcccaactcttcaaaatgtgactaattcccatgacaaccacctagctttgagggatccaaggaggctcagaaaagcattctttaatggagatggtgacttagaaatgacacattcagagaaatgccctaaattctaccaaccgaaaatttctcaatttcagtactaatttctaaaggtcccaaatattcatagaagatccacccaataygaaagcaactaaccagcacttcaaatcacctcattttcttattacgagctccactttagctaaatttccaaagcagaacatgcaaaatgctaacatagttaaatgtctatttggttatacataaatggtgcatgtccattaatgtataatacattttgaatgcaaaaggtaaataccctttatgatttctcaagctaccatcaaagaggctccagtggtcaacagcaggagggtgacagaccccttcagggacctcaggacccccggtgaagcaaggtaggagtatagtaagtggaggaa

SEQ ID NO: 195766 - DNA, 601 bp, Human
tgatggaaaagagatgagatggaaagcatctctagaacattctgctgtatattagtcaatgtactttgcctttgggcccctttttgagaaccttcagcagagacttctggaactttctaaggcttttgtggaggtcacatttggttctctgtgaaaatgtaaggtagagtccatttaatatttcttttgatttttagaattttgatccaatattcactggagacttataatggttttcttttcgttttttctttttctttttttctttttcttgaaacgaagtttcactcttgtccccaarcaggagtgcaatggcacgatctcggctcactgcagtctccgcctcctcagttcaagcaattctcctgcctcagcctcccgagtagctgggattacaggtgcccaccaccatgcccagctattttttttttaaatattttaagtagagacagggtttcactatgttggccaggctagtctcaaacttctgacctcaggtgattcacccgcctcccaaagtgctggcattacaggcgtgagccaccgcacctggcctttataatgttattttgagtgctagaagtctaaactcgtaggaaag

SEQ ID NO: 195767 - DNA, 601 bp, Human
ggcaaagataaagcaattagcttttcttcagtgaagtctgaagccttttggggtactgatcccataataagtatggctacagaaccagaaaggcctagacagaggataaactgttatgcagtaaggaggcagagccactcagagcagaaagggtgggagaaggggacaagagaggaaaggtgaggggacgaggggaacatgggctaaagtttgggtattgagagagaaagcaagaggaagaaaggggtttttagggggctacactgccatgacacatgaaatgatggaaaagagatgagayggaaagcatctctagaacattctgctgtatattagtcaatgtactttgcctttgggcccctttttgagaaccttcagcagagacttctggaactttctaaggcttttgtggaggtcacatttggttctctgtgaaaatgtaaggtagagtccatttaatatttcttttgatttttagaattttgatccaatattcactggagacttataatggttttcttttcgttttttctttttctttttttctttttcttgaaacgaagtttcactcttgtccccaagcaggagtgcaatggcacga

SEQ ID NO: 195768 - DNA, 601 bp, Human
tttatcacataaacacaaatttctgtggcaaagataaagcaattagcttttcttcagtgaagtctgaagccttttggggtactgatcccataataagtatggctacagaaccagaaaggcctagacagaggataaactgttatgcagtaaggaggcagagccactcagagcagaaagggtgggagaaggggacaagagaggaaaggtgaggggacgaggggaacatgggctaaagtttgggtattgagagagaaagcaagaggaagaaaggggtttttagggggctacactgccatgacayatgaaatgatggaaaagagatgagatggaaagcatctctagaacattctgctgtatattagtcaatgtactttgcctttgggcccctttttgagaaccttcagcagagacttctggaactttctaaggcttttgtggaggtcacatttggttctctgtgaaaatgtaaggtagagtccatttaatatttcttttgatttttagaattttgatccaatattcactggagacttataatggttttcttttcgttttttctttttctttttttctttttcttgaaacgaagtttcactcttgt

SEQ ID NO: 195769 - DNA, 601 bp, Human
cctaatagttttctttatttggaggtacaatgtgattagtcaaagtagactatcatttttattccctccatccttcataaaaatgacaaaggattaacaggtgattcatttggaagttagtaaagattaatgaaggatatttatcacataaacacaaatttctgtggcaaagataaagcaattagcttttcttcagtgaagtctgaagccttttggggtactgatcccataataagtatggctacagaaccagaaaggcctagacagaggataaactgttatgcagtaaggaggcagagcyactcagagcagaaagggtgggagaaggggacaagagaggaaaggtgaggggacgaggggaacatgggctaaagtttgggtattgagagagaaagcaagaggaagaaaggggtttttagggggctacactgccatgacacatgaaatgatggaaaagagatgagatggaaagcatctctagaacattctgctgtatattagtcaatgtactttgcctttgggcccctttttgagaaccttcagcagagacttctggaactttctaaggcttttgtggaggtcacatttggttctctgtgaa

SEQ ID NO: 195770 - DNA, 601 bp, Human
aaatgatggccgattcaaagttcttttttctcacccttttcttctcaggctgtctctaagaacagcattttccttcatttttttttcctaatagttttctttatttggaggtacaatgtgattagtcaaagtagactatcatttttattccctccatccttcataaaaatgacaaaggattaacaggtgattcatttggaagttagtaaagattaatgaaggatatttatcacataaacacaaatttctgtggcaaagataaagcaattagcttttcttcagtgaagtctgaagccttttggggtactgatcccataataagtatggctacagaaccagaaaggcctagacagaggataaactgttatgcagtaaggaggcagagccactcagagcagaaagggtgggagaaggggacaagagaggaaaggtgaggggacgaggggaacatgggctaaagtttgggtattgagagagaaagcaagaggaagaaaggggtttttagggggctacactgccatgacacatgaaatgatggaaaagagatgagatggaaagcatctctagaacattctgctgtatattagtcaatgtactttgc

SEQ ID NO: 195771 - DNA, 601 bp, Human
gcctcagcttcctcaataactacctcctaaggttcctgagaactggaagagtccttcatccaaagacccagctcttattattattaccaggaatctaccctgttataaaagctctacaccaaatgaactatgttccctcttcaatctcccctctgcctcaggaggactgactttgtcatctaaagcaaatgatggccgattcaaagttcttttttctcacccttttcttctcaggctgtctctaagaacagcattttccttcatttttttttcctaatagttttctttatttggaggtacratgtgattagtcaaagtagactatcatttttattccctccatccttcataaaaatgacaaaggattaacaggtgattcatttggaagttagtaaagattaatgaaggatatttatcacataaacacaaatttctgtggcaaagataaagcaattagcttttcttcagtgaagtctgaagccttttggggtactgatcccataataagtatggctacagaaccagaaaggcctagacagaggataaactgttatgcagtaaggaggcagagccactcagagcagaaagggtgggagaaggg

SEQ ID NO: 195772 - DNA, 601 bp, Human
cacaagtgtgattgtgcctgtctgaaatgggatgatgtggtcatttgtgaaaaccacatctggggaagatgagtggtcctcattcacctgtgctctaagatctttgtaaataggagatttttgcactatctccaacaaggcacacacagaaacaatgcatagcaacagatctagaaaacgaataatcatacattgtgcaggcagacgaattttgactatccaatgatggcaggacagattgcaacaagagcaaaggacaaggtgataaaccctcctatcccccagcccagagcctctgcamcttcggcaagcccagcatgtctgtggactgggcaatgcttgtgtgctgatgtggggtagagaaaggagatatgcaagaatgaggacgagcacacactgccccagccctgcacagggcagttgagagcttgggatgagtctacgggcctaggttgggatcctggctcagccatgtgttgctcacatgagtagaatagattacttcatcccatggagcctcagcttcctcaataactacctcctaaggttcctgagaactggaagagtccttcatccaaagacccagctcttattattatta

SEQ ID NO: 195773 - DNA, 601 bp, Human
cctactttatggcaggtggatcacttgaggtcaggagttcaagaccagcctgggcaacatggcgaaaccccatctctgctaaaaatacaaaaattagctgggcatggtggcatgcgcctgtaatccctactactcaggaggctgagacagaggaatcccctgaacctgggaggtggaggttgcagtgagccaagatcaagccactgcattccagcctggtgacagagtgagactctgtctcaaaaaaaaaaaaaaaaaaattatgccaaaataaaaagttaaaatcaagccagaaaatatyacataaaaatcacattaagaaacacaatcctcatttctcagaatttcaaagcaaagaaagaggctacatgaaccagctttgaaatgcttttctattctctcaacctcctttggactccatgggtgccagatccttcctagcacccgaaccatatttggtagttagctaggtacaagctacagctacgaacgtacatgcttccatggtggcttaaaacagtggttggtttctaacgcccctagactatgcaaatggagttacatggagtgtgcagaagaagagccaggcctccatatcagt

SEQ ID NO: 195774 - DNA, 601 bp, Human
aatcaggtccagagatgagaaaatagtaccatatctatttcctcattgcaaatattgaacctactttatggcaggtggatcacttgaggtcaggagttcaagaccagcctgggcaacatggcgaaaccccatctctgctaaaaatacaaaaattagctgggcatggtggcatgcgcctgtaatccctactactcaggaggctgagacagaggaatcccctgaacctgggaggtggaggttgcagtgagccaagatcaagccactgcattccagcctggtgacagagtgagactctgtctcaaaaaaaaaaaaaaaaaaattatgccaaaataaaaagttaaaatcaagccagaaaatatcacataaaaatcacattaagaaacacaatcctcatttctcagaatttcaaagcaaagaaagaggctacatgaaccagctttgaaatgcttttctattctctcaacctcctttggactccatgggtgccagatccttcctagcacccgaaccatatttggtagttagctaggtacaagctacagctacgaacgtacatgcttccatggtggcttaaaacagtggttggtttctaacgccccta

SEQ ID NO: 195775 - DNA, 601 bp, Human
tttctatgtggatctaaacgccctaaggaaggcagcaaataaaagtccttcaacctggtcatctcaccctgtctatgccattgataatggaggatgttaagcacaagccatctgaggacagcccagacactctacagcccaacagtgggcagcaccacagacgccaataagggggatgagacaccttgtcccaaggtccacagaggcccaccctgaccacgtggcagccctctctcagagcctcctccacctcagctcagtagcccagctttctaaattgatttctgtgtctgtttcccayagctgttataacaactaccacaaactttgtggctggaaacaacacaaactatttgttctgggggtcagaagtttgaaatgagtcttaccaggctaacatcgagctgtcggcagggctgtgctccttctggaagctctaaaggagcatccttccattgccttttctagtttctgaaggctgcccatattccttggcgcatggccctgcatcactctgacctctgcttcatggtcgcatctccttctctgactcacttgcctccttcttgcttttatagcaatccctgtggttacagtgagc

SEQ ID NO: 195776 - DNA, 601 bp, Human
cataatttatataatatttgaggtgagcaagcactctcctcaccttctctactccctcattataagatcctataaagaaccccagaaaactaccgaaggcctgtgtattgctcagatcccaaaagcaaaaccataactacctgtgggtatcaatgcaaaaccattagcaaattttctatgtggatctaaacgccctaaggaaggcagcaaataaaagtccttcaacctggtcatctcaccctgtctatgccattgataatggaggatgttaagcacaagccatctgaggacagcccagacrctctacagcccaacagtgggcagcaccacagacgccaataagggggatgagacaccttgtcccaaggtccacagaggcccaccctgaccacgtggcagccctctctcagagcctcctccacctcagctcagtagcccagctttctaaattgatttctgtgtctgtttcccacagctgttataacaactaccacaaactttgtggctggaaacaacacaaactatttgttctgggggtcagaagtttgaaatgagtcttaccaggctaacatcgagctgtcggcagggctgtgctccttct

SEQ ID NO: 195777 - DNA, 601 bp, Human
cataagacattaagacactgttataaagtgacaggtactaccacaaacattacccatgctggcagtgagccacagatacagcttgtcttctgccaagcaggaaactgtactcaaaagacgattacaaatgattgctcattatgccagttcacatcttttccttgaagctcattagcacagagacgccgaactctcctgaggtccttgttatccagtggatctcctctcctgctccaaaacagcctttcccattgtcagtgagcagtgccaccttaccagctgtgcccagccataaacctgyccttctgtaatagaaatcaagagagaatgtccaggcatccaaatgtcaaggcctcatccacagccaccatggctggcccttcttcgctactgcaacagttgtcccgagaattcactctgatactaattggaagccctcattcccaagaagcaggtgtctgactacacttctttctccagatctgttaaaatagcatctcattaaaagcaacctcccttgggagataaggccaaagacctctgtcttatttcacacttaaattattttttctctttgcttaatccaagttccattttgtga

SEQ ID NO: 195778 - DNA, 601 bp, Human
aatacacattacatacaaaatatatgctaatcaactgtttgtactatcgttaaggtttccagttaacagtaggctattagtaattaagtttttggggagtcaaaaattacacgtagattttttactgcattgcggggttggcacccctaaccgccacattgttaaagggtcaacggtaaatatatatctacatattacatctacataaattgctatgttcttatacatcaaatttggtctgtatttggtctgtatttgttctgtagcatgcacttgtattaatattttatcattaatatttaatttgaaatattttaaatatttatgtattgtaaatattattttaatagtaaaataataaatagttttagtataaatgaattaacaaagcccctactttccaatagtattccaacagtccactgttatgagtctcctcatacagagcactgtgatataaaatatcgttgtatctttttattttcttataatatattcctaagagtggaatcactgaatcaaaagttgtaagcatctttaaggaccactcccaaacaacaatttgagagtggcctttggattcagtcctcgccaagaggta

SEQ ID NO: 195779 - DNA, 601 bp, Human
gttgaggatgaagacctttatgatcatccaattccacttaatgaatagtaaatatattttctcttccttacggttttcttaacattttcttttcactagcttactttactgtaagaatgcagcatataatacacattacatacaaaatatatgctaatcaactgtttgtactatcgttaaggtttccagttaacagtaggctattagtaattaagtttttggggagtcaaaaattacacgtagattttttactgcattgcggggttggcacccctaaccgccacattgttaaagggtcaayggtaaatatatatctacatattacatctacataaattgctatgttcttatacatcaaatttggtctgtatttggtctgtatttgttctgtagcatgcacttgtattaatattttatcattaatattaaatttgaaatattttaaatatttatgtattgtaaatattattttaatagtaaaataataaatagttttagtataaatgaattaacaaagcccctactttccaatagtattccaacagtccactgttatgagtctcctcatacagagcactgtgatataaaatatcgttgtatc

SEQ ID NO: 195780 - DNA, 601 bp, Human
tctgagaacatttattttatcttcctcacattagtcttcatcttagctatgaacttatttttgtatagagcatatagaataaagctggggtcattttttcttcaaatgatgagttgttggcccaaatagatttattgaatgattcttacatacctttgactttatgttttaactttccataattttccactgatttgtctatttatatttgtaatattttaatatccaacaagataaggtcaacttccttttagtgaaagcaagttgttaagttagtctgtttaagtcattacttgtgttygcaatgttttttgttgttgttgttgttcttttgttgttgttgttgttgttgtttgtttttaagactgagtcttactctgtcacctggactggagtgcagtggcatgatctcagcgcagtggcatgatctcagctcactgcaacctctgcctcccaggttcaagcaattctcctgcctcagcctcccaagtagctgggattacaggtgcctgctaccatgcctggctaattttttgtatttttagtagagatggggtttcgccatgttggccaggctggtctcgaactcctgacctcgtga

SEQ ID NO: 195781 - DNA, 601 bp, Human
taattcaagagatatgctctgaggtaattcactgtctgagatttcttaagcagaattaaatactgtatacattccccatgctgaggtgaattatctttttatttttttccacaatgaaaatagatttttatcaactctcacaagcagaggcaaaaattactcctaccaaataccaatgatactcacaggatgtgacattaatgtctaataggcttagccagtcttaaaaaaccccacccatcacaactcaatggaaaatactaataccatatgctgagatatcttaaaatttgaaaatagytttatctttccatcttgtttatggtaacttgtattcttgttttgtgtttctatggggtggaatctggcaatcttttcaggtgtagtatctgccttggcacctggctcagaaagagttccctttcctcagtccctgcatgtgcccacccttatcctctgagaacatttattttatcttcctcacattagtcttcatcttagctatgaacttatttttgtatagagcatatagaataaagctggggtcattttttcttcaaatgatgagttgttggcccaaatagatttattgaatgattct

SEQ ID NO: 195782 - DNA, 601 bp, Human
ccatagcaacaatgcaacaaatagtcattgaataagtgaacattttgattttacatcatttcatgtatgctactccattttgagtcaggataaacctctgagctgactatcaaaaagcacacatagttcttgtcaaccattaaagtaaactaaaagggcagggaaaaaaaacagcccatggttttcatacaataaataataaaagtttcagattcatagtcatccatttgattatgacatatgaattcatacaactcatgcagatttgtatatatgattgtatttccatttaacaggaatytgtcatcatgaaagttatattatgttaaataattgccctctactgaatatttgccccataagaggaacaggaaaagggttataatgaatcactgacatcagaagatcatgtatttgacctagatgcctctgaatcagctctgcaactaggacttcaaggtaaaacatatgttatacagtcaaatatgaatattttaattcaagagatatgctctgaggtaattcactgtctgagatttcttaagcagaattaaatactgtatacattccccatgctgaggtgaattatctttttattttt

SEQ ID NO: 195783 - DNA, 601 bp, Human
atgaaacgtgacgggaagggaaagatgagaaaggatgggattctgagcctcttcctctttatttattttttcaaaccagaaatctaaaactgtcctttaccatacctcttgcccactcccacatgacaaatctcaccaattctacctcccagtggaccctccattccatccaccaccttcaggccactgccagcaccctgaggtagatggccttctggcctatgcatttatctctctgttttcagcccattctctactccagtgtccaaatgacctctcaaacacatgcatctgatcatasttctctctggcttcaacagtttcccactaactcttacagaacaaagtcccctgccgcccggcccatagcaacaatgcaacaaatagtcattgaataagtgaacattttgattttacatcatttcatgtatgctactccattttgagtcaggataaacctctgagctgactatcaaaaagcacacatagttcttgtcaaccattaaagtaaactaaaagggcagggaaaaaaaacagcccatggttttcatacaataaataataaaagtttcagattcatagtcatccatttgattatgac

SEQ ID NO: 195784 - DNA, 601 bp, Human
aggtttgaaagtggccgggaaacaggagttattacttgccctgtgggagagaaggaataagtctatggaggggtagagtttgcttacaagcaaccagcttctaggagccaacagtgggcttcctccagcctcttgtctcagttccagcctgggcacacacaggattggctcttcagacagaaatcaggagcccggggaattattagtcctatcaggcaagaagtataggcagtagagggtaaaagttttgtatgttgagacactactgagaggtgggaggacatgaaagggagagggcagrgtggattattcacacccaaatcttaaactgggaccctacattataaacatgccccaacttgtgctttcatgttgtaattctataatttcatgtttgcctgatgcagtcaaacacaatcaaacaaaaatgaaacgtgacgggaagggaaagatgagaaaggatgggattctgagcctcttcctctttatttattttttcaaaccagaaatctaaaactgtcctttaccatacctcttgcccactcccacatgacaaatctcaccaattctacctcccagtggaccctccattccatccacc

SEQ ID NO: 195785 - DNA, 601 bp, Human
cccgcccctgctttggggacacaagcaaactgctccccagggcttcactcctgtgtgtcttcccttcctctcctccacatatcacagctccccctttccctcagcaggaggcagattaggggcccaggtacatggggtagtgctgtacaggtgggaggtgctgggaagacaaaggtcatgctgaaattaggctgtatgaaaaagatatgtctgcagtctgggctgaagggctctatagccaggaggatagtccctgccatgtttctctcatagataaagggtatcacaatggccagtgaarcccgaatacagagtagaggttgtggagaagtgcaagaatcctcccaaaggagttttaggacaaatatcaatcagggtgtccagaaaagtccaactttatttttttatctcatttttaattttagattcaggggttacatgtacaggttttttacatgggtatattgcttgatgctaaggtttgggatatgactgtacccatcacccaggtagtgacacagtacccatttggtaatttttcaacccaagctcctacccccacctctagtagttcccagcgtctactgctcccatcttcatg

SEQ ID NO: 195786 - DNA, 601 bp, Human
gatgatcttaggtgatgcaaaggcaattaaaccctttaaagaaatctaaggcagagattagatggaagtaaaaaaacaagggggggaaagaattttaagacggatgcttaggccactgctgtggtgtacattacatgtgaaatgtaccagaaagaacacaaacagcctttgccctccatgagagaaacttgctagaggaaaacagggacaggagtctgctaatggccagggctctgagctccatgaccagggagggacagaggggagttgtgccctggttgccctggtgatacacaacgaygctgccccgcccctgctttggggacacaagcaaactgctccccagggcttcactcctgtgtgtcttcccttcctctcctccacatatcacagctccccctttccctcagcaggaggcagattaggggcccaggtacatggggtagtgctgtacaggtgggaggtgctgggaagacaaaggtcatgctgaaattaggctgtatgaaaaagatatgtctgcagtctgggctgaagggctctatagccaggaggatagtccctgccatgtttctctcatagataaagggtatcacaatggcca

SEQ ID NO: 195787 - DNA, 601 bp, Human
gatacatgaatgatcccagtgaattccaagttccttccaagtaacttctactgatgtcccgaagacactttcctaaaacaccctttcctcctaaccctagataccagctgtttggaggacagcaacctacactgactgcttccctacctggtatcagacattgtgcaaggtgctttgattccatgtgatctactaacaacctgtgaggtcttggttattgtcctgttttatggttaagagacctgagactcagtagatgtaggtgatctgccaaggcttcatctggggaagaaggggtacrtatgaatggggtggcatctcttccactccaatggtttgctttcaagagggaaagccaagccagtattaccacattttcatatttttctagagaaatatgaaatcgagactactatgtggattctcctgatatttacatgtatagtttaaaaaaaaactatgggccaaacaaacaaatctgcatcccaaatttcccctaaaggaagcaagataaagacatcagtgctgcttattctaaattatttctaaatttttaagcaatatttttttcaaatgatgatcttaggtgatgcaaaggcaa

SEQ ID NO: 195788 - DNA, 601 bp, Human
tctttggcagtcttcaaaaacaataagataaagaaaaagaaaagaaaaaaacaaaagctcaagcaactcccagtgtgccctaccaaatgtacgtttcaagggagcaagcccggctgaattaacagaggttacatccaaagggtaacaagcagcgttcctgagtggctcttacattaagtcaaatgaaaatattaaaggacctgtaattttccctttattgctctcagttccatcacaggagctaactgcctctataaaaataacaaatgttaatttgctgcattacttgatagctttgctytgcaaagaagaatgccacattcggtcctgctttgattcactttcattccttcatcaacaaacatgtatggggcacccactgaaatgctgcatcctgttcagggatctggggatacagtagtacagtagtgaacacacagtcaaaaatccccactcagagcttgcattcaactgggtagagaaataacaagacaagtaagtaaaacacatagtgcgtgagatgatagtaaggctcagggtataagaaggaagctagacgggagagaaaaggaacagacaaagctggcgggagggtggtggg

SEQ ID NO: 195789 - DNA, 601 bp, Human
ctttgagaagccaaggccaacctgcggcatattctagccccaactgctgttaaagctggggctctgttattgtactgacacacctcctcttgtaacttcttctgaacctgcattatctctccaactaaattgcaagtgatccaattgtaattgaaatccaattaaagttactcaagtagtaaaacaatgcaagtactttgtttcactacttctctctatatcttacaaagcacttggcacacagtagaggcataataaatatgttggctacatgatacaaatgaaaggctttttataggcragaaaccataaagcatcttaacaatagggtaaacatttacttatttttgtatctgtaaaaggatctacttcactctagtgaagcagaaactattctttcagtgtagaatcatttctactaattttctttggcagtcttcaaaaacaataagataaagaaaaagaaaagaaaaaaacaaaagctcaagcaactcccagtgtgccctaccaaatgtacgtttcaagggagcaagcccggctgaattaacagaggttacatccaaagggtaacaagcagcgttcctgagtggctcttacatta

SEQ ID NO: 195790 - DNA, 601 bp, Human
gtcatggccatcatgatcatgtcacagtgctgcagagattttgtttatggccagttttggggccagtttatggccagatttgggggcctatcccaagcaaggtatgatcattccctcttcacagctaccatggccccttctgagccatgtttgatcagaaaaagaaatgaccttgggtccagtgatctcagttaaaattcagtttctgggcccggcatgttggctcaagcctgtaatgtcagcacttcgggaggccaaggtgggtggatcacctgaggtcaggagctcaaaccagcctgaycaatatggtgaaaccctgtctctactaaaaatataaaaattagccgggcatggtggtgggcacctgtagtcccagctacttgggaggctgagacaggagaatttcttgaacccaggtggtggatgttgcagtgtgctgaggtcatgccactgcactccagcctgggagacagagcaagactccgtctcaaaaaaaaaaaaaaaaatcagtttctcccactgtgtggtctcacctggtgatcctgggccagctactgagactccctgcatctcggttcactaatcaataaagaggaaatag

SEQ ID NO: 195791 - DNA, 601 bp, Human
catgatctcagctcactgcaacctctacctcctatgttcaagtgattctcctgcctcagcctccctagtagctggaattccaggcgtgcgccaccatgcccggctaattttgtatttttagtaaagatgaggttttaccatgttggccaggctggtcttgaactcctgacctcaggtgatctacccaccttggcctcccaatgtgctaagattacaggcataagccaccacgcctggccccaaatggctcctttctataaactcggctctcataagttagaaagggtcccaaaagtggaaygattctgcaaagttcccccaaaccttatcatccctccaccactaacaataaacacataaccaaactgcggacaagcctacagctgtcctcagcatgccatctttaccacctccctaattctgttcactgccctgacacttgtcccaaggaaccaactatatcccttgaggtctgtgtaaagccattcacatttctctgatgtctttcgctgcacatattgctgagaccagcttggtcgtggagaccctaacccagcagcgctagaggagttaaagacacacacacagaaatatagcatgt

SEQ ID NO: 195792 - DNA, 601 bp, Human
aggcacttagctgtgcaggaacaatggtgagcctttagcccaatcaggagcagcaacggatgcctcgctggatcaggagcacagcccacaccctgccagatctggaggggtagaagtcagcagcgggtctgtgatggcggcattcagcagtggtggatggtgagtgaaagctcagcttgagccagaacaaacacagaccagaagagtgtgcagttgcaagctttaatagagtgaaaacagagctcccatacaatgggaggggacccaaagggggttgcccactcccggctcgaatgcctgrggtttatatcccaatcattgtccctccccctgtgctctcagatgatagatgatttgactatttctttacctcctgctcttagcctaatttgtattttagtgagccctctttactacctgattggttgggtgtgagctgagttacaagctccgtgtttaaaggtgggtgcggtcaccttccccagctaggcttaagaattcctagtcagcctaggaaatccagctagtcctgtctctcagaagttccctggaaaactaagtgggataactcaaaaggtggctctattgaggacaatgacca

SEQ ID NO: 195793 - DNA, 601 bp, Human
gctcccaagatgaggtgggccttttgttctctgacccggggttcttggcctcacagattccaaggaatggaaccttgagccatgcggtgagtgttatagctctattagaagctgtggatcacagaagagaaccgtggaacccagcgactagtgttcagcttgattaggacgaacccaggcacttagctgtgcaggaacaatggtgagcctttagcccaatcaggagcagcaacggatgcctcgctggatcaggagcacagcccacaccctgccagatctggaggggtagaagtcagcagcrggtctgtgatggcggcattcagcagtggtggatggtgagtgaaagctcagcttgagccagaacaaacacagaccagaagagtgtgcagttgcaagctttaatagagtgaaaacagagctcccatacaatgggaggggacccaaagggggttgcccactcccggctcgaatgcctggggtttatatcccaatcattgtccctccccctgtgctctcagatgatagatgatttgactatttctttacctcctgctcttagcctaatttgtattttagtgagccctctttactacctgattgg

SEQ ID NO: 195794 - DNA, 601 bp, Human
gcaaatgttggacctcctcataggcaagattttagagatcacttaaaacaattcagtgggtggaaatcaccaacaatcacagaatggataaaaacagtaaactgtcttaatgagttcttgttgctcgaaataaaatttcaagggacactatcacacagggcttcaaagagtgctttatctgaaatgacattgatggagtgttgaagtgttactggggggtctttgttcttccagctcccaagatgaggtgggccttttgttctctgacccggggttcttggcctcacagattccaaggaayggaaccttgagccatgcggtgagtgttatagctctattagaagctgtggatcacagaagagaaccgtggaacccagcgactagtgttcagcttgattaggacgaacccaggcacttagctgtgcaggaacaatggtgagcctttagcccaatcaggagcagcaacggatgcctcgctggatcaggagcacagcccacaccctgccagatctggaggggtagaagtcagcagcgggtctgtgatggcggcattcagcagtggtggatggtgagtgaaagctcagcttgagccagaacaaac

SEQ ID NO: 195795 - DNA, 601 bp, Human
agaaagggcacctgtgaacacaaaattgcaaatgttggacctcctcataggcaagattttagagatcacttaaaacaattcagtgggtggaaatcaccaacaatcacagaatggataaaaacagtaaactgtcttaatgagttcttgttgctcgaaataaaatttcaagggacactatcacacagggcttcaaagagtgctttatctgaaatgacattgatggagtgttgaagtgttactggggggtctttgttcttccagctcccaagatgaggtgggccttttgttctctgacccgggrttcttggcctcacagattccaaggaatggaaccttgagccatgcggtgagtgttatagctctattagaagctgtggatcacagaagagaaccgtggaacccagcgactagtgttcagcttgattaggacgaacccaggcacttagctgtgcaggaacaatggtgagcctttagcccaatcaggagcagcaacggatgcctcgctggatcaggagcacagcccacaccctgccagatctggaggggtagaagtcagcagcgggtctgtgatggcggcattcagcagtggtggatggtgagt

SEQ ID NO: 195796 - DNA, 601 bp, Human
ttccagactgtgtcaacctaccccgagcatcaaaacagctgcatccaaaccataatggtcacataaaatgtcatgtattcttgccactagttatttcatcacaacaattttgtagaatactgtttctgcccaacctgaagatgaggttttattaaaattatatctctaagaatacaggctttgcatttgattgctgacacagtatttcatattacgtagctctcaattattaattgagtatgtgaaagtttagtttggcgtaaacacaccaacctgatacatccttaatcaatgccagttytatatgcccagaaagggcacctgtgaacacaaaattgcaaatgttggacctcctcataggcaagattttagagatcacttaaaacaattcagtgggtggaaatcaccaacaatcacagaatggataaaaacagtaaactgtcttaatgagttcttgttgctcgaaataaaatttcaagggacactatcacacagggcttcaaagagtgctttatctgaaatgacattgatggagtgttgaagtgttactggggggtctttgttcttccagctcccaagatgaggtgggccttttgttctc

SEQ ID NO: 195797 - DNA, 601 bp, Human
tgtctcatacactagttggtaatttttttaaatagcagaatgtttaatggcttggcttccagactgtgtcaacctaccccgagcatcaaaacagctgcatccaaaccataatggtcacataaaatgtcatgtattcttgccactagttatttcatcacaacaattttgtagaatactgtttctgcccaacctgaagatgaggttttattaaaattatatctctaagaatacaggctttgcatttgattgctgacacagtatttcatattacgtagctctcaattattaattgagtatgtgwaagtttagtttggcgtaaacacaccaacctgatacatccttaatcaatgccagttttatatgcccagaaagggcacctgtgaacacaaaattgcaaatgttggacctcctcataggcaagattttagagatcacttaaaacaattcagtgggtggaaatcaccaacaatcacagaatggataaaaacagtaaactgtcttaatgagttcttgttgctcgaaataaaatttcaagggacactatcacacagggcttcaaagagtgctttatctgaaatgacattgatggagtgttgaagtg

SEQ ID NO: 195798 - DNA, 601 bp, Human
cttgtaatactaacttgaatatatattttactaggattgaggccataattgttaaaaattaattgaatacttaatgggcatctgaagttcaaacaccctcctccacaccctctcctgcccccaaacaaccactgactactacacagtcaaacaaatataattaattgaaataataatttaacaagaaattataagaataattatgattttaatcatataattaaaactcacaaaagtaggtgagtccattctttagaatagaaaataccatattcctattgatcaaattccaatttcaacyaataaatttaattgatattgaagtctgactatccaacattaaagtagaaataagataatcagagattcagaccataaaaactgcaagtgtgagcagaacacttcataaagaacaagcaatatccttttctagaataaatgaatatggtcaacactcaactcttggtgaggtataattttacttctagattgcatctaattctcacaccatcacttacccatctctgaatcccaccgaattcctcattccatctctcattcctacttttaccttaatcctcatctcagggttgatgtgact

SEQ ID NO: 195799 - DNA, 601 bp, Human
ctttaaaataatcttatcctacaaataatggcatgctacattaaattacacctaaaagatggccacatgaagtccagacatggaactaaaatatgcctggacttccaaatatttcaacaggaaggcaaccatcccagcatttgtttaaatatgaaaattttcatcgtggaaattttccaacgaacacgtaagtaaagagaacagtataaagaacccccacaaaccgtttacccagcttcaaccccttatcaacattctgccattcttgtgtcacatgtcaatctcatcagaatttttaaamgggcattctctgagcaaaacaagccttctgtcagaactacagtggtgtctcaaattttgtattttctataataacatagattcttctaccttgtggtaccaatcacagaatatatcaactcaacagcatctgctcaatttcaaaactactctaaacagtaactcacatttgcaacaaatcaagatatgaaagggccaattgctagtgagttagctctaagcaacatagactgatcttttctcatatatatatatcacattcatgtaaaaatacaaggtctgacatggaaggaggggtcta

SEQ ID NO: 195800 - DNA, 601 bp, Human
ttcctacccacacctagaatcagctatttctgcaaggagccctggtagtaggaagttttagtaggatatggtttcgtttagtaagaaatgtggcactgctgcatggctgtcattgctttgaggcctgaatatcattcaagatgtggtcatgttcatgagatgtcgccgcagtgaggttagtcatttactaccacctaacaccgtccttttctgacaatgccgtccatgaggggatgtcccctgaaggcagttattctgccaaaaatcaaagctccctgcagagatatgccattcctgaacyggtaggtcactcttggcatatgatcatgaatcacgtcatgtggcagaaaaggaaaagaacctcctagagatttggaaggccagtttctgacgagagaactagggaatcaacattcccaggcatcagccttcctggaaattttccctctgcactctccggggcacacggcctgattccatcactgcctcagcagagacctgagcagatggagctgaaatcttgcaacttctacctaaataaaatggccattatgtaaatatcgggcttgaatccagtgtgcaagggcatatgtgtatttca

SEQ ID NO: 195801 - DNA, 601 bp, Human
gaatggttcaccacacataagagtcaacaatgtattgacaatctcatggtttattactgatgggaatagggaattattttaataaaagattaaggttaaaagaatcaccaccatcccgtttattcattttcaaggataatatgcatcagagctccctttcactcaaaacatatgaagagcccaagattacatttctgtatctctgtgtagtaaaaagaacagataactttagaaatcaacagacctgggcttgcccacttcctagttcagtgactttggcaacatacttgacacctctgasactttattcttcaatctttcaagtagagatttcataagttcgtgacaatcaaataaaatatgctatacaaagaacctaatagaaagcctagcgaaaagtagctattcaataaatagtgaattttttttagtatttcagtaactaagcacaagccacacaccttttaatacttaaacttgaaataataatatgaaaacacttgttcaaagcaagagagaataaaggatttattgagacaatacttacatgtagacattcatagtgaagccttctgcattcattttgaggatgaacccctct

SEQ ID NO: 195802 - DNA, 601 bp, Human
ttaattaaacaaggtggaggtcactgatgaccttgacagcagtttaagtgccatggtcatgtagaaagcctgactagggtgggttcaagatagaagaggagaaataaaaaagcatatagatcaggaattattagatcatgtccaggcacccctgaggggttcccaagagctttccatgcatcaacagagtcaaaactactcttattctttcataagtttatggcagagttgttcaaagattccatgacatatagatgacatcctgtactgacagctaatgagatgtgtgcttgtgtattaygttttaaatgtttttaatttctaatatgggaaatactaatgaatataaccaaaataaactacaattctttggaggtgtttttaagagttgtaaagaggtcctgagatcaaaaagtttgagaatggctgagtagacagacagacatgcatgcatatacttatagcaaagctttagcctcagaagtcacatcggggacgcacagggtcctagtcaaaagctgattctattcagtgcaatatgtgactgtctgaaaagctctagcctgaaacaaccttatttattcagggccggatgtcaaaa

SEQ ID NO: 195803 - DNA, 601 bp, Human
acaaaagacttttttcaattataccttattttgcatactctggaaaaacttggagtttagactgggttaagcctattatatttctttgatatgtttataaattatttctcaacatgaagacataaaatggtctactttccattcattcattcacttcaaatatttactaatactctagtaggtgccaggcacactcaaggctgaggagcaatagaagaacagacaaaagaaatggctgtcataatagattgttcagctgtggttggaaaatgagaggcaattattttaaataataattaawatacgtcatacattaaatggcaaaaaaaagtgccagggagaaaaataaagcaggaaaggggggaaagagtgttggaggaattgcaatcttaaaatgggtattaagggaaggcctcacttgagaagctgatatttgaataatgatctaaggtcgacaacagagtgaaccctccagataaatggggacgggcactctaggacgatgacactgtaagtgcaaaagcccagaggtcccacaaggatgtcagtgtgggtagaggggaactggcagggaagggttataagaggtaatggaagtagg

SEQ ID NO: 195804 - DNA, 601 bp, Human
gcttcatttccaaacccacaaatcctaagttgctttacaatgtaatatacatcaagtataggctatcttctccagagcagtagctacaattgttagtgtatattatcttgacttatgttcaggtatcggttggtatgaagtgaaatcttaagagataactcaatatcctaagacttaagaaatgcctggtccaaaactcttcttacaaaagaggcaacagttgtgtcacaagtgcaatgacatttatgtcaattgttgtactcccagaataattccttagaggagaatgaaataatcaaarttgatcatgggaagacatcttttatatctgtaccaaatctgaagtattgatgttaatccctacataacctaaatgtaacattgagctagctcctctctcaccaaaccttttgtgtaaattatgcctagggaaagagaaacacaaaagatcaagaaaatgtacacaatgttcgccagaaaatgcataccagtcccagactcatgaataaacactcaggtaaaaagcactgtcacataaacacattgatgaatctccaaaatgttaatctccaaaatgtccagtcgacttctgatgctcaca

SEQ ID NO: 195805 - DNA, 601 bp, Human
tttgggaaatacatgtgcagaaaacaattcccaaagaactttggcttatgcaagtgatatgttagtatttatcatattagattttaacgaaaattttttttaaatattgcatcatttaaactcacaataggtgaactgcagagcctcacatctgtaatctcaaccctttgggaggccaaggtgggaagattttttgaagccaggagtttgagaacagcctgggtaacatagcaagacccccatcactatgataacaattattttttaaattaaccacatgctgtggcatgtgcctgcagtyctagctacttgggaggctaaggcaggaggatcacttaagcccaggagtttgggttgcagtgagttatgatcacaccactgcactccagcttgagctacagagtgagaccctgtttctaaaaaatacaaaaaacaaattaaagaaacccctaacaaactcatcacatgtcaatataataacatcttatgacattttaatggttttttcttacatttttacaaatatctttactgtttactctccagcctaataaaaaacagctagattcttttatttacttctgctttgaatctgttgaga

SEQ ID NO: 195806 - DNA, 601 bp, Human
ggcataggcagaggatatgctactttattataatttttctaaaaactgctgaacaaatgacatccaaaaactaatttggaaaatcaaaataacaagagaagcatgtggacaaatgtacacctgtggccaggtctccaaactgcatgcagtggagtaaatcgccttactcccatgacctccctcttcatccctaggctgtagttccagcccccgccctgtcagttacaagttctcatacgagtcttcgcttctccataagcagatgctaagaaagggtatccactggaatgccaccccactytgaactagcacattaccattgtggtttagattctttattcccttgcgagtttgattagcgtaagttgactgcaaagaattctggatactgaccaagtttcctgaaggcaagaatatcaccttttttgttttctcctgaaaaccagcacttaacatagtgtctcatacaccacagaatgaatgcagcaaacagctgttgaacaaataatagggaggtggtgagagaggagaagggagggaggaaggaaagaaagaaaaaaagagaaagagggagggaagaagagaaggaaaggagaaaaga

SEQ ID NO: 195807 - DNA, 601 bp, Human
ccttaataaaaatcactattaaggccaggcgccgtggctcacacctgtaatcctagcactttgggaggccggggcgggcagatcacgaggtgaagagatcaagaccttcctggtcaacatggtgaaaccccgtctctactaaaaatacaaaaattagctgggcatggtggcacacacctatagtcccagctactcaggaggctgaggcaggagtatcacttgaacccaggaggtggagtttgtagtgagccaagattgcgccactgcactccagcctggtgacagaccgagactctgtctaaaaaaaaaaaaaaaaaaaaaaaatcactattaaaacatttcacagtgatggaaaagtgtaagtatacccagatctcaagtttcctgttgcatctttcaaacatgaacaaatacgtactttcaactctactctatatagaccctccattgggcactggggatatagtaccaaaaaatatttagtcttatctataacagtttaatttttttaacctagataatacagtcattaatactggtataattaaatattaattttcaaaatgtttatgaatgtagaaaatggagaatgagcattata

SEQ ID NO: 195808 - DNA, 601 bp, Human
tgtgccaaatattgttttagattatagttctaaatagtaactaatgtagtaactcatttaattttcatgactgtcctaaggaagtagctactattatcatccccattttacagatgaggaaatagaggcctatagaggtgaagtaacttgaccacttgctaataagtggcacagcttggactggagtccaggttctacatagatttcagtgctcaaacacaatgccatgctgcctctggaatggattttgatgttaagtataaggcaaaggtgtaaaattttgttttttgctatcctgaayagtcagctaacaaccctagcaacattactgaatcatcttgatttcccacaacgagtgatgccaactttatcacatatattcttattttccttgacatcacatatgtgccagacgacagagatgaagcagtctgttattcccattgcacacttacagattcaataactaagacaactgagaggtgatttatcaaaacctctccactggagacttctgctccccacggcatctggccggcagaccatgagtcatgctctccagcggcccctctcaaacagcaggatcctcaagatgcaaatg

SEQ ID NO: 195809 - DNA, 601 bp, Human
aaagaaagaaaatatttttgtacaggtgtacaatgtgtttgtttggagctgttattacaaaaaacctctaaaaattaaaatgtttataaagtaaaatgttactgtgagctaaggttatagtgaagaaagagaagtatgattttgataaatttagcatagcttaagtgtacagtgtttattatctacagtcatgtgctgccctaggccttcacattcactcaccactcactcattgctcacccagagcaacatccagtcctgcaagctccattcatgataagtaccctatacacgtttatctttttttttttttgagatggagttttgctcttcttgcccaggctggagtgcaatggcacaatctcagctcaccgcaacctctgcctcccaggttcaagtgattctcctgcctcagcctcccaagtagctgggattacaggcatgtgccaccatgcctggctaattttgtatttttagtagagacggggtttctccatgttggtcaggctggtgtcaaactcccgacctcaggtgatccgcccacttcagcctcccaaagtgctgggattacaggtgtgagccaccacacctggccaggtgt

SEQ ID NO: 195810 - DNA, 601 bp, Human
tatatatttatatatagaaatatatatttatatatagaatatatatatttatatatagaatatatatttacatatagaatatatatatttttatatatttatatatattctatatatatagaatatatatatttatatatagaatatttatagaatatatttatatagaatatatggaatatattctataaaatatatattctatataaatatattctataaaatatatattctataaaatatatatattctatataaatatatatatttatacttatatataaatttaaaactagaaaamagcttatagaataaggatataaagaaagaaaatatttttgtacaggtgtacaatgtgtttgtttggagctgttattacaaaaaacctctaaaaattaaaatgtttataaagtaaaatgttactgtgagctaaggttatagtgaagaaagagaagtatgattttgataaatttagcatagcttaagtgtacagtgtttattatctacagtcatgtgctgccctaggccttcacattcactcaccactcactcattgctcacccagagcaacatccagtcctgcaagctccattcatgataa

SEQ ID NO: 195811 - DNA, 601 bp, Human
agtagattataacactgcaacctgcccggaagttgccttaacgagtcctggaattggaggcccaggactccaagtctgttggcaagactcaatctcaacctaaatgcagtcttttggtgagaaaataatactcaaagaagtagcacaaagaacaattttaaactaagtaatgaatcctatattagcaatgcagacttgatggtgaggccagtcttcaagcttctcattggtttttattttgcagattagtgagacaacatatgatcatccagaaacctcctggattagtgagttctgatgyttgtatcaatcagaaaagcagaaaccacttcaaggatttacagtacagtcatgagccgcataataatgttttgtgtcaaagacagatcaaatatctaatggtactcccataagattgtagtggagctgaaaaattcttaccacctagtgatgttgcagccatagcgatatcatggcacaatgcattacccacgtgtttgtggtgatgctggtggaaacaaacctgctatgctaccaggcatataaaagtcttgcatatgcaattatgtacagaacataatgatagtgataaaaaatggct

SEQ ID NO: 195812 - DNA, 601 bp, Human
ttcttggaaataaattactgaaacaaatgaatttcattttttcaatctaaatggtaattctcacatgacagcaaaaatcttacacaacactgtactgagtgtaaatggatgttcaagtagattataacactgcaacctgcccggaagttgccttaacgagtcctggaattggaggcccaggactccaagtctgttggcaagactcaatctcaacctaaatgcagtcttttggtgagaaaataatactcaaagaagtagcacaaagaacaattttaaactaagtaatgaatcctatattagyaatgcagacttgatggtgaggccagtcttcaagcttctcattggtttttattttgcagattagtgagacaacatatgatcatccagaaacctcctggattagtgagttctgatgtttgtatcaatcagaaaagcagaaaccacttcaaggatttacagtacagtcatgagccgcataataatgttttgtgtcaaagacagatcaaatatctaatggtactcccataagattgtagtggagctgaaaaattcttaccacctagtgatgttgcagccatagcgatatcatggcacaatgcat

SEQ ID NO: 195813 - DNA, 601 bp, Human
tgaagaggcattattacggttactatgactatactaattattctgaagttgctccttgatgcaacaggaagagtgctgtatttgattattgatgtctgtcacaggcataaggggcaggcacagaagtgcaggcagtgcctaatatccacaccaactccaggaccatgactgacttaccacaccttgtgcccagcagcaagacatctagtttgcattaggccatgtgtgcaggagggaccaatggaagggaatggaattaatgagagctgaaccctgacactggcgggtctataaacatgtwagaattgcccaaaggaaactcaatgattttgtaacagctctacataatgggtgatacagatgctattattattgagttatataaaaactgatgcttagagaggcacaaggtaacatctgggtcagaatgagactcagaaaccaggttcctccaacagcaaagtccatgctgttcagctgtaactatattgccattagaagctacatgttttaacattacacttttaaaatgataatgtaatccaaccctcatctatttttgctgataaatataacctgcatcatatgaaagttgagaaat

SEQ ID NO: 195814 - DNA, 601 bp, Human
tgtcttcacgctccccaagcttttaagaaacactaactttaaaacaaaaccaatttttccttattactgttggggtattacgtgcaaattcaaattaagccaatttaggtacaccatttacataatgtatacttcctaatatgtaaagaatcctttaggaggccgaggcaggcggatcacgaggtcaggagatcgagaccatcttggctaaaatggtgaaaccccgtctctactaaaaatacaaaaaattagctgggcatggtggtgggtgcctgtagtcccagctactcaggaggctgaygcaggaggatggcatgaacctgggaggtggaggttgcagtaagccgagattgtgccactgcactccagcctgggcggcaaagcgagactccgtctccaaaaaaaaagaatccttccttctaaagctatgactactctgtaatgggtttgagctaatatctccccaaattctgaagcaaataagtgttatcacacatggctgctgaactggtgaagaggcattattacggttactatgactatactaattattctgaagttgctccttgatgcaacaggaagagtgctgtatttgattatt

SEQ ID NO: 195815 - DNA, 601 bp, Human
taacctaagctttcaactgcaggaaaagcttatgttttagctgctttgcactattcagaaaagctcaaattgaaaataattagaatagtttttaagccaggaaattgagttttgtgtttacatcattcctctaacctccatagtaataataataatcaacccatgtgattattatgactctccatttgaatctatattgaaaattttgatagcacttaaaattaataaggcagctgtaacaatataccaagtatgaatgaaaatatttatatattctattattcatatttatattttcctrttacatattattttgatctagatttcattggcaatacccctaaaatcctacagatttaataaatgtcattccaatttaacttttccaagtgtcttcacgctccccaagcttttaagaaacactaactttaaaacaaaaccaatttttccttattactgttggggtattacgtgcaaattcaaattaagccaatttaggtacaccatttacataatgtatacttcctaatatgtaaagaatcctttaggaggccgaggcaggcggatcacgaggtcaggagatcgagaccatcttggctaa

SEQ ID NO: 195816 - DNA, 601 bp, Human
gaaagtgaattaccatctacaggaaataaagtgtctccttcccaatacttaatatactgcctctgttctcaggcatccttctgaattaagaatggctatttgtaggtcgaagtggtgaaaaaaccttatcaaggtgaacataagttttatctataaatgcataccataaaaagaaaagaaccggccgggcgcagtggctcacacctgtaatcccagcactctgggaggctgaggtgggtggatcacgaggtcaggagatcgagaccatcctggctaacacggtgaaaccctgtctctactraaaatacaaaaaattagccgggcgtggtggcgggtgcctgtagtcccagctactcgggaggctgaggcaggagaatggcgtgaacccgggaggcagagtttgcagtgagccgagatcgtgccactgcactccagcctgggtgacagagcgagactccgtctcaaaaaaaaaaaaaaagaaaagaaccttcctgggatgaatcctactttgtccacataaatgattcctttaaataatttaatatgatttattataattttatttagagtttcaagccatattattccaagcccctgtttt

SEQ ID NO: 195817 - DNA, 601 bp, Human
agaaaaggggagtgaaaatgtaagagaaagaaaaaaaaaccaaaagcatcttttatttgtgatgtgccattattaagaatattgcagctaaaggaataaacaaacaaaaatcagcaatgcaaggagtgtgtcttcatacttatttttcctcttctttaaaggggtaaagcttaacttgaaacagaattccaagccatcattagtctcagatacagcttacctgaatgtttctgtaagttctccttactgagcatagccacgagtacctgaattcaaccctagtaccttgaagtcaactacrtttgcacccagttgggaaaccaattgttaagcatgttatgttttcctatttgaattaaaatgtgttttctaaagaaaaggcattagaaagagatttttcaggcctatcactacacatgcagatacttgttaagcactgaatgatgaatgaatgaatgaatgaatgaatgaatgagtgaatggataactactttccatggttcacccaggggcagcctattaattgcacacataaatgcccccatagaaccaaccagtcttctgtaaggagaagactctctaaaccaattctttttcattt

SEQ ID NO: 195818 - DNA, 601 bp, Human
gaaaccctaatcttcaatgccatggtacttggagatggggcctctgggaggcaaataggtttagatgaggtccttgggatgaagcccccataatgagattaacgtccttataaggagaggaacagacaccagcgtttcctctctctgccataagagaacacagcaagaaggtggccatctgcaaaagcaagaagaggcttctcactagacccagaatctcctggcaccttgatcttggacttgtaagaaaaaaaaaaaagtgttgttacttaaaccacccagtctatatgttttttttttkttgttatggcagccgaggctgactaagacagaagacttttccaaaaacggtgggacttcagatgagggccaagtagaaaacaaggtggggaagtgagataggtggaaatgaaggagaggaagaaaaaagtcatttcatggaaggaaacgtgaggctaaaagagaaaaatgaaaaaagtcagcaaggtaagcacagagcaacctccctagacagagaaagaaaaaaaaatggtttgtttaatcctaagcaaaacacattgacactttctattctttccaataaacctgacattcaaaagag

SEQ ID NO: 195819 - DNA, 601 bp, Human
ctctgacacttggggatgtctaattttcacaacttcacttactgaatacttatgctgtgccaaaaacggtgctgcatgctttatttcacttaagcctcacaaataccctataatataggtacattactagtcccattttacagatgagaaaactgaggcttataggttggagtaattggcctaatgtcgcataattagtaagtgatagaactgggactagaattccagatctgtgctttcgataacctattcctgcttcagtatgccgagtttgtggatcatctcaggtcaggagatcccrtcatgctcctcttgcagctgacacctatggcgcctgtatacatggattagtggctgggatcacctaaccagtccacttgaagcacaaagcaatatgataaaacaaaagtggcatccacagataattcttctgtttcatatggaattctgctcattggtatactgtggttacaaaaaggcccacaaaatctttcatttcctgtatgcagtctgcttcgcagtgtgacccttcagctcctcccatgaagaggtgaaggctatctctccacccttgaatttgaaattagccaagtgattttct

SEQ ID NO: 195820 - DNA, 601 bp, Human
gtgaacaagacaaaggccctcctccatggaatttatattctcttgtgagagacagttaaaaaaaattgaataaaataattttaaatagtaattcatcccagcactttgggaggctgaggcaggtggattgcctgagcctaggagtttgagaccagcctgggtaacatagcaaaacccagtctctactaaaaataaaaaaaaattagccacgcatggtggcacacgctgtaaccccagctactcaggaggctgaggtaggaggattgcactccagcccgggtgataatgaagccctgtatcaaaaaaaaaaaagtatttcatgttatatgaagaaaaatacaggaaaggaaaaaagagaaagatccatgaaacatttaagaggtaaaaaccgcaagacaaagtaaccacaaagctgcctatgaattttcagaatgctccatcttgacttcagtgctaaagtaaagaatcttcctgaacactctaagcacagtttctagagaaagtccatctaatcaagagcacataacagatggttcttgatctagttccacaacacacagctcaagggcaatgcactgatggtttggggctgccatatacc

SEQ ID NO: 195821 - DNA, 601 bp, Human
ataagtttcccagtctctggtatgtctttattagcagcatgagaacagactaacacaccaggccctgctgtaatctctggagataacggctgtgaacaagacaaaggccctcctccatggaatttatattctcttgtgagagacagttaaaaaaaattgaataaaataattttaaatagtaattcatcccagcactttgggaggctgaggcaggtggattgcctgagcctaggagtttgagaccagcctgggtaacatagcaaaacccagtctctactaaaaataaaaaaaaattagccaygcatggtggcacacgctgtaaccccagctactcaggaggctgaggtaggaggattgcactccagcccgggtgataatgaagccctgtatcaaaaaaaaaaaagtatttcatgttatatgaagaaaaatacaggaaaggaaaaaagagaaagatccatgaaacatttaagaggtaaaaaccgcaagacaaagtaaccacaaagctgcctatgaattttcagaatgctccatcttgacttcagtgctaaagtaaagaatcttcctgaacactctaagcacagtttctagagaaagtccatct

SEQ ID NO: 195822 - DNA, 601 bp, Human
tcacagcaaatgtcactacattatttatgtagttgtttcctcatttggtatctgtttcccaattccactgtaagtttcatgagggaaagggctttgtctggtataccgctatccccattatgtgctagacataaagacggcaacaacagacactggggactaccagagtgggagggacggaggatggcaagaggggaaaactaactcttgggtaccatgctcagtatctgggcgtacatatgcttaagcaaattgacttggatgaatgaatgaaagagaggcaagaaagagaagcatgagygtagaacaatactatgcttcagttcattgtcttcggaccacaacaccaaattcccaagagcaacagggatcccttgaggaggacaaggggatgatatggtccaggacagctgtgtagaggactgatttggggtgggaaacaagggaagcatgggacaaaacagcaggcaagaaagagaaactgaacaaaggcgcgggaatagctatatccactcattcatcccacaactacttaaactacacgtgattacatgaaagtgacacagctatagtagttatcacagccatgggtatagtagtt

SEQ ID NO: 195823 - DNA, 601 bp, Human
gggtactatgttcagaatccattgtaccctaaacctcagtatcacacaatatacccaggcaacaaacctgcacatgtaccccctgagtctaaaataaaactggaataaataaaataaatattaaaaataaaaatcaaaagaagataaaattaattgttttaatttgaaaagaaaaagaaagctattcaacaaaacagccttgaaaagaacatcccaacctttaaaaaaatgtgatcgaattcctgctatcttttggttcccctaaagaaaatactagccgaagcactgatgtgagcattgyataattttactgttattagacacctgctgtatgccagaccctgctaggcataagaggaaaaaaaatgaatgagaaactgcccaggccttcaggagctcacagctgagatggggtttcagaaatgaagtaagtgtaaagcccagtgtgcctgacgggctcactcaccagatatggggagataccagcgaaggccctcactcactgtagtcccgcagtcaaggagggctttcagccttcttcttaaaggataactgggggcgactcaggcagaagggaagggaaaaggtgcttctggcaaag

SEQ ID NO: 195824 - DNA, 601 bp, Human
gcaagtatgtttccactgcctaaagtcaacagggatcaaattatgggttttcccacttttttctcataatttgtagtgttttccaaatgttctataagcatatatactttagatattagaaaaaaaatttattgagaaagccaaataccacatgttctcacttataagtgggagctgagcattgggtacacatggacataaagatggcaacaacagacaatggggactcctagagcttgtggggaaggaggagggaaggaggaggctaaactaactattgggtactatgttcagaatccaytgtaccctaaacctcagtatcacacaatatacccaggcaacaaacctgcacatgtaccccctgagtctaaaataaaactggaataaataaaataaatattaaaaataaaaatcaaaagaagataaaattaattgttttaatttgaaaagaaaaagaaagctattcaacaaaacagccttgaaaagaacatcccaacctttaaaaaaatgtgatcgaattcctgctatcttttggttcccctaaagaaaatactagccgaagcactgatgtgagcattgcataattttactgttattagac

SEQ ID NO: 195825 - DNA, 601 bp, Human
tactggtctttgggggcctcaactccactgtggattcccttaacacttcccacacttccacaaacactccatgcagtaaagcctcttgaaccatctgtgctgaactctgcttcctgcctgccgagctctggctgatagagtcccagaccatctctggccctggggatcatcactgttccagtgtacccatcctgaacccaagggggctgcagacaaccattttgtagttttaaaacacacatgcaaatatacatagtcacggaataaaaaacgatgtctggaaataggttactgagggttyacacgtgccattttaaagcacatcaagcagtgtgcatttaaatatacattacactgagttaaaattctaaagtcctaattgcaaaacaagcctgcacccaaggaaggacaacagatatttattcagattaaatattgtcctcctgagctttcattacacttcatggggccttgagtattgccaaaatttgatttctgtaaaataaaactccaaaactcaaattgatacacattggagcctggtggttttcacagcaaagccctctgggcagggctggaatcacatgcttggagtctcatc

SEQ ID NO: 195826 - DNA, 601 bp, Human
gaagggaagagctttggagaaggttcatgaccttgaccctgttctgccaagtagaagctaaagttttctcatctcctcctcttctctttctctatcgctctttcatgatgcaagtgacaactaattaaataaaactatctgtgaaatacatgtgcattgagacctcccagagacaaagatgcaaccttctgccagccccaaatccaatctctgctgttccctgtgcccaggggaacggacccaatggactgcattacccaggttcccttgatcttaacttcctgtaagccagtgggagagrcaccagcaggagaggaaaggtcaggccctgctccatcctgctttgaactatttctggcagtccctaggtcaattcatacctgtctggagacctctcctttatgacttctgatctcactgggaccagttgtaccattttctctccttgcctcttccggccttgcagtggttatagcttcatgctattgttactggtctttgggggcctcaactccactgtggattcccttaacacttcccacacttccacaaacactccatgcagtaaagcctcttgaaccatctgtgctgaactctgctt

SEQ ID NO: 195827 - DNA, 601 bp, Human
tttcaggacatttagtcctctgacttcaagagaaaaaaaaatattggtggggaaaaatagcttgaggaatattgatctggcaaagatttgagtcctagcatccaagatggtcctcttctccaggagttgctgcctgctggctctccctccagattgagtcaccttgtcccagaattactttttcatgaacctgatatcctcagtatccaacccagagtataataattataccaaaatccagtggaagtctgctaaagcctgtgagtcatcccatgagactcggataaacaccagattttcyttctccagtggccccattcacaaacagagcactgtctcatgtcattattgcacagaataatgcaatgaatctccaacctctttagatcatgtaaattagtcctcatgttccttagctaggcaaagggatcctccatatactaccagccagatgtttgagagaaagcttacatctgccacactggtagtaatctatcctgcatcagagctgctgtaaacatacgtgaccacaaaagccagagagggttctacatttgggaaattcgccacagaacgggtctgttcctgattgctttataca

SEQ ID NO: 195828 - DNA, 601 bp, Human
ttttaacagtgcattagccatcacgtcatcaaagcctctgaggctggcatgagccttcctgccaattctgggaaacacttctgggaaagtaaacaagaatagataagagagaatattcacagcctctgtcccatttgaatggccttcagactttaaaaggttgagaatgacatacagtaattacatgtctcatacatgagtaggtttatcctaagtgggacagaggcaactgggaattagaaaactagggagaaaggacagaggcaactgcgaattagaaaactagggaaaaaagaaaatktagtccctagatgggaacagaggtaagtgagaagggccctaaaaggcagtgcagtaagcacccgccaaggctgctttccaatcacacatctacctgaaaaggtatcatgttgcagaatgctgctctcttctctccttcctaaccctttcaatttcaggacatttagtcctctgacttcaagagaaaaaaaaatattggtggggaaaaatagcttgaggaatattgatctggcaaagatttgagtcctagcatccaagatggtcctcttctccaggagttgctgcctgctggctctccctc

SEQ ID NO: 195829 - DNA, 601 bp, Human
ggtggcaactcagattcaccagaaaggacccatcttactcaggaagaggcacagccattcctcagaaacatgaaggatttctgagaaggcagggaagattgcctttgtaaaggccaaattggaaggaatgcacacacagcagatccatctctcctgtggggtaaatgaccagatcatctgctgagcagcactggggtgaggtcacgggaaaggtccccaggagaggggagtgattcagatgtggaactggaaaagatgagaaccagaaacacatgacatgaattttacatgaaactctagrccccactgaggcaaagaccatgatgtgcagttgcctacatgtaagcagttttgtgatttttctccagcagcctcaatggaggtgggaagactgatctgctatatagaaaagatcttaagacaccaaagacagtgaaacctagaactgagatgactaaaaacatcttttgccttgctctatgtcacgagtatttgacagtgagctgataatttaaatgacctctttcattaaccactcctttggcagtgttgaaaacaccaattaaacctgaacagtgtggcactattgatattacaggag

SEQ ID NO: 195830 - DNA, 601 bp, Human
aggagcaaattcatagaaaccaaaggagacagtttcaattgctacagagaactcaagcaagttaaaaaccaaaagccctgaaagtgtccactggatttaggaaccagaaggttcctgggatccttcccaagggctattagtggaatggcagtcagaaaacagatcacagtagattgagcaaataggaggagaggaatcagaagagcaagtaggtactctttccagaacttgggggcatgaagaatcaaaggagcaatacttgaccctgtttctaggccagagggaactgatcaaagaggargcaagagctataagggggtcacacagtaagaaaagtttcaaagggggtggcaactcagattcaccagaaaggacccatcttactcaggaagaggcacagccattcctcagaaacatgaaggatttctgagaaggcagggaagattgcctttgtaaaggccaaattggaaggaatgcacacacagcagatccatctctcctgtggggtaaatgaccagatcatctgctgagcagcactggggtgaggtcacgggaaaggtccccaggagaggggagtgattcagatgtggaactggaaaag

SEQ ID NO: 195831 - DNA, 601 bp, Human
aaacctaagtatcaaagtagttacccaataagtcagagttcatgcagatttcttcaagaggtcaattttcttcggagcaaaagtaattattctaaacgaaaaatgattttgtattctattctaaaaatagttgttcataaaatgtgctagtatttcttccttttcactgtcattaataaagatatatgttttaaataaaattgtaaacagattcacacatgtattaccaattatacaatatcactcaatttcatttcacaaaccaatactacatgtaagtaatatgaaatatgctattttycattgtaaatgtattatttttcagaagctgcaggaatctagtatcataaatattaaaaggacacataatcactgtattaactaatactctcctgtcacttatagcagggtttctttgaaaggtggagcagaatacactgcatttttggaagaatagggcattataactagggaagaattgataaacataagaaacatgaaattatgtatatatgtaaaaagactataactatgttaaaaagttaatagtggctatttctgggtgataagattaagagtgatcattattttcttctttata

SEQ ID NO: 195832 - DNA, 601 bp, Human
ttttaactagacattttcatagctcgtatattttccccaagatacatttataatgttatattaataaataaacctaagtatcaaagtagttacccaataagtcagagttcatgcagatttcttcaagaggtcaattttcttcggagcaaaagtaattattctaaacgaaaaatgattttgtattctattctaaaaatagttgttcataaaatgtgctagtatttcttccttttcactgtcattaataaagatatatgttttaaataaaattgtaaacagattcacacatgtattaccaatyatacaatatcactcaatttcatttcacaaaccaatactacatgtaagtaatatgaaatatgctattttccattgtaaatgtattatttttcagaagctgcaggaatctagtatcataaatattaaaaggacacataatcactgtattaactaatactctcctgtcacttatagcagggtttctttgaaaggtggagcagaatacactgcatttttggaagaatagggcattataactagggaagaattgataaacataagaaacatgaaattatgtatatatgtaaaaagactataacta

SEQ ID NO: 195833 - DNA, 601 bp, Human
aagaaatcatgggatactcaaggccccatgctaaacacgggtcacccagaaatactaaaaaacaaggccccaacacttgatcctaaaaaatgtatattttagcggaatagacaaggcaggtccacaaataacaaatcaaggataagttaaagacacagcatagagtctctttgggacacaggacataagtaacaaattgtacttgctgcctttaaaaagtagggcagaaggaagataactaatatactttaggaatacaagaactcattttcctgcataacaaaataaacaatacacatcycttttttaactagacattttcatagctcgtatattttccccaagatacatttataatgttatattaataaataaacctaagtatcaaagtagttacccaataagtcagagttcatgcagatttcttcaagaggtcaattttcttcggagcaaaagtaattattctaaacgaaaaatgattttgtattctattctaaaaatagttgttcataaaatgtgctagtatttcttccttttcactgtcattaataaagatatatgttttaaataaaattgtaaacagattcacacatgtattacc

SEQ ID NO: 195834 - DNA, 601 bp, Human
tgttttgttctctagctcccctctcccttttctcatgttcagatataacacgtttgctatcccattcatggtaaactgactacctatcgcacatgccaacacttagtcttgggatgaaactggagacattcaggaatgcgttttggcaaaactgatctacctggctccatacctgctgaaatgtataatccctcttggtaatgaaaagaaatagaatgtcttggtgagagaaagagcaggaaccctgatacacaaatggaagaaagaaacctccaaggtcaggagcaaagggagcaaaatraaacctgtgatgatttcccattattggtgtcatctctgaggctataattccctctgtggacactggtaactccactgacagcaggaaaagaaatccatgtccttatattgttccccacataatctgactttataatgcgcaaaccccatttcccaagcccttctcagcctgccttcttcctaccccacctctaagacgatctctagatttgaggcttctaacctcagacggccccactcctatcttcccctccccagcccttacgtgtgttacctaaagagagatattctagccaattat

SEQ ID NO: 195835 - DNA, 601 bp, Human
tccgttactgttttgttctctagctcccctctcccttttctcatgttcagatataacacgtttgctatcccattcatggtaaactgactacctatcgcacatgccaacacttagtcttgggatgaaactggagacattcaggaatgcgttttggcaaaactgatctacctggctccatacctgctgaaatgtataatccctcttggtaatgaaaagaaatagaatgtcttggtgagagaaagagcaggaaccctgatacacaaatggaagaaagaaacctccaaggtcaggagcaaagggrgcaaaataaaacctgtgatgatttcccattattggtgtcatctctgaggctataattccctctgtggacactggtaactccactgacagcaggaaaagaaatccatgtccttatattgttccccacataatctgactttataatgcgcaaaccccatttcccaagcccttctcagcctgccttcttcctaccccacctctaagacgatctctagatttgaggcttctaacctcagacggccccactcctatcttcccctccccagcccttacgtgtgttacctaaagagagatattctag

SEQ ID NO: 195836 - DNA, 601 bp, Human
ctggcatgactgcattactaaacctgatgcttccaaagttaaccttctagggtgctaacaacattaaagtgccataaaagtgatagagaaaaactccaagagcaaagaattaattagctccatggggacatgccagacaggaaaacaaggtttcgaagggtacagtgtgaatccttaggtagggaaaactgtaaacatgaatcacttcttcaatctaaatccaatattttagagcagacatttgggattgcctgcaaagtcacagggcactgatggacaagtttgtgtatgggaagttccygcaatccaagacaatgatctatttgagagctacccacacgcaggagatgtgtgaaaaatcaccaaatgagaacagaagttgatgtgaagaccctcttctcctagaggagactaggagactacttattctgtgggcccaagtccaacatttctctaggaattctcttttctacctttattaagccaaagctctctgtaatatttgttcatttggccatgatcaatttttctctccgttactgttttgttctctagctcccctctcccttttctcatgttcagatataacacgtttgctatc

SEQ ID NO: 195837 - DNA, 601 bp, Human
caaacaggggtaaggcactctccttcctcactccactataatgattataaactttctttttctaattaaaaaagatcaaaatgaggataggaaaatgctagatattttagatgcaaaaatattttcaaagtgaaccaaatggggtcaagagactccctgagaaataacattccctatattaacagtctatttgccttactcttatgaaatagaattacttgttcaaatttccccaagttttgaagtttcacacgttttaaaatctgctaatatttcttgggagaactaaggtggtagtctkcatgggtgctaatatactatgccccataacatttgaagatgagtattgtatatagtgaccaaaatagatagcaggacagcagtttaaagtcaccacatgctgctgctgctagtggcacaaatcattctgccaatgtagttgatgatttaatcaaattgcacttttctctagtaccttcaacaaaaaacaatcctcacctggggcagtcaagaaagctgggaaaaaaaaaaaaacaatgaaaattcactgtaatcggaaaatgcaaagtgcttcctggcatgactgcattactaaacctga

SEQ ID NO: 195838 - DNA, 601 bp, Human
ttccttctttctctctttcgaaatgaggtctcactgtgttgcccagactgcagtgcagtggctgtttacaggcacgatcccagcactgatcagcataggagttttgacctgctccattttcaacctgggcaggttcacccctacttaggcaacctcgtggttccccgctactgggaggtcaccatattgatgctgaaattagtgcaggaacccaattagcatagcacacaacagcccaggactcctgggctcaagtgatcctccagcgtcaccctgctgagtagctggaactacaggcacrcaccatggcaccaggctctccttgttttaattaagtagtttatgaaacatgaaccacaaaagctacagcaattgggagtccaatggacaaaacaaagtatgtacagaccctttatcgatgctctcagtctcacacaaaccatgttgaaggaaaagaagtttgagatcaaaaggaaaacttagagttggaataaaataaagaaaagccccaagccagagttcaaacacagacctttctgccacttttgtttccaacatgaacaagcaaggaatatatcaataactataaggatcttatgat

SEQ ID NO: 195839 - DNA, 601 bp, Human
gttccatcactacactcaaaaatcatgcctgttaaatatcagatcatcttagttgatttgatctatgcagatcacagataatccagaacatgaccaccaaatctttatccatatttatatccatatttatagacactaaagatagacatcaaacataggattagaagtttcaaggacaaaccagaggaagcacttgtaaaaacttgcatgagtagatacaatgcattagtcctcaatgtgttgtccctggatcagcatcactggcatcacttgggaacttgtcagaaatgcagattctcakgcctcacctcagacatcacctgcattgaaggcattggtacagcacaggctgctgggtgcgacctgctgtaccatcaccttccaggtaacttcaaggcagctaatgtttgaaaaacactgctctggagggcacaaaacttgccagcttaggttcttattcagaatccagaaggtctagtaacctgacaggatgctgtgtagggcaactgaggctctccatactgccatttagaattggatcattatttaaaacagatctgatgggatcacatttaatcaaggcagtggctatctcacaaga

SEQ ID NO: 195840 - DNA, 601 bp, Human
cacctatgtggtaggccttaatattgaaaagaatttttcctcctactttgtctttgtcattgttttaattatgatagggtctgtgcatttccacgtaaattttagaataagtttatctatggtcataaaaaacatgctgtagaaattgcaggaaattgcattaaacctattggttaatttggtgacaaccaacatgtttactgtgttgaggcttcaaatccatgaatatagtacatctttccaagtatttagttctttttgatttcagtattttataattttaagcatatagatcctgtaygtgttttgttaaatttacacatatatatttctttttctttggagtgattataaaagttgtgtttttaatttttatttccacatgttcattgtgagtatatagaaatgtgattgatatttatgtgttgatcttatatcttgtgacctcactgaactcatttatctgttagagtagtattttcgttgacgtcttgggattttctatgtacataattatgtcatctgcagacgaaatgagtgtaatttctttatgagctatacgccttttgtttcctttcattttccttattgtactggctag

SEQ ID NO: 195841 - DNA, 601 bp, Human
tgagagatggatggtgatttcttgtgtggttttaatttgcatttctccgatggctaaataggtattaaaaatcttttcatattcttctttgccatccacatatctactgcaataaaatatatattcatggtttcttttctttttttttttttctgagatagagtctcactccgtcacccaggctggactgcagtggcatcatctcagctcactgcaacctccgcctccagggttcaagcaattctctcacctcagcctcgcaagtagctgggactgcaagcacccactaccatgcccggctttttttttttttttttttttttcagtagagacggagttttgccatgttaaccaggttggtttcgaactcctgacctcaagtgatccacctacttcggcctcccaaagttctaggattacaggcgtgagccactgcacccggcctctattcatggattttgcccattttctaatggaactgtttaacttatttttactacggagttttaagtttcttttacgtattctggatactagtcctttcttggatatgtagtttgcaaatattttctcccagtccatagcttgtcttttcattctc

SEQ ID NO: 195842 - DNA, 601 bp, Human
gcccagccaggcgtggtggctcacgcctgtaatccagcattttgggaggctgagacaggcagatcacaaggttaggagttcgagaccagcctggccaacatagtgaaacccccatctttactaaaaatacaaaaattagccgggcgtagtggtgggcgcctgtaatcccagctactcgggaggctgaggcaggagaatcgcttgaaaccagaaggcagaggttgcagtgagtggcgatcgcacctctgcactccagcctgggcaacaagagtgaaactctgtctaaaaaaaaaaaaaaagrgggtgggggagagcccaaataaagcaggagacactgaactgcagttggaagggtcacggtttcagatagatagataatatagatgtctgtgtgtataaatacttgtatatacacgtgttgtgtgtgtgtatacacacatatatatcctgtccacttagaaggcctagaagtatgataccctagaaacaaagaatatacctagaacccagatcttggtttctaaatcccagtctccaccaaaagaaaccaggatttcttggaaaaataactgattccaagctattttggcaagggaaagca

SEQ ID NO: 195843 - DNA, 601 bp, Human
aaatttaattaccattgcaacagtgttgagaggcaggatctttaagagatgattaggtcatgcgggtttcacgctcataaatggattaatgccattatcatggcagcgagctagttatcatgggagtgggcttctgataaaaaggataagttcaacccaatttcctctgtgtcacgttaacttgcttctactttccacccatctgccatgggatggtcttcatcagatggcagagccaatgctggcaccacatccttggacttcccagcctccagaactgtgagaaatgaatttcctttcyttataaattacccactctgtggtattctgctacagcagcaaaaaacagactaagacagcatctctaggtaaactttatttccagcgatgcagacatgcaccaattcacttatagaatactgcgcaattattgagtttaaagattaatggaaatccagtatgaattcaggcaacaaaactcataattacaaaagaagtttctcataccaattaattgatatcaattaaatatattaaggctctctggtaaaaatattatcccatatagtcttactccaaaacccagtatattaaaaatatt

SEQ ID NO: 195844 - DNA, 601 bp, Human
gaggtgattggatcatgggggtggacttcccccttgccattcttgccattctcataatagtgagtgagttctcatgagatctggctgtttaaaagtataaagcacttctcccttcactctcttcctcctgcttcagccatgtaagatgtacctccttcctcttcaccttctgccataattgtaagtttcctgagtgccccccatccatgcttcctgttcagcctgaggaatcatgagccaattaaacctcatttctttatgattacccagtctcaggtagttctttatagcagtgtgagastggactaatacagtgatgcacaaggatctctggtggaagaaatatctaagcagcaaagcattcaggttgctgtgtggttactttcaactacatatagtggaatgctagagaaaagaaattacttaaatatgcaatttataattcaaaggaaacagaacaaaaagatttgaaaattcacagcctgactatgtaaagaataaaaagcatgtcagagagacaatgctaagggtatagccacgtgatcatttgttaaagagattaatatgaacaaaaagaagccaagtgctattcatcaagaca

SEQ ID NO: 195845 - DNA, 601 bp, Human
gcagcctcgggacactgctccatgcatcccagccactccagctccagtcatggttaaaagggccccagagaagtctcagaccactgctccagaggatgtaagctataaggcttgatgacttccatacagtgttatgcctgtaggtatgcagagggcaagagctgaggcatgggagcctctgcctagatttcagaggatgtatggaaacacctggtccaggcagaattttgctataggagcaaagctctcatggagaacctctactagggcagtgccaagaagaaatatgggattggactcyttacacagatgccccactggggaactgcctagtggagctgtgagaagagggccacagtcctccagaccccacaatggcagatccactgacagcttgtaccctgcacctgcaaaagctgcaggcactcaacaccagccgatgaaagcagtctcaggaactgtgccctgcagagccacagaggcagagctgcccaaggccttgggagcccaccccttgtgtcagtgtcgcctgaatatgagacatggggtcaagggagattattttggacccttcagatttaatgactgccttgctgggttt

SEQ ID NO: 195846 - DNA, 601 bp, Human
gcagaaatttgcataagtaaaaaggagccaagacaatggggaaaatgccttgaaggcattttttttcagagaccttcttggcagcgccttccatcacaggccctgaggcctagaaggaaagaatggttctgtgggctggcccagggccctactgccctgagcagcctcgggacactgctccatgcatcccagccactccagctccagtcatggttaaaagggccccagagaagtctcagaccactgctccagaggatgtaagctataaggcttgatgacttccatacagtgttatgcctgyaggtatgcagagggcaagagctgaggcatgggagcctctgcctagatttcagaggatgtatggaaacacctggtccaggcagaattttgctataggagcaaagctctcatggagaacctctactagggcagtgccaagaagaaatatgggattggactccttacacagatgccccactggggaactgcctagtggagctgtgagaagagggccacagtcctccagaccccacaatggcagatccactgacagcttgtaccctgcacctgcaaaagctgcaggcactcaacaccagccgat

SEQ ID NO: 195847 - DNA, 601 bp, Human
aaaatttggaaaatatttacacaataagatggttttcaacattaaagaactcctgcagaaatttacagctacaactaagagtatatgctatggtttcaatgtccctgccaaaactcatgttgaaatttaattgccgttgtaacagtgttgagaggtaggatttttatgaggtgattaggccatgatggcttcaccttcatgaatggattaatgccattatcatgtgagtggcctagttatcatgggagtgggctcctggtattaaagatgagtttggcctgacttcttttccgttttgtgyacttgctttcaccttctgtccttctgccaatgtctgagcagatgctgatgccacgcccttggtcttcatagcctccagactgtgagaaataaatttttctttataaattacctggtcagtggtattctattgtagcagcagactgagacggaaaatttataccagaaagtggggctgttgctataacaaatacctgaaaatgcagaagaagctttagaattgggtaatggatagaggatggaagagtttggagcaggctaaaaagagcatttatggctgtgaacagagcattaagggtga

SEQ ID NO: 195848 - DNA, 601 bp, Human
ggaatagctagatcaattcctggcatgcagaacacactcagtaaatccatagcaaattcatgcctcaatagttacctgctattgttttaaatgggcctccacatgatatcatctatcaaataacctaaaaacttccttaaaagttaatactaagatgaaacactttaaaatttggaaaatatttacacaataagatggttttcaacattaaagaactcctgcagaaatttacagctacaactaagagtatatgctatggtttcaatgtccctgccaaaactcatgttgaaatttaattgcygttgtaacagtgttgagaggtaggatttttatgaggtgattaggccatgatggcttcaccttcatgaatggattaatgccattatcatgtgagtggcctagttatcatgggagtgggctcctggtattaaagatgagtttggcctgacttcttttccgttttgtgtacttgctttcaccttctgtccttctgccaatgtctgagcagatgctgatgccacgcccttggtcttcatagcctccagactgtgagaaataaatttttctttataaattacctggtcagtggtattctattgta

SEQ ID NO: 195849 - DNA, 601 bp, Human
ctccctgggcttggatgagagatatgcctcattctctgcatcccattaccagaatggtacagtcaacctgggaatcattgagacagatgcatccaaactaaataatgagtttaattcacaaggggaagtggaaaatatatggaattagtctctaaataaatgctgaggaatgggactctaaaccctccctagttggcatggttaattaatattgtagggtaaaatgcaactaaagcgggtaacagaataggacagataaaaggaaaccatcagagaaataacatgaagagcttcctctagragtgatttcttaaactggggacaggcttcataggaaatggcacagtaatgcctgtgacatctgcaatttgactgggtcaatttttagttccgcttaaattaaggcttttcatttagataggccagaactgaagagatgctcttactgatgaaataaaataaataagaataaagaggttaacagataaacaagttaaacaaatgtaacaagtttttgttttcttcctcctgtctggcaccatggacagcaacaccctacaattcccatgaagtaggcagacttacttgccagtgaggaaag

SEQ ID NO: 195850 - DNA, 601 bp, Human
cagagtggttaagtctacgggctctgagatcacacttcctggccttcaaatctgagctctgccacttctaaccatgcaacttggggcaagttacttaatctctctaggcctccgattcctcatctattaaatgaggatgataacagtacccaccacctagagctatcatgaaggttgagggagacgagttacataaagtatctgctgagtgcctggcacatatcatgcactcaggaaatgctggataacactattatcactcaactaacactttgtaaatgataaattatgcaaagggtakgtgtttcataaatgcttgattgaccgaagttctgctacatgtcatactgcaaacgaatatcttcatgaggaagatgcatgatgaaaaaccctcccaaaacaagctacttgggaatttataatgcttccttgttttttcatttgtacttttaagtatcaaagacacagttatatttttcagaaagttattttatagctttgaatattgcagtagtagaggctcccagagtatacaagaacaatttatgcagatgtaaaagaaccaactaacaatggatatgagaaaaatcaacggaatatg

SEQ ID NO: 195851 - DNA, 601 bp, Human
agtcccataattccatggagtttattccatgtgattcatatcacagagtggttaagtctacgggctctgagatcacacttcctggccttcaaatctgagctctgccacttctaaccatgcaacttggggcaagttacttaatctctctaggcctccgattcctcatctattaaatgaggatgataacagtacccaccacctagagctatcatgaaggttgagggagacgagttacataaagtatctgctgagtgcctggcacatatcatgcactcaggaaatgctggataacactattatyactcaactaacactttgtaaatgataaattatgcaaagggtatgtgtttcataaatgcttgattgaccgaagttctgctacatgtcatactgcaaacgaatatcttcatgaggaagatgcatgatgaaaaaccctcccaaaacaagctacttgggaatttataatgcttccttgttttttcatttgtacttttaagtatcaaagacacagttatatttttcagaaagttattttatagctttgaatattgcagtagtagaggctcccagagtatacaagaacaatttatgcagatgtaaa

SEQ ID NO: 195852 - DNA, 601 bp, Human
gggtatagatgctagctctatctataacattctatcgtgaccaaatcagacagcacgtacaaggactagaaaaacaactgctgtgtcaaggcacagagagcactgatggtagagaaggaagggccttagctatcgttactccaggcctaatcaacagccagaatgtttctgaaactgccatttatgatgtctgtattagtttgcttgggctgccacaacacaaaaccacagaccaagtggctttctcacagttctggaggctgaaagtccaagatcaaggtgttggtaggtgcagtttccycccgtggcctctctccttggcttgcagatgaccaccttcttgctgtgtcctcgtgtggctttttgtctgtgtgcgtgcgtccctgttgcctctccctcttcttatgaggacaccagtcctgctggattaaggctcacatatatgacctcacttaaccttaatcacctccttaatggccctatgtcccaaaacagtcacattctgaggtactggggattaggaattcagctaatgactctgaggagaacacaattcagtccatgatgtaacaatgaaagtttttgatctggcaaaataatc

SEQ ID NO: 195853 - DNA, 601 bp, Human
atttaaaatcttttcagcctttaccttaatagctagagcacagtatttaatatactggtaggggagaagcacggagagctgacccaaaaatcaagggcgactttaaaggagccccacttccagtagcaactcctcctgtgacttgctgttcggtgtctcctgctgtgggtatagatgctagctctatctataacattctatcgtgaccaaatcagacagcacgtacaaggactagaaaaacaactgctgtgtcaaggcacagagagcactgatggtagagaaggaagggccttagctatcrttactccaggcctaatcaacagccagaatgtttctgaaactgccatttatgatgtctgtattagtttgcttgggctgccacaacacaaaaccacagaccaagtggctttctcacagttctggaggctgaaagtccaagatcaaggtgttggtaggtgcagtttccccccgtggcctctctccttggcttgcagatgaccaccttcttgctgtgtcctcgtgtggctttttgtctgtgtgcgtgcgtccctgttgcctctccctcttcttatgaggacaccagtcctgctggattaaggct

SEQ ID NO: 195854 - DNA, 601 bp, Human
aggagacttgacttataaggtgcatcatgggcattatttaaaatcttttcagcctttaccttaatagctagagcacagtatttaatatactggtaggggagaagcacggagagctgacccaaaaatcaagggcgactttaaaggagccccacttccagtagcaactcctcctgtgacttgctgttcggtgtctcctgctgtgggtatagatgctagctctatctataacattctatcgtgaccaaatcagacagcacgtacaaggactagaaaaacaactgctgtgtcaaggcacagagatcactgatggtagagaaggaagggccttagctatcgttactccaggcctaatcaacagccagaatgtttctgaaactgccatttatgatgtctgtattagtttgcttgggctgccacaacacaaaaccacagaccaagtggctttctcacagttctggaggctgaaagtccaagatcaaggtgttggtaggtgcagtttccccccgtggcctctctccttggcttgcagatgaccaccttcttgctgtgtcctcgtgtggctttttgtctgtgtgcgtgcgtccctgttgcctctccctct

SEQ ID NO: 195855 - DNA, 601 bp, Human
gaggagacttgacttataaggtgcatcatgggcattatttaaaatcttttcagcctttaccttaatagctagagcacagtatttaatatactggtaggggagaagcacggagagctgacccaaaaatcaagggcgactttaaaggagccccacttccagtagcaactcctcctgtgacttgctgttcggtgtctcctgctgtgggtatagatgctagctctatctataacattctatcgtgaccaaatcagacagcacgtacaaggactagaaaaacaactgctgtgtcaaggcacagagrgcactgatggtagagaaggaagggccttagctatcgttactccaggcctaatcaacagccagaatgtttctgaaactgccatttatgatgtctgtattagtttgcttgggctgccacaacacaaaaccacagaccaagtggctttctcacagttctggaggctgaaagtccaagatcaaggtgttggtaggtgcagtttccccccgtggcctctctccttggcttgcagatgaccaccttcttgctgtgtcctcgtgtggctttttgtctgtgtgcgtgcgtccctgttgcctctccctc

SEQ ID NO: 195856 - DNA, 601 bp, Human
agatgactaataacataatatttgaatccacttatgatcaaagacattaggccactgagcactacaggcactcctggcttactaagaaatagagctctccctatgaaaagttcaggtgctgttaaatgggaagatgtaaaagcgcccagggtctctgaaatttacatttctgtttccttgctttgagctctgtgcactattggagctgtctgtcattaagaacccagcactgacttcataaaacaattcctcttcttttatttctttttttcacagatattaatgcagaagatacaagatraagatgaaataagactggatatttgcagtcatattcctgggatgatgaggcagggagtgcatggaaggaagagaaatgtcaaagagaacatctcagtttccacagttttatccaagattcgtggcccaatttccaactatccctgtcaccaattccaggaatatctacgatctgaagactgatgatcacatactttctagcttcaacaaaacaaagttagaaatctagctaataatcatatgtacaatctctccatttatttcccttaagccaactaacttttttgagtttatacagatc

SEQ ID NO: 195857 - DNA, 601 bp, Human
agatgagatttaatgaggccataatcagcaccttgattaacagatgactaataacataatatttgaatccacttatgatcaaagacattaggccactgagcactacaggcactcctggcttactaagaaatagagctctccctatgaaaagttcaggtgctgttaaatgggaagatgtaaaagcgcccagggtctctgaaatttacatttctgtttccttgctttgagctctgtgcactattggagctgtctgtcattaagaacccagcactgacttcataaaacaattcctcttcttttrtttctttttttcacagatattaatgcagaagatacaagataaagatgaaataagactggatatttgcagtcatattcctgggatgatgaggcagggagtgcatggaaggaagagaaatgtcaaagagaacatctcagtttccacagttttatccaagattcgtggcccaatttccaactatccctgtcaccaattccaggaatatctacgatctgaagactgatgatcacatactttctagcttcaacaaaacaaagttagaaatctagctaataatcatatgtacaatctctccattta

SEQ ID NO: 195858 - DNA, 601 bp, Human
gcctttgatgacatttttctcttgaaaatggctgaagtaacatatcaaaattaaaactggctcaatttctcagagttcagacaggttaactcaatcttgaaagcaatgataataaacttgctgatcatttttgaagcttagaagaaaattagattatcaaggagatgagatttaatgaggccataatcagcaccttgattaacagatgactaataacataatatttgaatccacttatgatcaaagacattaggccactgagcactacaggcactcctggcttactaagaaatagagctckccctatgaaaagttcaggtgctgttaaatgggaagatgtaaaagcgcccagggtctctgaaatttacatttctgtttccttgctttgagctctgtgcactattggagctgtctgtcattaagaacccagcactgacttcataaaacaattcctcttcttttatttctttttttcacagatattaatgcagaagatacaagataaagatgaaataagactggatatttgcagtcatattcctgggatgatgaggcagggagtgcatggaaggaagagaaatgtcaaagagaacatctcagt

SEQ ID NO: 195859 - DNA, 601 bp, Human
catagttgaggcattaatttaatttagttgtggacaaaattcatagaatgaattaatgatttctaaggaactaaacttagggcagcagcaaccactgcacaatttaggggcaccattcccatgtactacctactaccatgtgcatgacaccccggggcaggggtgtgcatcactatggccccaaatgcacaagaaaaaacaaaccctgtggattttattattaaggttaagcaggtctggaaaatatctcaaagcaataggagtttaatacctgttaaataggcaatggcctgttgaattrgcttgttaatatatggtcagtgtagcactaacttatgtttataagtaacttttgttataaaaagaaaaagaaagacaagaggaagaaaatatcacacacggtatggaaaaatttttcattaagttgcctctccaactcagaaactgtaagctgacattttgaaaagggctcaggtggaaagccagcagtactaacatctgcatgaaaggtggatcttaggagacataacttcataaagttgcaattttacaaaggtgagtcctgtcatctcatctgtgatcataagcctatagacattcc

SEQ ID NO: 195860 - DNA, 601 bp, Human
ccaggattgctcagaatatccagaaatagcaaaaaagtagcagggaagggcattcttttctcaaatgttcaaggaacaaagttatgtgaaattaaccccacaattaactaattgccttttccttcagtagaaataaagtgaaataattcaggctccaatccatatactggattcatcttgtcgaagggaaacactgcagagtttttttttaaatgaaataagaaatctagaagagattttttatataagagtggaacaaagttcaaaattgtacaataattgcttaataaatgagttcaawttaagcagataaactaaaggctgatttaaatgactttcttcttttccaattattaaaattcttaattttccccatgagtatttcggtttcatgaatcactcagtaatagccacactgaatttcatctaaaattctaccttaatcaaaaaggtaaaaagctctggagaaaaatcctccacctacaatatgccataaagtagtttctcctgtacaaaacttattgcacaataaaatttccttaagattgttattctgcaggaatagcagatgtttgaaattaaacaaattcttataacattg

SEQ ID NO: 195861 - DNA, 601 bp, Human; identical to SEQ ID NO: 22713

SEQ ID NO: 195862 - DNA, 601 bp, Human; identical to SEQ ID NO: 22714

SEQ ID NO: 195863 - DNA, 601 bp, Human; identical to SEQ ID NO: 22715

SEQ ID NO: 195864 - DNA, 601 bp, Human; identical to SEQ ID NO: 22716

SEQ ID NO: 195865 - DNA, 601 bp, Human; identical to SEQ ID NO: 22717

SEQ ID NO: 195866 - DNA, 601 bp, Human; identical to SEQ ID NO: 22718

SEQ ID NO: 195867 - DNA, 601 bp, Human; identical to SEQ ID NO: 22719

SEQ ID NO: 195868 - DNA, 601 bp, Human; identical to SEQ ID NO: 22720

SEQ ID NO: 195869 - DNA, 601 bp, Human; identical to SEQ ID NO: 22721

SEQ ID NO: 195870 - DNA, 601 bp, Human; identical to SEQ ID NO: 22722

SEQ ID NO: 195871 - DNA, 601 bp, Human; identical to SEQ ID NO: 22723

SEQ ID NO: 195872 - DNA, 601 bp, Human; identical to SEQ ID NO: 22724

SEQ ID NO: 195873 - DNA, 601 bp, Human; identical to SEQ ID NO: 22725

SEQ ID NO: 195874 - DNA, 601 bp, Human; identical to SEQ ID NO: 22726

SEQ ID NO: 195875 - DNA, 601 bp, Human; identical to SEQ ID NO: 22727

SEQ ID NO: 195876 - DNA, 601 bp, Human; identical to SEQ ID NO: 22728

SEQ ID NO: 195877 - DNA, 601 bp, Human; identical to SEQ ID NO: 22729

SEQ ID NO: 195878 - DNA, 601 bp, Human; identical to SEQ ID NO: 22730

SEQ ID NO: 195879 - DNA, 601 bp, Human; identical to SEQ ID NO: 22731

SEQ ID NO: 195880 - DNA, 601 bp, Human; identical to SEQ ID NO: 22732

SEQ ID NO: 195881 - DNA, 601 bp, Human; identical to SEQ ID NO: 22733

SEQ ID NO: 195882 - DNA, 601 bp, Human; identical to SEQ ID NO: 22734

SEQ ID NO: 195883 - DNA, 601 bp, Human; identical to SEQ ID NO: 22735

SEQ ID NO: 195884 - DNA, 601 bp, Human; identical to SEQ ID NO: 22736

SEQ ID NO: 195885 - DNA, 601 bp, Human; identical to SEQ ID NO: 22737

SEQ ID NO: 195886 - DNA, 601 bp, Human; identical to SEQ ID NO: 22738

SEQ ID NO: 195887 - DNA, 601 bp, Human; identical to SEQ ID NO: 22739

SEQ ID NO: 195888 - DNA, 601 bp, Human; identical to SEQ ID NO: 22740

SEQ ID NO: 195889 - DNA, 601 bp, Human; identical to SEQ ID NO: 22741

SEQ ID NO: 195890 - DNA, 601 bp, Human
atgaaatttctcacttccttgtgaccactggttattctaatggaaatccctgtcaaatgctatataataaaagttttgattataaagaagattggaacttttggtagctctggtttatgattttatatctataggtttaaaaagacttctgtagaataataaaagctgaagcagttcactaaaagcgaaatgtgatttctgtaatgacgtttcttttcaaactgataggaacaacataaaaatcccacgcttaaataaatgaaaagttaccaactatctttgatgtcagtttgaggacttktaataattcttctcttgcccatgtttcaataactacatgaccccactcaatccttccctttatagacacagagtaaaatacctttatgtcaggaaattgccccaggtaggtatccagtgttagcaaggacccatccacgagtttttgatggaagtcttcccacagcacatcacatttctaaaagaaataaagagaccactgctgaattattttaattggatacctttcaccaaacttctaaaaaaatctgaaactataaaattagacaagtaatactttcccagatatgagatgctaggg

SEQ ID NO: 195891 - DNA, 601 bp, Human
agtaattaaaacagcattgtcctggcataaagacagttatacagacctctgaaacagaatataaagcccagaagtaaatccacaaatattcagtcaactgatcttcaaaaagggtgccaagaatacagaactgggaacaggcagtctcctcaataaatggtgctgggaaaactggatatttacatgccaaaaaattaaattggacctttatcttataccatacacaaaaatcaactaaaaatggattaaagacctgaattgtaagctctgaaactgtaaaactcctagaagaaaagttgarggggggggaagcttcattttctaaatgaagatgttttaaaataaacattggtgttagcaatgatttcttggacttgacaccaaaaagataggcaacaaaagcaaaaatagacaagaggaactgcatcaaagtaaaaagcttctgctcagcaaaagaaacaatcaagagtaaaatgcaagctatagaaatggagaaaagatctgcaaaccacatgtttgatgaggagttaatttccaaaatatacaaaggaacacccagagctcaatagaaaaaataactaataatctgacttaaaaatcg

SEQ ID NO: 195892 - DNA, 601 bp, Human
caattttgaacgaccaatgggtccaaaaagatatcaaaatggatattaaaaagtatctcagcacaaatgaaaactaaaacaagtagcagaaaaagctgtactaagtggaaagttttagtgataaacgcatacattaaaaggaaagatctcaaataaacaacctaactctacatctcaaggaactaagaaaagaacaaatgaaaccccaaattggcaaaagaaaggaaagataaagattagagtggaaataagtgaaataaagattagaaaaacaacaggaaaaatcaaggtaactatgagttttttttttttttgagcagataaaattaacaaacttttatctaaactaaataagatagaagactcacataaataaaatcagaaatgaaaggtgatatattacaactgatgccatagaaataaaaaggttaagagactaatatgaacagtatatactggcaaactgaataatatagaagagacagataaattactagatacatacaacctaggaagactgaatcatgaagaaatggaaggtttgaacacatctttaagtagtaaggagatttaataggcaaccaaatacctcccaacaaca

SEQ ID NO: 195893 - DNA, 601 bp, Human
ttatttgcttagctaagtcatactatgaacatatatcatatgaataatttgaacaagttgtaagctgctttggaattttcaggtaggaagacacaatttaacctcttctgatttcttaagtattgcttttaaggagattaaattaccatgcaataaaggtgatggtagcaagatggaagaataggaagccctggactctccttccccacaaacatacagatttaataccaacacaggaatcaatttttgtttgtaagacacccagaaactcgttgaatagctccttaacccttggcaagtrcaaatccagccacattgaaacaagcaggaaaaggggagctacattcttgctatccctagcacagtgccatataatgaagagggaacctccagctacctacttctcagtgaagagtgaagaaataggacagcacatctagcatcccaacttttctgacttctacccaagggagtgccttctacttgcctgtctgggatagctgtcaggtccagcatacactagtccctggggtctacagagaataaacagaggtttgaacatgaatgcaggcacttgccatggctcctctccctaggttag

SEQ ID NO: 195894 - DNA, 601 bp, Human
gctcacctcatccaatctcatccctgcttctcagtctcggttagtgcttcttccaacagctcccaccatttctctgacagactttatgagtcaactacaacctgtcactctatgctattcttctacacacccttcaggactggtgagaggtgggttggggcagttaacctctttggctatttctaattgctttcattttccctgcacctaccacttacaactagtatactagcagaaagcatggagatacacacccagtcactcaaagtatgcaatgagttagcctaggcagagtagagtrgaaacccttcaattaggtatggtgaacaccatgtgcctataaggtgacaaggctcattacttttagcaaaaatgtgttaccttcaaaggaggctatcccttgaagcagtggcctacgtaactatatgcaaactcttataaagctcttccttatggacttgccttctagcctggggcattcctttaatatcttccaagtagcaaatcttgattctctgaagatgaatttgatttttgaaagcatctatgaatcaataacttttaagtcttagaataagatggaagagtgcactgggtaatc

SEQ ID NO: 195895 - DNA, 601 bp, Human
tgatggatccttctagcaacctacagaatgagtgtttcagggattatctccattttacttttaggaaatgtggagctgcatgagataacctctaatttgtccgaaattgctcagcaagtctgtggcaaaagtgaactgaattagaagttggccccagtgaccagcgccaggagtagggtgaggcaggtgagacagggcacaaaatttaagaaggccccttactctcagggtcatgtgagtgcagggttagcaacttcctccctctaatttgcaccacgggttctttgctcacctcatccartctcatccctgcttctcagtctcggttagtgcttcttccaacagctcccaccatttctctgacagactttatgagtcaactacaacctgtcactctatgctattcttctacacacccttcaggactggtgagaggtgggttggggcagttaacctctttggctatttctaattgctttcattttccctgcacctaccacttacaactagtatactagcagaaagcatggagatacacacccagtcactcaaagtatgcaatgagttagcctaggcagagtagagtggaaacccttcaatt

SEQ ID NO: 195896 - DNA, 601 bp, Human
agaagtatctacgtgccccataaatatgaacaattattatatgccaattaaataaattgttatacatcaaataaatgagaaaaatgtaaaaataagtagaacgaataaggaagtatcataaaatatattgactcctgagccctacactaagagattctgatttaattagactgaggcaagccctagatatctacagtttaaaaaaaatcttccccgtagtccagttatgcccagctatttgaaaaataagaactaacccaggaggagatgctttaaaaaatttgatatggtaggaaaaagaaaaaaaaaacacaataatataaatggttatggcttacaaggcattgtcacatctgatggatccttctagcaacctacagaatgagtgtttcagggattatctccattttacttttaggaaatgtggagctgcatgagataacctctaatttgtccgaaattgctcagcaagtctgtggcaaaagtgaactgaattagaagttggccccagtgaccagcgccaggagtagggtgaggcaggtgagacagggcacaaaatttaagaaggccccttactctcagggtcatgtgagtgcagggt

SEQ ID NO: 195897 - DNA, 601 bp, Human
aaaatcaatgtaaaatataaaagattttgttttcctacttttaattgcttgaaaaggtaactgatcattcagagcaaaaaaacataactaatgtattgtggggtttataacatgtaaaagaaaaatgtatgacaataacagtgcaaaggaaaggaggtgggaactgaaagtgtactgttgtactgttcttaaataatacatgaagtaatacatcatttcaagttaaacctaatatgttaaagatgtatattatacattataaggcagcaactaagaaataaattaataaagaagtatctaygtgccccataaatatgaacaattattatatgccaattaaataaattgttatacatcaaataaatgagaaaaatgtaaaaataagtagaacgaataaggaagtatcataaaatatattgactcctgagccctacactaagagattctgatttaattagactgaggcaagccctagatatctacagtttaaaaaaaatcttccccgtagtccagttatgcccagctatttgaaaaataagaactaacccaggaggagatgctttaaaaaatttgatatggtaggaaaaagaaaaaaaaaaca

SEQ ID NO: 195898 - DNA, 601 bp, Human
tcagacaaacaaaggctgagggaattcattgccagcataagaattttaatatgaagtggagctacacagaaaaatgagtaccagaaatgataaaaatcaatgtaaaatataaaagattttgttttcctacttttaattgcttgaaaaggtaactgatcattcagagcaaaaaaacataactaatgtattgtggggtttataacatgtaaaagaaaaatgtatgacaataacagtgcaaaggaaaggaggtgggaactgaaagtgtactgttgtactgttcttaaataatacatgaagtaaaacatcatttcaagttaaacctaatatgttaaagatgtatattatacattataaggcagcaactaagaaataaattaataaagaagtatctacgtgccccataaatatgaacaattattatatgccaattaaataaattgttatacatcaaataaatgagaaaaatgtaaaaataagtagaacgaataaggaagtatcataaaatatattgactcctgagccctacactaagagattctgatttaattagactgaggcaagccctagatatctacagtttaaaaaaaatcttccccgtagt

SEQ ID NO: 195899 - DNA, 601 bp, Human
ttcaagagataatggctgaaaattttttttaaataatgaagacatcaaagtatagatgcaagaaactcagagaataccaaaaaggaaaaataccaaacaatacacatctaaatacatcatagtcaaactacttaacatcaagaataaaagaaaagcatacaataaaaaggtaagaattacgggatgctaatcttcagaaaccatgcaaaccagaacacattggatgatatatttacagtactgaaaaataaaagttaaaagaaatctgccaactcagaattccacacccaatgaaaatatctacaaaagtgaagatgaaatattttttttcagacaaacaaaggctgagggaattcattgccagcataagaattttaatatgaagtggagctacacagaaaaatgagtaccagaaatgataaaaatcaatgtaaaatataaaagattttgttttcctacttttaattgcttgaaaaggtaactgatcattcagagcaaaaaaacataactaatgtattgtggggtttataacatgtaaaagaaaaatgtatgacaataacagtgcaaaggaaaggaggtgggaactgaaagtgtactgttg

SEQ ID NO: 195900 - DNA, 601 bp, Human
atgagagaataataagcaatatttcaagagataatggctgaaaattttttttaaataatgaagacatcaaagtatagatgcaagaaactcagagaataccaaaaaggaaaaataccaaacaatacacatctaaatacatcatagtcaaactacttaacatcaagaataaaagaaaagcatacaataaaaaggtaagaattacgggatgctaatcttcagaaaccatgcaaaccagaacacattggatgatatatttacagtactgaaaaataaaagttaaaagaaatctgccaactcagamttccacacccaatgaaaatatttacaaaagtgaagatgaaatattttttttcagacaaacaaaggctgagggaattcattgccagcataagaattttaatatgaagtggagctacacagaaaaatgagtaccagaaatgataaaaatcaatgtaaaatataaaagattttgttttcctacttttaattgcttgaaaaggtaactgatcattcagagcaaaaaaacataactaatgtattgtggggtttataacatgtaaaagaaaaatgtatgacaataacagtgcaaaggaaaggaggt

SEQ ID NO: 195901 - DNA, 601 bp, Human
ctctagattttaggcaaaaataattgctgtaggcaaaagggtaaaagaaaaagtctcaaggggcataaaagcttcctaggcccaagacctgactcctacaacaagtagtggactgctccaacttgggcagggaaggaaactctcgctcaaatccaaccacagatatgaggctgactttgcctaaaacaaggccgggaaaggatttaaaacaaacaaacaaacaaacaaacaaacaaaacaacaacaacaaaaacagccctaactccactacaagctataacactaaaaaacaagcaatagyggcctaccactggaggaggacagtgcaaggagagagaccccttctgcagaggggtctctacaggcatacaaagacaactaaaatctaataagcagcagccacactgagagaaaccctccagcacctaagggcccccaagtcaggcttcaacctaagaatttgaaaatattacagatattaaaatataagtacaaggcattagcagtccaattctggaggaatttgaaagctgcggtgcactgaagtaacaatagcaaaaataaagacccaatgcagctcaggtcctgattaattgattcc

SEQ ID NO: 195902 - DNA, 601 bp, Human
acccacaggtgcaagcaaagatctactgcttctcggggagcaataaaagtaaaaccaatgtggctctggtagagatggagagccttctgacctctagattttaggcaaaaataattgctgtaggcaaaagggtaaaagaaaaagtctcaaggggcataaaagcttcctaggcccaagacctgactcctacaacaagtagtggactgctccaacttgggcagggaaggaaactctcgctcaaatccaaccacagatatgaggctgactttgcctaaaacaaggccgggaaaggatttaaaacaaacaaacaaacaaacaaacaaacaaaacaacaacaacaaaaacagccctaactccactacaagctataacactaaaaaacaagcaatagtggcctaccactggaggaggacagtgcaaggagagagaccccttctgcagaggggtctctacaggcatacaaagacaactaaaatctaataagcagcagccacactgagagaaaccctccagcacctaagggcccccaagtcaggcttcaacctaagaatttgaaaatattacagatattaaaatataagtacaaggcattagcagtcca

SEQ ID NO: 195903 - DNA, 601 bp, Human
ctacaagtgattctcaatactttgttcattagaatcccctggactaatgtgtcatttggaatagctggtggccaaagacacagggccaaaggcacagattgtgctaatgggcaagctctttcccatgggtcaacattggaagccatgagaaagtctgagaacaagacattcccttgcagtgtggatgagaatgaggtgatatatggctgctaggggataggcgtaaagccctgctcatttctatggaacatttcctcttaacaacaacaacaacaacaaccacaaaaacaaaaagctttamgccgcttgaggagggggcaccaaacccttctacccacaggtgcaagcaaagatctactgcttctcggggagcaataaaagtaaaaccaatgtggctctggtagagatggagagccttctgacctctagattttaggcaaaaataattgctgtaggcaaaagggtaaaagaaaaagtctcaaggggcataaaagcttcctaggcccaagacctgactcctacaacaagtagtggactgctccaacttgggcagggaaggaaactctcgctcaaatccaaccacagatatgaggctgacttt

SEQ ID NO: 195904 - DNA, 601 bp, Human
ccctttgacagccaggtgccaaaatgctttccttggccagagctgctgaggatcttgactggagatcaagatgggctggagtttcactagctaagtgactcctgaaaatcagatgaacacctccaatcctttgtgttgaagccattagataaatatcttcccttttgataataattaggctaatcacaagcagctgagggcagagtttgcagtcaaagaccagaaaataatccagaattggtcagggagagaaggcaaaactatactcattattctctagtcgaaatctttaaatgttctrttctgaagatagtgggaaactatgttagatttggttttataattctgataacactcacaccaacagcaattctataaaaacagatttacttcccaagaaatctcttttcctacaagtgattctcaatactttgttcattagaatcccctggactaatgtgtcatttggaatagctggtggccaaagacacagggccaaaggcacagattgtgctaatgggcaagctctttcccatgggtcaacattggaagccatgagaaagtctgagaacaagacattcccttgcagtgtggatgagaa

SEQ ID NO: 195905 - DNA, 601 bp, Human; identical to SEQ ID NO: 22742

SEQ ID NO: 195906 - DNA, 601 bp, Human; identical to SEQ ID NO: 22743

SEQ ID NO: 195907 - DNA, 601 bp, Human; identical to SEQ ID NO: 22744

SEQ ID NO: 195908 - DNA, 601 bp, Human; identical to SEQ ID NO: 22745

SEQ ID NO: 195909 - DNA, 601 bp, Human; identical to SEQ ID NO: 22746

SEQ ID NO: 195910 - DNA, 601 bp, Human; identical to SEQ ID NO: 22747

SEQ ID NO: 195911 - DNA, 601 bp, Human; identical to SEQ ID NO: 22748

SEQ ID NO: 195912 - DNA, 601 bp, Human; identical to SEQ ID NO: 22749

SEQ ID NO: 195913 - DNA, 601 bp, Human; identical to SEQ ID NO: 22750

SEQ ID NO: 195914 - DNA, 601 bp, Human; identical to SEQ ID NO: 22751

SEQ ID NO: 195915 - DNA, 601 bp, Human; identical to SEQ ID NO: 22752

SEQ ID NO: 195916 - DNA, 601 bp, Human
atgataaatgctcaaggtgatagataccccaaataccctaactcgatcattccacatcctatgcatataacaaatacatgtgtcccataaatatgtaaaatatttggtatcaataaaacaatttttaaaaataagataaattattcattttacacttttcaatatttttccaattttctataagtatatactacccttaattaaaaaaaagataattttcaaataccgtacatctcccatgtaagaatgcttcagactaaccaagtaattaaaacaagcctgaatgacaattaaaattatrttgttggttctggaaccgccactttctttagggctagcccctgagagtccttccaccatgggactttcatggacataccagccctgaaccaggcacttacctgggaaggtgttgtcacactgatttctggaacaaagttgtcctcaaagaaactgatgatgttctcctgctgcagttcctttgtcggggtgactttaggtagaggtgggacaggaggccctttccttgtctaggaagcattaaatacaaacattaatccagccaaagacaatgtgtcagacacgaagaaaggtcacatga

SEQ ID NO: 195917 - DNA, 601 bp, Human
aaaaaagaatgaaataatgttgtttgcaataacatggatggagctggaggtcattatgttaagtgaaataagccaggcacagaaaagacagatgccacaaattaataatatatgggagcttagaaacaatcgatctcatggagatagaggatagaataatagataccagaggctgagaaggatgtgtgggtggaaggaggagataaagagaggttggttagtggatgcaaacatacagttagattgaacaaataagccccaatattcaatagcagattagggtgactgtagtcagcaacamtgtattaggtatttcaaagtagctagaagagacgacttgaaatgttaccaatgcatagaaatgataaatgctcaaggtgatagataccccaaataccctaactcgatcattccacatcctatgcatataacaaatacatgtgtcccataaatatgtaaaatatttggtatcaataaaacaatttttaaaaataagataaattattcattttacacttttcaatatttttccaattttctataagtatatactacccttaattaaaaaaaagataattttcaaataccgtacatctcccat

SEQ ID NO: 195918 - DNA, 601 bp, Human
tgggcaaatggatatagaaaatgtggtatagacacacaatggtatagacacacacacactactgaatcaaaaaagaatgaaataatgttgtttgcaataacatggatggagctggaggtcattatgttaagtgaaataagccaggcacagaaaagacagatgccacaaattaataatatatgggagcttagaaacaatcgatctcatggagatagaggatagaataatagataccagaggctgagaaggatgtgtgggtggaaggaggagataaagagaggttggttagtggatgcaaacrtacagttagattgaacaaataagccccaatattcaatagcagattagggtgactgtagtcagcaacactgtattaggtatttcaaagtagctagaagagacgacttgaaatgttaccaatgcatagaaatgataaatgctcaaggtgatagataccccaaataccctaactcgatcattccacatcctatgcatataacaaatacatgtgtcccataaatatgtaaaatatttggtatcaataaaacaatttttaaaaataagataaattattcattttacacttttcaatatttttcca

SEQ ID NO: 195919 - DNA, 601 bp, Human
aaatatccttaaacagatacaatgcaaaaaggtcttctcaatgctatattacagtcagactatgtactaaggcaaaaataaaagacagaatcctaagaacagcaagagaaaagcatctgtttatttagtcagtttatcttttaatttaatctgttttctttcaaggctattactaatatgtgaagttttgtgactgtcataatgttaattgttttctggtcattttgtatgtgtgtgtgtatatatgtcacatatatatgtcatacaatgacatatatgtcaccatggtttggtagtataytgcagtagtaccacttgagtcattcctcttcctcatttgtgtgtttggtctcacaaaaagattgcggagggatggagggaggtgggcaaaggtaaaatactacctactagggactatgttcactatctgggtgatgagatcattagaagctcaaacctcagcatcacgcaatatctccatgttacaaaactccacatgtatcccctgaatctataataaaataaaaataaagaagtctcccaacaaacagaagcctagaattagttgaattcacagcccaaccctatcaataccagtcct

SEQ ID NO: 195920 - DNA, 601 bp, Human
cacacactcaacctactgctgccactaccaatatctgagcaagccacctggagcccaagaatcagcctgtctggactcactaacactggagctagtgtaacccacattggagccaagcacaagcaatgctcagtctaccactgcctccactggggcccaaagactggtcaacctggcatccttgtcctcagcaaaactttaccctggccccctgctagcaaatgcaccctaagtcattgaggaaatcacaagtacaactgacactatttacagccaaataaattatacaaagatcacactrctacatgtggccaaaatcaaagccaaaatgtccgacccaaccaacaacatatatacatcttcagagaaaagccctcccctacaaaaaccaatttcaaagaattggaagaagcaaccagattggaaattggaagttataccagatgcacagatatcaacacaatgaaacagaatcataaaacagcaaggaaatatgacacttccaaagaaacaagataaagaattcaaaatattgcttttaaagaagctcagtgagatacaagaaaattttgaaaaacaaagaaatcagaaaaacatttta

SEQ ID NO: 195921 - DNA, 601 bp, Human
acatgaaataatatataaagagatgtttatcgaagtgctggtgaagcaacaaaaaagttggaagcaacttgtggccaataatcaggggttggtacaaccaactgagagaatactatgggcaaatatgtttttgcaaacacaatattatgacatgaaaatatgctcaataaaattaagtagaaaggtcagaaatacatgatagtacagtctcaattttatagtgcaaaattgatatatactcagtgatttgggaagactaaaagaagacagaccaaagggcactagtggtcatgtcagagtrgtatgatttaagtgattattaaaattcttttttttttttcctgagatggagttttgctctcgttgcccaggctggagtgcaacggcacaatcttggttcaccgcaacctccgcctcccacctcctcctgcctcagccttccgagtagctgggattacaggcatgcaccaccatgcccggctaatttttgtatttttagtagcgacagggtttccccttgttggtcagacttgtctcgaactcctgacttcaggtgatctgcccgccttggcctcccaaaatgctgggattacaggtgtga

SEQ ID NO: 195922 - DNA, 601 bp, Human
caatgagtctgcatgtcatgttgtctctacttcagttgccttgtctaccaaatggggatgtcctcagctaagcacacaaggcttctaggtgaccaaagtctctatttgtgatggaactgagaggatgctcttggagggtccaggtcaaagcaactgagtaagggtattgttgccttaaaacactcccagttcgaaaattcatgtagcgaacaaagagaatgaagctgggcagtagcaaatgcaaagggactgtacaactttggaaattagaattgctcaagtttgtcccaggacaactggsagatgctgggtaagatcctttggcgctaagacagctatccctggcggcatctcggtatccacagacatacaatctggccatgcaccgataaacaccattctcaaaggagctgctaaatcacatctcaagccccagttaattttatcaaactcagcatcttatgcatacaacagaagaaagaaaacaatagctcaaagcattttgcctattgataagtgtgcttgaaaagaatgaaaaatcatgatttgccactgcattgtgtctgagtttttattttctgaggtccctattattatcaat

SEQ ID NO: 195923 - DNA, 601 bp, Human
atttattctcttttatctatttatctgtagattatcaaatacattattgtctggatgatacagttcattcacttataatacgtagctcgacctataatctgatcaacacatctaaggttataagcactcatgtgtatgtgtatgtgtccaactaccctaaatatggaagactttgagtcacactagttttgaagggagcagttatgaatggtcagtcatagcacacacttgactcagctgggtatttctctggaataaatctattaattcactgtggtgctttgttaatggtcactgattwgtgccatgtggaatcctgataactttaaacagtggctcccacagtgtggtgccaacaccagcagcattagcagcattttcctcagaaatgcagattcctgacctcatcccagacctgccaaatcagaaactgctggatgggctgaagtaacataaaatggctatttatagctacagaggaacaagccactgaagaaactgccaagatgcttcagggagagacagcatctgtatatttttaattaaagccagattatgtcactcaataaaccagaaagcagacagaaatataaatccctgt

SEQ ID NO: 195924 - DNA, 601 bp, Human
tacgtgtgtatatacacacatacatgattgctttattttttgtcttgatctcttgttagaatcatatttatatggaatagatttgatttccagggacaaaatatcttttaaatctttatttcttaaagtgttttaccaaacacccatttcctaggaaagcatattttgggggtgaaggagagactgagaaattcttccctaaacaaagttgaatggaactttgttacagaacttttcagagccttaaacatgccgatgtaaactgtgaaaaatcaaaagggatgtagcccctcagtctcaygtaaacagagactcccttttcaaagcatctaatgatactagttttcctcataaacatgctttggaaaatgctgttttaaaagaataatgtagggacacaaacacacaaagaggaagggaaagaaaaagagagagaatggatttctaagttcttaggatggaaaaatagggaacaattttttggacctttggaagatctgtttttgtaaacacaaaaccagaaaagcaagtaaaccattgggtcataaccacggggcatctccctacaagcagataagaacatttaccagaaaaaattcta

SEQ ID NO: 195925 - DNA, 601 bp, Human
gggtctcactgtgttgcctagactggtcccaaacacctggcctcaagcaatcctcctgctttggcctcccaaagtgttgagattacagatgtgagtcaccatgtctggccccaaaacattttctgaggacaagaattgaaaaagagagagaaataaccttgcacatacacacatatttatgtgtgcatatacatgtatatatacacatgcacacatatatacgtgtgtatatacacatatatacacatgtatatatacatatatacgttatatacacgtatatatatgtgtatatacacaygtatatatacatatacgtgtgtatatacacacatacatgattgctttattttttgtcttgatctcttgttagaatcatatttatatggaatagatttgatttccagggacaaaatatcttttaaatctttatttcttaaagtgttttaccaaacacccatttcctaggaaagcatattttgggggtgaaggagagactgagaaattcttccctaaacaaagttgaatggaactttgttacagaacttttcagagccttaaacatgccgatgtaaactgtgaaaaatcaaaagggatgtag

SEQ ID NO: 195926 - DNA, 601 bp, Human
gtaacctcgacctcctgggctcaagagatccacctgcctctcagccttctgagcagctgggactacagacacatactgccatgcccagctatttttttttttttttgtagagacagggtctcactgtgttgcctagactggtcccaaacacctggcctcaagcaatcctcctgctttggcctcccaaagtgttgagattacagatgtgagtcaccatgtctggccccaaaacattttctgaggacaagaattgaaaaagagagagaaataaccttgcacatacacacatatttatgtgtgyatatacatgtatatatacacatgcacacatatatacgtgtgtatatacacatatatacacatgtatatatacatatatacgttatatacacgtatatatatgtgtatatacacatgtatatatacatatacgtgtgtatatacacacatacatgattgctttattttttgtcttgatctcttgttagaatcatatttatatggaatagatttgatttccagggacaaaatatcttttaaatctttatttcttaaagtgttttaccaaacacccatttcctaggaaagcatattttggggg

SEQ ID NO: 195927 - DNA, 601 bp, Human
tgtacggtcgattatatgcttctggaactctagggctcctatccacaaaggtgttgtgagcatgaagatggggcctgtttccaggagggtgagtggtaagatggtgagactgttctttttggtcagcttggcatttcacttatggaaacccctgagactggccatcagaatgttgctgataagcttatttcaagtgactccaactttttatatggaagaggtccccagcaaaaaatatttgctcagggccataatcctaaagggagggtgaacattggatttaaaatccagtcatcaagtyagaagaaaagccaatccaaaacactttcttttttttttttttgagacagggtctcgctcttgtcacctaggctggaatgcagtactgtgatcatagctcactgtaacctcgacctcctgggctcaagagatccacctgcctctcagccttctgagcagctgggactacagacacatactgccatgcccagctatttttttttttttttgtagagacagggtctcactgtgttgcctagactggtcccaaacacctggcctcaagcaatcctcctgctttggcctcccaaagtgttgagat

SEQ ID NO: 195928 - DNA, 601 bp, Human
tatttagtagctttccctgttctgtagacagaaaaagcctaggcactgttagcagctctggagtcagaaccttgaaagatagtgaagcctaatgacccaatgattttaaaacattttcagaataccagatgatacataaactgcactgcttggttactcctgctcaaggaatggaacaatgatgttggtaatccaccagggcaatgaactgactaaatttgggcttgaaatgcactgtgtggtttttcttccttctaattttcatcttactaattctttctgtcttaaaataatgttaacrtgtttactttgaaaaatagcaagagaaagaagaggcagctggtccagaaatatgttatgttgaaaagccagtgtggtatttagaaccaggttacagatacccagtaagtgagagatgcatatgttcataactgcaggctggcctctcaggattacatgggtgaaaaaaccatttcatggactgattctgcaagttgaattctatttcagttcaattggctagggaaaacagcatgatttaatgaacttaacaagtaagatgcagtattaggctggaaaacagagacataagggtagaaaa

SEQ ID NO: 195929 - DNA, 601 bp, Human
tcatttttataagcatatcaggtaaaagagatttcaatatataactatagccataaaacatttagtagtgatgcatctgtaggtagtttgcaagtatttgattgacccagaaatctagcctccagagcacacacacaacacattttctgaggatcttaacctttagaatttgaataaaatgtataaaatctgtaaacacctcaaaaaaaccacttagaagtaaaacatatagtctccaaatcatcctcatggctgcatgcaaacagacagataaacacacacacacacacacacacacacmcccatacacaaaatttctttaatcataacacagtattatagtaagccagattaccatgagggcatagagattttcatcttttcttcttctagagattttcatcttttattctttcattaaacatattttgaaaacctttactatatcctaagtattgtgctggacacttgtgacttcccaatgaggcaaaagaggtagagtaggaagcttaagacagagaggttaaataaaatctttaggaacaaggccaatcagaagttatcttttatgtaatagaaatacctttcatgtaaaagtcac

SEQ ID NO: 195930 - DNA, 601 bp, Human
atactgcgtctatgcgtcagatgactcacatatcattgatctatagactcggtgcaacatgattcaatatctgtactgctttgaatagtattttcccccaccccccaaatttcatgcctatctggaacctgtaagtgtgtccttaactgacaacagggtctgaaccaatgtaataaaataaagattttgattagagtgggtcctaatccaatgactggtggccctgtaagaagaggaaaatttggatatgtagacgcaaggagaatgccatgtgaagacacagagcccacagacacacagrgaaaatgccatgtgatgaccaaggtgcatattggagtactggagtgatgtatctgcaagccaaggaaccccaaggactttcagcaaccaccagaggctaggagagaagaaaggattgattctcccctagagccttcagagagagcatgtccctactgacaccttgatctcagacatctagcagccaaaactgttagagaatttttttgtggggggttttgtatttaagccactcagttgtggtacagcagcccaggaaataatacaatatcaacttacagttgattctgaagttcatatg

SEQ ID NO: 195931 - DNA, 601 bp, Human
gaaaacacaacaaaacagagcccagatgagttctccgatgaattctatcaaacctttaagcaacaaataataccaacacaaacttaaccagcaattgattttcagttcaattcattcaataccattaccctagtattaaatcataaaaacccttttcttaaaaaaaacctataaattaatattccccatgaacaggaatgtaaaaattctagaccgagctttagcaagctgactaaaagatacacagataaaaaggataacatatcatcaccaaatggggttcatcctaggacttcatggrtggtttaccattggaaaaccaataagtataattcaccatattaacaaactataaagaaaactcatatgatcatcttaacagatgcagcagagcatttgagaaaatccacattaattcctgtttaaaactctttaagtaggaataaaaggctacttcctcaatctgataaaagccatctaataaaacctacaagtaacaaacaccatgtttaaaagtgaaatactacatgctcttcctctaagatcaagacaagggtgactgctttactacttttactcaatattattctggtggtacaag

SEQ ID NO: 195932 - DNA, 601 bp, Human
ctacactggaattaaattggaaattgttaacagaatggtctctagaaaatccacaaatattttaatcatccaaaatgatctctgcaaaatccacaaataatactcttctaaataattcaatgagtcaaaaaagaaatcaaagtggaaattggaaacctgaatggaaatgaaaacaatatatcaaaatgtatgggatgctgctaaagcagtacttacggaaaatttatagcactaaactcccatataagaaaacaaaaaggtccgaaattattaacctcaccttctttttaccctgaatataaaaaaaaaacataaacagagcaataaaacccaaagtagaaactggaaattatacagattagagtggaaatcagtgaaacagaaaacaaaagacagagtgagaacaagaaaaagagagaatcaataagaccacaggctagttatttgagacgatcaataaaattaatcaacatttagccagtctaattggagtaaaaagagagagtgaacaaggatgcagattaccaatattaggaatgagagagggaaacatcatcatagatattagagatatcaaaaaataatagtaaatatgatgaac

SEQ ID NO: 195933 - DNA, 601 bp, Human
ggaaatgtaacatgataagcagtattctgggtcatcaaataggtctcaactaattcttttttaaaggtcctatctgagattttatttccaaaaacaaacaaacaaatgaacaaataaacacaatggaacctctttcttgcacagacaccagagacaatgctaaagttcccagtataactctattataaagacacatgcatttgtgcgtttgtcgcagcaatattcacaacagcaaagacatggaatcaacataactacctatcaatgaaggcctggataaagaaaatgatatatatgacakatatatcatatatatatcatatatatgatatatatcatatatctgtcatatatatcatatatatatcatatatatcatatatcatatatatcatatatcatatatatcatatatatcatatatatcatatatcatatatatcatatatatcatatatatcatatatatatcatatacatacacacacacacacgccatggaatactatgcagccataaaaagaatgagatcatgttctttgcaaggacatggatggaactggaggccattgtccttagcaaactaacacaggaacagcaa

SEQ ID NO: 195934 - DNA, 601 bp, Human
tcattgcctaaacatttatgcactcaattagagagcttcaacataaagcaaaaaccaagaaagctgtaaagaaaaataaaaaagcacacacacttttataggaaagacttcaatattcctcattcaataattgaaagaacaaatggagagaaaataagcaatggtataaaagatttagataacactgtgactaaatttgacctaatttacacttataacattctatccaacaacagcagaatatatattcttttcaagtgcacatggaaatgtaacatgataagcagtattctgggtcatyaaataggtctcaactaattcttttttaaaggtcctatctgagattttatttccaaaaacaaacaaacaaatgaacaaataaacacaatggaacctctttcttgcacagacaccagagacaatgctaaagttcccagtataactctattataaagacacatgcatttgtgcgtttgtcgcagcaatattcacaacagcaaagacatggaatcaacataactacctatcaatgaaggcctggataaagaaaatgatatatatgacagatatatcatatatatatcatatatatgatatatat

SEQ ID NO: 195935 - DNA, 601 bp, Human
ataatgccaattggactgccttcaaaatatgtggctggttttttcaggctcaacttctacttagctttgccctcttaatcttgagaattatcccttaaggtactcatgtcaaagaatattctggtaaagctacaaacatagcaaaaggattttgccagcttatatagtattcctttttaaaagggcaggaacgtactcacaactctgtcaccacatgttgaaacacagaaaagtgtaattttccttaacaagacaaatgaatcctgtacaccttcatcacaattagagtacacatggtatrgtctcaacattcttagctttttgggaacttgattgtaagtactgctttaccatcagaaatctacaaggggtgacttggaatgtgctcctaagaaaggagaccagctgtggaaaccacagtgggagaaaatcttccaataggaaaacattgccaattataatcatctgtactatgtttcatgaggtgtcttctacttgggacatctaagtttatcagtaaagtaccggacctcttccagtgcagatgtgcaatttgagcataatcggcatgcctagccttgccacggcttcgtgatagatg

SEQ ID NO: 195936 - DNA, 601 bp, Human
aaacctttttttctttataaatgactcagtctcaggcaattctttatagcagtgtgaaaatggactaatacaacatgtgaatatgtaaaattactgtcatcaaatatccataatgccaattggactgccttcaaaatatgtggctggttttttcaggctcaacttctacttagctttgccctcttaatcttgagaattatcccttaaggtactcatgtcaaagaatattctggtaaagctacaaacatagcaaaaggattttgccagcttatatagtattcctttttaaaagggcaggaaygtactcacaactctgtcaccacatgttgaaacacagaaaagtgtaattttccttaacaagacaaatgaatcctgtacaccttcatcacaattagagtacacatggtatggtctcaacattcttagctttttgggaacttgattgtaagtactgctttaccatcagaaatctacaaggggtgacttggaatgtgctcctaagaaaggagaccagctgtggaaaccacagtgggagaaaatcttccaataggaaaacattgccaattataatcatctgtactatgtttcatgaggtgtcttc

SEQ ID NO: 195937 - DNA, 601 bp, Human
gtagtaaacatattatacttggagtatgataggcactgttcgaagaactttacacatatgaacattacctcatgttaacacactttggtgcaatctaatgttgacaacactttattgcctttaaagcatttatcttgccatgttctccagactgcattgtacctgccttttcaaatataatccttacaaaaaattgagggagagatggcagcaattctccatttgggagaatgaagagaattggctgaatggtgatctattgtcatggcccccagctgccatgtagcagaggtaagactgyagttggtacctctgactccaatgcctgccaggctgtcaactgatgccccagacccaagtttcttaattaggaaccccaaaaatctgcagaggaattctcaaagttctgcaagttctccataaaattttaggtcatgggaatatattcattatttccttttaagcataatgaatccccttaaggaagctcaaatgggaatttagagatgaaggatgaaatgaggcatcagactataatgggctatgctcagactttgattgagatcaatctgtggttataccccaattttaccacttgcta

SEQ ID NO: 195938 - DNA, 601 bp, Human
cagacacagtggctcatgcctgtaatcccagcactttgggaggccgaggtgggcagatcaggaggtgaagagattgagaccatcctggctaacatggtgaaaccctgtctctactaaaaatacaaaaaaaaaaaaaaaaaagaaaagaaaaattagttgggcatggtggtgcatgaccgtagtcccagctacttgggaggctgaggcaggagaatcgcttgaacctgggagacgaaggttgcagtgagctgagatcatgccactgcactccagcctgggtgatggaccaaggctccattcycccccaaaaataaaaaaaataaaaataaagaaaagcgaggtggtataacctaaatactttccttagcatatccgtactcattgcagaagaaagctgctaatatgtcatgctattagccttgcattttctattctgcagcacagtaactccccatatatactttttaaaaatttcacaaggataatgcccttctgagagctctactttctttactaattacaatcacaaaactatcaaccgattccctattcaaaatctgcataagctttgtttttccccaacttttatgtaggtaaaaat

SEQ ID NO: 195939 - DNA, 601 bp, Human
acaaagtcccataaagtacatcacagaaaagggagttggggtcagttttcatacaatttaaattacatgtgtttagcattcaatataaaattctttttaaaaaaactttgttgcctagaaattgaaacgtcaaaccaatgggtaaagtatacataaaaacagatttttggagacagatttttgaagaataggagttattctaattaatattcatcacagacattaaaaactgagaaatgtatgaaaagtgagggccagacacagtggctcatgcctgtaatcccagcactttgggaggccraggtgggcagatcaggaggtgaagagattgagaccatcctggctaacatggtgaaaccctgtctctactaaaaatacaaaaaaaaaaaaaaaaaagaaaagaaaaattagttgggcatggtggtgcatgaccgtagtcccagctacttgggaggctgaggcaggagaatcgcttgaacctgggagacgaaggttgcagtgagctgagatcatgccactgcactccagcctgggtgatggaccaaggctccattcccccccaaaaataaaaaaaataaaaataaagaaaagcgaggtggta

SEQ ID NO: 195940 - DNA, 601 bp, Human
catcccaacggcctcattccctcactggtaccctaccccttgatttggttatcatttgatccagtcttcatccatagcattgttagtttcaattgtgtatgtgtatgagtgagggtgaacgggagggagagaggagagagacagccatgcctcccaacatttgctgcaaaatgagctcccattaataatatttttggattagaaagaaggtaagccaaataagacacaggacgaaagtcctgctttgataatacaaaaaaatctataatactaaacattatcatttgttcatttatttgtrgtatcataatacatgaaaacaatgtgggcttgaagtcagcataacccaggctcaagttacacagtaaagggccaggctaagacaaagtcccataaagtacatcacagaaaagggagttggggtcagttttcatacaatttaaattacatgtgtttagcattcaatataaaattctttttaaaaaaactttgttgcctagaaattgaaacgtcaaaccaatgggtaaagtatacataaaaacagatttttggagacagatttttgaagaataggagttattctaattaatattcatcacag

SEQ ID NO: 195941 - DNA, 601 bp, Human
tcctaatataccaagatgcaaggagtctcctctgtcagctcagagaacttggatcaagaaattacagatgacccaatcgataaaatgggccaagatctggactcattatagcaatactgctgatgttcttctgggaagctaaaattttaaaaggaaggtgccattgtgtactgctgaccacatcccaacggcctcattccctcactggtaccctaccccttgatttggttatcatttgatccagtcttcatccatagcattgttagtttcaattgtgtatgtgtatgagtgagggtgaacrggagggagagaggagagagacagccatgcctcccaacatttgctgcaaaatgagctcccattaataatatttttggattagaaagaaggtaagccaaataagacacaggacgaaagtcctgctttgataatacaaaaaaatctataatactaaacattatcatttgttcatttatttgtggtatcataatacatgaaaacaatgtgggcttgaagtcagcataacccaggctcaagttacacagtaaagggccaggctaagacaaagtcccataaagtacatcacagaaaagggagttgg

SEQ ID NO: 195942 - DNA, 601 bp, Human
cagtgagaaggaaataactaactctggccaagtataacctaagttgccctggaatgtgtcccaggctctagctcttgtcctttgtctagctccaagtccagtcaacagagagaatgttccaaggatgtatcctaatataccaagatgcaaggagtctcctctgtcagctcagagaacttggatcaagaaattacagatgacccaatcgataaaatgggccaagatctggactcattatagcaatactgctgatgttcttctgggaagctaaaattttaaaaggaaggtgccattgtgtackgctgaccacatcccaacggcctcattccctcactggtaccctaccccttgatttggttatcatttgatccagtcttcatccatagcattgttagtttcaattgtgtatgtgtatgagtgagggtgaacgggagggagagaggagagagacagccatgcctcccaacatttgctgcaaaatgagctcccattaataatatttttggattagaaagaaggtaagccaaataagacacaggacgaaagtcctgctttgataatacaaaaaaatctataatactaaacattatcatttgttcat

SEQ ID NO: 195943 - DNA, 601 bp, Human; identical to SEQ ID NO: 22753

SEQ ID NO: 195944 - DNA, 601 bp, Human; identical to SEQ ID NO: 22754

SEQ ID NO: 195945 - DNA, 601 bp, Human; identical to SEQ ID NO: 22755

SEQ ID NO: 195946 - DNA, 601 bp, Human; identical to SEQ ID NO: 22756

SEQ ID NO: 195947 - DNA, 601 bp, Human; identical to SEQ ID NO: 22757

SEQ ID NO: 195948 - DNA, 601 bp, Human; identical to SEQ ID NO: 22758

SEQ ID NO: 195949 - DNA, 601 bp, Human; identical to SEQ ID NO: 22759

SEQ ID NO: 195950 - DNA, 601 bp, Human; identical to SEQ ID NO: 22760

SEQ ID NO: 195951 - DNA, 601 bp, Human; identical to SEQ ID NO: 22761

SEQ ID NO: 195952 - DNA, 601 bp, Human; identical to SEQ ID NO: 22762

SEQ ID NO: 195953 - DNA, 601 bp, Human; identical to SEQ ID NO: 22763

SEQ ID NO: 195954 - DNA, 601 bp, Human; identical to SEQ ID NO: 22764

SEQ ID NO: 195955 - DNA, 601 bp, Human; identical to SEQ ID NO: 22765

SEQ ID NO: 195956 - DNA, 601 bp, Human; identical to SEQ ID NO: 22766

SEQ ID NO: 195957 - DNA, 601 bp, Human; identical to SEQ ID NO: 22767

SEQ ID NO: 195958 - DNA, 601 bp, Human; identical to SEQ ID NO: 22768

SEQ ID NO: 195959 - DNA, 601 bp, Human; identical to SEQ ID NO: 22769

SEQ ID NO: 195960 - DNA, 601 bp, Human; identical to SEQ ID NO: 22770

SEQ ID NO: 195961 - DNA, 601 bp, Human; identical to SEQ ID NO: 22771

SEQ ID NO: 195962 - DNA, 601 bp, Human; identical to SEQ ID NO: 22772

SEQ ID NO: 195963 - DNA, 601 bp, Human; identical to SEQ ID NO: 22773

SEQ ID NO: 195964 - DNA, 601 bp, Human; identical to SEQ ID NO: 22774

SEQ ID NO: 195965 - DNA, 601 bp, Human; identical to SEQ ID NO: 22775

SEQ ID NO: 195966 - DNA, 601 bp, Human; identical to SEQ ID NO: 22776

SEQ ID NO: 195967 - DNA, 601 bp, Human; identical to SEQ ID NO: 22777

SEQ ID NO: 195968 - DNA, 601 bp, Human; identical to SEQ ID NO: 22778

SEQ ID NO: 195969 - DNA, 601 bp, Human
tcagcagacttaattgtgagcaaatggtggtgcatataggaatccttacagattcatggagttgtgatatgggatttcaacacctcattggaccttaaccaacctatgaaactaatattgtaagtaatcaatatgtacacacaatgaacaaagttattattctgtttatcacatgcaagttccctaataaaggcacgtctccagctgtcacaggtagaacaaagcattaacaggtctgattactcgcaagttctacaacccttctactgtgctatacctgtggctatgtacagttttcttkagatcataagatcagttatctggatatcttccttaataaaaaatgaaagagaacaggcatgaaggctatttgaacctgggagctacgacagatatggagcatgtttggcccaagtgaggcaaagatgagagcgatgcatatggtcatgagatgagcatggctgtggcagcgaggcagatggagggtgagagggaggtggtgctcaccactgcctcctccactggctcctcagcccgagtgtccattccaaggtccagaccaacggcaggtgtgacagcagccagaggctcctctgctttt

SEQ ID NO: 195970 - DNA, 601 bp, Human
attcctttaaaaataaattatcttcttaattataatagtaacgaaaaattaaactccatttttcccttcctttgttatttaaataatcttaaagctaaggtgagtagacagatcaccattggacaccaagtgaaaaagcactgtctgcatggacttgctgaaatctccagtgaatctgggagtggccctggacacagcactccctggtctaaagtccctgcaagcaatgcctctaggagagattcagtccagctttaagtattttccattactatcttgcactattatttatttttctacytgattaatgaactgttgatgtgacagatgacctaccattttccctgtaaaatgacttaaggcaccaacgacatgaagtaagactcatttctctaggtatctaatctagggaatgttatttttggtaatagagaaattgtttttcctatttgtacagtctatgaagggtaaatggtaccctgattgaaattgttggaagacatttttctgcatttcataaataaatgacttttcactcgccatgggtatttggtactctacactttcatgggtattacaatgtccaattctacttggtaca

SEQ ID NO: 195971 - DNA, 601 bp, Human
acgacaaccacagccagccaattaattaatgctagggacacaatgtggatttttgtttttacaactaaataccacgtatctagcaacctaatagacctttctccagagaaatataaccctaatattatgttagattattatgaccggaaggaagaagctataaatctactttaggaaacaaaaatacattttatctgattctattttcctaaggagaagggagaacgaggggaaaaattgatttcatccaagtatgtccatgttaaaaacatggaaggcagccactactgatgaccattargcaaactgaattgctgtaaactgtctcctcttagttaacattgttactattatttttcagtccatatggagaaatgaacttgaattttttctctgtggaaagcgtggatcacactgtgagctctgcacctatgattcttgcatcacctgtggatctcaggaagtgcctgaatccttcattagactgtaaattgccttatattttacaaggaatcaaaatttttgattctctacagttcacctgtgagcttcaggagaaaaggtattttcagaatgaagcattcttccaaacagctgctta

SEQ ID NO: 195972 - DNA, 601 bp, Human
catgtgatttgcctgccttgccctcccaaagtgctgggattacaggcatgagccaccacacctggccccaaatcattttttttctaacaaatattttcattatttacataacatagaaacatctggaaaagtaaagacaagagtgttgtttttttaaatgcatcctgtagacataccagtaaaatttgatgttgttgggaaaaactgaagacaatactacctatatgagaaataaaacaacaaacaaaaatgtaataattaaacttttcttaaaagccctaggtttcttttggaaacaccrttaaaatttcccatgtttgaaattatacgtgcctctttacaaaaacaaaacaaaaaccaaacaaacaaaaaaaaccagaacaatcacaaacttcatctcaggtgaaatgcattctgtcaaaacttgaactaataattatggtgacatttcagtagtgaaagggattacctcaaaaggtcatgtcaactcaacgctgactgacgacaaccacagccagccaattaattaatgctagggacacaatgtggatttttgtttttacaactaaataccacgtatctagcaacctaatagaccttt

SEQ ID NO: 195973 - DNA, 601 bp, Human
tttttttttttgagacagagtctcactctgtcgccctggttggagtgcaatggttaagatctcagctcactgcacctctgccttctgggttcaagtgattctcctgcctcagcctcccaagtagctgggattacaggcacctgccatcatgccaggctaatttttgtatttttgtagagatggggtttcatcatgttggccaggctggtcttgaactcctgacctcatgtgatttgcctgccttgccctcccaaagtgctgggattacaggcatgagccaccacacctggccccaaatcattttttttctaacaaatattttcattatttacataacatagaaacatctggaaaagtaaagacaagagtgttgtttttttaaatgcatcctgtagacataccagtaaaatttgatgttgttgggaaaaactgaagacaatactacctatatgagaaataaaacaacaaacaaaaatgtaataattaaacttttcttaaaagccctaggtttcttttggaaacaccgttaaaatttcccatgtttgaaattatacgtgcctctttacaaaaacaaaacaaaaaccaaacaaacaaaaaaaac

SEQ ID NO: 195974 - DNA, 601 bp, Human
aaaaataataggcaaaaaagaacactggtataattcacatcatttaagcaaaatacaggcactgacagaaatttagagaaaattagaaggggcctctttagaaaaaaatggaataaatgtgggtaaaaatctaaccataattaattgtaaccaaataatacattatgaattggctctgtgctcatctttacctgctttacaacctgattctctaacacatattgaaacgaatattgaaatcatattgaatttttttttttttgagacagagtctcactctgtcgccctggttggagtgcawtggttaagatctcagctcactgcacctctgccttctgggttcaagtgattctcctgcctcagcctcccaagtagctgggattacaggcacctgccatcatgccaggctaatttttgtatttttgtagagatggggtttcatcatgttggccaggctggtcttgaactcctgacctcatgtgatttgcctgccttgccctcccaaagtgctgggattacaggcatgagccaccacacctggccccaaatcattttttttctaacaaatattttcattatttacataacatagaaacatctg

SEQ ID NO: 195975 - DNA, 601 bp, Human
tctaaatttaattacacggcattattttgaaaaaataataggcaaaaaagaacactggtataattcacatcatttaagcaaaatacaggcactgacagaaatttagagaaaattagaaggggcctctttagaaaaaaatggaataaatgtgggtaaaaatctaaccataattaattgtaaccaaataatacattatgaattggctctgtgctcatctttacctgctttacaacctgattctctaacacatattgaaacgaatattgaaatcatattgaatttttttttttttgagacagartctcactctgtcgccctggttggagtgcaatggttaagatctcagctcactgcacctctgccttctgggttcaagtgattctcctgcctcagcctcccaagtagctgggattacaggcacctgccatcatgccaggctaatttttgtatttttgtagagatggggtttcatcatgttggccaggctggtcttgaactcctgacctcatgtgatttgcctgccttgccctcccaaagtgctgggattacaggcatgagccaccacacctggccccaaatcattttttttctaacaaatatt

SEQ ID NO: 195976 - DNA, 601 bp, Human
tcctgtatttgttctatagatttcatttttgtcctgtggatttcatcgttaagttatgtacaggctggaaaagtggaaaagatgaccagttgatccattgcactacagaactacaactgagaacatttagaagtttcattgatagctatgttcacaagttagagattaatctgatcccatggctggaaggaccatagggcccaatgttctcattttagaagggaggaactattataaagtagaagcagcactagagacagactagagattgggttttagttttgactcttccactaatttkctatggagctggaggaagtccctttgggcctagctgtgtaaactcatggggaaaagtaacaaaggagaataaatacagcgggaattctggctgcagggcaccattgccttttcttgcccatctctaattctagatccaacttgagctcttgacttgtctgaagttccttggcattttaatgaaaatacagcattttcttcagaatccattttaaagaaaagcccaagaggtaggtagggtatccagatcctcattatggccccaaatagaagatgattggactatggcacaggctggtga

SEQ ID NO: 195977 - DNA, 601 bp, Human
agccgagattgcgccactgcacttcagcctgggtgacagagcgagactccatcacaaaaaaaaaaaaaaaaagaatttctctacattacttttgcctactttattattctacattattttgtcctgtatttgttctatagatttcatttttgtcctgtggatttcatcgttaagttatgtacaggctggaaaagtggaaaagatgaccagttgatccattgcactacagaactacaactgagaacatttagaagtttcattgatagctatgttcacaagttagagattaatctgatcccayggctggaaggaccatagggcccaatgttctcattttagaagggaggaactattataaagtagaagcagcactagagacagactagagattgggttttagttttgactcttccactaatttgctatggagctggaggaagtccctttgggcctagctgtgtaaactcatggggaaaagtaacaaaggagaataaatacagcgggaattctggctgcagggcaccattgccttttcttgcccatctctaattctagatccaacttgagctcttgacttgtctgaagttccttggcattttaa

SEQ ID NO: 195978 - DNA, 601 bp, Human
ggaatctattagggaaaatctctctctctctctctttctccctataaaagtgagaacaccacatgttctcacttttgagtagaaactaaccagtggatacacattgacataaagatggaaataataggcattggagctccaaaagtggagacggagaggaggctgaaggttggaaaattatctattgggtataaagttcactatttgggtgatggtttaatagaagcccaaatcttaccattgcacaatataaccatataataaacctgcacatgtaccctctggatctaaaataaaattwaaaaattttaaattaaaaaaattcaaaaaattaaatatacactaaggtaaattatacaagccataagtacagaataaagacatatatattttaaattttagccaaatgatattcttccatggctatggaacactttatactacagttagagaacagccatcttcctggcatttgctcttacagagacatttgactacaggaccactgaattcaaggcttactgatttaccccaaagatggagaataataattctgattctgattcataagcaggtttctgcttgacagttttgatatatg

SEQ ID NO: 195979 - DNA, 601 bp, Human
ctggttatttaaaaggataaataaaatttatagactgctataataattaatattaggtgtcaacttgactggattgagggatgcctagatggttggtgaagtattgtttctaggtgtgtctgtgaggttggtgccagaggagactgacatttgagtcagtggactgggagaggaagacccctcctcaatgtgaatgggcaccatccaatcagctgccagcatggctggaacaccaagtagaagagggggataagcttgcttgctctgagttctctctcctctcctctctctctccctttcyctctctctctctctctctctctctctctctctctctctctctctcgtgctggatgcctgctttctctcctactgcccaaaactcaaggttttgggacttaacaccagtggcctcttgggggttctcaggcctttggcatcacacagagcttcattgtcagcttccctggtttgaagctttcagacttaggctgagccttgctactggtttctctctgtccccagcttgcagatggccaatcgtgggactttgccttgtaattgcataagccaattttccctaatagactcctctctctct

SEQ ID NO: 195980 - DNA, 601 bp, Human
caaatatttaaaagaatacatttcaatgtagtctctccccattaagtttgctttttttggtgatttcttatgatccacatgcaggaattccatcaactaggaaaacttcagtttgagcatgtttttttctattatactggccacttctgcttctgtaacattcttatagtctcttcttcaggatgaacttctacccatgagctgtatcttcactccttggtccctaaatctatcatctttgcttgtgcttctctttatgtgttgggagaactcctccagcttgtcctcatatcactaaatygattctctatagtgttgcttctcgtctttaccacatctcatgcaaattttaattctaatattacatttcctccccttaaaatcttttctcatgttattgagttcccttttcatctgcctttcaaagtgactttcttttcttctcaatatggttgccttatcatctcacccttcatcttttgtttcacctatcgaggtcatcttgagttttactgacaacaaaaaggaaggcaattttcaaattttgtctttgtatgtcaggtaatttttgttattgttgcatgttctctaaagaaacttt

SEQ ID NO: 195981 - DNA, 601 bp, Human
aacctaattgttgttcatttgtagtgctttcttatttccaacctagatgcttgcagaactttttttttaaactttaaactcaaatatttaaaagaatacatttcaatgtagtctctccccattaagtttgctttttttggtgatttcttatgatccacatgcaggaattccatcaactaggaaaacttcagtttgagcatgtttttttctattatactggccacttctgcttctgtaacattcttatagtctcttcttcaggatgaacttctacccatgagctgtatcttcactccttggyccctaaatctatcatctttgcttgtgcttctctttatgtgttgggagaactcctccagcttgtcctcatatcactaaatcgattctctatagtgttgcttctcgtctttaccacatctcatgcaaattttaattctaatattacatttcctccccttaaaatcttttctcatgttattgagttcccttttcatctgcctttcaaagtgactttcttttcttctcaatatggttgccttatcatctcacccttcatcttttgtttcacctatcgaggtcatcttgagttttactgacaaca

SEQ ID NO: 195982 - DNA, 601 bp, Human
tcaccacatttgctttatcacgtcttcccacctatctgccttgatttgagtcatcttccagtcaattgcaatatagcttcataaaatgctttttaggaattctatggaaagtctctagcaccttatgtaattggtaatgtctttctgctgctttcctacatgaccaactattgacttggggtagaattactgtattgtgtttctttgtgctcaaaatttgtatgttgttctaatagcttctgacctttagtattgatatggataagtcagagaacaacctaattgttgttcatttgtagtsctttcttatttccaacctagatgcttgcagaactttttttttaaactttaaactcaaatatttaaaagaatacatttcaatgtagtctctccccattaagtttgctttttttggtgatttcttatgatccacatgcaggaattccatcaactaggaaaacttcagtttgagcatgtttttttctattatactggccacttctgcttctgtaacattcttatagtctcttcttcaggatgaacttctacccatgagctgtatcttcactccttggtccctaaatctatcatctttgcttgt

SEQ ID NO: 195983 - DNA, 601 bp, Human
ggaattggcactttagactttaaagagaagccaaacaattttaatgatctacttggaaaacaaacaacactcctacaccctactttgagtccattagtaatgaattcccatttttccagctgctgtttacttaccacgttgattttacagggcttaaaaactacataaacagagaaggatcatccactatctgcgtatcctcatagctttctgtttctgacactagtctgatgatcagggggcatcagtcctccctttatgtctggaatctggtccagatgttttgctcttaccaaaatayttccaatgccgtatttactgaccgcaagaatagaacaacataaaaatacaatggaaaacaggaacccatttgttcagattaggtgttagctgtagataaaatcaaggaaagagtaaaaaggttttcatcaatgaaagttatacctcttattattattgttgttgtcatgcatttcaatttgttagctatttgtagagctataaaagaaaaaacattttctatgctctgcttgctacagtacatgttatacctgctaggaaaaaccacaatgataaatgactaccatttgctttttaaaaa

SEQ ID NO: 195984 - DNA, 601 bp, Human
acgttcctgacgttgtaggagcaaatacctcagcctcagcacctcagctgtgatttttgtcacataaaaaagaactgcagcatgcagaaaacgaattttaagaatgataaataaatatcaggaaaataccgaaattaacaactctggcaaaggtaaggtgctaaggaattggcactttagactttaaagagaagccaaacaattttaatgatctacttggaaaacaaacaacactcctacaccctactttgagtccattagtaatgaattcccatttttccagctgctgtttacttaccaygttgattttacagggcttaaaaactacataaacagagaaggatcatccactatctgcgtatcctcatagctttctgtttctgacactagtctgatgatcagggggcatcagtcctccctttatgtctggaatctggtccagatgttttgctcttaccaaaatacttccaatgccgtatttactgaccgcaagaatagaacaacataaaaatacaatggaaaacaggaacccatttgttcagattaggtgttagctgtagataaaatcaaggaaagagtaaaaaggttttcatcaatgaaa

SEQ ID NO: 195985 - DNA, 601 bp, Human
aagggattaataaccagaatacataaggatctcaaacaactctatggggaaaaaatctaataattccaattaaaaaatgggcaaaagatctgaatagacagttcacaaaagaagacataaatagcaaacaagtatgtgaaaaggtgctcaacctcactgatcatcagagaaatgcaaatcgaaactacaatgagatctcatctcaccccagttaaaacggcttttatccaaaagacaggcaataacaaatgctggcgaggaagtagagaaaaaagaaacctcatatactgttggtggaaakgtaaattaatgcaactattatggtgaacagtttggaggttcctcaaaaaaaaaaaaaaacacaaaaactaaaagtagagataccatatgatccagcaatcccactgctaggtatatactcaaaaaaaaaaaaaaacaaaaaaaaaagggaaatcaatatatcaaggaggtatctgcactcacatgtttattgcagcactattcacaatagccaagatttggaagcaacctaagtatccatcaacagatgaatggataaagaaaatgtgatacatatatacaatggagtactattcagcca

SEQ ID NO: 195986 - DNA, 601 bp, Human
cttttagtctcagttgaattgatactacatctctgggagaggatatctttccatgacctatagatggtgttgccacaggtgattttttaaacttgttccatacgaacataatgtttattattaacctgtaacttgtctctagatatctatcaatttggttgtataagattttaccatcactaaatatacatgttatcacctttcctttgctagataatttaagcaggcaacgaaactggactcctatcttttgccatatacaaaaattaaataaaaatggattaaatacttaaatataagkcttcaaactatgaaactaccaaaaggaaacattgggaaagctctctaggacactggactgggtaaagatttcttgagtaatatcccaaaagcacaggcacacaaagcgaaaatggacaaatgggattacgtcaagttaaaaagcctctgcactgccaagggaacaatcaacaaagacaacctgcagaatgggagaaaatatttgtgaactacccatctgacaagggattaataaccagaatacataaggatctcaaacaactctatggggaaaaaatctaataattccaattaaaaaatg

SEQ ID NO: 195987 - DNA, 601 bp, Human
atcagcttggcagacttgatttgagaggttcacgtgagaaagactatgttagaagaatctcaggttgatcttatataatatatccgggacacatatttcaaaaatggctcttactatctgatgggattaggattaactattttttctttgttgaatacattctatccagttcaacatcttaagttaggaaggccctaatattgcaaatattaactttcaaactcagaaaacagaaaaggacaatgaagagtacctccgagtgagcatcagaaatcggagatgaagaacatgaaccacacayctacacttataacaaagcagttttaaaaacgtttctgctggctcaaaggtacaggtaatagtttaaataaaaatgcctgttacagaatatatacagtacatttttctataagataatattttatttgggaatgaaaaagaaatgttaacagctatactactcattatatgtccaagtatttactcatattcttagaaacttatttccctctcttatgagaatctcctattacgaggatgtggctctccaaatgtgcaatccctagccatgacatacttccttctttctgccctgtcatga

SEQ ID NO: 195988 - DNA, 601 bp, Human
attttagttttgaacaaatgggttggagtccaactctttaaacaggattctgacaacatcagcttggcagacttgatttgagaggttcacgtgagaaagactatgttagaagaatctcaggttgatcttatataatatatccgggacacatatttcaaaaatggctcttactatctgatgggattaggattaactattttttctttgttgaatacattctatccagttcaacatcttaagttaggaaggccctaatattgcaaatattaactttcaaactcagaaaacagaaaaggacaaygaagagtacctccgagtgagcatcagaaatcggagatgaagaacatgaaccacacatctacacttataacaaagcagttttaaaaacgtttctgctggctcaaaggtacaggtaatagtttaaataaaaatgcctgttacagaatatatacagtacatttttctataagataatattttatttgggaatgaaaaagaaatgttaacagctatactactcattatatgtccaagtatttactcatattcttagaaacttatttccctctcttatgagaatctcctattacgaggatgtggc

SEQ ID NO: 195989 - DNA, 601 bp, Human; identical to SEQ ID NO: 22779

SEQ ID NO: 195990 - DNA, 601 bp, Human; identical to SEQ ID NO: 22780

SEQ ID NO: 195991 - DNA, 601 bp, Human; identical to SEQ ID NO: 22781

SEQ ID NO: 195992 - DNA, 601 bp, Human; identical to SEQ ID NO: 22782

SEQ ID NO: 195993 - DNA, 601 bp, Human; identical to SEQ ID NO: 22783

SEQ ID NO: 195994 - DNA, 601 bp, Human; identical to SEQ ID NO: 22784

SEQ ID NO: 195995 - DNA, 601 bp, Human; identical to SEQ ID NO: 22785

SEQ ID NO: 195996 - DNA, 601 bp, Human; identical to SEQ ID NO: 22786

SEQ ID NO: 195997 - DNA, 601 bp, Human; identical to SEQ ID NO: 22787

SEQ ID NO: 195998 - DNA, 601 bp, Human; identical to SEQ ID NO: 22788

SEQ ID NO: 195999 - DNA, 601 bp, Human; identical to SEQ ID NO: 22789

SEQ ID NO: 196000 - DNA, 601 bp, Human; identical to SEQ ID NO: 22790

SEQ ID NO: 196001 - DNA, 601 bp, Human; identical to SEQ ID NO: 26597

SEQ ID NO: 196002 - DNA, 601 bp, Human; identical to SEQ ID NO: 26598

SEQ ID NO: 196003 - DNA, 601 bp, Human; identical to SEQ ID NO: 26599

SEQ ID NO: 196004 - DNA, 601 bp, Human; identical to SEQ ID NO: 26600

SEQ ID NO: 196005 - DNA, 601 bp, Human; identical to SEQ ID NO: 26601

SEQ ID NO: 196006 - DNA, 601 bp, Human; identical to SEQ ID NO: 26602

SEQ ID NO: 196007 - DNA, 601 bp, Human; identical to SEQ ID NO: 26603

SEQ ID NO: 196008 - DNA, 601 bp, Human; identical to SEQ ID NO: 26604

SEQ ID NO: 196009 - DNA, 601 bp, Human; identical to SEQ ID NO: 26605

SEQ ID NO: 196010 - DNA, 601 bp, Human; identical to SEQ ID NO: 26606

SEQ ID NO: 196011 - DNA, 601 bp, Human; identical to SEQ ID NO: 26607

SEQ ID NO: 196012 - DNA, 601 bp, Human; identical to SEQ ID NO: 26608

SEQ ID NO: 196013 - DNA, 601 bp, Human; identical to SEQ ID NO: 26609

SEQ ID NO: 196014 - DNA, 601 bp, Human
gttgagtaagggaaaagtaggattggaacccgtgctgttcctgattttaggacactagtcttagccccttccttaaacagattaacttaggtgggccacttgttatgcaaggaaaacttcagttactttgactggtgatttaataaaactcgacatcatgaagattccaatttacctgccttcccttagaatctctggtaaccatatgaaggtgcaaatcattcattcccacgttcacaagcccttcattagctgactaggccatggaaagaagggacttagaaatgattaaccaggatgycattgctgatgtcaaggagtggcattctgggaggagagggaggaagtctactgaaaggtagaaaaatgaaaaaaactataggatagctatttaataaacggcagtgagagttgggaggaacgagatgaccacccctgaaacatattttagaatgaaagagatgaaggatatctgtctgctttttgttgccatgtggaaaatttgcttcttggtttctagatccatgtagaggtaggttattaccttttctttgtgcagttcccagctatgtgagcagtacacagcttccctaagtttaac

SEQ ID NO: 196015 - DNA, 601 bp, Human
atggattttatttcctgaaccccaggaaaagaaattttgaatttgaaaacacttatgtcaccagtttgtggatgttggaactgtgtgtgtcattggtcaaacaccagtcatttgcaaatggctccccttaacaggagaatctacccaggaaattccgtatcttactggcagaacttgctgctttaaagtgtttattatagtctcagctacttggaggattacttaataagcccaggagttctaggctgccatggactgtaatcttgcctgtgaataatcactgtactccaggctgggcaayatagtgagatcccatctcaaaaactatatatgttgattgtagaaaattcgaaaatatggacaactataaagaaggtagtaaaaatggattgtaattcttaacatgctagtatatttttcttcaagcatttttataagcatgtactttatttcatagcttacacagaagatagatgcagttttgcttcctgctttatttatttttatgtatttatttattttttgagacggagttttgctgttgttgcccaggttgaaatgcagtggcacaatcttggctcactgcaacctccgcctcccg

SEQ ID NO: 196016 - DNA, 601 bp, Human
aaaaagaatctaaattctaatgttctggataatagtgatcacattccaaaatgagaatgttatctgtaatcttgtactttatacttctattaaaatgttctataaatttttcatggcttggtggttctgggtagctaaggttatgcaagcagcagcgttgcagtgtgacgtggagggagtactgtgtattcagatccggggagcacctgctgactaaattacctctgctcgaccccagcaggacaccctgactttttaacacactcgttagaattctaaaatgtcaggctcacagtttatrtattagttctctatggcttttgtttacgttaatagtactgacttgtttttttcctagatagctgtaaaccacatgagtggactttttaatgacagccagattcgtctttgttttatagagttgttgcctgcaatctctatccctttgtaaagacagtggcttctccaggtgtaagtgttgaggaggctgtggagcaaattgacattggtaagtcagaaaaaccattttagaagactgagaggagaggattatttaaattttagtgagatttcattttgaattttattactgaggaaatag

SEQ ID NO: 196017 - DNA, 601 bp, Human
tggctgactgcaacctctgcctcctgggctcaagtgattctcttgcctcagcctcctgagtagctgggattacaggtgcacaccaccacgcctggctaattttttttgtattttttatagagatggaatttcgccatgttggccagagtggtctcgaactcctgacctcaggtgatccacctgcctcagcctcccaaagtgctgggattccaggcatgagccactgcgcccagcttattttcctgatttttaagtcaggaattaaaatggaagtacatgcacaatgactttatttaaaagyggttcataagctgatagggacatacaaaaatcaatacgtcttttgttcttcaaaggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggtgggatgcactttcatgatattgtaagttacatccatggagtgcagtgtttgccagaccaagcagtattcagttcttggtagattgcattac

SEQ ID NO: 196018 - DNA, 601 bp, Human
tggccaggctggtctcaaactcctgacctcaagttatctgcctatctcagcctccccagagtgctgggattacaggcgtgagccaccacacctggcctcagatctcagatacactttgacactaacacttcccaaatccccacagacaccctgtgaagtcctgtaggctgaagtaatctaagtaatttgttttctctcggcctttctgggcttcacagcacagtaatcttttaaaaatggaaatcggatgatgtcagaccctacttaaagccattccttggcttttcttaagcactttgcsctgccccacaaaccctgtgctgcctgcctgcctcctatctgccccctcagcagctctccctgcgcctgctgctagcccctccgccctgtgcctccaagtgggcccagctctttccactccagcgcctctggctccttgtccccttcacccagaattcttccctctgcccttcaccgtcctggtttcttgttattcaggcctcacctcctcagagaagccttccttgaccgcttagaccaaagtagcagcccatcatgcttccatcccatcaccctgttttgctgcatgtgtttctattca

SEQ ID NO: 196019 - DNA, 601 bp, Human
tgcagaatagtttcaatgccctaaaactcccttgtgctcctccgcctcatccctcctttcccttctccccaaccctttgcaaccactgttatctttttctcttttcttttttttttttttggaatggagtcttgctatgttgtctgagctggttttgatatcctgggactcaagcagtccttccgccttggcctctcaagtagctgggattacaggcatgcaccaccatgcccagctgtttttactgactctgtacccatttccagaatgtcagatagttgggatcatacagtatggagcmcttttaggcactttcagttaacaacatgcattaagtttcttccacatctttttgtgggttggtagcttatttcttaatgctgaataatatttcactgtgtatgaatgtaccacagtttatccatggacatattgaagggcatcaaaacttcaaggacagtttttggtagtttatgaacaaaattgctataatcatttgtgtgcaagttttcaactcattttgataaatacctaatattttcttttattgtatactatttattgcctattttttatttgcctccccagtaagctccataag

SEQ ID NO: 196020 - DNA, 601 bp, Human
tgcattaagtttcttccacatctttttgtgggttggtagcttatttcttaatgctgaataatatttcactgtgtatgaatgtaccacagtttatccatggacatattgaagggcatcaaaacttcaaggacagtttttggtagtttatgaacaaaattgctataatcatttgtgtgcaagttttcaactcattttgataaatacctaatattttcttttattgtatactatttattgcctattttttatttgcctccccagtaagctccataaggacagtgacttttttttaagagggttscagggacggtttttttcactgatgtatcctgaatacctagaacagtgcttaacatcgtagtaggcaactcagtaaatatttggcaaggtctttaaaaactatcttaacccatgaaggacatgaaattacacatttttgttttttgggttttttttttttttttttgagacggagtctcgctcttgttggccaggctggagtgcagtggcgcggtttcggctcactacaacctccaccttccaggttcaagcgattctcctgcctcagcctccctagtagctgggattacatgcgcccgcc

SEQ ID NO: 196021 - DNA, 601 bp, Human
aagtttcttccacatctttttgtgggttggtagcttatttcttaatgctgaataatatttcactgtgtatgaatgtaccacagtttatccatggacatattgaagggcatcaaaacttcaaggacagtttttggtagtttatgaacaaaattgctataatcatttgtgtgcaagttttcaactcattttgataaatacctaatattttcttttattgtatactatttattgcctattttttatttgcctccccagtaagctccataaggacagtgacttttttttaagagggttgcagggmcggtttttttcactgatgtatcctgaatacctagaacagtgcttaacatcgtagtaggcaactcagtaaatatttggcaaggtctttaaaaactatcttaacccatgaaggacatgaaattacacatttttgttttttgggttttttttttttttttttgagacggagtctcgctcttgttggccaggctggagtgcagtggcgcggtttcggctcactacaacctccaccttccaggttcaagcgattctcctgcctcagcctccctagtagctgggattacatgcgcccgccaccaca

SEQ ID NO: 196022 - DNA, 601 bp, Human
gtttatccatggacatattgaagggcatcaaaacttcaaggacagtttttggtagtttatgaacaaaattgctataatcatttgtgtgcaagttttcaactcattttgataaatacctaatattttcttttattgtatactatttattgcctattttttatttgcctccccagtaagctccataaggacagtgacttttttttaagagggttgcagggacggtttttttcactgatgtatcctgaatacctagaacagtgcttaacatcgtagtaggcaactcagtaaatatttggcaagktctttaaaaactatcttaacccatgaaggacatgaaattacacatttttgttttttgggttttttttttttttttttgagacggagtctcgctcttgttggccaggctggagtgcagtggcgcggtttcggctcactacaacctccaccttccaggttcaagcgattctcctgcctcagcctccctagtagctgggattacatgcgcccgccaccacacccagctaatttttgtgtttttagtagagacgggggtttcaccatgttgaccaggctgatctcgaactcctgaccttgtgat

SEQ ID NO: 196023 - DNA, 601 bp, Human
actatttattgcctattttttatttgcctccccagtaagctccataaggacagtgacttttttttaagagggttgcagggacggtttttttcactgatgtatcctgaatacctagaacagtgcttaacatcgtagtaggcaactcagtaaatatttggcaaggtctttaaaaactatcttaacccatgaaggacatgaaattacacatttttgttttttgggttttttttttttttttttgagacggagtctcgctcttgttggccaggctggagtgcagtggcgcggtttcggctcactrcaacctccaccttccaggttcaagcgattctcctgcctcagcctccctagtagctgggattacatgcgcccgccaccacacccagctaatttttgtgtttttagtagagacgggggtttcaccatgttgaccaggctgatctcgaactcctgaccttgtgatccacccacctcggcctcccaaagtgctggggtcatgggggtgagccattgtacccggctcatttttgtttttaattagtgctggcccaccatttctttctgtgtgctgaacttcttatgtttattcacaagagatact

SEQ ID NO: 196024 - DNA, 601 bp, Human
aaagtgaaatgtcctaatgcaatagactaagtcttgtgccacatctttgaaaatgtaatggagtaaacataaagaagttcttctttggactctttatctgaaacttcttatagtcgttgtatgagatactttgcttctgtgtttaaatcatgaactccgcaattgagttgtctgtacaccacatcttgctgacagtcctccagcacatgatttgttctcaggtgtttattgggtgttaaagtgatgtgagtggggaagaaataaatgatgtgtgatatcaaagtgatatcaagcagaacakagagaaagagtgagtcagtaatgaagtaaacgagcttcacctacacgctgggtactgtcaggcttcagtggctctgtggttttggagggcagagaggagatttccctcacactgctcccacaaccatatttttagtgtataattatctggctaaatagatttctgtttaatttagcacaggcactagaaaatgtgctgcgtagactgggtgttaagaaaactgtcttgatttaggagttgacaggtagtaactttagctttctttgtttatgattttactattttctaaccaggtgctgc

SEQ ID NO: 196025 - DNA, 601 bp, Human
gcaatagactaagtcttgtgccacatctttgaaaatgtaatggagtaaacataaagaagttcttctttggactctttatctgaaacttcttatagtcgttgtatgagatactttgcttctgtgtttaaatcatgaactccgcaattgagttgtctgtacaccacatcttgctgacagtcctccagcacatgatttgttctcaggtgtttattgggtgttaaagtgatgtgagtggggaagaaataaatgatgtgtgatatcaaagtgatatcaagcagaacagagagaaagagtgagtcartaatgaagtaaacgagcttcacctacacgctgggtactgtcaggcttcagtggctctgtggttttggagggcagagaggagatttccctcacactgctcccacaaccatatttttagtgtataattatctggctaaatagatttctgtttaatttagcacaggcactagaaaatgtgctgcgtagactgggtgttaagaaaactgtcttgatttaggagttgacaggtagtaactttagctttctttgtttatgattttactattttctaaccaggtgctgctgttggaattccactcag

SEQ ID NO: 196026 - DNA, 601 bp, Human
cagtcctccagcacatgatttgttctcaggtgtttattgggtgttaaagtgatgtgagtggggaagaaataaatgatgtgtgatatcaaagtgatatcaagcagaacagagagaaagagtgagtcagtaatgaagtaaacgagcttcacctacacgctgggtactgtcaggcttcagtggctctgtggttttggagggcagagaggagatttccctcacactgctcccacaaccatatttttagtgtataattatctggctaaatagatttctgtttaatttagcacaggcactagaaaaygtgctgcgtagactgggtgttaagaaaactgtcttgatttaggagttgacaggtagtaactttagctttctttgtttatgattttactattttctaaccaggtgctgctgttggaattccactcagtgaagatgaggccaaagtctgcatggtttatgatctctataaaaccctcacacccatctcagcggcatatgcaagagcaagaggtcagactcatagggctttttgatttgggggagaaagaaaaagcaatattttatcctaaatagaataaagaggatagaataaagaaaaaat

SEQ ID NO: 196027 - DNA, 601 bp, Human
gtcaggagatcgagaccatcctggctaacacggtgaaaccccgtctctactaaaaatacaaaaaattagctgggcgtggtggggggtaccctgtagtcccaggtactcaggaggctgaggcaggagaatggtgtgaacccggcaggtggaacttgcagtgagccaagatagcgccagtgcactccagcctgggtgacagagcgatactccgtctcaaaaaaaaaaaagtatttgttagtattttagtgtaataaatggaaacacaattggaatttggtcaatgtaattttgctaatttagsctattgaatgcatttgttattgtttaatatgtgaccaaaattgaaattacaaaaagctattcttttttttttttttttttttttgagacagcttcttgctctgttgcccaggctggagtgcagtggcgccatctcagctcactgcaacctccacctcctgggttcaagcgattctcctgcctcagcgtcctgagtagctgggattacaggtgcgtgccaccacacctggctaatttttttgtatttttagtagagacatggtttcaccatgttggccaggctggtcttgagctcctgacc

SEQ ID NO: 196028 - DNA, 601 bp, Human
actgcaacctccacctcctgggttcaagcgattctcctgcctcagcgtcctgagtagctgggattacaggtgcgtgccaccacacctggctaatttttttgtatttttagtagagacatggtttcaccatgttggccaggctggtcttgagctcctgacctcaagtgattcacctgcctcagcctcccagagggctgggattacaggcgtgatttatggctcttctaactttactacatttggttagagtcatgttttatcagagacatttacttgttgaatttaataacccatgaatatycctttagtatttctgaaagttcttgagaaactattaccatagtttatcatctacagcagtggtcagcaacttcagctgaatccagcctgccaccctgtttttgtgaatatagtatatataaattggtccttcacagaaaaagttttctgagtgtcactctagagggtaaaattaaagaatactttcttactggttacttcagttaaatgacttattgatctgttaaaatcttatgtaaacagtaagattagctttagagtaatgaattttatatgacagtggagaattttattacttttt

SEQ ID NO: 196029 - DNA, 601 bp, Human
cctccacctcctgggttcaagcgattctcctgcctcagcgtcctgagtagctgggattacaggtgcgtgccaccacacctggctaatttttttgtatttttagtagagacatggtttcaccatgttggccaggctggtcttgagctcctgacctcaagtgattcacctgcctcagcctcccagagggctgggattacaggcgtgatttatggctcttctaactttactacatttggttagagtcatgttttatcagagacatttacttgttgaatttaataacccatgaatatccctttartatttctgaaagttcttgagaaactattaccatagtttatcatctacagcagtggtcagcaacttcagctgaatccagcctgccaccctgtttttgtgaatatagtatatataaattggtccttcacagaaaaagttttctgagtgtcactctagagggtaaaattaaagaatactttcttactggttacttcagttaaatgacttattgatctgttaaaatcttatgtaaacagtaagattagctttagagtaatgaattttatatgacagtggagaattttattactttttctgtatc

SEQ ID NO: 196030 - DNA, 601 bp, Human
ctcctgcctcagcgtcctgagtagctgggattacaggtgcgtgccaccacacctggctaatttttttgtatttttagtagagacatggtttcaccatgttggccaggctggtcttgagctcctgacctcaagtgattcacctgcctcagcctcccagagggctgggattacaggcgtgatttatggctcttctaactttactacatttggttagagtcatgttttatcagagacatttacttgttgaatttaataacccatgaatatccctttagtatttctgaaagttcttgagaaactrttaccatagtttatcatctacagcagtggtcagcaacttcagctgaatccagcctgccaccctgtttttgtgaatatagtatatataaattggtccttcacagaaaaagttttctgagtgtcactctagagggtaaaattaaagaatactttcttactggttacttcagttaaatgacttattgatctgttaaaatcttatgtaaacagtaagattagctttagagtaatgaattttatatgacagtggagaattttattactttttctgtatcaggatactttgtgataaatacctcat

SEQ ID NO: 196031 - DNA, 601 bp, Human
tacatttggttagagtcatgttttatcagagacatttacttgttgaatttaataacccatgaatatccctttagtatttctgaaagttcttgagaaactattaccatagtttatcatctacagcagtggtcagcaacttcagctgaatccagcctgccaccctgtttttgtgaatatagtatatataaattggtccttcacagaaaaagttttctgagtgtcactctagagggtaaaattaaagaatactttcttactggttacttcagttaaatgacttattgatctgttaaaatcttaygtaaacagtaagattagctttagagtaatgaattttatatgacagtggagaattttattactttttctgtatcaggatactttgtgataaatacctcattttaattttatttacaggggctgataggatgtcttcatttggtgattttgttgcattgtccgatgtttgtgatgtaccaactgcaaaaattatttccagagaagttagtggacattcatgtatcttaatctgtgtgttgaataaagctttatttgttcataatgttaattgaaaccataacctataatatttatatttata

SEQ ID NO: 196032 - DNA, 601 bp, Human
cagagacatttacttgttgaatttaataacccatgaatatccctttagtatttctgaaagttcttgagaaactattaccatagtttatcatctacagcagtggtcagcaacttcagctgaatccagcctgccaccctgtttttgtgaatatagtatatataaattggtccttcacagaaaaagttttctgagtgtcactctagagggtaaaattaaagaatactttcttactggttacttcagttaaatgacttattgatctgttaaaatcttatgtaaacagtaagattagctttagagwaatgaattttatatgacagtggagaattttattactttttctgtatcaggatactttgtgataaatacctcattttaattttatttacaggggctgataggatgtcttcatttggtgattttgttgcattgtccgatgtttgtgatgtaccaactgcaaaaattatttccagagaagttagtggacattcatgtatcttaatctgtgtgttgaataaagctttatttgttcataatgttaattgaaaccataacctataatatttatatttataatatcttttaattagctaagtttatc

SEQ ID NO: 196033 - DNA, 601 bp, Human
aactgcaaaaattatttccagagaagttagtggacattcatgtatcttaatctgtgtgttgaataaagctttatttgttcataatgttaattgaaaccataacctataatatttatatttataatatcttttaattagctaagtttatcatttaatgttcatattttaaatagaacatgaatcttaaattgttaattttgaaatgtagtgaattattgtttcagatggatatttggctgttatgatgttttttacttatatatttattttaaattctttgttgtcttcatgccaaagttaytgtttctgaagagcagaagttgtaattttaggtggtgatgcgatataatccatcttactgcatagtgggtaaaaaacagaaactacattaataaacttaccccatcagttgaataccaaacaggtattccagacaggtgggggtactgttggtagtaggaagacaggaagaaaagagaaaaagattaaatagctcagaaaggggaaaaaaataagcagaggtgaaggctgaaggagcatgtggcttggcactattttgttgctttaggattctttccatggccactgccatccctgggtt

SEQ ID NO: 196034 - DNA, 601 bp, Human
ggtataattgccccaggatatgaagaagaagccttgacaatactttccaaaaagaaaaatggaaactattgtgtccttcaggtgagtgcaattcatgtttgaagcggtaatttgctcttttattctgtgtctctttctccgttgtttactctttcctttatactcatacccttctagtttatccttattatagtttattttccccaatcctgcatttaaaaaaatactattaacttggggttttgagatgagagtagctttcttaccctcaattttaactttttgctggttgtgatggctyatgcctataatttcagccacttgagaggctgatgtgggaggatggcttgaggccaagaattggaggctgtattgtggtactatgatgcctgtgaataacgactgcactccagccttggcagtgtagtaagaccatgtctctaaaatactaataatagtaacaatatttaatggaaagtctctccatccttctgttaccttttgaaaagataactattttaaatttcttgcttatctttcctgaaatagtctatatattcagcaaatatttgcatgtgcatttctttttctattttcctat

SEQ ID NO: 196035 - DNA, 601 bp, Human
ttttttccatgtgctaggctacaaatgtgtttttatatcaatacatatagatgctgggtgcagtagctgacatttgtaatcccaacactttggtaggccaaggggcagctctcttgaggtcaggagtttaagaccagcctgaccatgtagtgaaaccttgtctctagaaaaagtacaaaaattagcctggcgtggtagctgcgcctgtaggtccagctactcgagaggctgaggtgagaggattgcatgagtctgggagatcaaggctgcagtgagccgtgtttgtgccactgcactcctmtctgggtgacagaacaagatcctatctcgaaaataaatgcatattcatatctttatctgaaagtccatgtggcagtcagtccatgtgtagatgtactacgatggatatttattgttcttatttttaccctgattgattgatttatttttttattttattttttctgagacagagtctcgctctgtcacccaggctggagtgcagtggtgcgatctcgggtcactgcaagctccgcctcccgggttcacgccattctcctgcttcagcctcccaagtagctgggactacaggcgcccgcca

SEQ ID NO: 196036 - DNA, 601 bp, Human
ggtcactctatgggggtgactaccatcgtgtcaattgtgaagatcacaaaattgtaccataaaggacaattaagaaatttgaccggagttacacaataaagaatggacaagctgacatttattttttggagtatcttaattgggccttcagtttgaaggatgtttgtcctaggtctaaagtaggctgtgcttgttgttcagtactttgcaggaatcattccattgctttctggtctgtctggctgatagcctggaattttttattgagtgctaggcattgggtatgaaaaaactgtagcgrtattttgagggctggatggtgttatttttctctccagagttgacttgtccttcttttgggcagataaggtgtaggaggtatcttcattctgtcaggaattgttgagcttcctaaaggctaaataggaatttagccttcagtctttgtgaggactggtctgttcatggttcattcctgctcctgaatccctaggtatctactgctctacgctgaactcggcttttgtcccttagtcctctaagactgccaaaagttgtgctcagccaatttacctttagtttattgcatgcaacttggaaa

SEQ ID NO: 196037 - DNA, 601 bp, Human
ttgcaggaatcattccattgctttctggtctgtctggctgatagcctggaattttttattgagtgctaggcattgggtatgaaaaaactgtagcgatattttgagggctggatggtgttatttttctctccagagttgacttgtccttcttttgggcagataaggtgtaggaggtatcttcattctgtcaggaattgttgagcttcctaaaggctaaataggaatttagccttcagtctttgtgaggactggtctgttcatggttcattcctgctcctgaatccctaggtatctactgctstacgctgaactcggcttttgtcccttagtcctctaagactgccaaaagttgtgctcagccaatttacctttagtttattgcatgcaacttggaaaatgccttgaggagaaaagcatagactgtcaggcccatttcttactgcttccattttctctgggatctttgtctgttagcacttgctgtctgtccgctctgcccagcatttctgtttgttactaaaagaggattggtctcttaagctatttgctgtaacagaaggagatgaggggctgcagcttgctcccaggtctgaatcctgag

SEQ ID NO: 196038 - DNA, 601 bp, Human
gaactacatgggggaaactgcccccatgatccagttacctccacctagtcccgcctgttgacacatggggattattataattcagggtgagatttaggtggggacacagccaaaccgtatcaccaagattatctttgaaggtctagacatctatgaagctggcttttgctactaagttttctgggaaccagaggaatcagatttatagttgatgactcaaatagcagataaagataaaagatatataacattaataataccttagagtaataaattcttaagaaatcctaatagcttttttaaattaaactttttaattttgagataaaagttgtagattcatatacagttgtaagagttcccatgtaaccgttaccctatttctcctaatgctagcatttgtcacactacagtacagttccacaaccatgccattgacattgataacagttaaagacacagggcatttccaacactgcagtgatccctcatgttcttttgtatccgggctcacttgatatggcttccaccctctccttacccttgggcaaccacaaatctgtttttcctttctataattttcattcatcgtgcattcatg

SEQ ID NO: 196039 - DNA, 601 bp, Human
tcccgcctgttgacacatggggattattataattcagggtgagatttaggtggggacacagccaaaccgtatcaccaagattatctttgaaggtctagacatctatgaagctggcttttgctactaagttttctgggaaccagaggaatcagatttatagttgatgactcaaatagcagataaagataaaagatatataacattaataataccttagagtaataaattcttaagaaatcctaatagcttttttaaattaaactttttaattttgagataaaagttgtagattcatatacasttgtaagagttcccatgtaaccgttaccctatttctcctaatgctagcatttgtcacactacagtacagttccacaaccatgccattgacattgataacagttaaagacacagggcatttccaacactgcagtgatccctcatgttcttttgtatccgggctcacttgatatggcttccaccctctccttacccttgggcaaccacaaatctgtttttcctttctataattttcattcatcgtgcattcatgtacagtttttgtgtgtgtgtgtgagcataaggtttttgtcttttgggg

SEQ ID NO: 196040 - DNA, 601 bp, Human
atgaagctggcttttgctactaagttttctgggaaccagaggaatcagatttatagttgatgactcaaatagcagataaagataaaagatatataacattaataataccttagagtaataaattcttaagaaatcctaatagcttttttaaattaaactttttaattttgagataaaagttgtagattcatatacagttgtaagagttcccatgtaaccgttaccctatttctcctaatgctagcatttgtcacactacagtacagttccacaaccatgccattgacattgataacagttraagacacagggcatttccaacactgcagtgatccctcatgttcttttgtatccgggctcacttgatatggcttccaccctctccttacccttgggcaaccacaaatctgtttttcctttctataattttcattcatcgtgcattcatgtacagtttttgtgtgtgtgtgtgagcataaggtttttgtcttttggggaaacagggtccaactctgttgtccaggctggagtgcaatggctcggtcttggctcactgcaatctccgcctcccgggttcaagcgattctcctgcctcagcctc

SEQ ID NO: 196041 - DNA, 601 bp, Human
acacagggcatttccaacactgcagtgatccctcatgttcttttgtatccgggctcacttgatatggcttccaccctctccttacccttgggcaaccacaaatctgtttttcctttctataattttcattcatcgtgcattcatgtacagtttttgtgtgtgtgtgtgagcataaggtttttgtcttttggggaaacagggtccaactctgttgtccaggctggagtgcaatggctcggtcttggctcactgcaatctccgcctcccgggttcaagcgattctcctgcctcagcctcccarggagctgggattacaggcatgcggcaccacacctggctaatctttgtattttcagtagagacggggtttcaccatgttggtcaggctggtcttgaactcctgactcaggtgatctacccgcctgggattacaggcatgagccactgtgcccagcctaaacgtaagtttttatttctctttgataaatgcccagggttgttaactgctttgtggtatggtagttgcatgtttagtttactaagaaactgctgaattgttttccagagtggcttgtaccattttgtattcccaccagcaatg

SEQ ID NO: 196042 - DNA, 601 bp, Human
aaagttcttaattttactgaagtcaaatttatcaacttatctgttggctgtagcaaatatcctctgtccatttagcatacagacgtggactatcatccttcttttccatttgtattcatgcctgatactaaagatagtgatatttttgggcgttattcttgttgttctatttggactggtaattcctaatggtttttgaacagtttcaacttaagttattctaaacaaaagagaaaatgatcgtaatttgatttttccaaagtcttggctgtctgtgtgcatcataacgatttgtgatgtytatgaaacaattctccgcattggttctgaacgtaaattttaccatgtctccagatatttaaaagtactctggtcaagaaaatattgtttgtcagttttggaatggatatggtagttcttacctcatgtgatataaaaaggcttaatccacaattgctacaaaataacatgagtttgtgtctatggatgcattgtgctaagttccaccccaaatgtgttaaatatttaagtaaatcatggtagtgtgtaggagaacagttaatttccctctgtcatttgagtggtataactatgttgtagg

SEQ ID NO: 196043 - DNA, 601 bp, Human
ttgttgttctatttggactggtaattcctaatggtttttgaacagtttcaacttaagttattctaaacaaaagagaaaatgatcgtaatttgatttttccaaagtcttggctgtctgtgtgcatcataacgatttgtgatgtctatgaaacaattctccgcattggttctgaacgtaaattttaccatgtctccagatatttaaaagtactctggtcaagaaaatattgtttgtcagttttggaatggatatggtagttcttacctcatgtgatataaaaaggcttaatccacaattgctrcaaaataacatgagtttgtgtctatggatgcattgtgctaagttccaccccaaatgtgttaaatatttaagtaaatcatggtagtgtgtaggagaacagttaatttccctctgtcatttgagtggtataactatgttgtaggtcttttacattaaatagaactaagaaacttaaagttggccaggtgtggtggctcacacctgttgtaatcctggcactctgggaggctgaggcacgtagatgacttgagctcaggagttcgagaccagcctggccaacatggtgaaaccccatctctac

SEQ ID NO: 196044 - DNA, 601 bp, Human
gggaggctgaggcacgtagatgacttgagctcaggagttcgagaccagcctggccaacatggtgaaaccccatctctactaaaaatacaaaaattagccaggcatggtggtgcatgcgcctgtaattgaagcgtgagaatctcttgcacccgggaggtggaggttacagtgagccgagattgtgccgttggagattgtcccattgtgcctgggagacagagtgagactctgactcaaaaaaaccacaaaaaataatatttaaaaaaagaagcttaaagttaaatgagtttaaaaggccccrtgcaatttaccattgtgtatgtgtttcagttgccagagtctgccctccgagacctcatcgtagccaccattgctgtcaagtacactcagtctaactctgtgtgctacgccaagaacgggcaggtaagtgggctgttggactcgccttcgggggactgttgttttacgaaatgatatttaaacatccgtctgccttagatattggacagcttgaaagggaatatttgccaaatgtttgtcttttgtgtttgtcagtgtttcctcagtaccctggtgggctgttaaaactaatgatgatcag

SEQ ID NO: 196045 - DNA, 601 bp, Human
aaacatccgtctgccttagatattggacagcttgaaagggaatatttgccaaatgtttgtcttttgtgtttgtcagtgtttcctcagtaccctggtgggctgttaaaactaatgatgatcagaaaatatctttggaaccaggtactcaaagtagttgtgctgcttcttgccttgaataggttggcacattttggattagtgagactctaatagctgttacaaaactggattatttcctttccttttcccccattggtattatttccagggaagaggaggtaagttacggtactgccacccrccagcctatatttttgcagcctgcagggtattttcacattatttcttatgttgtcttatcaagaatctgctgagtagaaagactgctagactaggagttaacttcatctttaaaaagttaggttcattgaggcataatttgtatacagtagaattcacctttttaaagtacagtttgaccagttttcacaaatttcacagtatgtgaccgctgccacaattaaataccaaacatttctcactgtgtgacgttaagcaagatattacacttctttcctagtgtcccgagcctcagaataca

SEQ ID NO: 196046 - DNA, 601 bp, Human
aaaattgatcattgaaacttcttacacatttctcatgttcttctgtctcatgtaactttcttcattgtttttgacccctttctgaaaccacagtcctctgtctttttaaattgcagccttggtgtaggtttgtatatttgtacttcccctgttgattataagcttttgatgacaaggactgcttttcacctacgtcgaggtgcctgccaccacgtcatgcatggtgcttgctgtccgatgggtctgtattcaacattaaatacaaattgcctgacggcaggtaaccctggggtcttctccyaccacattttctacatgtgccattaataacttgatacattttgttacatttcatgttcttctgtttgaagaaggtatgtgggaacattacaatcgcaaacgttaggtaggtagcccgccagaagaaaagatctagcccagtttctggacatattgcgtgcctaacaaaatgctggatggaaaacagaagcctgctaatcaaatactagatggtcttctgaagagccaattgactaccctcagttttttactcaggagcaggaatcaacataagtgtcattgaagagtgaggctgcagaat

SEQ ID NO: 196047 - DNA, 601 bp, Human
caacattaaatacaaattgcctgacggcaggtaaccctggggtcttctcctaccacattttctacatgtgccattaataacttgatacattttgttacatttcatgttcttctgtttgaagaaggtatgtgggaacattacaatcgcaaacgttaggtaggtagcccgccagaagaaaagatctagcccagtttctggacatattgcgtgcctaacaaaatgctggatggaaaacagaagcctgctaatcaaatactagatggtcttctgaagagccaattgactaccctcagttttttaytcaggagcaggaatcaacataagtgtcattgaagagtgaggctgcagaatgtaactgaagtccttaagatatcttttttttttcaactttgatacttggatttttctgtttgatattaccagtcaacccctgctactagtcctgaaagagtcctggaagtgaacaagaataaaagtatgtcaaagctaaaacatgacccaagatagaagcaccttgtaaaatatgattaactgtctgtgccactatgacacaatactgcaggctgggtaacttataaaccatagacatttatttttcata

SEQ ID NO: 196048 - DNA, 601 bp, Human
ccaattgactaccctcagttttttactcaggagcaggaatcaacataagtgtcattgaagagtgaggctgcagaatgtaactgaagtccttaagatatcttttttttttcaactttgatacttggatttttctgtttgatattaccagtcaacccctgctactagtcctgaaagagtcctggaagtgaacaagaataaaagtatgtcaaagctaaaacatgacccaagatagaagcaccttgtaaaatatgattaactgtctgtgccactatgacacaatactgcaggctgggtaacttayaaaccatagacatttatttttcatagttctggaggctgtgaagtcccagatcaaggtactggtgggctgagagtctggggaggcctaccctctgcttcccagatggcacagccctctctggaaaggacaaacactgtgtccttacttcacagaaggggcatacttcccctgaagcccttttataagtctgtaatccattcatgagggccccaccctcattgcccaataactttctaaaggccttatacttcttaatactgttgcattggggattaagtttcaacatgaattttggagtgg

SEQ ID NO: 196049 - DNA, 601 bp, Human
atttgataaagtggaaggcactgtttgaggaagtccctgagttactcactgaggcagagaagaaggaatgggttgagaaactgactgaagtttctatcagctctgatgccttcttccctttccgagataacgtagacagagctaaaagggtaagtatggaattgggtgcatttgcttagagttgagcattatgtagaaactgtttcagaaatcctgcttttgatttttaaaaggtgtggcaaagtgatacagatcagtaatattcagagaaccatttgacttctccattgggtggatggaraacccaaatcctgttgttattttgcctttttgactgagtgtatctttgttagcatatgctttttagagggggattttgagttttgcaggtttttacataaaatcgcgttttgaaaatcaatatacttcccccagagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacag

SEQ ID NO: 196050 - DNA, 601 bp, Human
gaatggattgatggggaggtggggatgtcacaggtctgatggcagagccgggggaagggaacagccaggaaggcttgcaggttctgctgtttggttgctgaagggggtcagtgtgtgtatgtgtcatggaggtgggcagggaaggggagggctgtgcgtgggggagaggatatatatgctggtgtggctgagaaagcggaaccgagcctcgcatccatcggagggagccggggactgacagctctcaggtaggcaactgcacggggcccccagcccgaccgcgactaactggactaactgmgtggagctccgggagggcagggccaccaggggctggctcctcggcctctctcctttgtccagtgtggatgctgctggcctcttgcgagatggtttcttcattcatctcctttgtagcgcttggatggtggggaacgggggagggctgagtctcttttttaacctcagacagacgcagaagcagaaagaggggaacttggaaatgaggaaaagttttgcttccccagctgtggcccctacgtggttgttgctctgtgtcgagaggaggctgctggaggagtgaggccagaggaggggcagg

SEQ ID NO: 196051 - DNA, 601 bp, Human
gcatctctctccctcgagtcttgcttccccggcttcactacccagcccctcctccccgaatctcgctctgaacatgggcaagttctgggggaatttcaagtaaggcaggatgattcgggaaatggactatttaaagcaagctgctttggacttgaatacccccatcctgcgcttaaacatctgtgtttagcttcctcaagcagcccataattgccccaattataaccaataacattgttcggcagactaacaaaagatgagctttgcacggcattcgccagcaagcccaaaccagagtttycaacatagatgggaaaagtaactgcctggcttcttatcaaaacctcccaaagcaaatactgctctttttcgctgcttgtgggtggctactgcatgcagcctctttttttctcatttgtaaagtgtggcagggaaatattctacaagcttacactgaggctatgttacctttaacaaaaaggattcgtgctcctttgggcttgctgagtcttctgcagaggagggtccctggaaaacccatccccaaccatcaccacctctgtaaaagcatgtgccgcctggtgctgcctggcgagggcgc

SEQ ID NO: 196052 - DNA, 601 bp, Human
aaaaaattctctgggcgtggcggtgggcgcctgtagtcccagctactcgggaggctgaggcaggagaatggcgtgaactcgggaggtggaggttgcggtgagccgagatcacaccactgcactcctgcctgggtgacagagcgagactccatctcaaaaaaaaaaaaaaaaaagaagaagaagtttgaagattgttgtcctagattcattgctgtttctctgtgttttccaatattttagaaaagaacaccgaatgattttattacataaaagtaaataaaagcttttctttctttctttytgagttggaggtcttgctatattgcccaggcaggtcttttgttgttgttgttgttgtttacagacagggtctcactctgtcacccacactggagtgcagtggcacaatcatagctcactgcagactcaacctcctgggcccaagctatcctcctgcctcaaccttctgaatagctaagactgcagatgtgcaccaccacacctagctaaattttttttttttttttttttttgtagagataggtgtcttactatgttccccaagctggtctcaaactcctgggctcaagcgtcctaagtt

SEQ ID NO: 196053 - DNA, 601 bp, Human
tcattcgaggtcaggagtttgagaccagactgaccaacgtggtgaaaccccgtctctactaaaaatacaaaaaaaattagccaggcatggtggcgggcacctgtaatcccagctactcaggaggctgaggcgggagaatcatttgaacccaggaggcagagtttgcagtaagccaagatagcgccactgaactccagcctgggcaacagagcgagactccatctccaaaaaataaaaaataagaagtaaataaaaaaggttgtcatcagacagggagtacagacttcaggacaagaggaarccctacatgaagacagctgctgggatcactgacaggcagggtcagacataagtcccagctctgccacttcaagttacatcagctcctcaagcctcaatctgctcaactataaaatggggatgatagcacttaccccatagggtgatgcttataaagcaattagcgcaaagcctggctcatagtgctctaaagtcatagcaatatgattgctatgaaatgcaaatagattccaccgcaatgagatgccatcagaatctggcaatcttccaaaagcagaaacagtgtgtaaagttgatggtt

SEQ ID NO: 196054 - DNA, 601 bp, Human
tccattttgcagattctgtgaattgcaggggggaatggatagcattgaatatggatggctcctcaaataatcagtggagtcaattgttaaaagtgaggggagacagagaagggtcgggaggttggagtccgaaaggtagacgtgcctctgacccacagggaggtcctggctagagccaaggacactcaacaaggtctccctaagtgccaagctgcagggcctcacatttcacctgcaggaagactatcaaatggaacatgtactacgtgtcccagaagctcatcttccttttatacctcgyccttaaatcccatttacccagattttggcaagcatcagtcaaaccagccaacatttcctgaacatgcaagttgccccagttaatgaagttcacaaaaaacctcagccagagagcattttgctaacatctgtcacagtttgtcagctcagcctatgcacacattctgtattacaacctcatattaggaaggaaaggaaacggctccttttctcctcccttccctttcttctgcgacgtatagccactgccaccatgtggctgtagagggcacagccacgctgtttggaacaaattctacaa

SEQ ID NO: 196055 - DNA, 601 bp, Human
tcctctgagataggtactaatttcatcccatttttgcagatgaggaaatgagaggtcaagtacagctagcaagcttcagagctgtgatcggaagcaggcagtctgtagtcattagcagatgagaaagcgcatatcaccgccactctgcagcgtgggtctgttgtgcctgtgttgatagatggggcccccgaggctcgctggcctcccactatgatgtgctcttccagatgccagggcagcagaggagactgatctaactcagaccagggggtggacatggcttcccagaagggatgatgctagaggtgtgtgtgaaggatgagttggagaaggatattctgggcagagggaacagcaagtgccaagataaaaagacattaagaagccaggcacagtggctcatgtctgtaatcccagcactttgggaggccgaggtaggcagatcacttgaggtgaggagttcaagaccagcctggccaacatgtgaagccccgtctctactaaaaacacaaaaattagctggatgtggtggtgtgcacctgtaatcttgctactcaggaggctgaggcatgagaatcacttaaacttaagaggcggagtt

SEQ ID NO: 196056 - DNA, 601 bp, Human
ggaaatgagaggtcaagtacagctagcaagcttcagagctgtgatcggaagcaggcagtctgtagtcattagcagatgagaaagcgcatatcaccgccactctgcagcgtgggtctgttgtgcctgtgttgatagatggggcccccgaggctcgctggcctcccactatgatgtgctcttccagatgccagggcagcagaggagactgatctaactcagaccagggggtggacatggcttcccagaagggatgatgctagaggtgtgtgtgaaggatgagttggagaaggatattctgggyagagggaacagcaagtgccaagataaaaagacattaagaagccaggcacagtggctcatgtctgtaatcccagcactttgggaggccgaggtaggcagatcacttgaggtgaggagttcaagaccagcctggccaacatgtgaagccccgtctctactaaaaacacaaaaattagctggatgtggtggtgtgcacctgtaatcttgctactcaggaggctgaggcatgagaatcacttaaacttaagaggcggagtttgcagtgagtcgagatcgcgccactgcactccagcctgggcga

SEQ ID NO: 196057 - DNA, 601 bp, Human
accgccactctgcagcgtgggtctgttgtgcctgtgttgatagatggggcccccgaggctcgctggcctcccactatgatgtgctcttccagatgccagggcagcagaggagactgatctaactcagaccagggggtggacatggcttcccagaagggatgatgctagaggtgtgtgtgaaggatgagttggagaaggatattctgggcagagggaacagcaagtgccaagataaaaagacattaagaagccaggcacagtggctcatgtctgtaatcccagcactttgggaggccgaggyaggcagatcacttgaggtgaggagttcaagaccagcctggccaacatgtgaagccccgtctctactaaaaacacaaaaattagctggatgtggtggtgtgcacctgtaatcttgctactcaggaggctgaggcatgagaatcacttaaacttaagaggcggagtttgcagtgagtcgagatcgcgccactgcactccagcctgggcgacagagtgagactctgtctcaaaaaaaaaaaaaagaaaaagaaaaaaaaaaaaaaaaagacattaagagcctgatacagttgggagctacacg

SEQ ID NO: 196058 - DNA, 601 bp, Human
gctcatgtctgtaatcccagcactttgggaggccgaggtaggcagatcacttgaggtgaggagttcaagaccagcctggccaacatgtgaagccccgtctctactaaaaacacaaaaattagctggatgtggtggtgtgcacctgtaatcttgctactcaggaggctgaggcatgagaatcacttaaacttaagaggcggagtttgcagtgagtcgagatcgcgccactgcactccagcctgggcgacagagtgagactctgtctcaaaaaaaaaaaaaagaaaaagaaaaaaaaaaaaagaaagacattaagagcctgatacagttgggagctacacgtgatcggctgagactagaggctatgcaaggttaggtgccaggagatgaagcaggagttggtcagtgctaagtccttggagctccccctgacagcaacaaggttataaaattagtttaaatataaggtgacatcatcagattggagatggcttggggggaagccagatcattaggtggactaattaggaggctattacaataaccaaggcaataaatctcaactaaagccctggtccttgggatagagaagaaaaattaatct

SEQ ID NO: 196059 - DNA, 601 bp, Human
cccagcactttgggaggccgaggtaggcagatcacttgaggtgaggagttcaagaccagcctggccaacatgtgaagccccgtctctactaaaaacacaaaaattagctggatgtggtggtgtgcacctgtaatcttgctactcaggaggctgaggcatgagaatcacttaaacttaagaggcggagtttgcagtgagtcgagatcgcgccactgcactccagcctgggcgacagagtgagactctgtctcaaaaaaaaaaaaaagaaaaagaaaaaaaaaaaaaaaaagacattaagagsctgatacagttgggagctacacgtgatcggctgagactagaggctatgcaaggttaggtgccaggagatgaagcaggagttggtcagtgctaagtccttggagctccccctgacagcaacaaggttataaaattagtttaaatataaggtgacatcatcagattggagatggcttggggggaagccagatcattaggtggactaattaggaggctattacaataaccaaggcaataaatctcaactaaagccctggtccttgggatagagaagaaaaattaatctcaaatgcatttgcga

SEQ ID NO: 196060 - DNA, 601 bp, Human
aggtgacatcatcagattggagatggcttggggggaagccagatcattaggtggactaattaggaggctattacaataaccaaggcaataaatctcaactaaagccctggtccttgggatagagaagaaaaattaatctcaaatgcatttgcgatacagtcatttatgtaggcactgtgttcattatttgtttcaaaacccgtctcaaatgtgagttcattggccaggtgcagtgacttatgcctgtaatcccaacactttgggaggctaaggtgggaggaacatttgaggccaggagttmgagaccagcctaggcaacatggcgagacctcatttctgctaaaaatttaaaaactaaccaagcatcctgggctcaaacaatcctcccagctacttgggaggctgaggtgggaggattgcttgcgcccaggagttcaacgcttcagtgagccgtgattgccccactacacaccagcctgggcaacagagcgagaccatctcaaacaaacaaaaagtcaattcattgatttaacaaacacttattgagcaccccagtagtcatcatcctctgggtatgaaatgctttgatgacgcacaagaa

SEQ ID NO: 196061 - DNA, 601 bp, Human
catttatgtaggcactgtgttcattatttgtttcaaaacccgtctcaaatgtgagttcattggccaggtgcagtgacttatgcctgtaatcccaacactttgggaggctaaggtgggaggaacatttgaggccaggagttagagaccagcctaggcaacatggcgagacctcatttctgctaaaaatttaaaaactaaccaagcatcctgggctcaaacaatcctcccagctacttgggaggctgaggtgggaggattgcttgcgcccaggagttcaacgcttcagtgagccgtgattgcmccactacacaccagcctgggcaacagagcgagaccatctcaaacaaacaaaaagtcaattcattgatttaacaaacacttattgagcaccccagtagtcatcatcctctgggtatgaaatgctttgatgacgcacaagaagaactggggtgggctcagctgcaggtccctcctttgttcacgtccttctcataccagcacttcccaaactttggcatggatacaagtcacctgggaatcttgctaaaaatgtggatccttacaaaaaattagcgggacctggtagcatatgcctgtaatc

SEQ ID NO: 196062 - DNA, 601 bp, Human
tgtaggcactgtgttcattatttgtttcaaaacccgtctcaaatgtgagttcattggccaggtgcagtgacttatgcctgtaatcccaacactttgggaggctaaggtgggaggaacatttgaggccaggagttagagaccagcctaggcaacatggcgagacctcatttctgctaaaaatttaaaaactaaccaagcatcctgggctcaaacaatcctcccagctacttgggaggctgaggtgggaggattgcttgcgcccaggagttcaacgcttcagtgagccgtgattgccccactrcacaccagcctgggcaacagagcgagaccatctcaaacaaacaaaaagtcaattcattgatttaacaaacacttattgagcaccccagtagtcatcatcctctgggtatgaaatgctttgatgacgcacaagaagaactggggtgggctcagctgcaggtccctcctttgttcacgtccttctcataccagcacttcccaaactttggcatggatacaagtcacctgggaatcttgctaaaaatgtggatccttacaaaaaattagcgggacctggtagcatatgcctgtaatctcagca

SEQ ID NO: 196063 - DNA, 601 bp, Human; identical to SEQ ID NO: 34296

SEQ ID NO: 196064 - DNA, 601 bp, Human; identical to SEQ ID NO: 34297

SEQ ID NO: 196065 - DNA, 601 bp, Human; identical to SEQ ID NO: 34298

SEQ ID NO: 196066 - DNA, 601 bp, Human; identical to SEQ ID NO: 34299

SEQ ID NO: 196067 - DNA, 601 bp, Human; identical to SEQ ID NO: 34300

SEQ ID NO: 196068 - DNA, 601 bp, Human; identical to SEQ ID NO: 34301

SEQ ID NO: 196069 - DNA, 601 bp, Human; identical to SEQ ID NO: 34302

SEQ ID NO: 196070 - DNA, 601 bp, Human; identical to SEQ ID NO: 34303

SEQ ID NO: 196071 - DNA, 601 bp, Human; identical to SEQ ID NO: 34304

SEQ ID NO: 196072 - DNA, 601 bp, Human; identical to SEQ ID NO: 34305

SEQ ID NO: 196073 - DNA, 601 bp, Human; identical to SEQ ID NO: 34306

SEQ ID NO: 196074 - DNA, 601 bp, Human; identical to SEQ ID NO: 34307

SEQ ID NO: 196075 - DNA, 601 bp, Human; identical to SEQ ID NO: 34308

SEQ ID NO: 196076 - DNA, 601 bp, Human; identical to SEQ ID NO: 34309

SEQ ID NO: 196077 - DNA, 601 bp, Human; identical to SEQ ID NO: 34310

SEQ ID NO: 196078 - DNA, 601 bp, Human; identical to SEQ ID NO: 34311

SEQ ID NO: 196079 - DNA, 601 bp, Human; identical to SEQ ID NO: 34312

SEQ ID NO: 196080 - DNA, 601 bp, Human; identical to SEQ ID NO: 34313

SEQ ID NO: 196081 - DNA, 601 bp, Human; identical to SEQ ID NO: 34314

SEQ ID NO: 196082 - DNA, 601 bp, Human; identical to SEQ ID NO: 34315

SEQ ID NO: 196083 - DNA, 601 bp, Human; identical to SEQ ID NO: 34316

SEQ ID NO: 196084 - DNA, 601 bp, Human; identical to SEQ ID NO: 34317

SEQ ID NO: 196085 - DNA, 601 bp, Human; identical to SEQ ID NO: 34318

SEQ ID NO: 196086 - DNA, 601 bp, Human; identical to SEQ ID NO: 34319

SEQ ID NO: 196087 - DNA, 601 bp, Human; identical to SEQ ID NO: 34320

SEQ ID NO: 196088 - DNA, 601 bp, Human; identical to SEQ ID NO: 34321

SEQ ID NO: 196089 - DNA, 601 bp, Human; identical to SEQ ID NO: 34322

SEQ ID NO: 196090 - DNA, 601 bp, Human; identical to SEQ ID NO: 34323

SEQ ID NO: 196091 - DNA, 601 bp, Human; identical to SEQ ID NO: 34324

SEQ ID NO: 196092 - DNA, 601 bp, Human; identical to SEQ ID NO: 32912

SEQ ID NO: 196093 - DNA, 601 bp, Human; identical to SEQ ID NO: 30279

SEQ ID NO: 196094 - DNA, 601 bp, Human; identical to SEQ ID NO: 30280

SEQ ID NO: 196095 - DNA, 601 bp, Human; identical to SEQ ID NO: 30281

SEQ ID NO: 196096 - DNA, 601 bp, Human; identical to SEQ ID NO: 30282

SEQ ID NO: 196097 - DNA, 601 bp, Human; identical to SEQ ID NO: 30283

SEQ ID NO: 196098 - DNA, 601 bp, Human; identical to SEQ ID NO: 30284

SEQ ID NO: 196099 - DNA, 601 bp, Human; identical to SEQ ID NO: 30285

SEQ ID NO: 196100 - DNA, 601 bp, Human; identical to SEQ ID NO: 30286

SEQ ID NO: 196101 - DNA, 601 bp, Human; identical to SEQ ID NO: 30287

SEQ ID NO: 196102 - DNA, 601 bp, Human; identical to SEQ ID NO: 30288

SEQ ID NO: 196103 - DNA, 601 bp, Human; identical to SEQ ID NO: 30289

SEQ ID NO: 196104 - DNA, 601 bp, Human; identical to SEQ ID NO: 30290

SEQ ID NO: 196105 - DNA, 601 bp, Human; identical to SEQ ID NO: 30291

SEQ ID NO: 196106 - DNA, 601 bp, Human; identical to SEQ ID NO: 30292

SEQ ID NO: 196107 - DNA, 601 bp, Human; identical to SEQ ID NO: 30293

SEQ ID NO: 196108 - DNA, 601 bp, Human; identical to SEQ ID NO: 30294

SEQ ID NO: 196109 - DNA, 601 bp, Human; identical to SEQ ID NO: 33537

SEQ ID NO: 196110 - DNA, 601 bp, Human; identical to SEQ ID NO: 33538

SEQ ID NO: 196111 - DNA, 601 bp, Human; identical to SEQ ID NO: 33539

SEQ ID NO: 196112 - DNA, 601 bp, Human; identical to SEQ ID NO: 33540

SEQ ID NO: 196113 - DNA, 601 bp, Human; identical to SEQ ID NO: 33541

SEQ ID NO: 196114 - DNA, 601 bp, Human; identical to SEQ ID NO: 33542

SEQ ID NO: 196115 - DNA, 601 bp, Human; identical to SEQ ID NO: 33543

SEQ ID NO: 196116 - DNA, 601 bp, Human; identical to SEQ ID NO: 33544

SEQ ID NO: 196117 - DNA, 601 bp, Human; identical to SEQ ID NO: 33545

SEQ ID NO: 196118 - DNA, 601 bp, Human; identical to SEQ ID NO: 33546

SEQ ID NO: 196119 - DNA, 601 bp, Human; identical to SEQ ID NO: 33547

SEQ ID NO: 196120 - DNA, 601 bp, Human; identical to SEQ ID NO: 33548

SEQ ID NO: 196121 - DNA, 601 bp, Human; identical to SEQ ID NO: 33549

SEQ ID NO: 196122 - DNA, 601 bp, Human; identical to SEQ ID NO: 33550

SEQ ID NO: 196123 - DNA, 601 bp, Human; identical to SEQ ID NO: 33551

SEQ ID NO: 196124 - DNA, 601 bp, Human; identical to SEQ ID NO: 33552

SEQ ID NO: 196125 - DNA, 601 bp, Human; identical to SEQ ID NO: 33553

SEQ ID NO: 196126 - DNA, 601 bp, Human; identical to SEQ ID NO: 33554

SEQ ID NO: 196127 - DNA, 601 bp, Human; identical to SEQ ID NO: 33555

SEQ ID NO: 196128 - DNA, 601 bp, Human; identical to SEQ ID NO: 33556

SEQ ID NO: 196129 - DNA, 601 bp, Human; identical to SEQ ID NO: 33557

SEQ ID NO: 196130 - DNA, 601 bp, Human; identical to SEQ ID NO: 33558

SEQ ID NO: 196131 - DNA, 601 bp, Human; identical to SEQ ID NO: 33559

SEQ ID NO: 196132 - DNA, 601 bp, Human; identical to SEQ ID NO: 33560

SEQ ID NO: 196133 - DNA, 601 bp, Human; identical to SEQ ID NO: 33561

SEQ ID NO: 196134 - DNA, 601 bp, Human; identical to SEQ ID NO: 33562

SEQ ID NO: 196135 - DNA, 601 bp, Human; identical to SEQ ID NO: 33563

SEQ ID NO: 196136 - DNA, 601 bp, Human; identical to SEQ ID NO: 33564

SEQ ID NO: 196137 - DNA, 601 bp, Human; identical to SEQ ID NO: 33565

SEQ ID NO: 196138 - DNA, 601 bp, Human; identical to SEQ ID NO: 33566

SEQ ID NO: 196139 - DNA, 601 bp, Human; identical to SEQ ID NO: 33567

SEQ ID NO: 196140 - DNA, 601 bp, Human; identical to SEQ ID NO: 33568

SEQ ID NO: 196141 - DNA, 601 bp, Human; identical to SEQ ID NO: 33569

SEQ ID NO: 196142 - DNA, 601 bp, Human; identical to SEQ ID NO: 33570

SEQ ID NO: 196143 - DNA, 601 bp, Human; identical to SEQ ID NO: 33571

SEQ ID NO: 196144 - DNA, 601 bp, Human; identical to SEQ ID NO: 33572

SEQ ID NO: 196145 - DNA, 601 bp, Human; identical to SEQ ID NO: 33573

SEQ ID NO: 196146 - DNA, 601 bp, Human; identical to SEQ ID NO: 33574

SEQ ID NO: 196147 - DNA, 601 bp, Human; identical to SEQ ID NO: 33575

SEQ ID NO: 196148 - DNA, 601 bp, Human; identical to SEQ ID NO: 33576

SEQ ID NO: 196149 - DNA, 601 bp, Human; identical to SEQ ID NO: 33577

SEQ ID NO: 196150 - DNA, 601 bp, Human; identical to SEQ ID NO: 33578

SEQ ID NO: 196151 - DNA, 601 bp, Human; identical to SEQ ID NO: 33579

SEQ ID NO: 196152 - DNA, 601 bp, Human
aaagaagagatgacgtcgaagagttatgggtcagattaactccgtttttcactatctaaatagcagacatgaaatagacagcttttaaaaaaaggcatcctagctaatagtccactctagatattataaaaccaagcactgtcttctttggctaccagttttagggtttgtctcctatctccaaattgaaaattactgttgacttaatttagaaaaaagctgctgagtacttgctgttggtgaacacacaaatcttttggaaaatacaggtgctatatagatgcataaccattccacataraatataaaagaaaatctgaccaaaacactcccaccatgcccaaatgccacataaagctcttcaacattttaatttcagcctaagagaccaaggaattttggacattcacattatatacaaaattttatgtggatagaagataaatttcaaagattcactaattatacactcacttcatccctctccaaatcttcctgcatttaccagacttcctttcttacgtgtatcttcacactattttatctttttctaagcatattacctaaggtgctaactcattctgtactctatataacctat

SEQ ID NO: 196153 - DNA, 601 bp, Human
acacatgatgaatgccgagataaatgtgtgaagagttctctgagcatctaaagctgggacacacaatccagcgtagtggggatggatcacagaagacttcttcaaggaagagactcctgagttgattcttgaagggcaagtacgagttggtgaggaaaaaatgatgagaatctgggcaagggagaacacacgagcagaggggctggccaggaaccagaggcagctgttacactgcagaatggaggaaaggaaggttggtgggagagaaggctggaaggacaggctggagccaggtcttaayggcttgtggaattcttgctttcctctctttctaaggtagaccccatcaaaatgctcttggtgtccacccccactttgttttttgccatgtatcagtcacagctctgggtaaaccctttcagtcctgtcctggcgtctgctgccaggctgctgaggaagagagaaaccatgaggattactggcgcttgcagtcctgggctcgcctcactctcacttcctgctcctttctacagcaaaacctagagtttcctccaaaacactgatatacagtacatctaagaaaaagtaaagagaaataaga

SEQ ID NO: 196154 - DNA, 601 bp, Human
ttaaatttatccttccttcctctttgtacacattcatatcagaaggaaaatggtactcttttctgtcaccacccccccaacccccaaccacggaagcaagaacattaaaatcactagcagaggaaatgttatactaatagaaagaaaactggatttagaatataaagtatgttcatatgaaaggacatctttggttaccattcattcagtctgcagaattaatgtatttcagttagattacttatgagatcaacggttctactggctctttataagtcagggaaggggttcaagaaattaragatggcacaactatagacattagatgaggacatggggcacacatctatctaccacatgccgccacagctgaaatgtgtctgtgtgtctcagagaaatggctgcctcctgtcttgcatagcaagcatgtaagctttggtcactcacagattgagggagatgaactgaatgatttctaaagtcatttttgtcttttaaattctataaatctactgaggaatctatgtgtttataaggctttaatgtttagaatgatgtatggacatgggcatttgacactcaaatgggggggttggtgaca

SEQ ID NO: 196155 - DNA, 601 bp, Human
tttatgtgcttttcctcctgtcttctgggaatggttaatagggctggaggaaggaaccacagtactaatggtgctagtctattcatatctgaatcctatgggagagatgctaactcttttcctagagcccgtaatgattcaactagttggaggattgctctggattgatggtgtattctttcaaaataatcttaaattaaggtaactcaaggtacaggttgctgtgtgtgatgcatcattccagtaatcccagcactttcggaagctgaggcagccagcccacttgggttcaggagttcgrgaccagcctgggcaacatggtgagaccccatctctacaaaaaatacaaaaattagctgggcatggtggtgtgcacctgtagtcccagctacctgggaagtggaggcaggaggatcacttgagcctgggaggtggaggttgcagtgagctgattgccactgcactctagccagggtgatagagtaagaccccgtctcaaaaaaaaaaaaaaaaaaaaggtataggttacagtgactgtcccgatacaatttggatcattaacaaatatatttggctacctattatcatcaaatgtaccaga

SEQ ID NO: 196156 - DNA, 601 bp, Human
gcagccagcccacttgggttcaggagttcgagaccagcctgggcaacatggtgagaccccatctctacaaaaaatacaaaaattagctgggcatggtggtgtgcacctgtagtcccagctacctgggaagtggaggcaggaggatcacttgagcctgggaggtggaggttgcagtgagctgattgccactgcactctagccagggtgatagagtaagaccccgtctcaaaaaaaaaaaaaaaaaaaaggtataggttacagtgactgtcccgatacaatttggatcattaacaaatatatytggctacctattatcatcaaatgtaccagataatttatagaactgaagcaattctaaaaattgccagatgaatatataaacaaagcattaaatagttataaagtcttgattagctatgactttcgatttattcttcctcactgcttgctattttatgcaaaatgggaaatgaaccaaaaataattttcttgagaattctggtttgaataatttctgagctgtaaacaaacttcattcaagttcatagtccagaatatagctgactccttggggttatacagttatcaatttttggaagaa

SEQ ID NO: 196157 - DNA, 601 bp, Human
gggtaaatctccacacaactttttaactaagggccaaaataatgtttaaaattagtcatatcttgctccatctcatcacgggtagttgttttagacagagctgaaaccgaagatgtaacaatttagtttactcttgactcgcagtactgctgttcttacatctgactatcttgggctgtgcgggaagacgggggttatgaagacaaagatggcgagaggcactctctgattccacaaataacctgctcctgagaggttcaaagatgccacatttctcgttcccatctatcttttgggtaakatctccttgctaacttctatcaacaaattgcagataagtcgagtgcagtttctgtccagttactgggcaagttgggatattctatcaatagcttcagagaacaccaccaaaaaggcgagcagaactgatgaaaaagcagtttggtgtatttagatgggcatgcatatacaccacttaaaaaaaaatcagtcctacatgctgctttaaatatatactgcatttttcacaaacattttccatgccaatcaacatacatcattattgctgttgagtgcatactatctgactaaacagatacat

SEQ ID NO: 196158 - DNA, 601 bp, Human
tttaaaaacataaagattaaagaaaaagacaaaagaataaaaaggacaataaagaataaaaaatgaggaaaactcagcaataaagatagataatcttttcaacagaacataaactactacaacgaagtcaatgtgtaccctgttttggtccttagaaacacctttatataaaatatagtcagcgttaaaggacaatctgcatataatcagctctttgctgccttgcgacatcttctgtgtttcaacttctcatgccgatctaaaggcagaaaaacaattctgtttcttttactaccaccascgctccctcaaaaagatagttacataatagatgccattttataactgctgcatttgtaataaggcagcgacaaatccatttctaacatatcacggtaatccattatattttctatgaaatagaaaacaaggtttattactcaagagttaaaatattttcatgtattgatactttcaatttatgtttacctttaatttacatgtttatacattttcagtgattaagattatattattagataaatatattgcaaatgtaatgaaatgcctaaaaacatttttttttttagatggattcttg

SEQ ID NO: 196159 - DNA, 601 bp, Human
taatccattatattttctatgaaatagaaaacaaggtttattactcaagagttaaaatattttcatgtattgatactttcaatttatgtttacctttaatttacatgtttatacattttcagtgattaagattatattattagataaatatattgcaaatgtaatgaaatgcctaaaaacatttttttttttagatggattcttgctctgtcagccaggctggagtgcagtggcacgatcttggctcactgcaacctccgcctcttgggttcaagcaattctccttcctcagcctcctgastagctgggattacaggcgtgcaccacagcacctggcttaatttttgtatttttagtagagacggggtttcaacatcttggccaggctggtctcgaactcctgacctcgtgatctgcccacctcggcctcccaaagtgctgggattccaggtgtgagccactgcgcccagccctaaaaacctttataaagtaagaataatcaaaatggggctatttttcatgctctgaacttctggtagcctcttaataatgatactaacattaaaaaatgtttcaaagaacaaagtaactggctgatagt

SEQ ID NO: 196160 - DNA, 601 bp, Human
atgaaatagaaaacaaggtttattactcaagagttaaaatattttcatgtattgatactttcaatttatgtttacctttaatttacatgtttatacattttcagtgattaagattatattattagataaatatattgcaaatgtaatgaaatgcctaaaaacatttttttttttagatggattcttgctctgtcagccaggctggagtgcagtggcacgatcttggctcactgcaacctccgcctcttgggttcaagcaattctccttcctcagcctcctgagtagctgggattacaggcrtgcaccacagcacctggcttaatttttgtatttttagtagagacggggtttcaacatcttggccaggctggtctcgaactcctgacctcgtgatctgcccacctcggcctcccaaagtgctgggattccaggtgtgagccactgcgcccagccctaaaaacctttataaagtaagaataatcaaaatggggctatttttcatgctctgaacttctggtagcctcttaataatgatactaacattaaaaaatgtttcaaagaacaaagtaactggctgatagtaaaactacatattttcta

SEQ ID NO: 196161 - DNA, 601 bp, Human
gttagagactggtaatgtgataagaagagtctctacgagatagatgaatctgaaacagcaggagagaggctgaacttcagactgtttacactagactaataccagacttttccagatagatctggtgtgaaatgaactgttgagaaataaagcaatgagccagtgggaagattccacaatttatagattgggtctacacttggcacaaaatatatcttatggttgggatgagttccttctttttccttgaatgtcaatttaagtataataacaatattttttgggctatttttctctttaytcaaaatgaaaatgttttcttggatcccaagggggaaaacagatattcttagaatttaagattacttatttcagttaagtggaatgccaatgtgaaaaatggcaaaactgtcttgtaatgtgtgacgtgcaaaatagaaaataaaacaggttgatgtgatggagtctgatgagaagcttctttagactggcttgttgtgaagaacatgtagaagcagagatcttcaaggtgagaccagaaacgatcgaatgaacctgccagtgaagacctgggagtggctcttacaagtgtcctaagtta

SEQ ID NO: 196162 - DNA, 601 bp, Human
gctggtgtagctgacagtcagtgaggggactccagtgccagggcctctggagagctgatgcaggggcagattacacagggacactaggccagatcaagcgtttcaatttattctaagtgcagtggaaaagcattccaggcttttaaacaggggatgataaagtctgattcacatttctaaagttcactctggatactgtgggaagaataggttacataaaaggaggagtgtaggcaagcaagcaaatgattgtataggcaaaaggcagatcgttggtggcctggtctgggtgctgatagtrgagatggactgacgtggaggaactggagcgatgttcgggaggtaagagttgtcaggaagaattggatttggggataagggaagacaggatcaaagatgacttctagtttgctagctctagcagctgggtaagtactgatagcatttaagacggggaagagtgaagtaggagcaggtgtggtaaagacaagcatgcgttctcttttcagagtttgctataataactatcacccacaattacaaggaaaaagccaaattcatgcattttaattttccttttttagttatttataaagatcaa

SEQ ID NO: 196163 - DNA, 601 bp, Human
gagaaagttatagtagtatatacagtatgtaaagtttactgttttaagctataaatatttttgtttttcacatcagataacacattgtattaggctcacctctacaatatcttagctaattattgctatcaaatattaaaccaccgaagatcctcaaataaggtcttttcaatgtcctttacttataacatcgataaaaaaaaaaacacaaaaaacttgattccaggctggggccactgcctgtactgagtttgcatgttgtctcatgtctgcatgggttttgagtacaccagcttttctyccacatctcaaagctgtgcatgttaggtgaattggcatgtctacatggtcctagtctgaatgaatgaatgaatatgtatgtatgaatgcaccccgcgctgggatggcgtactggccagagctggttcacacctggcaccctgagctgccaaggtaggctctggcaaccagcaaccttgaactggaataactgggtaaataattatctgttttttttttaattaatctttcttaaatgttaagtatagctcatatgtacttcaatgtttaatattagaaatgctttgatctttagaagttt

SEQ ID NO: 196164 - DNA, 601 bp, Human
caagggtaaaactggtttggttatatgtcattttgcttaaagctgcagtttcaaagaacctgctgatgacattaagtgaggacttactgtattctgaagttaattttcactttggcatttctttctcttttcccatcttactgcaaaatttcactgatttattttttctttatagagatttagtgttttcatcaatatttctccataaagagaagggaaaatcattgcatttaaacaacagagaacattttatccagaggagttttgacaatagagagactaaaggtaaattagggaatgkgtcagataatcattaagcagcatttatgcacttacagaattttcaggtgttatcttgggcatgtcccttcaagtctttgacagcaatttcctgatctataaaacaaagtaccacttacctaccccaccttatagagttttagtgggatcaaatggaataatacacatgaaaatgctttgaaactacagggattagtccagcaaaacatttttatctttttggattaagcaactgacatttagctaaccaaaagagatctgtttttgtttttttttcccttcaattttagacatctactca

SEQ ID NO: 196165 - DNA, 601 bp, Human
gcaaattctaaatgtattatcagcaggtcaacaacagttacaagcccagtgctttagcattatctgaaaaaatttctgagcataaaataaatttttctatttttttaggctccaatctttaatgacaatattctctctttcaatatgtaatttttattagataataaaatgtttcaaaatattaaaaagcataaaaaagtaaccacaaattttacttccaattcctgccccatccacacttttcctattccctctccacagataaccactgttacttgtttcttcaatcgcattttaaagwtaatttttgcatatactgacaaatatgaatagatatcttcctcatgttacctaatactagcaaactaaacacatattcttgttttgtgtctagaatattcagagacccattttcttttcttttttttttttttttcgagacagagtctcatttctgtcacccaggctggattgcagtggcacaatcttggctcactgcaacctctgcctcctgggttcaagcaattctcatgccgtagcctccccaatacaaaaaaatacaggtaatttttgtatttttagtagagacagggtttcacca

SEQ ID NO: 196166 - DNA, 601 bp, Human
aatgacaatattctctctttcaatatgtaatttttattagataataaaatgtttcaaaatattaaaaagcataaaaaagtaaccacaaattttacttccaattcctgccccatccacacttttcctattccctctccacagataaccactgttacttgtttcttcaatcgcattttaaagataatttttgcatatactgacaaatatgaatagatatcttcctcatgttacctaatactagcaaactaaacacatattcttgttttgtgtctagaatattcagagacccattttcttttcttttttttttttttttcgagacagagtctcatttctgtcacccaggctggattgcagtggcacaatcttggctcactgcaacctctgcctcctgggttcaagcaattctcatgccgtagcctccccaatacaaaaaaatacaggtaatttttgtatttttagtagagacagggtttcaccatgttggccaggctggtctcaaactcctgacctcaagtaatctacccaccttggcctcccaaagtgttgggattataggtgtgagccactgcgcccggcctcagagacctattttccaaaa

SEQ ID NO: 196167 - DNA, 601 bp, Human
tctgaagaggtactggctaaaaactccagattttgtgaaagccatgaatttaccaatattaaaaaaccagcaaacacaagcaggataactataacaagaaccaccctagctatggacatcaaactcaaacttctgatagccaaagataatgagaaaatcttgaaagtacccagaaaataaataacacattacatacatggaaacaatgacaagattaatggctgacttctcagaaacaatgaacagccataagacgcaagaatggcatcttcaaaatttgataaaaaatctgaaaaccaayaacccttctttatatattttttaaacaacaatatatctgatgaaacttttcttcaaaagtgaaagggaagtatttttggattggcaaaaaatgagataatttgtcaccagcaaacctgctgtaaaagaaatactagaagaacatatttaggttgcagggaatagctacagaggaaaaaactaaaggcattgaaaatggcaaattatgtaggtagatataaagtacatctgtctgcctatccatgcatctatctgaattttttcgcaaaaggtaagatggttaaaaagatctctaccattt

SEQ ID NO: 196168 - DNA, 601 bp, Human
ggctaaaaactccagattttgtgaaagccatgaatttaccaatattaaaaaaccagcaaacacaagcaggataactataacaagaaccaccctagctatggacatcaaactcaaacttctgatagccaaagataatgagaaaatcttgaaagtacccagaaaataaataacacattacatacatggaaacaatgacaagattaatggctgacttctcagaaacaatgaacagccataagacgcaagaatggcatcttcaaaatttgataaaaaatctgaaaaccaacaacccttctttatrtattttttaaacaacaatatatctgatgaaacttttcttcaaaagtgaaagggaagtatttttggattggcaaaaaatgagataatttgtcaccagcaaacctgctgtaaaagaaatactagaagaacatatttaggttgcagggaatagctacagaggaaaaaactaaaggcattgaaaatggcaaattatgtaggtagatataaagtacatctgtctgcctatccatgcatctatctgaattttttcgcaaaaggtaagatggttaaaaagatctctaccattttaaagttcctataa

SEQ ID NO: 196169 - DNA, 601 bp, Human
cgctgttcaataaacatccttgaaaaagacagtagggaataaaaattgatatgatcaataattccattcataggcatctatcaagaagaatatataaaatgttcatataaagacctggatatgaactttttattttttaatttgagacagagtcccactctgttgcccaggctggagtgcagtggcgcaatcttggctcactgcagcctctgcctcctgggttcaagcgattcttgtgccccagcttcctgagtagctgggattacaggtgtgagccaccaggcctggctaatttatatatttttagtagagacagagttttgccatgttgcccagctggtcttgaactcctggcctcaagcaatcctcctgccttggcctcccagagtgctgggattagaggtgtgagccaccatgcccggcctgaacgtgaattttcataagcagttttacttatgatcactgaaaattagagataacacaaacatccataaacaggagaataaactatagtatattcatacaatgaaatactactcagcaatataaaggattgaactagtatacacagaatacttactaatgaaccgcaaacaccatg

SEQ ID NO: 196170 - DNA, 601 bp, Human
catataaagacctggatatgaactttttattttttaatttgagacagagtcccactctgttgcccaggctggagtgcagtggcgcaatcttggctcactgcagcctctgcctcctgggttcaagcgattcttgtgccccagcttcctgagtagctgggattacaggtgtgagccaccaggcctggctaatttatatatttttagtagagacagagttttgccatgttgcccagctggtcttgaactcctggcctcaagcaatcctcctgccttggcctcccagagtgctgggattagaggygtgagccaccatgcccggcctgaacgtgaattttcataagcagttttacttatgatcactgaaaattagagataacacaaacatccataaacaggagaataaactatagtatattcatacaatgaaatactactcagcaatataaaggattgaactagtatacacagaatacttactaatgaaccgcaaacaccatgctgtaccaaaaaaaactatacagcagagtacatattgcacatttgcttgtataaaatttagaagggacaaaactaatgtatactgacagcaacatatcagtgg

SEQ ID NO: 196171 - DNA, 601 bp, Human
actgaaaattagagataacacaaacatccataaacaggagaataaactatagtatattcatacaatgaaatactactcagcaatataaaggattgaactagtatacacagaatacttactaatgaaccgcaaacaccatgctgtaccaaaaaaaactatacagcagagtacatattgcacatttgcttgtataaaatttagaagggacaaaactaatgtatactgacagcaacatatcagtggttgcctggggtcagatgatggcaaatgaatggctgcaaagggtcactaggaaagtttygtgagtaacgaaaagttgtatatcttgattgtggcagtgtctgcacagacgtatacatttgtcaaaatacactgaaatttatacttaaaatgggtgtattcttcaggtaaattatgcctccaaaaagtggatacaaagcaaaaacgaatggaacggaagtatacaatttcattgttttgtttgtttttgagacatggtctcagtctattgcccaagctaagtgcagtggtgtaataatggctcattgcagccttgacctcaaacaattctcctgcctcagcctctccagtagctgagacc

SEQ ID NO: 196172 - DNA, 601 bp, Human
ctatttttaaatgttttatagagatgaggtgtcactacatagcccaggatagtcttgaactcctagactcaagctatcttcctgccttggcctcctgaagtgctgtgattacaggcatgtgtcattgcacttggcctgttttttaaaaatgagaattgagtgatgcatatgttaacatcggattgaaatttcgagtgattattttttcccatgaaaatttttctataatcagaaaaaagaaactgttttataaagtgaatttaacaaaaagttttactcactaaaattttaagagaatgcrctatatatagagaaatacatctgcaataatatttcattgctctgttcattgaaatgcttaggaaaccaaaactttttaaaaaatatgaaagtatttactggagagaaaaagagacaagaaacaaaacattttatatcctagttcttagtttaacatattcaactaaaagttaaacaatgttgaaatttattagacttgtgaaagggatatggttcagagagacccctgtaatacagttttgtagtaattacttattgattgttcaccagcatatttattcctcaataacttaactgaaga

SEQ ID NO: 196173 - DNA, 601 bp, Human
ttcctgccttggcctcctgaagtgctgtgattacaggcatgtgtcattgcacttggcctgttttttaaaaatgagaattgagtgatgcatatgttaacatcggattgaaatttcgagtgattattttttcccatgaaaatttttctataatcagaaaaaagaaactgttttataaagtgaatttaacaaaaagttttactcactaaaattttaagagaatgcactatatatagagaaatacatctgcaataatatttcattgctctgttcattgaaatgcttaggaaaccaaaactttttwaaaaatatgaaagtatttactggagagaaaaagagacaagaaacaaaacattttatatcctagttcttagtttaacatattcaactaaaagttaaacaatgttgaaatttattagacttgtgaaagggatatggttcagagagacccctgtaatacagttttgtagtaattacttattgattgttcaccagcatatttattcctcaataacttaactgaagaaagttttacctttagtttaagagcaaagaatgtgattaacttcactccaaccctagtggtatttcatgtgtttataat

SEQ ID NO: 196174 - DNA, 601 bp, Human
aatgagaattgagtgatgcatatgttaacatcggattgaaatttcgagtgattattttttcccatgaaaatttttctataatcagaaaaaagaaactgttttataaagtgaatttaacaaaaagttttactcactaaaattttaagagaatgcactatatatagagaaatacatctgcaataatatttcattgctctgttcattgaaatgcttaggaaaccaaaactttttaaaaaatatgaaagtatttactggagagaaaaagagacaagaaacaaaacattttatatcctagttcttrgtttaacatattcaactaaaagttaaacaatgttgaaatttattagacttgtgaaagggatatggttcagagagacccctgtaatacagttttgtagtaattacttattgattgttcaccagcatatttattcctcaataacttaactgaagaaagttttacctttagtttaagagcaaagaatgtgattaacttcactccaaccctagtggtatttcatgtgtttataatgaatccgaagctttgggtaacacaaatgatcataatgcaaatatcatgacattgtggtattattgactt

SEQ ID NO: 196175 - DNA, 601 bp, Human
tggaggctgggcgtggtggcttacgcctgtaatccagcactttgggaggccgaggcaggcggatcacgaggtcaggagatcgagaccatcctggctaacacagtgaaacctcgtctctactaaaaaatgcaaaaaattagccgggcgtggtggtgggcacctgtagtcccagctactcgggaggctgaggcaagagaatggagtgaacctgggaggtgtagcttgcagtgagccaagattacaccactgcactccagcctggacgacagagcgagactctgtctcaaaaaaaaaaaaaaaraaaagaaaaacattggaattacttaatgatcaatatactacaaatagacagagtgatagcctacaatgccaatgagtgatagcctacaatgccaataaaatactaagataattttatcttccctgcctttgccctgagtattgggaagtttaaaagcataaaattatttctttcggttccaatagttccaaactatttcaaaaggaaattcaaattataaaattggatattcatgcttgtaccagattagattaaatcaaattaatgagatttcatatatacacatatatatgtgtgtgt

SEQ ID NO: 196176 - DNA, 601 bp, Human
aaaaaaaaaaaaagaaaaacattggaattacttaatgatcaatatactacaaatagacagagtgatagcctacaatgccaatgagtgatagcctacaatgccaataaaatactaagataattttatcttccctgcctttgccctgagtattgggaagtttaaaagcataaaattatttctttcggttccaatagttccaaactatttcaaaaggaaattcaaattataaaattggatattcatgcttgtaccagattagattaaatcaaattaatgagatttcatatatacacatatataggtgtgtgtgtgtgtgtgtgtgtgtgtgtgtgtgtgtgtatatttggaaatccttgtaggctatagaaaattacagaagcataaggcactaatattagcttatctggctgcctatagcttctaaattcataattttcctgactcctgcctcttctcttttactctgttttcctttagaatcaacacaataatgtattttgtaacgtcttcagtttgaaaagggacctattttcccttctttagaaaaacttgaaaagcaaatttataattcttaaggattattctatatagtgcttatgct

SEQ ID NO: 196177 - DNA, 601 bp, Human
aatgtaatgagacaatatgcccattataaactgtcagatgataagaaactggtctgggcttaaaggtgaatgacatttagatatttattgtttatggcagcagcctttgaagccaaatgcaggactcttaattagagtgcaataagcacagggtacaagaggaaactatcaaagctgctaattcttaaatctaaaagcaagaaaaaaggctttcttaaatcttcagacatacattgctcccatcccttggtgcttctgtgaaaggtgacacacaagagatgctagagattcttgcagagastccacaataagaagttggcaatgggaccctcactgttctacagctttcagaggcttttgatgtattgcggattatgagttatagagtgccaccaatgcaattaattttaaaatccaaaacctttgcacagtagaattattacattatcacaatactttgtaaagagctggacagtgaccacaataatatctgcaccaaacagatttttggattgtcttgaggcaaagtatttaatcaagagttgtcatttcacaaaatagaaaggtatccccacatttgctgattttttttctgtgacaa

SEQ ID NO: 196178 - DNA, 601 bp, Human
aactcattctaagaaaagattacttggaaactaaatttaatgaaaatatttgtgaaagtggttcacctttaaaattcatgtttgcatttaacttaaaaattgagtttttctaccttattttaaaatcttccagaggaaaagtttcaggagtttctgaactcatttttaagaattgtgtttgtatatgtgtgtgtgtatgtatgcaaaataaacattaaaaaaaatttttttttttgagagacagggtctcactctgtcacttaggctggagtgcagtcttacaatcatggctcactgcagycttgatctcctggactcaagcaatctttccacctcagcctcccgagtagctgagactacaggcatgtgccaccatgcccggctaatttttgaaattttttgtagagacgaggtcttgctttgttgcctaggctgctgttgacctcccaggctcaggcaatccttttgcctcggcctccaaagtactgagatgacagagtatgagtcaccacacccagccacataattctacatattaaaaattatacatttaaaaaatttacatacggggatacctcattttactgcactttgctttatt

SEQ ID NO: 196179 - DNA, 601 bp, Human
ctcgggaggttgaggcagaagaatggcttacacctgagaggtggaggttgcagtgagtcaagatcgtgacactgcactccagcctgggcgagaaagtgagactttgtctcaaaaaaaaaaaaaaaaaaaaggaattttgactttcaagtgttattatttaaaaagtacatttcattaggctatagctgccatagacagtgattcctctgatggatctaggcaaagcaaattgaaagccttctggaaaagatttgccattatagatgccattaagaacatttgtaatttatgggaggaagtaaaaaaaaaatcaacattaacaggagtttggaagaagttgattctaaccattctaaccctcctggatgactttgaggggttcaagacttcagtggaggaagtaactgcagatgtggtaaaatagcaagagaactagaattagaagtggggcctgaagacatgactgaattgctaccatctcatgataaaactttcatggatgaggagttgcttcttatggaggagtaaagaaaatggtttattgagatgggatctggtgaagacactgtgcacactgttgaaatgacaacaaaggattaag

SEQ ID NO: 196180 - DNA, 601 bp, Human
tcttaaaatatacacattatatgcttccctaggataatctttcactattagaagacaggcagctatgtactattcttaattaaagccctatttcagtcaaagtagagcaacctgcaatttaattataataatataaactgtaatgtaaccaatgacatcgtatgtattttcatcagataattagaatagtcagtaaataaagctttacaaagcaggaaataaaacaggtgaggggttgtgcctcattcatcacctcactgactaatgagagtctgaatgaagatcagtcatttcctatacrcaccttcatggtgtgcaataaaagcacacactgtagacagctctactaaatgtaacaccaagcaggcgtcagaaaaatccatacagagaagtgataaaatagtgtatagctaaaactaactcatttatcaagaaagacagaaaaattattaggaatgcccagactgtatgccctgtgatagaaatgaataatgggaacattaactacattattttaagaacacactttaaaaaacccaaaatctaagtctactctacctagacttgaattacctttgcaaatacagaaatggtgaaatgc

SEQ ID NO: 196181 - DNA, 601 bp, Human
cccgacatacacacttttaatcatgtgtgtgcattctcaagagctaaggcttcagttctcaccacctatttgcattctcaaattcaaccttctattttagctctagttcagtacttctacctgtgtacacacatcacaaaatgggtgtcttgttattttctgaaacttaacatgtccaacatggaattaatcatttaatattctgggcaaacttccccagctctatcactgacattattttctggtcagtcccttggactcaagtgaacaggcattttgatttttgatttaccgcctccaycagtcactaagtatcactgttaactcatttgaaatgtcttgtatgcagttcattctctgataggagcataggccatgttctcattgccaggtactatgaaatgcacgatttaaaaaaaagaaggtcctcctatttagcctgcttgtttccttatttccattaataatttttcctcatttccattaatctgtatttacgttaccaactttctaccacacaattttcttgttcaagaaatgataatgacttcctgtgttgtctaacatcgggtcaaatctgctctactaacggttcaaccac

SEQ ID NO: 196182 - DNA, 601 bp, Human
cagaaggcaagagagagatctctgaacgttttattgtgttttctctcatatcccccaataatttttcttcctagaagtagagaaaaagaccccaatttctccttcactgcctattatacagatctaacccagattaagtcattttttatttaaatttactgatatcaccacagggctcctatgagtagtaggcaggaagatattaatattctcagttaacagacaggaacagcggccccttcccatatcggggtttttgcacttgcagtttcctctgcctgcaatgctctttcctgagccytctgtatgccttgctcattcttaccttcaggaatctgtgtaaatgtcccctcgagaggtcttttcctaaccaccccacacaaagttggccatccttatttattatatcaccttgtttcttttccattatttatcatgtcttaattattttatttgcttgtttattgtttgataactccactagatacgatctcaacgagggcatggaagcagctggcactcaatagatgttcatttaataaataaatgaatcaatttaagattaatgattaggtgagcacaaaagtaattgtggtttttg

SEQ ID NO: 196183 - DNA, 601 bp, Human
aggaagaatccagattctgaaagagaacatccttctacctaaactggtgagcttataataaaactagcttgtaaaattaaaattgttgagagaatgaaggaggcatatcacaaatcattctaaagggcaattaagttttaagtagcacatattagatgatgtgctgaaaagcaaatttttacaaaaagtacactaaatggcactttagtgctacttcaaatggggataggcatgatggagagagccccggacccaggtccttggactggctgtactactgtttccatgtgaggcctgagckggtcagttaactcttctggttctcaatttccccagaaaaaagagggagagtaaggctgatcatttctgtttttgatttatcactggaaaaataagtactcagaagctacaaaactagtactaaaatgtgactgggaaaaaagcaagacaaatatcatcttttgaagataggaaatgttaatttgccaaccaattgttcaccaatcttggtttctggtgtttgttggtacctctatttggtggggaggattttataaagttaagagagtcaggtgaaaaattacagttcataaaatgtaat

SEQ ID NO: 196184 - DNA, 601 bp, Human
gtttttgatttatcactggaaaaataagtactcagaagctacaaaactagtactaaaatgtgactgggaaaaaagcaagacaaatatcatcttttgaagataggaaatgttaatttgccaaccaattgttcaccaatcttggtttctggtgtttgttggtacctctatttggtggggaggattttataaagttaagagagtcaggtgaaaaattacagttcataaaatgtaatccttgctaatagaagatatttttaaatgtccactaaaagaaaatatggtttttgtacaactagcaatyagtttgggatgggcagacatctaatgatccaacaagaattttctaaaagattttgcattctaaggattctgattacattcataacaaaagtcaaaacaatgtaacttgctgaaagaagggtggtaaaatacgatgcaacagttctttcgagcatgtaactaacaaataactttaaataaaaacttttatagcctaaagttaagaatttcaaaataactacatgaaaactgtatcttttctttacacgtaagtaacatcatcagtcttattgctgtttttgatcaacgttttaaaaacttc

SEQ ID NO: 196185 - DNA, 601 bp, Human
tgtgttgtatttgtcaaatttcattacaaacttcattttttaaaaaaaatatatttaattagatgactgcttttgtcaattactttgtttttctcccctgtgattcaatacaattcaatttttagccttcaggcaattagatgagaagagtgttgcttattttcctgaaatattaaagcacagagatcttcccaacttgttttttttcaaaataaaaaggctacacatgctatcctgccaataaccatcaattataaccaagaagaatcaaggtagctgtcctttagtcttgagtttactratatataaaagcataaaatttaaacaaaggaaaacacttccaattgtaagcatagtttaaaaatctaaatgtagaatgttctagtgaataggcactttagatttatctagctttttaaagatatttattctcatgaaaaaataagaggtagtgaagagaagtggcttttatgctatctcctagtcaaaatgagtaaatgttgataaatgaatgaataaaattgtatctcattatttttttttttttttcatgagagaggactctcattcattccctagttcctgaatagagagggtttta

SEQ ID NO: 196186 - DNA, 601 bp, Human
cctgccaataaccatcaattataaccaagaagaatcaaggtagctgtcctttagtcttgagtttactaatatataaaagcataaaatttaaacaaaggaaaacacttccaattgtaagcatagtttaaaaatctaaatgtagaatgttctagtgaataggcactttagatttatctagctttttaaagatatttattctcatgaaaaaataagaggtagtgaagagaagtggcttttatgctatctcctagtcaaaatgagtaaatgttgataaatgaatgaataaaattgtatctcattatttttttttttttttcatgagagaggactctcattcattccctagttcctgaatagagagggttttataaagttaaggaggcaagatgaaaaatggggaatgctgggaagaacttcaggctgttgttcagggcatggatatcaccactgtccacgtgagcagcagtaaatgccatgttctcgtggcagtgtttccctgagcatcagcgtggtcaaggctgcctgggaacaggcacactgaactaagagtcaggagccctaggttctggttcagggcttgctactcaccagttatgtcata

SEQ ID NO: 196187 - DNA, 601 bp, Human
aggaacgtttctgctccacaggacaggcttattttaagacttaataagcatttactacatatttaccaacgtggtaagggctatacgagagatacatgagaaaaaattaaatccctgatctcaagaagcttacaaccaggaaggtaagtcagccatataaaaccatataagcataagatatacaacacaaaacaatacaaaccataggtagagaataaattaagtgatacatgctgtaactgtgggaattttttttaaaaagtgagttaggtctagggggagaggtaaggttgaagacgtracacttatatagatgcaggtatgtacttatttgggagaaggtatgtacatgtttgtgtatgtgctctggattaatgtggaggaagacaagagataaagcaaaagggaagaggaagtgcttttcatgatagcgagcaggtggagagctagattactagggtctagaaaatggtgagagagagacagattaaataagataagctcatggccttaaataccaggaagagaagtttaaaagatggttaaaagagcacatcagatgtcttaaggaagtcctaacactactttagtgcctcccatt

SEQ ID NO: 196188 - DNA, 601 bp, Human
ggaacgtttctgctccacaggacaggcttattttaagacttaataagcatttactacatatttaccaacgtggtaagggctatacgagagatacatgagaaaaaattaaatccctgatctcaagaagcttacaaccaggaaggtaagtcagccatataaaaccatataagcataagatatacaacacaaaacaatacaaaccataggtagagaataaattaagtgatacatgctgtaactgtgggaattttttttaaaaagtgagttaggtctagggggagaggtaaggttgaagacgtgtcacttatatagatgcaggtatgtacttatttgggagaaggtatgtacatgtttgtgtatgtgctctggattaatgtggaggaagacaagagataaagcaaaagggaagaggaagtgcttttcatgatagcgagcaggtggagagctagattactagggtctagaaaatggtgagagagagacagattaaataagataagctcatggccttaaataccaggaagagaagtttaaaagatggttaaaagagcacatcagatgtcttaaggaagtcctaacactactttagtgcctcccattt

SEQ ID NO: 196189 - DNA, 601 bp, Human
tcatcaaggttatgagaaatagggcaggaagaaaggcagtagctctcattggttatgggacttttctgagtgtaagaggcaaacatatatgaacgacaacatcaaaaaaaatactgtattggctacctgatagaaggaaaataaatcttaagaaataattagggtcctttaaaaaaattttcctcaagaagaaagtatatgcttttgtacacataaataagtagcgggctgggagcaaggaaatagtatgataaaagttacatgtccttctaatatgcattcaatatggaagttaaaaaasggagaggaaacccaatggctatacagctctagtgcttcaaactattcttaagtgtaccacatgtgttattgtaggctttctaattactaaaatacctgcccaagaatgataaataataataaattacagcaagaacaccacagtaatccaagtcattatacagtgcctaaagctactcattctatctcaattttaggtttaaaaaatgggcaaatcgccaacatgacatttagaaaaatatgcagtatatagtgaataatgtttacactaaatatgacaaataatttctgaaaatacatt

SEQ ID NO: 196190 - DNA, 601 bp, Human
tctataggtatgaaagagcaattaattaccatattatgtagtagtaatagtttgcaaatttacaaagtcaactgaatacctatgtatacaggttttgtttcttttaaaaaatgtaaaatgtaagctactcattttttcattctatttaagcaaatgtaaacctatccagtacacacctaataccattaggcaggtggtttgttatttctgcataatcctcctttatcatatattatacactgatacctttaaattgcctttgggtacagagtatatagttttatttcagctgacagatgarcattttaaattatcaaatggtgacactgctggacagaaaatttggcatcaatgcaatttttgtcttatgtttgtgtccctccaggcaagttaattaaactcttagtctcagtttcctcatctacaaaatggaaaaacatatttgtacaccttgaaacttagagaagttctctttttccccatgccaatattaaatttttattttcttaaacaatgaatacattctcattattgaaaaatcacaaaattagacataaaatatagaatcttattaatcttgtctacccagaaataactatta

SEQ ID NO: 196191 - DNA, 601 bp, Human
tttttaatagatcagtgttatattcttacagtactataaacaactcaatgaaacaatgccctgccttaataacgatcatcatcagaacatcaaaatgtcacataactcagtatcttttttattagaagagttttgaaaatatcagactgaaatagtttggcaggcaaatgcctctttagaatacaaacacaaataataacaagaaacataatttatgttgtccattgtagctactcatgcactatctaaatgtcttgtttttttattgctttttttttttttttttttgagatggagtctygctctgttgcccaggctggagtgcagtggtgcgatctcggctcactgcaagctccgcctcccaggttcatgccattctcctgcctcagccacctgagcagctgggactacaggcgcctgccaccacgcccggctaatttttttgtatttttagtagagacggggtttcaccgtgttggccaggatggtctcgatctcctgacctcgtgatccacccgcctccacctcctaaagtgctgggattacaggcgtgagccactgcgccccgcctattgctttttaaagctattgcacacacgca

SEQ ID NO: 196192 - DNA, 601 bp, Human
catcagaacatcaaaatgtcacataactcagtatcttttttattagaagagttttgaaaatatcagactgaaatagtttggcaggcaaatgcctctttagaatacaaacacaaataataacaagaaacataatttatgttgtccattgtagctactcatgcactatctaaatgtcttgtttttttattgctttttttttttttttttttgagatggagtctcgctctgttgcccaggctggagtgcagtggtgcgatctcggctcactgcaagctccgcctcccaggttcatgccattctyctgcctcagccacctgagcagctgggactacaggcgcctgccaccacgcccggctaatttttttgtatttttagtagagacggggtttcaccgtgttggccaggatggtctcgatctcctgacctcgtgatccacccgcctccacctcctaaagtgctgggattacaggcgtgagccactgcgccccgcctattgctttttaaagctattgcacacacgcacatatttcaacatagttgaaactttctaaattacaaactttcaaaaaggaattgcttgcataattgaccttttaaaaat

SEQ ID NO: 196193 - DNA, 601 bp, Human
agagttttgaaaatatcagactgaaatagtttggcaggcaaatgcctctttagaatacaaacacaaataataacaagaaacataatttatgttgtccattgtagctactcatgcactatctaaatgtcttgtttttttattgctttttttttttttttttttgagatggagtctcgctctgttgcccaggctggagtgcagtggtgcgatctcggctcactgcaagctccgcctcccaggttcatgccattctcctgcctcagccacctgagcagctgggactacaggcgcctgccaccaygcccggctaatttttttgtatttttagtagagacggggtttcaccgtgttggccaggatggtctcgatctcctgacctcgtgatccacccgcctccacctcctaaagtgctgggattacaggcgtgagccactgcgccccgcctattgctttttaaagctattgcacacacgcacatatttcaacatagttgaaactttctaaattacaaactttcaaaaaggaattgcttgcataattgaccttttaaaaatgttaatccatttattcaacaaatatttatttagtgcctatgtactta

SEQ ID NO: 196194 - DNA, 601 bp, Human
tttgaaaatatcagactgaaatagtttggcaggcaaatgcctctttagaatacaaacacaaataataacaagaaacataatttatgttgtccattgtagctactcatgcactatctaaatgtcttgtttttttattgctttttttttttttttttttgagatggagtctcgctctgttgcccaggctggagtgcagtggtgcgatctcggctcactgcaagctccgcctcccaggttcatgccattctcctgcctcagccacctgagcagctgggactacaggcgcctgccaccacgcccrgctaatttttttgtatttttagtagagacggggtttcaccgtgttggccaggatggtctcgatctcctgacctcgtgatccacccgcctccacctcctaaagtgctgggattacaggcgtgagccactgcgccccgcctattgctttttaaagctattgcacacacgcacatatttcaacatagttgaaactttctaaattacaaactttcaaaaaggaattgcttgcataattgaccttttaaaaatgttaatccatttattcaacaaatatttatttagtgcctatgtacttaggcac

SEQ ID NO: 196195 - DNA, 601 bp, Human
cccagcctacatctttttcccgtgctggatgcttcctgccctcaaacatcagacttcaagttcttcagtttggggacttggactggttctccttgctccttatcttgcagacagcctattgtgggaccttgtgatcgtgtaagttttatatgtaaaaggggagtttattaagtattaagttaatacttatagtttattaaatattaacttaataattatattttattaagtattaatttaatacttacaggatatatgtagatctacagatatatagttctgtccctctaagagcgccctractaatacaatgtccttgcatcaacatgaataaagctggaggccattatcctaagcaaactaacacaggaatagaaaaccaaacaccgcatgttctcacttgtaagtgggagctaaacattgagtacatatggacacaaagaaaggaaccacagacaccggggccttcttgagagtggtgggtgtaagaagggtgaggactgaaaagttacctattgggtactatgcttattacttgggtgaaaaaataatctgtttacctaacttccatgacacgccatgtacctacctatataccaaa

SEQ ID NO: 196196 - DNA, 601 bp, Human
ttattaaatattaacttaataattatattttattaagtattaatttaatacttacaggatatatgtagatctacagatatatagttctgtccctctaagagcgccctaactaatacaatgtccttgcatcaacatgaataaagctggaggccattatcctaagcaaactaacacaggaatagaaaaccaaacaccgcatgttctcacttgtaagtgggagctaaacattgagtacatatggacacaaagaaaggaaccacagacaccggggccttcttgagagtggtgggtgtaagaaggrtgaggactgaaaagttacctattgggtactatgcttattacttgggtgaaaaaataatctgtttacctaacttccatgacacgccatgtacctacctatataccaaacctgcacatgtatctctgaacctaaagtaaaagttaaaaataaaggtaactcaattatgcagccagggagattaagcaaaatataatacaggaaaaaacaacaacaaacaaaatacaaaaaaaagaatctttattatatattaatgatagaaatttgtgtcatacattcttcagggattttaagagggctctt

SEQ ID NO: 196197 - DNA, 601 bp, Human
taatacttacaggatatatgtagatctacagatatatagttctgtccctctaagagcgccctaactaatacaatgtccttgcatcaacatgaataaagctggaggccattatcctaagcaaactaacacaggaatagaaaaccaaacaccgcatgttctcacttgtaagtgggagctaaacattgagtacatatggacacaaagaaaggaaccacagacaccggggccttcttgagagtggtgggtgtaagaagggtgaggactgaaaagttacctattgggtactatgcttattacttgkgtgaaaaaataatctgtttacctaacttccatgacacgccatgtacctacctatataccaaacctgcacatgtatctctgaacctaaagtaaaagttaaaaataaaggtaactcaattatgcagccagggagattaagcaaaatataatacaggaaaaaacaacaacaaacaaaatacaaaaaaaagaatctttattatatattaatgatagaaatttgtgtcatacattcttcagggattttaagagggctcttctacctgttttatttaacaagagttttcccaaatataaatgaaac

SEQ ID NO: 196198 - DNA, 601 bp, Human
ccaattcctgaacaaatggcatgccatcactgcataattttgttttttatgtgcttgcggttgttgtttaggagcttattttactgttaagtcatgtctctaagtcatttaagagcattagaatgaaaagatatggtcaaatttatgaggccaagaatgaaccttgtgtgagtactttacaccacattgagaatctaattattggtccataacacagcatttattactgttttctcttttcatacagactatgttgcaaattggcatacaatagtatccagttttaaagggccatttataygtaaagtagctatttttatctatttgtggtagtttatgggtaaaataccctgttttagcataggactggtgataggaggttaaaaacatttttaagaaatgaaaacacctttcaacagtgaaagctatgccaatactgtagatttggaataacataattgagaaacatctgtaaaatgaggcctgtcttattttatgtacaactttcctgagatacattttgtacaactttcctgagatacattttggacttcttttaagtgccttttttaaatttttttttttttttaagacaaggtct

SEQ ID NO: 196199 - DNA, 601 bp, Human
ggaaagatgttccacatcgcaaatcatcaagtaaatgcaaatgaaaacaacaagatactaattagtacctactgattagaatggtcaaaatccagaacactaacaccaccaaatgttggtgagggtgtgaaacaacgggaactttcattcatttcaggtggaaatgcaaaatagtacagatagtttggaagacagtttggcagttacaaaactaaacacactcttaccatatgatacagcaatagcactccttagtatttaaactaacgaactgaaaatttatgaccatacaaaaaactgsacagatgtttacagcagcactttcagacatgtattatagaatacttacatgtacatgtttgaattatgcttgttttatgttgaaatataatctgtaatttacatacatcaagataactcagtacattaagtattatttacagagagagatccaaaatatatctcaagatgtaaggcagattccactaagcttgactttctaaataaccttttaaaaattatgtagttatttcaaaatatttttaattaaaaagacacacacagatatgaactctccaacacaaacatacagctgtatagc

SEQ ID NO: 196200 - DNA, 601 bp, Human
aaacaacaagatactaattagtacctactgattagaatggtcaaaatccagaacactaacaccaccaaatgttggtgagggtgtgaaacaacgggaactttcattcatttcaggtggaaatgcaaaatagtacagatagtttggaagacagtttggcagttacaaaactaaacacactcttaccatatgatacagcaatagcactccttagtatttaaactaacgaactgaaaatttatgaccatacaaaaaactgcacagatgtttacagcagcactttcagacatgtattatagaatayttacatgtacatgtttgaattatgcttgttttatgttgaaatataatctgtaatttacatacatcaagataactcagtacattaagtattatttacagagagagatccaaaatatatctcaagatgtaaggcagattccactaagcttgactttctaaataaccttttaaaaattatgtagttatttcaaaatatttttaattaaaaagacacacacagatatgaactctccaacacaaacatacagctgtatagcctagtgtaacattataagacacatgccatagtaagcagcatcca

SEQ ID NO: 196201 - DNA, 601 bp, Human
ctcttaccatatgatacagcaatagcactccttagtatttaaactaacgaactgaaaatttatgaccatacaaaaaactgcacagatgtttacagcagcactttcagacatgtattatagaatacttacatgtacatgtttgaattatgcttgttttatgttgaaatataatctgtaatttacatacatcaagataactcagtacattaagtattatttacagagagagatccaaaatatatctcaagatgtaaggcagattccactaagcttgactttctaaataaccttttaaaaattrtgtagttatttcaaaatatttttaattaaaaagacacacacagatatgaactctccaacacaaacatacagctgtatagcctagtgtaacattataagacacatgccatagtaagcagcatccagatcaagaaacaggactttgccagccaccctagaaaccctacgtgggccttgtcccaatcatacttccttctctctcccccaaagtaaccacatcctggcatttactatcttatatggttttagcaaccaaatctacatcattagacactatagacagtcatgatcatttcaaaaa

SEQ ID NO: 196202 - DNA, 601 bp, Human
ttattttaaaccacaggcatctcattttttcttttcttttccttataatttatgtggacaaatctgggttatttgaactgtgggagacttattctatgggttcctgactgcatatgtatggtggagtttggcacattcttccttctgtatttatgacaaattggaagctggatgtggagacttgatgcctttggcaagactataggtgatatgttatcaggaggcactatgtggtttgctctccttttgagaagcaagcagctgttggtgaccatggtccagatccattaattcatcaggrgttgtaaaaatggtgattttctacttttatcatttcactttcatttgtaagcaggtataattttaagagaaacattgcttatctactatttagttaccagtgatatagttcatacaggaggggcaagataaatgcctgattcttttcctttatttaccagacttcttcttctttaaaagcaatttatttgattcggaccacaaaatacagggaaggagcaagggctaccctgtaacgccctggtcacacatcttcccagtctatgcttctatacatactctttgtaaaacagcaagctca

SEQ ID NO: 196203 - DNA, 601 bp, Human
tcttctttaaaagcaatttatttgattcggaccacaaaatacagggaaggagcaagggctaccctgtaacgccctggtcacacatcttcccagtctatgcttctatacatactctttgtaaaacagcaagctcatactgtccccaagtgttttttttttccacattatcacagctgcagagtataggataaggtgggaagttaaaacagatggcccactcagaaggtagggctccctccaatgcatgttccagctcccttttgctaatcttgaaaccaaggtaactggctcttcttactaytgttttacttttttttttgagacagggtctcactctgtcacccaggttgaagtgtagtggtgcaattttggctcactgcagccttgacctcccgggcttaggtgaccttcccacctcagcctcccaagtagctgggagtacaggcatgtgccaccatgcctagctaatttctgcatttttgttagagatggggtttcataatgttgcccaggatggtctcaaattcctggactcaagcgatctcttggcttctcaaagtgctcggattacaggtgtaagccaatgtgcccggccctcatt

SEQ ID NO: 196204 - DNA, 601 bp, Human
gtccataggtcttgaggacctctgtgtaattgttttctcctccacattcttttgggcctgtttacatagcctcataagctgcttttcttccaatagcagatattggccttcttcctcttctcctgggtggctgtcactgcctggtacttccagccaaactcgtgaaccaggcaccccagataggcaaattttctcacaggcttcagacacacaaccttgggagcagcaggaagcatcatccactttttcttgtcatagggcagtgggatcccattaaacaccttggggtggtcagggacgkcctggcctcgcttggtcttgcgaagcagcatgcctcaagcggtctgccaaaagatgcagatggggggcctcaggaagggttggtgttcatctacttgtgaaggaaggccaggtactccaacctgtttctgtggaaagtgccaaaaatgttgatgcctttgcagtgcacgaccaccaccttctggcccagcagtacctgcctatccaggacggctgtcaggcagaccagaaggtggccttggccagtgagcaccaggacctgcccctccatctttggcagctgcctgggaaaataccagtt

SEQ ID NO: 196205 - DNA, 601 bp, Human
cagtgggatcccattaaacaccttggggtggtcagggacgtcctggcctcgcttggtcttgcgaagcagcatgcctcaagcggtctgccaaaagatgcagatggggggcctcaggaagggttggtgttcatctacttgtgaaggaaggccaggtactccaacctgtttctgtggaaagtgccaaaaatgttgatgcctttgcagtgcacgaccaccaccttctggcccagcagtacctgcctatccaggacggctgtcaggcagaccagaaggtggccttggccagtgagcaccaggaccygcccctccatctttggcagctgcctgggaaaataccagttttcaagataactgctttcctgtcattctttgaaggtgaccaattatttttgcttttcattatgatgaacttatccatttattgatttttatttttaattagagatagggtcttgctatgctgtccaggctggttttgaactcctgggttcaagctatcctcctgcctcagcctctcaagtagctgtgattacatgcatgcttcactgcccatggcttgaacttatcaatttaaacgtacttagtggattttaatctatta

SEQ ID NO: 196206 - DNA, 601 bp, Human
ttagagatagggtcttgctatgctgtccaggctggttttgaactcctgggttcaagctatcctcctgcctcagcctctcaagtagctgtgattacatgcatgcttcactgcccatggcttgaacttatcaatttaaacgtacttagtggattttaatctattatagttcttatttttactgaaactcaaaattctcatttttggccaatggaagcctcttccagttggctcctgagtcctttgaccttactctagcagtctttgttagcttctttgttacctggtttgatatttcagactmatcttgtacatttccaatttcagtctcttctccaagaagccctggttagtggaaaatattaattcaagcccgcactctgtgtgttagagatgctcatagctactggtttcatactgtttctaggtcttttcaggggacatacatatatatgcatatttatgtatatttaaaatacaatatatcatatgctcatattaatattttcaattaaaactcagaactatagtgtttttctttttaacatatcatacaattcacccatttaaagtatacactttagtggctttagtatactcacac

SEQ ID NO: 196207 - DNA, 601 bp, Human
atacaatatatcatatgctcatattaatattttcaattaaaactcagaactatagtgtttttctttttaacatatcatacaattcacccatttaaagtatacactttagtggctttagtatactcacactgagttgattcacaattttagaacattatcatcatctcaaaaaagaagtgctgtgtgcatcagcagtcactccccatttccctccaacccctcttgtcctaggcaaccactgatctactttctgtctctatgaatatgcctattttggacatcatacagtatttatttggtkgtctgaagtttgttcccaggtatattcatcaggaaagggtcctggaaacaatattcccaagttcttgcatgctgacaatagcccgcttgtgtcatttacacctgaaagtcagttttgctgggtataaaaatctttgtttctcattctcaccacggctgccagaatatcccttgagttggtcattaaaatgagagatctatttataatacaatagaatgcaatctgcgaatttggggtaagaaatgagttaaaactatggtcatcccctaagtaaagaatcagtacatattcccaactgtt

SEQ ID NO: 196208 - DNA, 601 bp, Human
taggtaatacctaataaccaaacagagcctgagaaaccagaattctagattctaaaggtaatgttctttccaccctataagagctacttcttaagttcattagctggatgtctccaatacaatgattatttcaagtagccccatctttttttttttttgaggcagaatctcactctgttgcccaggctggagtgcagtggcgtgatctcagctcactgcaacctccgcctcctgggttcaagcaattctcctgcctcagcctcccgagtagctggggttacaggcatgcaccactacaccyagctattttttttttgtatttttagtagagacagggtctcaccatgtttgccagcctggtttccaactcctgacctcaggtgatctgcctgcctcggcctcccaaaatgctgggattacaggcatgagccaccacgcccagccaacccccggtttacaaatgatttacctataggctcaaaatttggtgatttcccttagaaagaaagagatctagtaagggcctcagatcactacataaaagtctactccagttacatgttctcagacaagtagctcgtatcctattactggaaggaga

SEQ ID NO: 196209 - DNA, 601 bp, Human
ggttacaggcatgcaccactacacccagctattttttttttgtatttttagtagagacagggtctcaccatgtttgccagcctggtttccaactcctgacctcaggtgatctgcctgcctcggcctcccaaaatgctgggattacaggcatgagccaccacgcccagccaacccccggtttacaaatgatttacctataggctcaaaatttggtgatttcccttagaaagaaagagatctagtaagggcctcagatcactacataaaagtctactccagttacatgttctcagacaagtasctcgtatcctattactggaaggagaaacacagtcttagggtgacaaggaagtaaagtgacagaatacattattagctttttgtcacatctatagattccatgaaacagctttaaaaaattaagtatttcaaatttacacatggcttcaatatcggtgtagtcataaccaaactatcaattcctatcatgaatagtcttatatttgctttggataattaaaaataaagtaaaatattacaaaattgtaaacatatactttctaattgtcttcagtttccatggtaaagtgagtctagattt

SEQ ID NO: 196210 - DNA, 601 bp, Human
cagctttaaaaaattaagtatttcaaatttacacatggcttcaatatcggtgtagtcataaccaaactatcaattcctatcatgaatagtcttatatttgctttggataattaaaaataaagtaaaatattacaaaattgtaaacatatactttctaattgtcttcagtttccatggtaaagtgagtctagattttgatttgtaaagcctcacgagtttctggtagactgtgtccttccgttttaatagtcacctcttttatctctcagaccaggttttcttttttctcctgctcattacygaaaagcttttctcttactcccttctttctcaagcaagcattcattctttttgaagtttcttaagggccatttactgcttgtaacaacaggaaaaaggctctttgctatgcctttcctaacacctttcaattagatcctgtaggaatagacaaagtcactgactgtgccaggtatctcagtagcccaaaatttccatgtatgttagtaataaatataaactttattatatgcttatctatagcaataatatattaatagagcatatacacttatcacaaataattcaacttttgacttct

SEQ ID NO: 196211 - DNA, 601 bp, Human
tttttagtagagacggggtttcaccgttttagccgggatggtcttgatctcctgacctcgtgatccgcccgcctcggcctcccaaagtgctgggattacaggcgtgagccaccgcgcccggcctaatttttttatttttagtagagacggggtttcaccatgttggccaggctcgtctcaaactcttgacctcaggtgattcgctcgccttggcctcccaaagtgctgggattacaggcgtgagccactgtgcccggcaactgctagttcatttttatgagatttaggtatgtaactgatragcaagtaaacagaaaaggaagaaaagttgtggtaccaaccctggcaacactggttttgggaataatatgtggacacggtcatgtgctttgctacagacagcagagtgtaatcccatttctgtcatgtcctatatggctaaggaattagcttctcagagcttcagtgtatctacaatatggagatgacgtaattaccccagtactgatactgtgtacttggcacacaataaaccataaaaaaagttttatcaccattgctgccctccttctcttcttcttcattccaaaggaaagaaaga

SEQ ID NO: 196212 - DNA, 601 bp, Human
atactgtgtacttggcacacaataaaccataaaaaaagttttatcaccattgctgccctccttctcttcttcttcattccaaaggaaagaaagaaatgaaccatcaatacagaactcttaagttcctctctttagaatgttatttcctccaaatcttccatggttgacccttctatgttattcagactgtggctccgatttggcctaaagtagtcctcatcatctccctttcccaccctccatcactttatcacatggttatattgtattttcttcagagctcttattgccatctaaaatkatcctgtgaacttgtttaacattttacccccttatcatgtaaatcttacgaaagcagaaactttgtctaatttgttcactgctgaatcctccagagactagaacatggcatggaacataacagatgcttaacacatttgctgaataaaggagtgaatcataagggactagacatgttaaaaattggaagcctgaccagatgatagagagaagtctactataactagttattcagggctcaattctaaattagtattattccaagtttagttataaagcattagacggcagaaactcataa

SEQ ID NO: 196213 - DNA, 601 bp, Human
tttcccaccctccatcactttatcacatggttatattgtattttcttcagagctcttattgccatctaaaattatcctgtgaacttgtttaacattttacccccttatcatgtaaatcttacgaaagcagaaactttgtctaatttgttcactgctgaatcctccagagactagaacatggcatggaacataacagatgcttaacacatttgctgaataaaggagtgaatcataagggactagacatgttaaaaattggaagcctgaccagatgatagagagaagtctactataactagtyattcagggctcaattctaaattagtattattccaagtttagttataaagcattagacggcagaaactcataaatgctggagttatttgccttaatagctaaacctaaactgtattatacagtgttctttctacctgactatagtaaccacatcagagaaaactaaggaagtcactatttaataatcataatatcaagttagacttaagaactgaaacacataagttagcagtaatttataaattagagcaactgtgggtattgttttgtcaataactaaaaataacataaaatatgatta

SEQ ID NO: 196214 - DNA, 601 bp, Human
ttctttctacctgactatagtaaccacatcagagaaaactaaggaagtcactatttaataatcataatatcaagttagacttaagaactgaaacacataagttagcagtaatttataaattagagcaactgtgggtattgttttgtcaataactaaaaataacataaaatatgattacacaagtaaatgcatcaacctaaatggtatttataaaactaagatgacaatctcttctgcttatcttttctaaccctagccttctacctaatgtcaagaatgaaaaacaaaagtgtttagaatraagagccacgaaaaaaattcttctgttctatgcctatcctattaaagctctggaatttccttgtttttgaaggaccttagaatctctatttgtactacttcagaggaatcggatacttcaaattattataaaataaatatcaattgttaagttaaaaacaaacattgccctcaaggcttatgtttattttattatcaatttaaatgaattttcagctaaattacaagactggagctgtttgctttcaaatgcaaacaaattgtggcatactcagatatatgacctctcttgggaaaacat

SEQ ID NO: 196215 - DNA, 601 bp, Human
agttcaagaccagtgtgggcaaaatggtgaggccttatctctacaaaaaaataaaaagtagcctgtaatcccggcactttgggaggccgaggtgggtgaatcacgaggtcaggagatggagaccatcctggttaacacggggaaaacccgtctctactaaaaaatacaacaaattagccgggcgtggtggcgggcgcctgtagtcccagctactcgggaggctgaggcgggagaatggcatgaacctgggaggcggagcttgcagtgagccgagactgcacaactgcactccagcctgggygacagagcaagactccatctcaaaaaaaaaaaaaaaaaaaaaagtaaaaataaataaataaataaataaataaataaataaaaagtaattagccaggcatggtggtgtgcatatatagtcccagctattcagagagctgaggcaggattccttgagcccaggagttcaaggatgcagtgaactatgatcgtgccactgtgctccagcctgagtgacagagagaccctcaattctgaaaaaacaaaacaaaacaaaaaccaatgacaaaaatccaaaacaaattcacagcaccacaatcaa

SEQ ID NO: 196216 - DNA, 601 bp, Human
gattatgacatcacttaaaactgctccattaaaaaaaactcttttaattcatacatcccaccatatagccttaactttaaaagcttccaataacctattaaattatggctactactcctacgctacttcagctaaacctcaagcaattcaatcagtccattttctctctaaccactactcacctgcctttttcctactgccttatattcatcttggactgcatggtctatacattcaataaattctgccaatactttaaaatccatgcctttctctctgtgttacctggctaccaaacctyaactaaaaccaactaactgccttctccatgcttgtacctaaagtgccgaacactgttggaaaaagcatcatacatttataaggattgaggctaccataaattcatggctaccagcctagacactgtccagaacctctaccatgtttctgtactcaaccctttagaatgacaattttaaaatgtacacgttcacatcaaacatctctcctcttcccgagtctcagcagaaatccttgtcttgtatttaacaggatccaccagagaataactatctcatttatttgccaccaagtctaataa

SEQ ID NO: 196217 - DNA, 601 bp, Human
ctttaaaagcttccaataacctattaaattatggctactactcctacgctacttcagctaaacctcaagcaattcaatcagtccattttctctctaaccactactcacctgcctttttcctactgccttatattcatcttggactgcatggtctatacattcaataaattctgccaatactttaaaatccatgcctttctctctgtgttacctggctaccaaacctcaactaaaaccaactaactgccttctccatgcttgtacctaaagtgccgaacactgttggaaaaagcatcatacrtttataaggattgaggctaccataaattcatggctaccagcctagacactgtccagaacctctaccatgtttctgtactcaaccctttagaatgacaattttaaaatgtacacgttcacatcaaacatctctcctcttcccgagtctcagcagaaatccttgtcttgtatttaacaggatccaccagagaataactatctcatttatttgccaccaagtctaataagttacctacttgtattcctaccttctcctccgctttctcatattgcaaaggatgcctccccaaaggccatctgt

SEQ ID NO: 196218 - DNA, 601 bp, Human
tttaaagtacaaattaaatttaccaatcataatggaatagtcaatgtgtaacagctataactcattaaccatggaaatttaattataaacataataagcaaaattacaattctctgttttactgaattaaacttttaaatgaaaatattagctattcagtattttacattcctttcttataaaaatttcaataatgccaaatagtaaattaacatttaaaatatatgtaaggctaaatctaaacctctaagaaatcaaagggccaaacatattaatatacaacaattacataattatatarttacattaatataacaatcagtatcacctgataaatataattaaaattgttcctttctaggaaattggcataaatgtgtcattaagttttagttagtttcctcaaattaaggaccatatatgtaccttgtagaatcactttcacatttacttcttataatttcttcttaggtttataatttcagaatgctctatgttaaatctattttaaaggtctacaataaatgacctactgtatttagtaatgatataatctacaaatagtctccagctgattttcaaaactttctttttcagagaa

SEQ ID NO: 196219 - DNA, 601 bp, Human
agaaaaggaagtgaaggtggggagggggtgtcttagtgttgtgcagccagggaaggcctcggaggggctgtatctatcttggtgggtggaaggagcagggtgaaagacattctaggtagaaggaatgcagatttaagaagcacacagatgggcttggtgcgttttttggaagaaaaagggtctgttatacagtggaaggtccatgaggactgttatgaaggaaaccagaaaaggtaggctgaggctgaattacaaaggctttgtaggccaaatcaaaacgactcaacttttaaggccacayggaccagtggtggtttgcaagaagactgtgtggagtgatgacaactttccttagtgccacagtggggaagagactgaagaggggagacgctggcagtacgaaggtcagttggatgaacattactgtcggttttctccctgtgtactggcctgtcattccaataacaaaaccgaccaaccagaacatcaactttttttcttacaggtctcatcaagttttccagttttggtttatgagctacatttaatcactaaaatgtaagctccacaaggccagggattgggggctattttatctcag

SEQ ID NO: 196220 - DNA, 601 bp, Human
gggaagagactgaagaggggagacgctggcagtacgaaggtcagttggatgaacattactgtcggttttctccctgtgtactggcctgtcattccaataacaaaaccgaccaaccagaacatcaactttttttcttacaggtctcatcaagttttccagttttggtttatgagctacatttaatcactaaaatgtaagctccacaaggccagggattgggggctattttatctcaggcatatctcgaggccatgagcagtgtctgacatatagttggcactcatccaatatctgctgaagrgatacttgatttcttccaaatagtgattgtgatctggagcacatctctcacggttttttcccaatcaccgcccaatctgataagcaccatttccatgtgccactctgtacaggtgaggacactatataaaaacatgcctagaagggtcttcctgctgagggggccactcaaactcacggtcatcaaaactttctgtctcttaataagtgaaaaacatggttcttactgctctcaaggtctttcccagaagactgtctcaataaggacgctgttgagaaggggcagagaaagctttatcag

SEQ ID NO: 196221 - DNA, 601 bp, Human
aatctgataagcaccatttccatgtgccactctgtacaggtgaggacactatataaaaacatgcctagaagggtcttcctgctgagggggccactcaaactcacggtcatcaaaactttctgtctcttaataagtgaaaaacatggttcttactgctctcaaggtctttcccagaagactgtctcaataaggacgctgttgagaaggggcagagaaagctttatcagcttttctttcattttgcaatctatttatattcttatttttgttacgtctttttgttttttttcccctaaattamtgaaatatagacttaaccacatatttattttttcttaatgcagacctttggaattatgtatttttttaagtataactctggctgctttccaacaaatttaatgtgatgcttatactgtagttgttaagttgtctaatattgtatactcattccttgatctagttatttgagagatttttaaattttcaagtagttttaccattttaaatatgtgtacatttctaatgttatattttgattggaggtatgatgtacatattttcctaaaattttcattgtctacagcatatgaaaaatatt

SEQ ID NO: 196222 - DNA, 601 bp, Human
actaatagagtgagaactcactcattaccctggaggaaggcaccaagccattcataagggatctggccccatgacccaaacatctctcatgagaccccatctttaacattggggatcacatttcaatatgagatttggaggggacacacatccgaactatatcgattacctgatttttaatttcactgtatcactatttcaattcttccttttaactatattgcatagctgttatttcttcactgtatgggattaacatatatttttattttaaggtattgtgatcactgttttcaattctttttttttttttccaattaggccttttgttgatatctctactttctggatttaaatctacctaattagagatcataattaaagttctttccatatataagaaagcaggataaatgtgagctcaatttttataatttagtatttaggcaggatttgggagggtgctaatgtatttctggtggatccaaatgtattgttggatttttcttgtttataccacatatttctaccttttatggaaaattcaatataagcaatatatgtgggttattttatggtatcaaattttttgtattcataa

SEQ ID NO: 196223 - DNA, 601 bp, Human
ttcactgtatcactatttcaattcttccttttaactatattgcatagctgttatttcttcactgtatgggattaacatatatttttattttaaggtattgtgatcactgttttcaattctttttttttttttccaattaggccttttgttgatatctctactttctggatttaaatctacctaattagagatcataattaaagttctttccatatataagaaagcaggataaatgtgagctcaatttttataatttagtatttaggcaggatttgggagggtgctaatgtatttctggtgsatccaaatgtattgttggatttttcttgtttataccacatatttctaccttttatggaaaattcaatataagcaatatatgtgggttattttatggtatcaaattttttgtattcataaaaatagcaaaaccagattgctgttaatgctcttccattctttgctctggtcactaggaaaccggaagatacatttccatccaaagcccagatgatttacaaactggcagaatacactgctatgtgctaaccttatctgaaactttaatatgccctaactttattctctgtttttccacagc

SEQ ID NO: 196224 - DNA, 601 bp, Human
gaggatgatacaaaaatcctttcttaatctatcaataaaaggcagctaaatttaaaattcctgctttgctccaagcagtggataattaatgaagccttgactcaggaagagctccaaagcacttgatacagggatgctggcctttaggactgtttacttggtagctaagtgtctcacccccttaattacataaaaactacaatttttatatcttacttgccaggctttattcatttaaaaaagtttttatttgtattaacattaaaataattctcaaagaaaaaaattcatccacaagccygccactacactaaacttctttaatttgtccataggcacatataatttgtagctataatcacaccatacataacataatagagccagtttctaaaggcattacttaacattccctgacaatatgttctgccaaactttcccagcttgctcatttcattagtacatattgtaagaaactcagtgtaagctacagcttcattgaaatataaaaattccatagattccttctaaatatatgtcacgaatggcatattttaccaaaaatgtagtttaagacactttataattcacatttatatac

SEQ ID NO: 196225 - DNA, 601 bp, Human
cagggatgctggcctttaggactgtttacttggtagctaagtgtctcacccccttaattacataaaaactacaatttttatatcttacttgccaggctttattcatttaaaaaagtttttatttgtattaacattaaaataattctcaaagaaaaaaattcatccacaagcccgccactacactaaacttctttaatttgtccataggcacatataatttgtagctataatcacaccatacataacataatagagccagtttctaaaggcattacttaacattccctgacaatatgttctsccaaactttcccagcttgctcatttcattagtacatattgtaagaaactcagtgtaagctacagcttcattgaaatataaaaattccatagattccttctaaatatatgtcacgaatggcatattttaccaaaaatgtagtttaagacactttataattcacatttatataccacttttcatcttacctcttctccagacagatagtaggctgagagtagtccaccaacaaagcgtatatttacttcaaagacagaaatttcagcattctatggaaaaaaaaaattcaaacatgatgata

SEQ ID NO: 196226 - DNA, 601 bp, Human
cccccttaattacataaaaactacaatttttatatcttacttgccaggctttattcatttaaaaaagtttttatttgtattaacattaaaataattctcaaagaaaaaaattcatccacaagcccgccactacactaaacttctttaatttgtccataggcacatataatttgtagctataatcacaccatacataacataatagagccagtttctaaaggcattacttaacattccctgacaatatgttctgccaaactttcccagcttgctcatttcattagtacatattgtaagaaaytcagtgtaagctacagcttcattgaaatataaaaattccatagattccttctaaatatatgtcacgaatggcatattttaccaaaaatgtagtttaagacactttataattcacatttatataccacttttcatcttacctcttctccagacagatagtaggctgagagtagtccaccaacaaagcgtatatttacttcaaagacagaaatttcagcattctatggaaaaaaaaaattcaaacatgatgatagtacacaattcagaaaaccattattgtgataaattatactaaatactt

SEQ ID NO: 196227 - DNA, 601 bp, Human
tagtacatattgtaagaaactcagtgtaagctacagcttcattgaaatataaaaattccatagattccttctaaatatatgtcacgaatggcatattttaccaaaaatgtagtttaagacactttataattcacatttatataccacttttcatcttacctcttctccagacagatagtaggctgagagtagtccaccaacaaagcgtatatttacttcaaagacagaaatttcagcattctatggaaaaaaaaaattcaaacatgatgatagtacacaattcagaaaaccattattgtgwtaaattatactaaatacttaaattttgttcaaatcttatgcttgcccagagaagtttatatacagggggaaatgttctcccttttaaaattaaggtattaaatatcactgtgcattatacgtatcgaaacatcactaacggacccccaaaatacgtacaatcattatatgacaatttttaaaaataaaggaaaaaacatacttaaaataaatgatacggtttgtctctgtgtccccacccaaatctcatcttgtagctcacataattcacacatgttgtgggatggacccggtgggagat

SEQ ID NO: 196228 - DNA, 601 bp, Human
gagtgtaaaatttgtttatacttaggagcaccataggataaacaaactctcaacaataatgtttgtttcatttttattttccctttgcaataaatttagatgcattaacttttctttttttttttttttgagtctgagtctcactctgttgcccaagctggagtgcagtggtgcaatctcagctcactgcaacccctgcctcccaggttcaagctattctcctgcctcagccccccaagtagctgggactacaggcgtgtgccaccatgcctgggaaattttttgtattttcagtagagayggggtttcgccatgttagccaggatggtcttaatctcctgacctcatgatccacccgcctcggcctcccaaaatgctgggattacaggagtgagccactgcgcctggccaactttttaaataatacccttacactgtcaattagaataccttatcaggaaaaagtgttaactaaaatataagtaataatatttataagctagaatgatactacatgttatttagtataatttttcttttttttttgctaaggctttttcaatttctcctttcttcatataaatgagaaaaatttctcaat

SEQ ID NO: 196229 - DNA, 601 bp, Human
ccgctattatatttgaggaggtttggggcaacaatgctacaattaccagatggaccaacccaagattcagtaagaaacttggacactattcataagtcaagtgttactaaagtatgctttccagttttccatcattagtgtttcagaggaatttagttattattcccctaccctttcttgaaaagacagatatcagtcggtttcatacatagctaaagaaaagcctgcaggtttttgaaggtaggagctgattttaataagaaggtagaactgaagtttttttgttttgttttgtttttgttttttttttttgagacggcgtcttgctctactgcccaggctggagtgcagtggtgcaatcacggctcactgcaacatccgcctcctgggttcaagcgatcctcctgcctcagcctcctgagtagctgggattacaggcacacaccaccatgcctggctattttttgtatttttagtagagacggggtttcaccatgttggccaggctggtctcaaactcctgacatcgtgatccaactgcctcgacctcccaaagtgctgggattacaggtgtgagccaccacgcccggtccacagaagt

SEQ ID NO: 196230 - DNA, 601 bp, Human
cactaccacaggtcattctaatcaaatagctccataaccttgagcaaatcactagctccttatgcctgctctctcatgtttaaaatagaagggtttaacacattgatccccaaggtcccttaatattgatcggaatattctctcctttatattctagattcaattattaggcaaattaaacacagactcatctgcctgtcttttaggtctcccaaatgcggtatatatagcaattaattaggggagtagaaacaaaatattaaacttttaatttatataagtttttaattgaaatagatgrgggaaagacttagctttactgatccttaatattctacctaacactggtgtcctcatttggtctctgagagaacaagagtgccacaaagcagaggcaacagcagggaaattctctttgtccactttcaacacacagcatgttacttgtgcgtggtgactgggatttacagaaactatcaaatgcttacccgaaagacaagagactttacgagaatttctgcaaagtagtctcagattagaaataatactgataacacacactgaagtgaacgactaaaaacttccatggcctacatgcttt

SEQ ID NO: 196231 - DNA, 601 bp, Human
ttgatcggaatattctctcctttatattctagattcaattattaggcaaattaaacacagactcatctgcctgtcttttaggtctcccaaatgcggtatatatagcaattaattaggggagtagaaacaaaatattaaacttttaatttatataagtttttaattgaaatagatgggggaaagacttagctttactgatccttaatattctacctaacactggtgtcctcatttggtctctgagagaacaagagtgccacaaagcagaggcaacagcagggaaattctctttgtccacttkcaacacacagcatgttacttgtgcgtggtgactgggatttacagaaactatcaaatgcttacccgaaagacaagagactttacgagaatttctgcaaagtagtctcagattagaaataatactgataacacacactgaagtgaacgactaaaaacttccatggcctacatgctttcttctcttagtataagttctttgtcaatatcattataaagtaaaacaatgactatcaaattagagctgataagacgtagtcctccccagtcaaaattatcaagaagtattagaagtattcactat

SEQ ID NO: 196232 - DNA, 601 bp, Human
ggaatattctctcctttatattctagattcaattattaggcaaattaaacacagactcatctgcctgtcttttaggtctcccaaatgcggtatatatagcaattaattaggggagtagaaacaaaatattaaacttttaatttatataagtttttaattgaaatagatgggggaaagacttagctttactgatccttaatattctacctaacactggtgtcctcatttggtctctgagagaacaagagtgccacaaagcagaggcaacagcagggaaattctctttgtccactttcaacayacagcatgttacttgtgcgtggtgactgggatttacagaaactatcaaatgcttacccgaaagacaagagactttacgagaatttctgcaaagtagtctcagattagaaataatactgataacacacactgaagtgaacgactaaaaacttccatggcctacatgctttcttctcttagtataagttctttgtcaatatcattataaagtaaaacaatgactatcaaattagagctgataagacgtagtcctccccagtcaaaattatcaagaagtattagaagtattcactatccttaa

SEQ ID NO: 196233 - DNA, 601 bp, Human
gaaacaaaatattaaacttttaatttatataagtttttaattgaaatagatgggggaaagacttagctttactgatccttaatattctacctaacactggtgtcctcatttggtctctgagagaacaagagtgccacaaagcagaggcaacagcagggaaattctctttgtccactttcaacacacagcatgttacttgtgcgtggtgactgggatttacagaaactatcaaatgcttacccgaaagacaagagactttacgagaatttctgcaaagtagtctcagattagaaataatacygataacacacactgaagtgaacgactaaaaacttccatggcctacatgctttcttctcttagtataagttctttgtcaatatcattataaagtaaaacaatgactatcaaattagagctgataagacgtagtcctccccagtcaaaattatcaagaagtattagaagtattcactatccttaattctgattctttccctcagtatacaatgggccatgaaatatttgctaagaatgatagcatacagaatttaaaaaatatatcacatatataatcaatttatttttactgagagatgaa

SEQ ID NO: 196234 - DNA, 601 bp, Human
aaagacttagctttactgatccttaatattctacctaacactggtgtcctcatttggtctctgagagaacaagagtgccacaaagcagaggcaacagcagggaaattctctttgtccactttcaacacacagcatgttacttgtgcgtggtgactgggatttacagaaactatcaaatgcttacccgaaagacaagagactttacgagaatttctgcaaagtagtctcagattagaaataatactgataacacacactgaagtgaacgactaaaaacttccatggcctacatgctttcttytcttagtataagttctttgtcaatatcattataaagtaaaacaatgactatcaaattagagctgataagacgtagtcctccccagtcaaaattatcaagaagtattagaagtattcactatccttaattctgattctttccctcagtatacaatgggccatgaaatatttgctaagaatgatagcatacagaatttaaaaaatatatcacatatataatcaatttatttttactgagagatgaataagatccacaaaatttgaatctttctttacgggaaaatgaatgctgctgctactg

SEQ ID NO: 196235 - DNA, 601 bp, Human
acgactaaaaacttccatggcctacatgctttcttctcttagtataagttctttgtcaatatcattataaagtaaaacaatgactatcaaattagagctgataagacgtagtcctccccagtcaaaattatcaagaagtattagaagtattcactatccttaattctgattctttccctcagtatacaatgggccatgaaatatttgctaagaatgatagcatacagaatttaaaaaatatatcacatatataatcaatttatttttactgagagatgaataagatccacaaaatttgaakctttctttacgggaaaatgaatgctgctgctactgctggatacaccatgacacagtgtaaaagcataagcactggagccccatggacctacatcagaatcacagctcttgacacacaaccagctgtgcaatctggagtaagcctctgaggttaagatgtttaatatacaaaggtgtgaaattaatgcccatctcatagagttgcagtgggactgaacaagaatactaggcacatgtaggtctcaataaatactaacttcttttctcttactcttcatttgccaaaaaacaaagacacaca

SEQ ID NO: 196236 - DNA, 601 bp, Human; identical to SEQ ID NO: 33580

SEQ ID NO: 196237 - DNA, 601 bp, Human; identical to SEQ ID NO: 33581

SEQ ID NO: 196238 - DNA, 601 bp, Human; identical to SEQ ID NO: 33582

SEQ ID NO: 196239 - DNA, 601 bp, Human; identical to SEQ ID NO: 33583

SEQ ID NO: 196240 - DNA, 601 bp, Human; identical to SEQ ID NO: 33584

SEQ ID NO: 196241 - DNA, 601 bp, Human; identical to SEQ ID NO: 33585

SEQ ID NO: 196242 - DNA, 601 bp, Human; identical to SEQ ID NO: 33586

SEQ ID NO: 196243 - DNA, 601 bp, Human; identical to SEQ ID NO: 33587

SEQ ID NO: 196244 - DNA, 601 bp, Human; identical to SEQ ID NO: 33588

SEQ ID NO: 196245 - DNA, 601 bp, Human; identical to SEQ ID NO: 33589

SEQ ID NO: 196246 - DNA, 601 bp, Human; identical to SEQ ID NO: 33590

SEQ ID NO: 196247 - DNA, 601 bp, Human; identical to SEQ ID NO: 33591

SEQ ID NO: 196248 - DNA, 601 bp, Human; identical to SEQ ID NO: 33592

SEQ ID NO: 196249 - DNA, 601 bp, Human; identical to SEQ ID NO: 33593

SEQ ID NO: 196250 - DNA, 601 bp, Human; identical to SEQ ID NO: 33594

SEQ ID NO: 196251 - DNA, 601 bp, Human; identical to SEQ ID NO: 33595

SEQ ID NO: 196252 - DNA, 601 bp, Human; identical to SEQ ID NO: 33596

SEQ ID NO: 196253 - DNA, 601 bp, Human; identical to SEQ ID NO: 33597

SEQ ID NO: 196254 - DNA, 601 bp, Human
ccaataatggttttaaaagccaaatccctctgccataaattagttgtataaacttttttcaatgactcaaagaacacatataattatttttgtatgcatattttttaaaaggattgggactcttcaactgtctagaactcagtaatcaaaatatggacataattgaaaaaggttccaatcaggctccatattttagagtatcttaaagcatcacacaaagttatagatattatttacgggccatttaccactcaaaatcttcattgagatcagtatcattttattaataacaaagttttcmtatgttcctgaacacaacaatcagcatctttaaccaacttgtaaattaccttcctaactcaccactattactaccaacagttaccaagaatcagtactatctgctaagtactctgctaaatgctataactttagtattgtaaccaattcttgctacaaccctatgaaatatgttttattaccattgttagggagatgaagaaactgaggtttggaagttaaaaaacaactttactcagtcaccacatttttccacagacaaggtgccagggttcatctccaagctagcctgactccaaag

SEQ ID NO: 196255 - DNA, 601 bp, Human
gttaccaagaatcagtactatctgctaagtactctgctaaatgctataactttagtattgtaaccaattcttgctacaaccctatgaaatatgttttattaccattgttagggagatgaagaaactgaggtttggaagttaaaaaacaactttactcagtcaccacatttttccacagacaaggtgccagggttcatctccaagctagcctgactccaaagcccatggcattaaccaacacattgcatcaccttcctttaatgagtcagcaaaaaaaatcttcctttactgaatcagattrttgatctttcaacaatcaaaagaatgtgtatatggtagtgttttcaggatttttttcttatacattaattttgttgagaagtaaaacagatttgagggtcacatgacttgatttataatccctacaacgccactgatgagtcacatacttaaggatgagtcacagtttttgtgactcttatctgaaaatttgggataattccttacaggatgcatgtaaggaatacatgatcgtggtatatgtttttgcaccttgcatactgcttgacagatggcaggtaatcacgtttattaaatttta

SEQ ID NO: 196256 - DNA, 601 bp, Human
ggtttggaagttaaaaaacaactttactcagtcaccacatttttccacagacaaggtgccagggttcatctccaagctagcctgactccaaagcccatggcattaaccaacacattgcatcaccttcctttaatgagtcagcaaaaaaaatcttcctttactgaatcagattgttgatctttcaacaatcaaaagaatgtgtatatggtagtgttttcaggatttttttcttatacattaattttgttgagaagtaaaacagatttgagggtcacatgacttgatttataatccctacaasgccactgatgagtcacatacttaaggatgagtcacagtttttgtgactcttatctgaaaatttgggataattccttacaggatgcatgtaaggaatacatgatcgtggtatatgtttttgcaccttgcatactgcttgacagatggcaggtaatcacgtttattaaattttaaatctatattaaaactaattaaattcacatcacagaaaaatagaaaccaatgagcctctgaaagactaggtatataaaaaatctacagaacacctagagattatatttgattttatttggtttttcca

SEQ ID NO: 196257 - DNA, 601 bp, Human
aaagcctgacattccacgtagaagtaaaatgggcccaaatttcaaatgcagtagtgaaaccctcacaaaaaaagataaactgaaagcaagccaaagatgttttcttcctgaatacgtatatttgctcctggtgaaaggtagagctgacacgctgtgtgaaaggaaacaaaggaccaaaatttcataattgcaacccattattttaacccagaaaatattaaattgggtataaggcattaaagaaatagtattacttccccttgactccatgcttataagaaaagattctttgatttgtactttcttcttaattggcatcagggctcattaattaggccaggtcatttattgagtatctgctacactatgaaaagattctaaaggactaaaagggaagtatacaggatgctgtctcatttactatctcattgataatgtatggaaacataagatactgcctgtttacatactcagtaaatgtttgtgaatatagaagagtaagaaaactaattaaatgttgtatacaactctattgttgtttctaacaaattaagtttaatgtcctgatctaatcaagcacgctgaagaaagaaatacgttg

SEQ ID NO: 196258 - DNA, 601 bp, Human
tggtgaaaggtagagctgacacgctgtgtgaaaggaaacaaaggaccaaaatttcataattgcaacccattattttaacccagaaaatattaaattgggtataaggcattaaagaaatagtattacttccccttgactccatgcttataagaaaagattctttgatttgtactttcttcttaattggcatcagggctcattaattaggccaggtcatttattgagtatctgctacactatgaaaagattctaaaggactaaaagggaagtatacaggatgctgtctcatttactatctcaytgataatgtatggaaacataagatactgcctgtttacatactcagtaaatgtttgtgaatatagaagagtaagaaaactaattaaatgttgtatacaactctattgttgtttctaacaaattaagtttaatgtcctgatctaatcaagcacgctgaagaaagaaatacgttggaatttccctagtatgcatagacttcatatcttgcatatttattgctagaactactcttagcaaatacttccatttgctgaagttttaaacacataatctttaaatttttatattagacacatcaaaa

SEQ ID NO: 196259 - DNA, 601 bp, Human
ataattgcaacccattattttaacccagaaaatattaaattgggtataaggcattaaagaaatagtattacttccccttgactccatgcttataagaaaagattctttgatttgtactttcttcttaattggcatcagggctcattaattaggccaggtcatttattgagtatctgctacactatgaaaagattctaaaggactaaaagggaagtatacaggatgctgtctcatttactatctcattgataatgtatggaaacataagatactgcctgtttacatactcagtaaatgtttrtgaatatagaagagtaagaaaactaattaaatgttgtatacaactctattgttgtttctaacaaattaagtttaatgtcctgatctaatcaagcacgctgaagaaagaaatacgttggaatttccctagtatgcatagacttcatatcttgcatatttattgctagaactactcttagcaaatacttccatttgctgaagttttaaacacataatctttaaatttttatattagacacatcaaaagtctttgaaaattacatgatttttccagacagatctcaggaaaactttgggcttt

SEQ ID NO: 196260 - DNA, 601 bp, Human
caaacctcagacagtcatctgaggcctctgagccctcctgctcctccatgcacagaaggcagctctatctggggtctgagaagctgtggccaggcctggcaccaaaatgacacatgccgaatcaggactgggagctggctcaactgaagaccctcacagcaccacctttccttgcctgccctacatccttcaattctcacagccttcctcctcctccacttcggctctcagctccagctctgtacctaacttttctcctcctgccctgtatgctactggggcagacaagatggtgttgtcytattcgacctggcctgtcactagatttatggaaaaccatgaattcctctcctcatgccaagctgctgtctacagctctgatattttctgaagtttactaccaccacgggagctaatgtggaccagcttctctttcctctttctgtattactcgacttcttgttgctatgtgtgcaattcgtttgttgccaggtactcgaggttgcctcttatctactgagtggagaatatatatatatggatggggattttcttcagattgaggtgtcctgaattctcctacagccaattttaatgtact

SEQ ID NO: 196261 - DNA, 601 bp, Human
agtcatctgaggcctctgagccctcctgctcctccatgcacagaaggcagctctatctggggtctgagaagctgtggccaggcctggcaccaaaatgacacatgccgaatcaggactgggagctggctcaactgaagaccctcacagcaccacctttccttgcctgccctacatccttcaattctcacagccttcctcctcctccacttcggctctcagctccagctctgtacctaacttttctcctcctgccctgtatgctactggggcagacaagatggtgttgtcctattcgacctgrcctgtcactagatttatggaaaaccatgaattcctctcctcatgccaagctgctgtctacagctctgatattttctgaagtttactaccaccacgggagctaatgtggaccagcttctctttcctctttctgtattactcgacttcttgttgctatgtgtgcaattcgtttgttgccaggtactcgaggttgcctcttatctactgagtggagaatatatatatatggatggggattttcttcagattgaggtgtcctgaattctcctacagccaattttaatgtacttctaagttggca

SEQ ID NO: 196262 - DNA, 601 bp, Human
ggaagcatcagcaactacagatctttagtgatcaagagaaaaagatattcatttttgtgggtttttttttttttttttttgagatggagttttgctcttgttgcccaggctggaatgcagtggcgcgatcttggctcactgcaatctccacctcccgcgttcaagcgattgtcctgcctcagcctcctgagcagctggaattacaggtgcctggctaatttttgtatttttagtagagacggggtttcgccatgttagccaggctggtctcgaactcctgagctcaggtgatctgcccacyttggcctcccaaaatgctgggattacaggagtgagccaccatgcccagccaaaaaaaggtattccttgctgggatatcacagatgctcccttaatatcctaaggagagctaaaaaagtgtgccatagaaaacaaatactattttcatgtaatgtctaatctcaaaagtttttttttaatacttgtaataaaaaggtaagcccaaacattctaactcatacatatatcattccacaacttcaaattttcacattttaatttttgcagcagtgacaaaatgatttttaaaattgaaatgtgc

SEQ ID NO: 196263 - DNA, 601 bp, Human
cttcaaattttcacattttaatttttgcagcagtgacaaaatgatttttaaaattgaaatgtgctatctttaaaagatttgtttatagatttgtcaaccttataaagactaagctttttcttttagattccttttttaaactttacaaatactatgaggttatcactagtattactagtagttaataaagttactaattatttagtgatcgatgaaaatgaattagcttgaatttcattaaaatgagcaaagtcagatatagttacctttttaaattacatttttttattattattattctttttttttttttttgaaacaagctatccctagagtcaagccccattcttcagttagcaagaggagaattgtagggcacaagtatttcccttttatcctttcttttgtgtgtgtatgttttctaaaacagacttttttttaaacagaagttttagatgcacagcaaaactgagtggaaagtacaaagttcctatatatcctctgtaccccaaaggcacaacctcctcactatcaacattacgcacgagaatcgtacgcttattacaactgatggacctacactgacacatcattaccaccc

SEQ ID NO: 196264 - DNA, 601 bp, Human
ttttcttttagattccttttttaaactttacaaatactatgaggttatcactagtattactagtagttaataaagttactaattatttagtgatcgatgaaaatgaattagcttgaatttcattaaaatgagcaaagtcagatatagttacctttttaaattacatttttttattattattattctttttttttttttttgaaacaagctatccctagagtcaagccccattcttcagttagcaagaggagaattgtagggcacaagtatttcccttttatcctttcttttgtgtgtgtaygttttctaaaacagacttttttttaaacagaagttttagatgcacagcaaaactgagtggaaagtacaaagttcctatatatcctctgtaccccaaaggcacaacctcctcactatcaacattacgcacgagaatcgtacgcttattacaactgatggacctacactgacacatcattaccacccaaagtccatgatttacattaaggctcactcttagtgttgtatatttcaatggttttgacaatgtataatggcatgtatttactaccatagtatcatagagtattttcactgccat

SEQ ID NO: 196265 - DNA, 601 bp, Human
tcatccctctctccaatccccagtaatttactgtctgcatagttttgtttcatccaaaatataattggaatcacaaaatacgtagccttttatattgtagccatgttacttctttcacttagcaacatgcatttaaggtacctccatgcccttttattgcttgatggctcatttctttttagtgttgaataatatttctttttagtgctgaataatattccattgtctggatatactgcagtttaattatccatttacctattgaggaacatctttgttgcttccaagttttggcaattaygaataaagctgttaaagaagagacttgcacagtataagcatttcctttttgaattaaggccagaaatcactattttcttaattaaaggattatgaattgtaattctgtaagttattattatttgaaggtagaattcataaaaatagattggccataaaatgtcacatattataggaaaatttgtttttcctaaaaaaaaaacaaaaaaaaccttctgaagtaactgtccttaaaattgtccattattaataagtggaatatccgttgtcatctagaatccatgatcttgtaagattctga

SEQ ID NO: 196266 - DNA, 601 bp, Human
atgaaatgtaatactaccagaaatgctggttcctaaggataatcttggagtagcaactagtgattccacaagacttaaaatccataattggtgtgtcccaaaaatgtattttcttatcatcatccttgtcacagaaatagcatttactgaacacttacacatcaggaagtatgtaaagcatttctccgctcatcccttacaacaactctgcaaggaaggtagtctccccagagagagtcccattgcacagatgaagaaatcaagaggtaaagtaattttcccaacatcagatcttggtggwggaggttggctatgaactcagattgagtctgaagcctaacatatattaccttgtacactgtcctgagccaaatgtgtgacccatgcaatctgggggaaacttggcttccaaataaagtgttactcatgtgctgttgatatatatctttgtatgtttctgttacttatctcattattctggaaaaatttacattatgtttaagagtgaggctttcagaaacatgacatgcaaaaccaacttccaatctttctttttttgaaaaccttgcagatacagggaaagcattaaatgtactgctat

SEQ ID NO: 196267 - DNA, 601 bp, Human
tttactgaacacttacacatcaggaagtatgtaaagcatttctccgctcatcccttacaacaactctgcaaggaaggtagtctccccagagagagtcccattgcacagatgaagaaatcaagaggtaaagtaattttcccaacatcagatcttggtggtggaggttggctatgaactcagattgagtctgaagcctaacatatattaccttgtacactgtcctgagccaaatgtgtgacccatgcaatctgggggaaacttggcttccaaataaagtgttactcatgtgctgttgatatayatctttgtatgtttctgttacttatctcattattctggaaaaatttacattatgtttaagagtgaggctttcagaaacatgacatgcaaaaccaacttccaatctttctttttttgaaaaccttgcagatacagggaaagcattaaatgtactgctatattaaaaaagtgaaaatatgagtatctcttacttctgtaccctgtagggaaaaagttacctgacatatactgaaacagaactttgctttacatacattttaatagctaaaagttctttcctttgaaaggtatctgttcacct

SEQ ID NO: 196268 - DNA, 601 bp, Human
atcttggtggtggaggttggctatgaactcagattgagtctgaagcctaacatatattaccttgtacactgtcctgagccaaatgtgtgacccatgcaatctgggggaaacttggcttccaaataaagtgttactcatgtgctgttgatatatatctttgtatgtttctgttacttatctcattattctggaaaaatttacattatgtttaagagtgaggctttcagaaacatgacatgcaaaaccaacttccaatctttctttttttgaaaaccttgcagatacagggaaagcattaaaygtactgctatattaaaaaagtgaaaatatgagtatctcttacttctgtaccctgtagggaaaaagttacctgacatatactgaaacagaactttgctttacatacattttaatagctaaaagttctttcctttgaaaggtatctgttcacctctacttgggcatcctacacgggttctttcatcaccatgagtcttggtttcattgaggattgtatttcatcaccaaaagaacaccctaataatttcattttgtgttactgaaaagagacatattgctcaatattactagcttgaatgtc

SEQ ID NO: 196269 - DNA, 601 bp, Human
aagaacaccctaataatttcattttgtgttactgaaaagagacatattgctcaatattactagcttgaatgtcaataatactctaaacattgccactaaatggcaatatcagatttctcattaaacacatgcagaaaaaaagtactgagatatggattatttttcaaagctctcttctatggtttcatctagacttctacattactaagattatcactaaaaatggcaaatgattattttagactatatgtgatacagtaccatctttaaggcaagcactaacatctaatatgcctgtatyattaccaccctaaaatcatattttctatggactgaagatcatctgaggtattttgtaagtgatggcaaatatttcctgggcctgcaaatgcattactctaacccttctggtagggttttaaaatctgatagagcctgattttttttcttcaaaatggtaaaaataataataataataataataataataatcatcatcatcatcatcattcattctattgttgatggatggcaagtggccagcaataaatatatgccagattcagcaacctgttaaaatagactgcattacttaatatga

SEQ ID NO: 196270 - DNA, 601 bp, Human
atctagacttctacattactaagattatcactaaaaatggcaaatgattattttagactatatgtgatacagtaccatctttaaggcaagcactaacatctaatatgcctgtatcattaccaccctaaaatcatattttctatggactgaagatcatctgaggtattttgtaagtgatggcaaatatttcctgggcctgcaaatgcattactctaacccttctggtagggttttaaaatctgatagagcctgattttttttcttcaaaatggtaaaaataataataataataataataatmataatcatcatcatcatcatcattcattctattgttgatggatggcaagtggccagcaataaatatatgccagattcagcaacctgttaaaatagactgcattacttaatatgagctttgaatgcaatgacttccaattttcttcagctattttatggcttaaaaattgggcaaagaccgccataaatttaggaagtaaaagaaatgtcaagtttgtcagcagaggtgaaattgttttattattccaaaagactacacaaagctgcaaaacaataataaaaatatgaatatatattagac

SEQ ID NO: 196271 - DNA, 601 bp, Human
tagacttctacattactaagattatcactaaaaatggcaaatgattattttagactatatgtgatacagtaccatctttaaggcaagcactaacatctaatatgcctgtatcattaccaccctaaaatcatattttctatggactgaagatcatctgaggtattttgtaagtgatggcaaatatttcctgggcctgcaaatgcattactctaacccttctggtagggttttaaaatctgatagagcctgattttttttcttcaaaatggtaaaaataataataataataataataataatmatcatcatcatcatcatcattcattctattgttgatggatggcaagtggccagcaataaatatatgccagattcagcaacctgttaaaatagactgcattacttaatatgagctttgaatgcaatgacttccaattttcttcagctattttatggcttaaaaattgggcaaagaccgccataaatttaggaagtaaaagaaatgtcaagtttgtcagcagaggtgaaattgttttattattccaaaagactacacaaagctgcaaaacaataataaaaatatgaatatatattagaccta

SEQ ID NO: 196272 - DNA, 601 bp, Human
ataatcatcatcatcatcatcattcattctattgttgatggatggcaagtggccagcaataaatatatgccagattcagcaacctgttaaaatagactgcattacttaatatgagctttgaatgcaatgacttccaattttcttcagctattttatggcttaaaaattgggcaaagaccgccataaatttaggaagtaaaagaaatgtcaagtttgtcagcagaggtgaaattgttttattattccaaaagactacacaaagctgcaaaacaataataaaaatatgaatatatattagacstactgcagataatatagatatatttaccccacaaccaaacctctttttcctttgcttcttgctgaaactgacaactgtaaaagcctaatgttctttcctggcctcttcacagctagaagtggctattggtcaaagttccagccaatgggacttttgtcaaggtcaatgggtatctttgctttccctcttccttctgccttgaaaaaaggtgtggcacatgcagatatgctgtcgcagtggttgttctgctgtcataaatgaattaaaagccaggagaactgcagtggtatcttctttttt

SEQ ID NO: 196273 - DNA, 601 bp, Human
gatggcaagtggccagcaataaatatatgccagattcagcaacctgttaaaatagactgcattacttaatatgagctttgaatgcaatgacttccaattttcttcagctattttatggcttaaaaattgggcaaagaccgccataaatttaggaagtaaaagaaatgtcaagtttgtcagcagaggtgaaattgttttattattccaaaagactacacaaagctgcaaaacaataataaaaatatgaatatatattagacctactgcagataatatagatatatttaccccacaaccaaamctctttttcctttgcttcttgctgaaactgacaactgtaaaagcctaatgttctttcctggcctcttcacagctagaagtggctattggtcaaagttccagccaatgggacttttgtcaaggtcaatgggtatctttgctttccctcttccttctgccttgaaaaaaggtgtggcacatgcagatatgctgtcgcagtggttgttctgctgtcataaatgaattaaaagccaggagaactgcagtggtatcttctttttttttttaagagacggagtcttgctgtgtccccagggtggag

SEQ ID NO: 196274 - DNA, 601 bp, Human
cattacttaatatgagctttgaatgcaatgacttccaattttcttcagctattttatggcttaaaaattgggcaaagaccgccataaatttaggaagtaaaagaaatgtcaagtttgtcagcagaggtgaaattgttttattattccaaaagactacacaaagctgcaaaacaataataaaaatatgaatatatattagacctactgcagataatatagatatatttaccccacaaccaaacctctttttcctttgcttcttgctgaaactgacaactgtaaaagcctaatgttctttccwggcctcttcacagctagaagtggctattggtcaaagttccagccaatgggacttttgtcaaggtcaatgggtatctttgctttccctcttccttctgccttgaaaaaaggtgtggcacatgcagatatgctgtcgcagtggttgttctgctgtcataaatgaattaaaagccaggagaactgcagtggtatcttctttttttttttaagagacggagtcttgctgtgtccccagggtggagtgcagtggcacaatcttggctcagtgcaacctctgcctcctgggttcaagtgattcttc

SEQ ID NO: 196275 - DNA, 601 bp, Human
agtttgtcagcagaggtgaaattgttttattattccaaaagactacacaaagctgcaaaacaataataaaaatatgaatatatattagacctactgcagataatatagatatatttaccccacaaccaaacctctttttcctttgcttcttgctgaaactgacaactgtaaaagcctaatgttctttcctggcctcttcacagctagaagtggctattggtcaaagttccagccaatgggacttttgtcaaggtcaatgggtatctttgctttccctcttccttctgccttgaaaaaaggkgtggcacatgcagatatgctgtcgcagtggttgttctgctgtcataaatgaattaaaagccaggagaactgcagtggtatcttctttttttttttaagagacggagtcttgctgtgtccccagggtggagtgcagtggcacaatcttggctcagtgcaacctctgcctcctgggttcaagtgattcttctgcttcagcctcccaagtggctgggactacaggcgctcaccaccacgcctggctaatttttgtatttttagtacagacgaggtttcactatgttggccaggctggtctcag

SEQ ID NO: 196276 - DNA, 601 bp, Human
ttttcttttcaatgtttgaacaatattagaattccatatccttcatttctggaaacaagactgttgttccaaacagagaagtatgaccttctaccattgacagaaaataccttcccagtactgaatataaaatgctgtccttggcttaggactctctaacttgatttaaaatatccttgtgtaaaatgctcctccaaaccagaaggatattttaccttctacaggatcctctgtcaggatttatgaaggatctgtccctctcgcctgcttccttggtcctgtctcagaaggtcaccttccyaacaactaactactcacctttgaattttactgacaaagaaccaaggtcctgaaatctagtggattgactacatggcctgcaatttttttttttttttttttgagacagggtcttgctctgtctcccaggctggagtacagtggcacaatctcagctcaccgcagcctcaacctcctgggctcaagcaattctcctgcctcagcctcccaagtaggtgggactacaggcatgtaccaccatgcctcgctaatttttagtatttttagtagggacaggattttgacatgttggccagactgg

SEQ ID NO: 196277 - DNA, 601 bp, Human
ctgataaaactgttgagttttttccaaaaatgtcttcagcataaggctctgaattaggaagtagcaaaccaagctgtgggtaacaatcatttcaaagtagaaggaaggccttaactagttttcaaccgctacgtagctgggtctttgatgtggtgctcagcacataactgagcccacagcaaggtggtggctgacagaagacgttctctgttctaataccctgacatcacaggacactggctggactttgcccaaacccttgaaaggtgccaattatatttaaggctgatctctcttaatyacaaagtctgtgaagaagtacttatcactgttacaccactttagagagtgtcagaaaaacaaactagtcaaattgaacaaaagatcgcattataaaatgtagttctgctgtaagctgcttttcccaggttctagccctaatttaaaaatatggcagacatgatctgaatcaaaaaggttttgtttcttccttttaaataaggagtcagtgtgtttccctttatgcctatagattcaaagttgtaatacaatgacccaaaaatgatgcagtggttatcatcctcgctgcaattaacacctt

SEQ ID NO: 196278 - DNA, 601 bp, Human
ttatacttggattttcttccacctctgcctgagacagcatgaacacctctcctcttcctcctcctcagcctactcaacacgaagacaaggaatgaagacatttatgatgactcacttccacctgaataaatatattttctaacaattttttaaataacattttcttttctatagcttactttgccataataatacagtatatcatacatataacatacaaaatacgtgttaactgactgcttatgtttagtcagtaaggcttccggtcagcagtaggctattggtagttaagtttgggggsgaatcgaaagttatacgcaggttttcaactgcatgaggggttggtgccccaatccctgcattgttcaagggtcacctgtaatttcatccttataatctccagaagaacctcactggaaaattagaaaatgagaactcccattcaatgattcacaggatcagagtatttcttacccttaattatatattctagaagttaagcacactcttttcctgtgatatctctttttataatcaccagaacaattattttctacttttcactttattgtagaactcagagccctatggctctcagtca

SEQ ID NO: 196279 - DNA, 601 bp, Human
tacccttaattatatattctagaagttaagcacactcttttcctgtgatatctctttttataatcaccagaacaattattttctacttttcactttattgtagaactcagagccctatggctctcagtcatgaatttcctcattgttaaaagtcactcatgatacatgaatattttatttgacaatgaagttgttactaaaaaaataaaaggccactggtttaaactggggcttttaatcttgacactactgaaattcgggctggataagcctgtgtttggggggttggggagggcagccytgtgcatttttggacgcagagtggtgtccctggcctgtatacactagatgtctgtatctcaccccaacagatgtgacaacccttatctccagacactggcaaatgtaccctgggaagcaaaacagccttagtttagagccaatggttaaagcatattattcaattaaaataataatcctaagactcacacagcactatatagtagttacaattccagacactttacatatatcaacacatttaatttaatcctcaataataactccacaaagttgggcctatatttaccttaacagatga

SEQ ID NO: 196280 - DNA, 601 bp, Human
cttaagaacaattaagttgcccttaaagagcaacctggattatccaggtgggcccaatctaataagtgggcccttaaatgcaaagaacattcttcagctgggggcagaagagatgcagcagaatggaaagtcagagattcagctgaacaggactccatgtgatgttgctggtttgaaaaaggagtgttcagttcttgctttgtcaacatgtatgaacactggaacaacacagagaagattagcacggcccctccgcaaggatcatgtgcaaatttatgaagcattccgttttttttttttgttttttttttttttttgagacagggtctcgctctgtcgcccaggctggagtgcagtggctcaatcttggctcactgcaatctccacctcgtgggttcaggcgattctcctgcctcatcctcccaaggagctgggattacaggcatgcaccaccatgtctggctaatttttgtatttttaatagagatggggtttcaccatgttggccaggctacattccatatttttaagatggtagtaaaacatggtgactatagctaagaacactgtactgtatacttgaaaactgctaagaaagtaa

SEQ ID NO: 196281 - DNA, 601 bp, Human
gattatccaggtgggcccaatctaataagtgggcccttaaatgcaaagaacattcttcagctgggggcagaagagatgcagcagaatggaaagtcagagattcagctgaacaggactccatgtgatgttgctggtttgaaaaaggagtgttcagttcttgctttgtcaacatgtatgaacactggaacaacacagagaagattagcacggcccctccgcaaggatcatgtgcaaatttatgaagcattccgttttttttttttgttttttttttttttttgagacagggtctcgctctgtygcccaggctggagtgcagtggctcaatcttggctcactgcaatctccacctcgtgggttcaggcgattctcctgcctcatcctcccaaggagctgggattacaggcatgcaccaccatgtctggctaatttttgtatttttaatagagatggggtttcaccatgttggccaggctacattccatatttttaagatggtagtaaaacatggtgactatagctaagaacactgtactgtatacttgaaaactgctaagaaagtaaattttaagtgctcccaccaaaagaaatggtaagtatg

SEQ ID NO: 196282 - DNA, 601 bp, Human
tttttgttttttttttttttttgagacagggtctcgctctgtcgcccaggctggagtgcagtggctcaatcttggctcactgcaatctccacctcgtgggttcaggcgattctcctgcctcatcctcccaaggagctgggattacaggcatgcaccaccatgtctggctaatttttgtatttttaatagagatggggtttcaccatgttggccaggctacattccatatttttaagatggtagtaaaacatggtgactatagctaagaacactgtactgtatacttgaaaactgctaagamagtaaattttaagtgctcccaccaaaagaaatggtaagtatgtgaggtaacagatatggtgattagctgaatttggccattccacaatggttacatattttgaaatgtgtacaccataaatatatacaatttttgtctaaatgaatgaatgaatgaaaagaaaatgaagggagcaaactgacgaagaatgcaggtggccttcagaaactgagagtcgactgacagcaaggaaatggggaccttagttctacagttggcaaggaactgaattttgccaacaacctgaatgagcttgtaaaa

SEQ ID NO: 196283 - DNA, 601 bp, Human
tgacagctcatttttggccttatgagactcagtgcagagaaaccaaacaaggccactctgactctgacctagaactgtaagatattaatttgtattgttttaagtcactctgtgataatttgttagagcaatgaaagaaaacacaccacacaacatgcccaagaagaacagtaagtcacccactgccacaccatgaattaccaagtggcagacagggatttagaaacccggtcttcaaaccccaaaactatttccttaagtaatcaatatctgcaaaggtttcctagcatgcaaacagttktgcatccgctcacttgctggctcctcacatccaggaaaggtaggcattatcatcactctcacaggtaagagataaagctcaaatgcactgtatatcttcacagggttggactgttaataagtggcaaagccacaagctctctcatctcagtgcctttgtgtgtgctgcctttaacactaagaaagtagtaagtaggttaaaacaaagtgagtcataaaaacagagaaaaataattttctgctgttcaggggataagaacaggcaagaatttatggaatgaataagatttaaattgggtct

SEQ ID NO: 196284 - DNA, 601 bp, Human
agtcacccactgccacaccatgaattaccaagtggcagacagggatttagaaacccggtcttcaaaccccaaaactatttccttaagtaatcaatatctgcaaaggtttcctagcatgcaaacagttgtgcatccgctcacttgctggctcctcacatccaggaaaggtaggcattatcatcactctcacaggtaagagataaagctcaaatgcactgtatatcttcacagggttggactgttaataagtggcaaagccacaagctctctcatctcagtgcctttgtgtgtgctgcctttracactaagaaagtagtaagtaggttaaaacaaagtgagtcataaaaacagagaaaaataattttctgctgttcaggggataagaacaggcaagaatttatggaatgaataagatttaaattgggtcttgatagacaggtaggatttcaaaagataagacctgattattttgtaaatttggaatcaaattcttgatttgatgtgtgcaggtgtgtgttttaactggtcaccatttacgtgtttagacttcatcacataatgaagcagcaatatgagaggctgtgaaacggttaccatctca

SEQ ID NO: 196285 - DNA, 601 bp, Human
atgaatatatagcagaactctggacaacttgcctctgacaagtaggcccacaacagagaaattttcaataagataaatacagcaaagcagatgtctggatgcagcagagatgccagaaaacctctgtgcagccaggcaatcctcttctttctgtcacttaggaggctctgtgccatgcctacatttgcactaaaaatcaatactccacccccctggccatagatgattagacacttaactaaagctgggtcagattctccattctgggaatttggaattgagcctctgagatgcttattayaaagtctattagtgtttaaacttattggctatgtaaacttgagtactgattcataagacagcctgtctgcagaggaaagaataaagcatgtatgactgaagacaaaagactaagtagcccagagtaagaaatgaggaatagcagtcttggttccctgtaccttcacatttgtaattccaggttctgtgaggtcttcacctaaatccatgagagattcctttttataataaatatcccccccccacccactgactccaaattaagtggatttacattcttactaacaaatgatctcttgta

SEQ ID NO: 196286 - DNA, 601 bp, Human
cttctttctgtcacttaggaggctctgtgccatgcctacatttgcactaaaaatcaatactccacccccctggccatagatgattagacacttaactaaagctgggtcagattctccattctgggaatttggaattgagcctctgagatgcttattacaaagtctattagtgtttaaacttattggctatgtaaacttgagtactgattcataagacagcctgtctgcagaggaaagaataaagcatgtatgactgaagacaaaagactaagtagcccagagtaagaaatgaggaatagcrgtcttggttccctgtaccttcacatttgtaattccaggttctgtgaggtcttcacctaaatccatgagagattcctttttataataaatatcccccccccacccactgactccaaattaagtggatttacattcttactaacaaatgatctcttgtatcagattctcaaaaaagcacttgggaacatgtgtcttccttgataggtcaatctacttgtttgccttgtccaaatatggcagagtggttgaatcccgctaaggaaaaatcaaacgagtgagcagagggggccagctgccggct

SEQ ID NO: 196287 - DNA, 601 bp, Human
cttaggaggctctgtgccatgcctacatttgcactaaaaatcaatactccacccccctggccatagatgattagacacttaactaaagctgggtcagattctccattctgggaatttggaattgagcctctgagatgcttattacaaagtctattagtgtttaaacttattggctatgtaaacttgagtactgattcataagacagcctgtctgcagaggaaagaataaagcatgtatgactgaagacaaaagactaagtagcccagagtaagaaatgaggaatagcagtcttggttccckgtaccttcacatttgtaattccaggttctgtgaggtcttcacctaaatccatgagagattcctttttataataaatatcccccccccacccactgactccaaattaagtggatttacattcttactaacaaatgatctcttgtatcagattctcaaaaaagcacttgggaacatgtgtcttccttgataggtcaatctacttgtttgccttgtccaaatatggcagagtggttgaatcccgctaaggaaaaatcaaacgagtgagcagagggggccagctgccggctccaactgtgtgct

SEQ ID NO: 196288 - DNA, 601 bp, Human
ctgattctttattcaaggtgggtaagatctgagcctgccaaggccccaggggatatggggaacccagcagagatgagtgcacaagaagagggtgggggcagggaccagacagacctggatttcaacctcgcaggagctgctcgaccctgggcaatttgcttgccccttcctggcttcaatttcctatgtataaaatgaggagaataatgtcaaatacccatattctgagaaaaaccaaatacttgttgttctgagaatttaatgagaatatgtacataaagtggtgagcatagtatctaayaggaagtgaacactcaacaaatggtatcctgtagttactggcatacttttcaccattccagaattaaaactgcagataaaggagacaaaatctatgccaagatgatattttaaaaatctcattattgatttccttaattatatataataacactaactgatggtataaaatcaattaaggagccactctcagaacaggaagaataacaaacacattctattaggagaaaaagggaatacatgatggagtataactgagaagctgcactttttattaaaagtatagttttaactgttgcct

SEQ ID NO: 196289 - DNA, 601 bp, Human
aataggaagtgaacactcaacaaatggtatcctgtagttactggcatacttttcaccattccagaattaaaactgcagataaaggagacaaaatctatgccaagatgatattttaaaaatctcattattgatttccttaattatatataataacactaactgatggtataaaatcaattaaggagccactctcagaacaggaagaataacaaacacattctattaggagaaaaagggaatacatgatggagtataactgagaagctgcactttttattaaaagtatagttttaactgttgyctctgttttaaacctagagaaaaagagaaaattatcagacattgctattattgctgttgttattcataaaccaaaaatacttggaaattaatagctgaggtttaagagccaactggccgggcacggtggctcacgcctgtaatcccagcgctttgggaggccaaggtgggaggatcacctgaggtcaggagttggagaccagcctggccaacatggtgaaacctggtctctaccaaaaatacaaaaattagctgggcgtggtggcgggcacctgtaatcccagctactccagaggctgag

SEQ ID NO: 196290 - DNA, 601 bp, Human
gggttacatttaggatgaattgccttttattgtcaaattctgggccacggacctatgagataaaaaaggtgtccccacttctagggtgtctgaaatctacttgaaagataacatatatgcacacaaaatcagtgacacacaggccaaagatagaaataatcaataacatgggaatttggagaagggagaaatcagtgaaggttgagagtgtagagagggcttcatgaggacatggattttgagcaagtgagaagactctccttttgagaaccataaagtaaacaaggtgaaatcctaaackacatgtgttctggagatagtaactatgtaagttttgtggaagcacagtccttcctgggaagtaacagagatacaactcaacaaataaactgatgcagatttacagaagactacggatgccaagctaaacatttgtgacttcactgtgacttcattctagagcaaaatgtttttctagctgaagtcactggaccagaagcatcagtatcacctagcaacatgctaaaaatgcaaattctggggcccacccaggcctactgaatcagaaactccaggctttcaaaatttttttattattatt

SEQ ID NO: 196291 - DNA, 601 bp, Human
ctcaaaaaattttgccaaaatggaaacaaaacaaaaccaactctaggtatatcctgtataaaattgaaatacaagaaaaatggcaacccttattaaatactgtccagtattctaggtaataaagaaaataaatgaagactctacctactttaaaaataacatatctaaaaaaaaaatactggctgtagatataaacacttttcaataaaataacagaatctttatattcgagtgttgacctttaaaggaatctcacaatcatctacatttatttcagcagtgttgtatttggtcaaaagayttttttttgtttttggcaccactttcaccagtttacagtcatataagaaaatgaatgcagttttcattttataaatcattctggaaaacaacttgaaaactggaaaaggcatttcctatattcattagtctctttattcactaggtctgattctaaatgacttctgactgttgtaaaaaaaaaaaatcaaaaagacaaagacttgtagcccatgagtatatacattagaaaggacttcaaagatgagcggacaccacttctggaataccagattacttagcgcgaaatcacacttaacct

SEQ ID NO: 196292 - DNA, 601 bp, Human
tcccacctccctctaggatggtctcagtggggcttctggcagttggcctgccatttagggctgaggaggagggagggcctggtcagccagtcaccaaagcacacgttctcattagagtcaagattatcccaggtggagtggggcctggttctcagtacttctcaacacctaagaagcaattctcagctattgtttgtacactgggggaatctcaggaagtcacagctcacaggccttatttctcatgtgtaaaatgagtagtgggtctggaatcctaataaatctaaattcaatgtgaagstctcaaaaagaccaaactctctgagctacaaaataaaactgatttatgctaactttgactactaagtgatggactgagctctgattatagaatttatcataattatataatttttgccaagcctaaaataataattctcacttcttaaaaacattcctccaagatgaaacagattgaaattcactttactcgatctctctctctatttagaagaataacttcaatacttaagatagataactcagccaaggcatggtggctcacacctgtaatcccaacactttggggtgccgaggtggg

SEQ ID NO: 196293 - DNA, 601 bp, Human
catagagatgttcatgaacaagaaccctcctgccaggtaggcctggggatttgggataatgagtccttgtagaaagttcccacaggaaaacaagttccctggcagacttatgattccctacctttggaaagggccctggagttgctagctgtaggggaccaccttgacaaaactggcccatcctcaaaggaccactgtgagtaggaatgacccagcctcaaaaaacattgtgtccttatgtccatttgttgtacaactgcccagttgccagggaaacagttccaggccccttttacacctmtggggagagccatcctattgcatttggttttggtattcttagtttttttagcggtaagctcaacttccttggacaagtcttcatatcctaagcttcatttaagccaaggtttttcaacctcagcattattgacattttgggctgggtaattttgtgtgtgtgtggaggctgtcctgtgcagtgtaggaggtttagtagatatctctgatctctacttctagactccagtagcaaccttcccccagttgtgaaaaccaaaaatgacatcagacattgccaaatgtcctctgggaggcaaga

SEQ ID NO: 196294 - DNA, 601 bp, Human
atgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcycccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctg

SEQ ID NO: 196295 - DNA, 601 bp, Human; identical to SEQ ID NO: 30307

SEQ ID NO: 196296 - DNA, 601 bp, Human; identical to SEQ ID NO: 30308

SEQ ID NO: 196297 - DNA, 601 bp, Human; identical to SEQ ID NO: 30309

SEQ ID NO: 196298 - DNA, 601 bp, Human
tacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaatwaaaaaaaaaaaaaaaaaattagaattttcagattctgggtatgggtcacatttcaaaatggaaagcctagcctttcaaaactccatttatttcctatttggcctattttcctacaaatacaaagccttgatagagttaacagactatcatgaaagtgaagacagtaatgttgccaagtagaatcccctaacaagccaagagtggtggctcatgcctgtaatcccagctacttgggcggctgaggcaggaggactgcttgagcctaggagcagtagaatcctgacaacctggcttggctca

SEQ ID NO: 196299 - DNA, 601 bp, Human
tgaacctgggaggcggaggttgcagtgagccaagattgcaccactgcactccagcctgggtgagagagcaagactccatctcaaaaaacaaacaaacaaaaaaacagggtcttaaatgccagactaaagggggtttgaatactaagtctattctagagatagtacaacttttaaatatttttgagtagtgcagtaatacagtagagtttcagaaagacttatatggcgatggtctgaaaatactggtgagatgataacctggaagcaacattattagaacagtttaagggtaaagtgttaragcttatcttaggatgttgaagatggaaaataaaaatacttgaggcacactgtgaataaaggagtgatacatcttgatggttaaaataaaatcacagttatgagcatttgggaacagaataatatgactctgaattacagaaacacgaaaataaaaaagttggcttggctgtaactatccagcagacaaaaatgtgcaaagtttagtgcctagtgtttataacagataagaataataaagcaattcactgaattaaacatagttagctaattcagaatctatcctaacagctccatgaaa

SEQ ID NO: 196300 - DNA, 601 bp, Human
ctactaaaaatacaaaaattagctaggcatggtgtagtcccagctacttgggaggctgaggcaggagaattgcttgaacctgggaggcggaggttgcagtgagccaagattgcaccactgcactccagcctgggtgagagagcaagactccatctcaaaaaacaaacaaacaaaaaaacagggtcttaaatgccagactaaagggggtttgaatactaagtctattctagagatagtacaacttttaaatatttttgagtagtgcagtaatacagtagagtttcagaaagacttatatggygatggtctgaaaatactggtgagatgataacctggaagcaacattattagaacagtttaagggtaaagtgttagagcttatcttaggatgttgaagatggaaaataaaaatacttgaggcacactgtgaataaaggagtgatacatcttgatggttaaaataaaatcacagttatgagcatttgggaacagaataatatgactctgaattacagaaacacgaaaataaaaaagttggcttggctgtaactatccagcagacaaaaatgtgcaaagtttagtgcctagtgtttataacaga

SEQ ID NO: 196301 - DNA, 601 bp, Human
acttccccttgggacactaaccttactcctggtttgatctttttctagcctatcctctttttctcctccttctcagtcccttttattttatcttgaaaaattgtttatatctttatatgctaccccaagtcattttcagaatgaggagagtatagataaatacaggcacccctagagatatgtcatctgcttagtcagttctatgctaaagatgtacaaataagtataagacatgacacttaccaggagtttgcaatctaattggggaaataaaaaatagtgtacagaaattaaacatatacacacacacacacacaataaggcaatatgggacaaatgataagtaaaatactagggaagtacaaaggcaaaagacaatcaggcaatcacgaaatgtaagaagaggatctgagctctggaatgacctttaaatagtgggaaatagacactcaaaaaaggaaagcaattgggagaacattttggctgctgaagataatatgggtaagtaggaagtaccaggtgtgattattgcatactgagtagatcagtttggtgtgaatgaagggtatgagtagggagcagtaaaagggaacgctggaaa

SEQ ID NO: 196302 - DNA, 601 bp, Human
aaaattaaaattaaattacatcaagaaaatgaggaaggggtttgtattaaaatgtgcacacactggccgggtgcagtggctcacgcctgtaatcccaacactttgggaggctgaggcaggtggatcacgaggtcaaaagattgagaccaccctggccaacatggtgaaaccctgtctctactaaaaatacaaaaattagccgggcaaggtggcgtgcacctgtagtcccagctactcgggaggctgaggcagaagaatcgcttgaacccgggaggtggagggtgcagtgagctgagatggygccactgcactccagcctggcaacagagcgagactctgtttctaaataaataaataaataaataaataaataaaaaagtgcatacactaacagggtttactgtgaaagcagggagagtacagagagctaaaccctgttagtgtaaagaaaatcaatagttgatgcaacaaagagccaaaaatgcaatataagcatgatatttacatacacaggaaatactgaaagaataagctaaaagggttgaaagcaaattgcctcagaagaaatggggttgaggtagtgctactcttagcttttccc

SEQ ID NO: 196303 - DNA, 601 bp, Human
gggtgaagggtacatagaagctctctgcactattttcccaaatctacaattatttcaaaataaaaagttaaaatgaaaagagttgaaaaggagggattatatatagtacctgagctgatgcagctcatgctgccaggagaggttttcctgcctgagctcttcttgcataatctgaaatgcttttgtcttatcttgatactcctgaagttgagccttcagtggatgtaactcagtgatctcttgattaatctgtaagtattgctgctgcagattcttcaattccttcagctttaaccaaagrgaaagtaaaatgattatttgtcacatctcattcatctaactgtaagtcattggtagctccctactaagtagtcagacaccacaacatgaaaccagcacctaacagtccactgatgacatatcactgcaacataagtctctaaagtagtgaaatacatgcagctaggctggtggaaatcacccatggagctgccatcaaggctacagggtgtgactattcctgcaacttctactccttcccctggctcctaaggtcctaagttcactttagggctacaattctgacgtggggtagacttaa

SEQ ID NO: 196304 - DNA, 601 bp, Human; identical to SEQ ID NO: 30310

SEQ ID NO: 196305 - DNA, 601 bp, Human; identical to SEQ ID NO: 30311

SEQ ID NO: 196306 - DNA, 601 bp, Human; identical to SEQ ID NO: 30312

SEQ ID NO: 196307 - DNA, 601 bp, Human; identical to SEQ ID NO: 30313

SEQ ID NO: 196308 - DNA, 601 bp, Human
aaaacattaaaaattttttttagttgttgcccaccaaaatgatttcatcatttattaatggtcctgaatttcagtttaaaacactgtcctagacagacaaatgcccaatgtgattcagagtctaatgtttggagagcaaatgtaacaggcctgagacgggagttagttgacggaaaaaagagacaggctagagctgtaaagggtggaacttccggaaatagctgatttgctggaaggggaactccatgggagctgctctggagtccctttgaaaactcccagacaaatctaccaataaagrgtctacagtttaactaattcatttgggcctgcagactttaaaaactgcaaatgtctcctctctgatacttcagtgtcaattagttgaatttaactacatttaataagtaccctctacatatgcaggcactgtgcttttccacatgcatgatcacgtttatttcagactgacttcgtcctaacacctcaggcaagttacttactactccagggcctttttcctcatctgtgaaaacagcctagtgatctttttaatttttggatcacagaccccttggtcaactgatgagttcttgtgatg

SEQ ID NO: 196309 - DNA, 601 bp, Human
aaagaaaaggtatgactccatttatatgtagttctaagtgggtaggagtgaacagaagacacaagggacttctggagttctggtatgttctgattctagatctgggtgctgattatatgggtatcttcactttgtgaaaatatatcatgctgtacttatgatttgtttacttttctgtatgttttacttcaataaaacattaaaaattttttttagttgttgcccaccaaaatgatttcatcatttattaatggtcctgaatttcagtttaaaacactgtcctagacagacaaatgcccartgtgattcagagtctaatgtttggagagcaaatgtaacaggcctgagacgggagttagttgacggaaaaaagagacaggctagagctgtaaagggtggaacttccggaaatagctgatttgctggaaggggaactccatgggagctgctctggagtccctttgaaaactcccagacaaatctaccaataaagagtctacagtttaactaattcatttgggcctgcagactttaaaaactgcaaatgtctcctctctgatacttcagtgtcaattagttgaatttaactacatttaataag

SEQ ID NO: 196310 - DNA, 601 bp, Human
aatattcccttgtgtacatataccacattcttaatctattcatctgttgacgggtacttacattgattctatgttttgttttttatgaacagtgctccaataaacatgggagtacagatgtctttttgatatattgattttctttcttgtagatacgtgggttgctggatcatatggtagttctatttttagctttttgagatacctccatactgttctccacagtggctgtactaacttacattgctaacagtgtatgggagttccccctttctctgcatccttgccagaatctgttactacctgtctttttgataaaagctatttcagcaaaggtgagatgacatctcactatagctttgatttacaattctctgatgtttagggatgctgagtatttttttttatatctgttggccatttgtatgtcttcttttgagaaacgtctattcagatcttttgcccacttttaagttgagttatttgttttcctgctatttaattgtttgagtcccttatatattctggttattaatcccttgttagatgggtagtttgcaaatgttttctctcattctgtggattgtctcttcactctgtt

SEQ ID NO: 196311 - DNA, 601 bp, Human
taccaatgcactctctatcttcatgagattcacttttttttttttgctcccacacgagtgagaatgtgatatttgtctttctgttcttggcttatttcacttaacataatgtcctccagttccatctatgttgccacaaatgacagaatttcatacctctaaaagctgaataatattcccttgtgtacatataccacattcttaatctattcatctgttgacgggtacttacattgattctatgttttgttttttatgaacagtgctccaataaacatgggagtacagatgtctttttgayatattgattttctttcttgtagatacgtgggttgctggatcatatggtagttctatttttagctttttgagatacctccatactgttctccacagtggctgtactaacttacattgctaacagtgtatgggagttccccctttctctgcatccttgccagaatctgttactacctgtctttttgataaaagctatttcagcaaaggtgagatgacatctcactatagctttgatttacaattctctgatgtttagggatgctgagtatttttttttatatctgttggccatttgtatgtc

SEQ ID NO: 196312 - DNA, 601 bp, Human
taatatattcatataatttgtaaagatcaaatcagtgtatctggaatatccatcaccttaagtatttgtctttcctttacgctagaagcatttaaattcttctcttctagctattttgaaatatacaatagattgtggtaaactataatcacctattgatttacctaacactaggtcttatttcttctatcaaaccatgtatttgcacccattaatcaacttctcttcattccctcctctcctttatccttcccagcctttagtaactaccaatgcactctctatcttcatgagattcacttttttttttttgctcccacacgagtgagaatgtgatatttgtctttctgttcttggcttatttcacttaacataatgtcctccagttccatctatgttgccacaaatgacagaatttcatacctctaaaagctgaataatattcccttgtgtacatataccacattcttaatctattcatctgttgacgggtacttacattgattctatgttttgttttttatgaacagtgctccaataaacatgggagtacagatgtctttttgatatattgattttctttcttgtagatacgtgggtt

SEQ ID NO: 196313 - DNA, 601 bp, Human
aacttatacacaacctcccagatacttaaaaaattttttaattcatgtataatagatatacatagtttcaggatacatgctataatgtaatatattcatataatttgtaaagatcaaatcagtgtatctggaatatccatcaccttaagtatttgtctttcctttacgctagaagcatttaaattcttctcttctagctattttgaaatatacaatagattgtggtaaactataatcacctattgatttacctaacactaggtcttatttcttctatcaaaccatgtatttgcacccattmatcaacttctcttcattccctcctctcctttatccttcccagcctttagtaactaccaatgcactctctatcttcatgagattcacttttttttttttgctcccacacgagtgagaatgtgatatttgtctttctgttcttggcttatttcacttaacataatgtcctccagttccatctatgttgccacaaatgacagaatttcatacctctaaaagctgaataatattcccttgtgtacatataccacattcttaatctattcatctgttgacgggtacttacattgattctatgttt

SEQ ID NO: 196314 - DNA, 601 bp, Human; identical to SEQ ID NO: 30314

SEQ ID NO: 196315 - DNA, 601 bp, Human; identical to SEQ ID NO: 30315

SEQ ID NO: 196316 - DNA, 601 bp, Human; identical to SEQ ID NO: 30316

SEQ ID NO: 196317 - DNA, 601 bp, Human; identical to SEQ ID NO: 40613

SEQ ID NO: 196318 - DNA, 601 bp, Human
attaaacctattaaatttattatattgctttcttcctaaatcattacttctttgtcattggtaaagttctgtgttccaattttgaatgtcaggttctatatgaatgatttctgtgagtatgtgtaatcaaatgatccaagggatcctcagttgcaaattggtccacttatgtttatggatggtcatctacaaaactatataaatatagatacatgtgcattgttaatctgtggattgtttacttctccattccttcctgatgtaattcatgtataggttgtccaaacatcatatatccttataatgtatacattatatacatatgtgcatgcacacaggtatgtacatcatacatgtgatattttgtattaattatcatccttaaactcctcataggaagaagaaaattgacaagtattcaaaatgtctacagacatattaactttattcacaatcctacgtgtatgcacatgtgtggcatttttatttaatatatgtgggtcttaagtgattcactaaatagataatgggatttgcaatcaggtcctacaataatttggtaaaatacagcctcatgtatttgttctattcctgctttaaa

SEQ ID NO: 196319 - DNA, 601 bp, Human
catcatacatgtgatattttgtattaattatcatccttaaactcctcataggaagaagaaaattgacaagtattcaaaatgtctacagacatattaactttattcacaatcctacgtgtatgcacatgtgtggcatttttatttaatatatgtgggtcttaagtgattcactaaatagataatgggatttgcaatcaggtcctacaataatttggtaaaatacagcctcatgtatttgttctattcctgctttaaattatattctcaattatatcattgaggcaaatataaatagggacayatgtatagctagttgattatatacatttaatggagtcctgacctcaaatttattaaaatgcttactatttagttactcgttactatttaaaggaaactttgccactcccttggctttgaaggtgacatagacagttggatatttgaaaagtctgattagttaagtggtaatgctaacttagaattgttacagaattattcatagaataaatatgtcttgaaatcctctgaagaataaaacatattgctgttccattttatgcaacatttaattcaatgaattttgattatcaactgatac

SEQ ID NO: 196320 - DNA, 601 bp, Human
tatatgtaccacattttctttattcaatccacaattgatgggcatcttggttgattccatgtctttgctgttgtgaatagtgctgcaatgaacatatgcatgcatgtgtctatttgatagaatcatgtattttcctttgtgtatatacccagtaatggtattgctgagtcaaatgtcgttctatgtttagctctttgaaaaatctccaaacttctttctacaatggctgaactaatttacattcccaccaaactgtacaagcattcctttttctctgcaacctcaccaacatttattgttytgacttcttaataatagccattcagactagtgtgaaatggtatctcattgaggttttgttttgcatttctctgatgattagtgatgctgaacgtttctttcatatgtttgttggctgcatgtacatcttcttttgaggagtatctgttcctgtcctttgcttacttttttaatggggttatttgttttttgcttgttgatttatttcagtttcttataggttctgggtattagacctttgcttgatgcatagtttgtgaatatttgcaaggtatagttttaatgatagaattcagcaaag

SEQ ID NO: 196321 - DNA, 601 bp, Human
gagcaagtcttatactaaacctcaataatatttgcattttgggggggcggggaaatgtgaaggaagaataattctggtgatagtcaaacactgccattttttaatttacatttttctaaatttaagcatattggcatgcacatttttggtaggtactgccctcctgccccctacagcctttccttgttcttggctatcttcctttctatgtggtgaagtgggaaggatagttcttgtatcatctctctgaaacacttgaaaattttgaccattccttttttcagggcaaaaataaaaattmttttgctttggcttctgcactgtcattctatctgtgttacctccttctttttggccatttattcccattgtcatactcttaaactcctttttcttttcctatttcttaactcatgatgttgttcaagattttattcccagtcttgttttctcattgtttacctcgttctccctaaaacctttcatttgactcgtgtttctgtacctgtatgctgtagactcaccaatctacattttcagttgtttgtactgacctccatattcacagttccagccatcactgatcatctttatttgaatg

SEQ ID NO: 196322 - DNA, 601 bp, Human
atccaaattatgcaggacaaagtttacatgcacagtaagtgatctattgtggtattgtttgcatttttcttggtacagtttaatttattgttgtaactgcttcgctatttaggagaatagaattggttaccaaagacattgtaaaactgttctataatactgtagtactcatttaatatacatatataaatagttttactttttaatttaacttttaaagaattttgcaaaataaaacagaattctgtttcagagtagagacacttaaacatttgtagttttcttagaacatgtataacartaccataatcttgtattcagatttttaaaatttgtaattgtggtaaaatacacatacaatttgccatcttaaccatttttaaatgtacaattcagtagtgttaaaaatattcacattgtagtgcaaccaatctccagaacttttttattttgcaaaactaaacttttgtatgcactaaacaaccattctccatttctctttccatagtctccagaaaccaccattctactttctgtttctatgaattaaatactctagatactcatagaaatcgattatacagtgtttgtctttttgtac

SEQ ID NO: 196323 - DNA, 601 bp, Human
gtggtaaaatacacatacaatttgccatcttaaccatttttaaatgtacaattcagtagtgttaaaaatattcacattgtagtgcaaccaatctccagaacttttttattttgcaaaactaaacttttgtatgcactaaacaaccattctccatttctctttccatagtctccagaaaccaccattctactttctgtttctatgaattaaatactctagatactcatagaaatcgattatacagtgtttgtctttttgtactggtttatttcacttaaaatagtattttcaaggttcatcsatgttgctgtgttgtaaagtgtcgaaattttctttgtttttaaggctcaattatattccattgtatgtatgtgtcacatattattcattcattcatcaaatacttgggttgcttccaccttttagctattataaataatgctgctatggacatgggtaaacaaatatctctttgaggccctgttctcaattcttttcagtatatacccagatgtggaattgctggatcatatattacttctctgttgaactttttgaggaaccatcatactgttttccataatggatataacatcattcc

SEQ ID NO: 196324 - DNA, 601 bp, Human
ttttttattttgcaaaactaaacttttgtatgcactaaacaaccattctccatttctctttccatagtctccagaaaccaccattctactttctgtttctatgaattaaatactctagatactcatagaaatcgattatacagtgtttgtctttttgtactggtttatttcacttaaaatagtattttcaaggttcatcgatgttgctgtgttgtaaagtgtcgaaattttctttgtttttaaggctcaattatattccattgtatgtatgtgtcacatattattcattcattcatcaaawacttgggttgcttccaccttttagctattataaataatgctgctatggacatgggtaaacaaatatctctttgaggccctgttctcaattcttttcagtatatacccagatgtggaattgctggatcatatattacttctctgttgaactttttgaggaaccatcatactgttttccataatggatataacatcattcctaccaacagtgcacaagagttctaacttatccgtatcctcactaacatatatatatattttaattgtactcatgttgatgggtgtaaggtgatatctaact

SEQ ID NO: 196325 - DNA, 601 bp, Human
ttggtgataaattctatcgccacctagtgctttggacaacattttatatttctgccatttctttttgcattacattaagatgtgtaaactgtgactgcccattcttctcataagacttttctctccccagtaagcttacttttctctccccagtaagctgttccacaagggcagagaatgcgttttctttagaactgtgtcctcacctcctggatcagggcatggcttgtagtagatgcttaatgcacatttggggagtgaactaatagataaatactatacagttcagagtccaataacyatattctgacacaactacatcccctacttggattttaaaagagaaagtttttgtatcttcttgatgatctaattataatgctgtgcatctagtttagccaggacaagatttacatatgttgctgaatttagtaaattcttacttcctggacttcagataaggtaaaaagtaagcataattacaaagggcaggaaaaacccttagttatgaaaatatgtattatcttgactatggtaattatatcataatgtcaaagttaatcaaattttacactttaagtacatatattttagtttactt

SEQ ID NO: 196326 - DNA, 601 bp, Human
cattaaacaaaagacccattagtggagcattgttttgcacttctgcagacaaagaagaaagagacctccagttagaatgaactctttttgtatttctttctttttctttttttttttttttttggcaacaaatagctttcttttaaattcagaaatgaaatggaattgagaccctaaattgctctcatctaaaatgtttcactctcatcttcactttcctagattatgatcaattttccccagaatgaataattcaaattgagcccagtcttctgaatccttagaaaaaacaatgccttarcattttgggtctattctactcacttatcacttggcacattttgtctggtactggcagatattctttttgtaacatataatttatttttccaaatggactacaagcttctgaagattaaagaccatttcattcattcattcattcattcaacaaatgtatttgagctcttaccatgtgttagacatgtgctaatcacttgcaatacagccaagaactaatcagacaaaaatccctgcctccctggagtttatattctagtggagggagacagagaataagaaatcagtgtcataaatatgt

SEQ ID NO: 196327 - DNA, 601 bp, Human
gtagttttagtagagatggggtttcactatgttggccaggctggtctcaaacacctgacctcaggtgaaccacctgcctcggcctttcaaagagctaggattgcaggcatgagccactgcacctggcaatttaaatatctttctagtggaaaattataccggcttatgcacttctctcatggtaatacttttcataatgtaccacaactgatggtttattttctgtctcctcgtttaaactgtgaggtctctatcatcctggtattctttgtacctaggatagcatctacttcacagtagctgcctaataaatatttgctgaaaactgaataaacatctaatgtcaaaagttgtgaataccaggtaacttagcataagccttgaccccatatgagtggggcttagagttcatctgctgctctaaaatcaaggtcattgtatctagtagtgaccccctggtactcacaactatataaagatacaactgggatcgtgatgtttgttcctattttattttactttttttccccagtcctgtattagaactagaagctgattggtcctgaatcacaacgaatttgactggagtcctatccttcag

SEQ ID NO: 196328 - DNA, 601 bp, Human
tgccctgctcagagaggaggaatctagaggggcgatctggccactgtggctttgctgagctgcagtgggctccagccagttcaaacttctcagcggctttgtttacactgtgaggggaaaattgcctactcaagcctcagtaatagcagacgctcctcctgcccccaagctcaagcatcccaggttgacttcagatggctgtgctagcagcaagaatttcaagccagtggatcttagcttgctgggctcggtgggggtgagatacgctgagctagaccacttggctccctgacttcagccyccttgccaggggagtgaacggttctgtcttgctggcattgcaggtgtcactgtggtaagaaaaaacactcctgcagctagctcagtgtctgctcaaatggctgcccagttttgtgcttgaaacccagggccctggtggtgtaggaacctgaggaatctcctggtctggtggttgtgaagactgtgggaaaagcatagtatcttggctggaatgcacttttcctcacagcacagtctctcatggcttcccttggctaggggagggagttccccaaccccttgcacttcccgtgtgaggcga

SEQ ID NO: 196329 - DNA, 601 bp, Human
agcctgggtgagagtctgagactatatcaaaaacaacaacaaaaactacttagtattatttaaaaatagctagacttcagggacccttctgaagggtacaggtgtctgtggagccacttcgagagctgctgatctagataaaactttcatttagaagacatggaaattaaggtgtctcatggatctgctactgatgatcgattagagaggggctgatactttcctacaagggtattagatatggctaggatggatgctcaaactatcttatggaaatatatgaaggtgattttgagtggcrgtttgtattttacctccctcccactgatgacacaacaaccaacccgcacaacccttctgaaactacccttgcctggaacagcaatgatcttgttaaattcaataatcattttttaaaaagtgcttactgagatttgtttgttagcaacccttgacatggctgatcactcccttcattttgactcaattgtatggtcctcccatgatctcacactcagtgaaagcaccctctctctccagatgcccaaccagaagtcagaaacttcccagactctgatctcttcctcaccaagtgatctca

SEQ ID NO: 196330 - DNA, 601 bp, Human
tgtggagccacttcgagagctgctgatctagataaaactttcatttagaagacatggaaattaaggtgtctcatggatctgctactgatgatcgattagagaggggctgatactttcctacaagggtattagatatggctaggatggatgctcaaactatcttatggaaatatatgaaggtgattttgagtggcggtttgtattttacctccctcccactgatgacacaacaaccaacccgcacaacccttctgaaactacccttgcctggaacagcaatgatcttgttaaattcaataaycattttttaaaaagtgcttactgagatttgtttgttagcaacccttgacatggctgatcactcccttcattttgactcaattgtatggtcctcccatgatctcacactcagtgaaagcaccctctctctccagatgcccaaccagaagtcagaaacttcccagactctgatctcttcctcaccaagtgatctcaatcatcttttcttataaatatctcagtattccatccacattttttctgcctgatattttgccctgactatgcatcttacctctcttacattatcactactatcttc

SEQ ID NO: 196331 - DNA, 601 bp, Human
tatcatttatttgtgataagaacagacaaaatcttctagctattttgaagtaaataaaaccttattgttaactatagtaatccttctaagcaacaggacaccagcatttattcttcctttctaattgtaactttgtacccactgaccatcccctctccatccctctcttccctctaccctccatttatttttatttatatttactcctgttttcaaaaaggttaagtaacaggtatgtatacatacatacagacagtacatgtacgcacacgcgcacgcacacgcagacacacacacaccacacacacacacacacacacacactcgagaaacagagagaaggaaaaagagacagtttctgattatttacaaatattttgctttatcattgtttgtcatactgtattgatgaaggtagtttttcagggaaaatagaaatagatactagtatagagatgagatttttaaaagataagaagaaagagtagaaggagaaaagaaaattgcttcatttgatccaagctgcaatggaattggatgatctttttttcttttcacactcttttatatagtggatcttttgtgtcagctctttaatgtg

SEQ ID NO: 196332 - DNA, 601 bp, Human
tttcaggtaaagacaaacacctcagagtacattttaaacagtctagctatatcccagaaatccttcccagtggttctaatatacatatgcatattaataccaatgtacctgtaatccattcagtagcttaatttaattatcagtattttttttcttgtgctgatagataataccacatatttccttgataatataaatgtattacacaaatcaataataatcatattgatagactatatcatttgggtttctatagggatattactgttttagaagtttaaaccctggacaccaaccgctrtctccatttcctttcacctcaaaaatcattaagcactgtcaattttactgtatcaatatttttcttaactacattcatcttttcaacccagaactttatcttagttatgatcgttccctggctttcctaataatcccctcactgaagtcctactcctaacatctctctcctacattcaccttctttctagtatgatttttttcagaactttgctcatggctcctcatcatttactaggtgtaacttgagctcatttgccaagcctaaaaagccttctatggtctggctctttccaatttg

SEQ ID NO: 196333 - DNA, 601 bp, Human
tcacctcaaaaatcattaagcactgtcaattttactgtatcaatatttttcttaactacattcatcttttcaacccagaactttatcttagttatgatcgttccctggctttcctaataatcccctcactgaagtcctactcctaacatctctctcctacattcaccttctttctagtatgatttttttcagaactttgctcatggctcctcatcatttactaggtgtaacttgagctcatttgccaagcctaaaaagccttctatggtctggctctttccaatttgtccagcctcatatwtgcttgctccctgttccaccaagccaccctctcatctcacctttgatgtgttgtcactcatcatgtatcacctattccagcataggatacttcattatttaaaccacttacctttttttgaatgtttggcatattcctactcatactctaattttcaggttttctgttaccttttagattgaatgtgctgagtcctccagatattttatatgtgtggtcctttatttatgcactttatgtataactccatgttgaaagttaactctagtgctttagtttctttttacatcactttttcaa

SEQ ID NO: 196334 - DNA, 601 bp, Human
agaccccagactttataatttccttttttatttgagtatcttaaaataaaaatgagcatcttgtatatacatcttacagcaggaatttagctcatccactaaggtgacacaagtaatcatttgttactgtataaagatttacttgtatagctgggtgtggtggggcaggcctgtagtcagctatgtgggaggctgaggtgggaggatcacttgagcctgggaagttgaggctgcagtgaacagtgttcacccagctaaactccaacgtaacaccccgtctcaaaaaaaaaaaaaaaaaaaacaatggaaatagaaccatagagaaataaagtatgaacagaacagacaggctttttcatttactgctagaacaactgcaagcccacctttgctgctatttgcttgtcttaattaattttagctgtttttctttaattcatttgaaatgaatataaatataaggttttggcaagtaatggatcaaaccaactcaacattttttaaattggtgaagcattttgaaaaagttggcttcatcttatattgcactaaatcaccaaaataaaagaataaagagtagcaacataatgaattgatgaat

SEQ ID NO: 196335 - DNA, 601 bp, Human
gtgatttataatgaacacattgcagctttttttagtcatgttcaattttagaggaattttatttaaaaatagagattctaaaaactatcataaatatagaacttggcatataataaaatttatattatatataatgcacaataatcctacctctgatgttttaatataaatatatacctcagtagatatttccatttcttttgttttaaattacctacctctggatcccaccagtgtagaatttctcctgcctaattgatccaaaaaagtactcaactctgttattagaaataagagtatrtgcatatataaagaatatgaattttaaggatgttaggatgtatacagtggccctaggaatagtgacccaaacaatgactttatacaaattctgagtctagctaccagcgaatgttactatttgtatttgacatctaatataaataacctaaattgtgaattgtatttaatgcttactgcattttactgctgtttctgccttattaactcaagacatcatggggcagttatcatcttcattttatagattcagaaacatagaataggcaggttatatatagaaagaaagatccctaaacta

SEQ ID NO: 196336 - DNA, 601 bp, Human
gtaaggttaaggctgagcgtttaagatcagtcccttctaacttgataacttgtgcttttcctgccctatcctgcttccaggaaggcatatctggtggctctgtgtgaatgcataagacacactccagcaggtagcaggcttcctgcaattcaagcctgagttaataaggactggtatagagcccagggggctcaaaggaatgattgaatgggaagatctttttgagatagggaaggatagtacggagacaaaagaggccttagagctttgcagcttaggtgactaggaagactctagtgcttttcaccgaagtggggctattgcaaaagcagggagcttgaaaaggagatggtattgattgcaaacaggaaaatttgagatgatggtaataccttaaaggaagagaggtccaacaaaaagctggaagctgaaaaattgtttctcatttctataatgactcagttttctgtttgtttcagaaatggagaaaaaaatttcagacttttgggagcatatgtttacaatccttcagagaaaaagacttagtcaacctatttggccacctagactaagtgactccagaagctgagagaatttaagt

SEQ ID NO: 196337 - DNA, 601 bp, Human
cttctccccaccccccgaaaaaaacccatgtaacagaaatagtaatagtaaaggaggttctttccatgaaacaaatgtggaatttttaaatatgagcctctaatattttatcagacataatttctttacacttcaaagatatcaagtgttttattataactaaacaaggaaacattgagttctatcatcttcatttttaaactattaagtttctctcaacagccaaaattgataataattataaattggcctttattttttatatataaaatgtatctatatccacatttctaactttcatatatatttatattatatatttatatattatattacatatatttatatttatatattatattacatatatttatatttatatatttatgaatgttaaaatgtaatatagatttttgtagaattttatctccttctgagaaaccatgtcataaatttttaagtttagattacttttcttttaacttggtttttaatttggaagcaggagcttggcattaatgtgtataacataacctgaactattttttcttttcttgagaaatgtagccttgtcttgcttgcttagtaaagtaatgcacct

SEQ ID NO: 196338 - DNA, 601 bp, Human
gtaacagaaatagtaatagtaaaggaggttctttccatgaaacaaatgtggaatttttaaatatgagcctctaatattttatcagacataatttctttacacttcaaagatatcaagtgttttattataactaaacaaggaaacattgagttctatcatcttcatttttaaactattaagtttctctcaacagccaaaattgataataattataaattggcctttattttttatatataaaatgtatctatatccacatttctaactttcatatatatttatattatatatttatatattatattacatatatttatatttatatattatattacatatatttatatttatatatttatgaatgttaaaatgtaatatagatttttgtagaattttatctccttctgagaaaccatgtcataaatttttaagtttagattacttttcttttaacttggtttttaatttggaagcaggagcttggcattaatgtgtataacataacctgaactattttttcttttcttgagaaatgtagccttgtcttgcttgcttagtaaagtaatgcaccttaattcagctttgttatccttcttcttct

SEQ ID NO: 196339 - DNA, 601 bp, Human
acagaaatagtaatagtaaaggaggttctttccatgaaacaaatgtggaatttttaaatatgagcctctaatattttatcagacataatttctttacacttcaaagatatcaagtgttttattataactaaacaaggaaacattgagttctatcatcttcatttttaaactattaagtttctctcaacagccaaaattgataataattataaattggcctttattttttatatataaaatgtatctatatccacatttctaactttcatatatatttatattatatatttatatattatattacatatatttatatttatatattatattacatatatttatatttatatatttatgaatgttaaaatgtaatatagatttttgtagaattttatctccttctgagaaaccatgtcataaatttttaagtttagattacttttcttttaacttggtttttaatttggaagcaggagcttggcattaatgtgtataacataacctgaactattttttcttttcttgagaaatgtagccttgtcttgcttgcttagtaaagtaatgcaccttaattcagctttgttatccttcttcttcttct

SEQ ID NO: 196340 - DNA, 601 bp, Human
atagtaatagtaaaggaggttctttccatgaaacaaatgtggaatttttaaatatgagcctctaatattttatcagacataatttctttacacttcaaagatatcaagtgttttattataactaaacaaggaaacattgagttctatcatcttcatttttaaactattaagtttctctcaacagccaaaattgataataattataaattggcctttattttttatatataaaatgtatctatatccacatttctaactttcatatatatttatattatatatttatatattatattacatatatttatatttatatattatattacatatatttatatttatatatttatgaatgttaaaatgtaatatagatttttgtagaattttatctccttctgagaaaccatgtcataaatttttaagtttagattacttttcttttaacttggtttttaatttggaagcaggagcttggcattaatgtgtataacataacctgaactattttttcttttcttgagaaatgtagccttgtcttgcttgcttagtaaagtaatgcaccttaattcagctttgttatccttcttcttcttcttctttt

SEQ ID NO: 196341 - DNA, 601 bp, Human
attgtttcttttttagctgtttaaaataaattctttaagaagtgcaacaataaaaaaacaaatcagcaatgttaaaaaatatgtaaggagacatgcagattttaatcttcttgttgctactgtattaaatattttgtccttatcaaaatgtatgcacaaaaactggacagaatatgcttctgtgatctttagcagctctgtattgccccataaatgactcagctacaaatcagtgaatgtgcttcaggctttgatttttgttattagttcaaagatgaacatcatgaggacatcactcagcgacagatttatcatgttttgtttcagatctcatagtgaaagctgaattttcttgtctttgttctaccaaatacattgctatatacatgatagtttaaaaaaattaaacctttttgaatatgctagagaatattaaccaatgcataataaaattaaatcaagtaggtgccatcacagtctaaaaatataacacccgatatatgtctgttgacatatttgttattcaaattcaaattttctttctcatattgttgtatatttacaaatgtgtatctatactatgcaaacattgatggctttt

SEQ ID NO: 196342 - DNA, 601 bp, Human
tgtttcttttttagctgtttaaaataaattctttaagaagtgcaacaataaaaaaacaaatcagcaatgttaaaaaatatgtaaggagacatgcagattttaatcttcttgttgctactgtattaaatattttgtccttatcaaaatgtatgcacaaaaactggacagaatatgcttctgtgatctttagcagctctgtattgccccataaatgactcagctacaaatcagtgaatgtgcttcaggctttgatttttgttattagttcaaagatgaacatcatgaggacatcactcagagtcagatttatcatgttttgtttcagatctcatagtgaaagctgaattttcttgtctttgttctaccaaatacattgctatatacatgatagtttaaaaaaattaaacctttttgaatatgctagagaatattaaccaatgcataataaaattaaatcaagtaggtgccatcacagtctaaaaatataacacccgatatatgtctgttgacatatttgttattcaaattcaaattttctttctcatattgttgtatatttacaaatgtgtatctatactatgcaaacattgatggcttttta

SEQ ID NO: 196343 - DNA, 601 bp, Human
aatatatgtaaaatgttttcagttgcagaaattttagtttgaatcaagagtggtgggactttgaaacctctattctctcttttgtaaatatttttgtcatatttaatctaaagataaaaacaaaacactttataataactaaaggtttgtttatttggggctggctgtaagcaagagagtattatcactgagggttgttcatagccactcctgtagctcatccactgtttcaatcctacagtttccttcctttccgcgtaggctgtcttcacctggggtcacaagacgtcctcatgctcarcaccatgctttgttgaagcaccagggtggaaatattattatattttctgtggaaaaagtgagggaaattgagataaaaaggggaaaagttatttaaataagtatgttcatatctggtttataagccttaagataatttttatgaagagctatcttgttttactcagattatttttattttggttgactttggcacctatctgcagtattagtagcattgaagttgttattcagtggatgaaaccttgctgaagtggctgtgtggataccctaaaatagccacttctcccttgatgagtgt

SEQ ID NO: 196344 - DNA, 601 bp, Human
ggagctgtatcaaacttacaaaaaagggtactgcattttgaatgtatatccaacatgattatgagacagacccagcccacactgtcagaaaaaaataaaaaatgtgtttgtccgttcaaactgtgatttggatataaaatagccaatatacttttaccatttaaaacattttcccattaattattttttctcttctttatcttttatgtgttctatattctcataccatatatgttgaatatgcttatctcatttcaccatttgtttaagcatagcagttaatttgtttcttcttaaatattcatcaaacagaattttgattaatttagatttaaattaaaatgtgtaagtgtagtattgtctattaataattcctggtatttctgccataggtcttgaaagtaccttggtccattctggactatttgtctttatttactaacatcattttctgtcataccacatctatttttatgtacttttgaaaataagacaaataatgattcagtcatccaagatttgcttaggtatggaaatatcaattttcaaatagtcttacagtaaaacaaatttaaaaggtcctagaaggaaaaaaaaagtt

SEQ ID NO: 196345 - DNA, 601 bp, Human
ttttcccattaattattttttctcttctttatcttttatgtgttctatattctcataccatatatgttgaatatgcttatctcatttcaccatttgtttaagcatagcagttaatttgtttcttcttaaatattcatcaaacagaattttgattaatttagatttaaattaaaatgtgtaagtgtagtattgtctattaataattcctggtatttctgccataggtcttgaaagtaccttggtccattctggactatttgtctttatttactaacatcattttctgtcataccacatctatttttatgtacttttgaaaataagacaaataatgattcagtcatccaagatttgcttaggtatggaaatatcaattttcaaatagtcttacagtaaaacaaatttaaaaggtcctagaaggaaaaaaaaagttttagttaaactcacttatttgcaaactactaaaaaaataaaataaaatgcaaaactgtacttcacctttattttattgctggatgaaattttttgttttcagaattattttcagacaatactgtaaatttttatggccagaatcttagcatttgcattttttatgcca

SEQ ID NO: 196346 - DNA, 601 bp, Human
tttctcaggaaacgataatttaaccatctgtatttgccttgtatatctgtgggacaatagacacattgatttagtatttttcactgttttttgtatagaagacatttttcttttatgttcttgagtaaatcatctcagaaaagatgtaatatttttatgttacaggtagcatcaccataagaatggctcactgattagttttgacttaaatacatgtttaccttagctatgctaagattaagtgtacaattttaatcttcaatatctgtaggcttccaggtttctggacagaattcaagaragtatcattttgtactggtcactgacagtccaaagactgtcgttaactctgatgtttttcaaatgacatattgtgttcacctgaatgtttgacccaacaaggaaaatgaatatttattccatacatccttaaagaagggaatttttcttttgcttttcataatgtaaattacatgatgattgcataaagttttcattgagattagtttataacaatttttttctataaatttaattaataaaaatatctaaatcttaaagtcaaacaattaattttaaatacagccattgacttttcagg

SEQ ID NO: 196347 - DNA, 601 bp, Human
cttgttaccaaaatctgtattagtcaaagttccccaaagaaacagtaccaacagataatatagtacaagaaactgactcaagcaattatggagactaagaagttccaagatctgaagttggtatgctggagacccagaagagttaatgttatagttccagtctaaaagccagcagactcaaaacctaaaaagagacaatattgtagcttgagtcagaaagcaggaaaacattaatgtctaacctcagggcagtcaggcaggagaagttctctgttcagcacatgagggtcagccctttttstctatccaggccttcaaatgattggataaggcccacctataatacattagggaggacaattactcagtccactaattcaagtgttaatctcatataaagacatacccacagacacaccaagaatcatgtttgtcaaagtatttgggtacccatgaccctgtcaagttgacacatataattaaccatcacagggagcctagaggtaaagaccttgggtggggggaattatagaaagaggctggagcagatcctacagggccctgaaggacacattaaagaattgggaacttgtcctaagga

SEQ ID NO: 196348 - DNA, 601 bp, Human
attctggggtctggaggatggtggcccttttctcacagctccactaggcagtgccccagtaggggctctgtgtggatgttccgacccaacatctccctttcacactgccctagcagagtttctccacgagggccccatccctgcagcaaacttctgcttgggcatccaggtgtttccatacatcttctgaaatctaggcagaggttcccaaaccgcatttcctgacttctgtgcactcacaggcttaacaccacatggaagctgccaaggcttggggcttgcaccctctgaagccacagcytgagctctacattggcccctttcagccgtggctagagcagctgggatgcagggcacaatgtccctagactacacacagcatggggaccctgggcccggcccacaaaaccagtttttcttcctaggcctctgggcctgtgatgggagggactgctgcaaagacctctgacatgccctggaaacattttccccattgtcttggggattaatattcagctccttgttacttattcaaatttctgtagtcagcttgaatttatgctcagaatatggaattttcttttctattgcattgtcagac

SEQ ID NO: 196349 - DNA, 601 bp, Human
aaatattaagcaagagtccctattttcacaaatctgacattgttgaccagggtttctcaaccttggcactactgacaatttggctagataactctttgctgtgggggactgtcctatgtaatgttggatgtttagtgacatccctgttctctacctaatatacgctgatagggcccaaataaatgtctcttgggtggcaaaatcaccctgtgtaaagaaccacagtttgagagagaagaaagacaataaagaaaaataacataacacaatattagtgatgataagtgctgtgaagtaaaayagaaaacgggactgtggtaagagtggcagcaggagcaagggttctaaagctttctcaaggacagcagtctgcatagcgcacagatgtagaagccttgtttctcttttaacagatgtctatcattcactctaaacctgtctatggaattgctaattaaggcaagagcctgatgtattacttacatgattaaattatttctggttcttgactatttacaaaatgtcacagtcacagtaagatttttttgaatatgtcaagtttctcaactgaatagaacattaataacttcaaatggactat

SEQ ID NO: 196350 - DNA, 601 bp, Human
caaatagaccaactattactagagttttcttaagttctctgttgaaatccagatacacttgtctgcagaattcatctgttaggaagaaacttttcctctatgatcttaggttcaaatggttggggtcctgagagttaactgacgatagatagattagcagaataaaagacagtgtttatgtatatgtacattgcaaaccctcaggagtactcagtgatgagtaactcactgaatcctcaaaattaacattttatataccattttaacaaaatgtatttttttaaaagggcatcagtggaarcgtatggaaagtttattgggctttttgatgctaatgagaataggaagcctgtctccatggcagctgaattcacaggaaattccttgcaggggagttaatgggagctatattttcaggacattctgctttaatcagataagggatgttcagataagatttctttttcattttctgtagctcaaatgttttcacttgaaaataatctttatgctaaaccgtgatctctttacatgtgataactcttaaaatgagaaaatgacacacaactacaccaaaaaagcaaataatttaagcatggca

SEQ ID NO: 196351 - DNA, 601 bp, Human
ggttaaattttaagagccctggctgaggacgaagtccattcacatggttgacagggggagattagaattttatttttggtttagagagattaaggaaaagtgaggtaactggcgatctatacgagcatagtcaagcttcgtggctctttacgggaatcatgtttacaaaatggtatttgttagcatgattttagggtggagtttttagtccctggacaacaaaaggtcacctattggacatttacaccagcccaactggagggttagtggtttcaaccagcttgcattggacaagagctgrccaagttcctgaaaaacaacttaaacaatcgttaccatggtgacctacacctcagcgatgttataagaaagttaggaaaagtttagtttatatcgcttagctatgtgacttttagctatataagttttaaaatcaactagaagcaagcagctaaaagcaagccagatgggttaagtttggtgggcctaatcaggtcagcccttgttttaagcagggtttaatccatcttatatgaaaaatttcttaacacgttgggatgcaattcacttctatatggaaacttatttagaccagctaata

SEQ ID NO: 196352 - DNA, 601 bp, Human
tgggttaagtttggtgggcctaatcaggtcagcccttgttttaagcagggtttaatccatcttatatgaaaaatttcttaacacgttgggatgcaattcacttctatatggaaacttatttagaccagctaatagctgtcttcctaatgcttctttatcttggcctttagaggcttccttccatagttttttccatagtcttttatctacaccttgttctccttaccacagagaaagtaatcaaaatggagttgtgtggtcttgtattctccttctggtctttaaaaataacatcaaccckcaatttcattcatgataacaagtgccctatgtagtatgtcctatcacttccatattttttcttactttaaaaataattaaaaatttcagatacttaaagcaagtgttaggtagccattatatttgcttaatatgagtattattaatttttaaaaaacgttaataggttttttgggaacaggtggtatttagttaaatgaacaagttctttagtggtgatttctgagattttggtgcatccattacctgagaagtgtacactgtagcaatatgtagtctttttttattttgagatggagtc

SEQ ID NO: 196353 - DNA, 601 bp, Human
aacttgttattcagtgaaaggataactattggtagcgaaatataaacctgatctagatttggagatcaaaattttggatttatacactttagggaatatatcagaatgaataaccttcacatcacattgagtactctatgaagaatcagttacatgggctggacttttgatcagaccctcatagaaaacagctgagcatgatgggcctggcattctattgatgattaccaatacagtcatgtattgcttaaaaagcacctggccaagttatacatattataaaggctttttggtattctcrttgagatggattgagaaatattttatatatattttttgagaaacgttttatgtatgaataatagatgggcaatatgaaatcacagtataaaatttagttttctttcaactagtctcaaaatttcatgcccattacaaaattaaaactaagaaaaaaaattagccatgtttattttttctttttctgttgtcagtgttcttttaacaccttagctcttcagggtgctctccctgcagctatatttttagatgtttcccagtttctctcctcatcaggatcatttaatattgtaacacttca

SEQ ID NO: 196354 - DNA, 601 bp, Human
ctagatttggagatcaaaattttggatttatacactttagggaatatatcagaatgaataaccttcacatcacattgagtactctatgaagaatcagttacatgggctggacttttgatcagaccctcatagaaaacagctgagcatgatgggcctggcattctattgatgattaccaatacagtcatgtattgcttaaaaagcacctggccaagttatacatattataaaggctttttggtattctcgttgagatggattgagaaatattttatatatattttttgagaaacgttttatrtatgaataatagatgggcaatatgaaatcacagtataaaatttagttttctttcaactagtctcaaaatttcatgcccattacaaaattaaaactaagaaaaaaaattagccatgtttattttttctttttctgttgtcagtgttcttttaacaccttagctcttcagggtgctctccctgcagctatatttttagatgtttcccagtttctctcctcatcaggatcatttaatattgtaacacttcaatttttaaataactccattttaatattttgtgattgagctatttcaccatat

SEQ ID NO: 196355 - DNA, 601 bp, Human
actgtcttcttccctcagaaggttgttaatgtttgtgtctcttgtgatgttaggaaccagtgatgatcactatctagctttattaattcattaggggctaaatgaggagattctatttctttcactttctcctcacttattagctggaatatttctaaaagaaaaaccttccctatgtactatttagtttcccattcatacaatttcatgtagaaaagaaaaaaataaatgcttattttcctttatttaccacttttcaaaatgataaattggttctttatcatcttacaacaccttataygttaatttttgtatcattacaaactataaataaatatatttattgtgcttcaattcttttccatgattgttctttttgagttttaattattttattttggtcattgtgaacctcctcaacgagcctcaaaataattttgactctgacctgtttctcattgatagtgtcttttgttgagtattaacacgattttccagaattatcttgtatatatttttgccccagccctaaattagcagtttatcaaagtagcttggtttctttcggtgggaattgttacatcaaaactgtaatacaggc

SEQ ID NO: 196356 - DNA, 601 bp, Human
attaattcattaggggctaaatgaggagattctatttctttcactttctcctcacttattagctggaatatttctaaaagaaaaaccttccctatgtactatttagtttcccattcatacaatttcatgtagaaaagaaaaaaataaatgcttattttcctttatttaccacttttcaaaatgataaattggttctttatcatcttacaacaccttatatgttaatttttgtatcattacaaactataaataaatatatttattgtgcttcaattcttttccatgattgttctttttgagytttaattattttattttggtcattgtgaacctcctcaacgagcctcaaaataattttgactctgacctgtttctcattgatagtgtcttttgttgagtattaacacgattttccagaattatcttgtatatatttttgccccagccctaaattagcagtttatcaaagtagcttggtttctttcggtgggaattgttacatcaaaactgtaatacaggcactgtggtactcattgctttcgacttagtcacagttcataggcttctctgtagacaaagctggaaaatattttatttcatt

SEQ ID NO: 196357 - DNA, 601 bp, Human
atttagtttcccattcatacaatttcatgtagaaaagaaaaaaataaatgcttattttcctttatttaccacttttcaaaatgataaattggttctttatcatcttacaacaccttatatgttaatttttgtatcattacaaactataaataaatatatttattgtgcttcaattcttttccatgattgttctttttgagttttaattattttattttggtcattgtgaacctcctcaacgagcctcaaaataattttgactctgacctgtttctcattgatagtgtcttttgttgagtaktaacacgattttccagaattatcttgtatatatttttgccccagccctaaattagcagtttatcaaagtagcttggtttctttcggtgggaattgttacatcaaaactgtaatacaggcactgtggtactcattgctttcgacttagtcacagttcataggcttctctgtagacaaagctggaaaatattttatttcatttcattttaaattataaaacccattaagagtttattttgataattccaactcaaatttagaactacaataatttaatcttctattttatgtctgtatctcc

SEQ ID NO: 196358 - DNA, 601 bp, Human
ggtaaagtgattgatttatcttcttttattatgtattttcagaattcaagacttagttgtaaaagtattcatatgatgtaattagcttttacaaatgttaaacacaatcttattccaaaaggtatcttaatttgtatcaaagtaaatctcttttgaaaggcaatatgtgcctgagatatgtttgtgcataattagattgttctatctcaaagttgcttaaggaaacaaagctattatgttgtaggagacagtaaaatgatttaggatatgggttctggattctagttcagattttctgtcytacgtagctgtctgatttggggcatttcaattatctacttaatattttgtaagtgtttaccctacagtagacctatgctaaccaatcataatgtaaatgtaaccaaaagagctataatccttttccccacagaacattcagtctcacgagggaaatagacacacatgcaattactatccataaaatgtgatgagtgctatgtgaaggaggacagggtactaggttagcacatagctgaggctccttactcaaatcctggatgatcagggaggtgcagcctatgctaactaggaactggat

SEQ ID NO: 196359 - DNA, 601 bp, Human
ataattagattgttctatctcaaagttgcttaaggaaacaaagctattatgttgtaggagacagtaaaatgatttaggatatgggttctggattctagttcagattttctgtcttacgtagctgtctgatttggggcatttcaattatctacttaatattttgtaagtgtttaccctacagtagacctatgctaaccaatcataatgtaaatgtaaccaaaagagctataatccttttccccacagaacattcagtctcacgagggaaatagacacacatgcaattactatccataaaatrtgatgagtgctatgtgaaggaggacagggtactaggttagcacatagctgaggctccttactcaaatcctggatgatcagggaggtgcagcctatgctaactaggaactggattatgggaacgagggatgagtgatccagatagcagaaacgatatgtgcaatggctcagaggtaagaaaacctggctcctgtgaggaaatgaaatgttactcggtatggatggatcatgggaatcagaggagtaagggatagcggaatgtaaacaaagacagatgaaaagaggctggactatgaagggc

SEQ ID NO: 196360 - DNA, 601 bp, Human
agagagttttcgagaagatttttcctcatggagatataatgggagaaaatgagttccatcttccagataaactagtgtgttatctgccttagctcgtcagatacatgagaaatcagaccacacactaataaaaacctaatttaaaagtgtatctactaagtgtgtatgataagtttttgacatttggaacagagcagtatcagatgcagcactatagtaacattaatacaatatgacaaagtggtaactaaatattgtgaaatatattattctcttacagatgtgtctagtttattgacaraactgatttatatagtgcatttcatcctaggaaagcaattttatgaaacattattataatggaaattgtgttttttcaattagttgttgaacgccaagactttaactcctgggggaaaatgtttataaggaatactttctgttaagagtgggcatgtgggcacttcattagaaaggttttatactagaggacttttataggtggtataaaactccctcccccccaggttttgtgttgtttaataacatctgaagccaacatgatgccattccttgttagtgctgctgctgcacagtttca

SEQ ID NO: 196361 - DNA, 601 bp, Human
ttgtgttgtttaataacatctgaagccaacatgatgccattccttgttagtgctgctgctgcacagtttcagacaagatgagcagaagaggtaagtttccctaagggagtagttagaaaattaattaaactgagggaggcactgggatatttagaaaacaaattagagtcaagaacaaacacacacaagaacaaaagggagtaataagaaccaagggagaaagaacaaagtttaagtcatggctttccctccactgtcctaaacagaatctggataatgtatcttagaaaattaagtttcatatctacatttataatctacatttataaatggttacatttataatctacatttataaatggttacatttataatctgaaaataatctgaaatatctacatttataaatggttacatttacaacatttaaacattttattccaacactgtttaaaagatacgttttctcctaagcaaagccttcatgccaatcatgaatctcagaggctgttctactaaacgtcattttgaaggttgccataaactcttcataaaggacaagtttataagggcttggtataaaaataaacattcaagcgct

SEQ ID NO: 196362 - DNA, 601 bp, Human
gtgttgtttaataacatctgaagccaacatgatgccattccttgttagtgctgctgctgcacagtttcagacaagatgagcagaagaggtaagtttccctaagggagtagttagaaaattaattaaactgagggaggcactgggatatttagaaaacaaattagagtcaagaacaaacacacacaagaacaaaagggagtaataagaaccaagggagaaagaacaaagtttaagtcatggctttccctccactgtcctaaacagaatctggataatgtatcttagaaaattaagtttcttttctacatttataatctacatttataaatggttacatttataatctacatttataaatggttacatttataatctgaaaataatctgaaatatctacatttataaatggttacatttacaacatttaaacattttattccaacactgtttaaaagatacgttttctcctaagcaaagccttcatgccaatcatgaatctcagaggctgttctactaaacgtcattttgaaggttgccataaactcttcataaaggacaagtttataagggcttggtataaaaataaacattcaagcgctct

SEQ ID NO: 196363 - DNA, 601 bp, Human
tgttgtttaataacatctgaagccaacatgatgccattccttgttagtgctgctgctgcacagtttcagacaagatgagcagaagaggtaagtttccctaagggagtagttagaaaattaattaaactgagggaggcactgggatatttagaaaacaaattagagtcaagaacaaacacacacaagaacaaaagggagtaataagaaccaagggagaaagaacaaagtttaagtcatggctttccctccactgtcctaaacagaatctggataatgtatcttagaaaattaagtttcttatctacatttataatctacatttataaatggttacatttataatctacatttataaatggttacatttataatctgaaaataatctgaaatatctacatttataaatggttacatttacaacatttaaacattttattccaacactgtttaaaagatacgttttctcctaagcaaagccttcatgccaatcatgaatctcagaggctgttctactaaacgtcattttgaaggttgccataaactcttcataaaggacaagtttataagggcttggtataaaaataaacattcaagcgctctc

SEQ ID NO: 196364 - DNA, 601 bp, Human
gttgtttaataacatctgaagccaacatgatgccattccttgttagtgctgctgctgcacagtttcagacaagatgagcagaagaggtaagtttccctaagggagtagttagaaaattaattaaactgagggaggcactgggatatttagaaaacaaattagagtcaagaacaaacacacacaagaacaaaagggagtaataagaaccaagggagaaagaacaaagtttaagtcatggctttccctccactgtcctaaacagaatctggataatgtatcttagaaaattaagtttcttatatacatttataatctacatttataaatggttacatttataatctacatttataaatggttacatttataatctgaaaataatctgaaatatctacatttataaatggttacatttacaacatttaaacattttattccaacactgtttaaaagatacgttttctcctaagcaaagccttcatgccaatcatgaatctcagaggctgttctactaaacgtcattttgaaggttgccataaactcttcataaaggacaagtttataagggcttggtataaaaataaacattcaagcgctctct

SEQ ID NO: 196365 - DNA, 601 bp, Human
attatatttaattatatatttattatatataattaattatatttaattatatatttattatatataattaattatatttaattatatatttattatatataattaattatatttaattatatatttattatatataattaattatatttaattatatatttattatatataattaattatatttaattaattatatataattatatataattatatataattatatttaattatatgtttaattatatataattatatataattatatgtttaattatatataattatatatttaattatatataattatatataattatatatttaattatatttaattatataattatatatttaattatatataattatatataaatcaaggttaacacaaactatgcctcttaagctgtgtactattttatgttgagatttttgcttatcaagtacaatctatgaaaagttaacactgtcatacaaaattaatttttcatctcttgactttgacagctatgttttatatcatctacacagtgtctgtctcatatgagatacttaatacatgttaaatagtaataagaatcaaatgtcagctcttagt

SEQ ID NO: 196366 - DNA, 601 bp, Human
tatatttaattatatatttattatatataattaattatatttaattatatatttattatatataattaattatatttaattatatatttattatatataattaattatatttaattatatatttattatatataattaattatatttaattatatatttattatatataattaattatatttaattaattatatataattatatataattatatataattatatttaattatatgtttaattatatataattatatataattatatgtttaattatatataattatatatttaattatatataattatatataattatatatttaattatatttaattatataattatatatttaattatatataattatatataaatcaaggttaacacaaactatgcctcttaagctgtgtactattttatgttgagatttttgcttatcaagtacaatctatgaaaagttaacactgtcatacaaaattaatttttcatctcttgactttgacagctatgttttatatcatctacacagtgtctgtctcatatgagatacttaatacatgttaaatagtaataagaatcaaatgtcagctcttagttg

SEQ ID NO: 196367 - DNA, 601 bp, Human
atatttaattatatatttattatatataattaattatatttaattatatatttattatatataattaattatatttaattatatatttattatatataattaattatatttaattatatatttattatatataattaattatatttaattaattatatataattatatataattatatataattatatttaattatatgtttaattatatataattatatataattatatgtttaattatatataattatatatttaattatatataattatatataattatatatttaattatatttaattatataattatatatttaattatatataattatatataaatcaaggttaacacaaactatgcctcttaagctgtgtactattttatgttgagatttttgcttatcaagtacaatctatgaaaagttaacactgtcatacaaaattaatttttcatctcttgactttgacagctatgttttatatcatctacacagtgtctgtctcatatgagatacttaatacatgttaaatagtaataagaatcaaatgtcagctcttagttgatggacatgacatgaagtctcagtgattcttcagaa

SEQ ID NO: 196368 - DNA, 601 bp, Human
tatatcatctacacagtgtctgtctcatatgagatacttaatacatgttaaatagtaataagaatcaaatgtcagctcttagttgatggacatgacatgaagtctcagtgattcttcagaaatgaatctgaacagaactatccaaagacagttaaatggttcaaagaactctaatattgagtgtcctcttttgactccatctagaaagatcatagcattcagggagaagaggactgctggatcacacattagtcttttcaagcatacctgtacacagaaatagtctctagggccactatcwttgaattccatggctacaaatggaaacaatgtgaattgctgggtggcctttgtggtatgtctggtgctgagcaataataaaggaaaatgaagggaaagcaagaacacttaagtctgtgtgactctaatgatttttagtcatttcttctttttttttccccatgcagctattttaagttaatacaggttcccctaaaggcaaatataactgactcattaggaaatcagttgggaaaacaatattttgcaattgtggccccaccccttcatttctccagagctcatgatagcacacatgctc

SEQ ID NO: 196369 - DNA, 601 bp, Human
atattcctgttaattcatctaaacttagttgaaatttaaaatatgttagatatttttctggactagtttcataggtgtgtgatctatatagtcacatgggaccttatttaattcttaatattatttggaaaagaggccatgcgtttttttgtttttttgtttttttttcctgggccctgcaaattatgaagccagccttgtttgcttccagtatttaaatagtaccggtgtttgcacaaataagtctaagaacaaaaaccacttgaatgtattatctgatttgacaagaaaagagataaaygtttgtccttaaggaaggtgatcccaagatcagaaacttaaataaggttttaaatcctgtattttggcttccctgacaccagtatctcctggttctctgtattcactgtctctctctctcatgcttctcttccttcatcacttatatgtcagagaatctcagggctatcttctctcaatttacctttattcctgagtgtcatttgctcttgtggttccaatccttctcataaatttatgatttccaaatttataacccaggtccatacctctcctttgagccatgaactcatgtaccaga

SEQ ID NO: 196370 - DNA, 601 bp, Human
tttgtccttaaggaaggtgatcccaagatcagaaacttaaataaggttttaaatcctgtattttggcttccctgacaccagtatctcctggttctctgtattcactgtctctctctctcatgcttctcttccttcatcacttatatgtcagagaatctcagggctatcttctctcaatttacctttattcctgagtgtcatttgctcttgtggttccaatccttctcataaatttatgatttccaaatttataacccaggtccatacctctcctttgagccatgaactcatgtaccagacrcctccacttgcaagtttggaaactcaatatcatcttccgtgacatcttcctgaaacctcttgattactgatggggatacagcagtcaaatgaagtctctatacacatagagattatgttttagaagagggaaaagataaccagcactctgtgtgtgtgtatgtgtgagagagagagagatgagaaagtgaaaagtgctctgaagaaaagcaaggtgagagaatgaagaaatatgtgaaagtgtatttctaatagcatttatctgcattactttttatctcagtgaatattatgaccatct

SEQ ID NO: 196371 - DNA, 601 bp, Human
aacatcaagctaaagcattctctaatttgaagagattattttaagaaaatgatgaacaaagtccagcatcattggaacatatttgcctgatatattttatgcacttattccacttatgtttataataactattcggtatgtttgggcttttgttcaggttgcttttagagcaacctgaaaaaaaaaattgtaatatttactagaattttgtttaaagtgaagtagctatattattaagtgtatgtttctaatcatgacctcaatttttaaagaatcttgtgtttaaagatttaataattgrggatataaaaatgatatcctgaagagttcctgaaatatttgaagcattaaagtaatgtttgatataaatgagcacctgttgaagttctatagtattcaattggaagaataatatcttctacacttacctcaaattcttttttatgataaagttggatataaaacctaaaacaactattctagtttacaacatctagtcatgacagataattgtcaaactgtgttttagtttactacagcatgtctttatggccaaatgacttctgggagtgttgtcctctgaagttgagcttcctactca

SEQ ID NO: 196372 - DNA, 601 bp, Human
taaatgtcaagagttaactgatacagcttaattggtcatttccaattttgatgtcagtctattgacctaccggctaaaagggcattgtagagtattagttggcatttgtttttggagtcctttatgatttctttcttattagtgttcacagcagtgtaccattaaagtttttggcttcagtacacattctgattattcctgaacctgcatagtcacaataggaagggtagtgttgattcaaacaaaattcagatccatgtatttttggcaggtatagtgtgttcttctgcaccaactcacrtattccattttgtgcctttacaaaactataggaatagtttagtgattgcctaaaattttcctagtaaattgaatgtttttctacaaaaatgtcttaaaaatcagaagataatatattcagtaaatttattttatgtacctattatattgtctagtactttaatatgtataattatttatggtttgattttatacacatctcattttccttaaatgtatattccaacttatatggagataaaagtaatgatatcactttgccttgaagaaactaaactctaagactgttatcatttgattc

SEQ ID NO: 196373 - DNA, 601 bp, Human
aacattttaaaacagaatgagatatctcaatggactgatcttagtaaaaaaaatttaattaggtaagaataattacattagttaaatggaacttttaattgaaaacttgttggcattttcttacctgcttcacagctgtcctttaatcatttatatttaaaaagtgaagagtttctgtacatgatgtttgaaaattatctaaacatcttggactttttgtataaacgtttaaaggagtttagataatgtggcagtaaaaacaaataggattttctgcttgcggaatggtacatttaaaagttatatatatcagaaagaaaagttatagagaaaatatgtatggtaagtatatactattcttgggaaaaaggcaaagtagtcattttctgaagctttaacatttataactttaaaacttcatgtattgaacatcattccttatgaagctttaaaatcttacagggaaataatactgtttataaaattatcttgttaaagaaaatggtatccaacaagagtttttgaaagaatgaaagcccgtatttgtgtaagataaacataaagggccaatggaaactcttattgttaaaattagtgtcag

SEQ ID NO: 196374 - DNA, 601 bp, Human
ttcttcgaagaatgaggaggccaggctgagatttaatgtacatgagaagtttaacagcaatgaaggtgaaacaacaaagaaaagaccataatataaatattggcaggttttatttgttcaggcagtaatttgctaggatatgaacacagtcaatggcctaagaataattacttttgattacccttattaatttgtatgaaatgttcatacaatagtttgttaagcaagcacacaacattataaagaattatggagagagacagacatatgtagaatgtaaagagtaaataattatgcagaraagacagacaaataagggttatggttatattacaaaaccggtataaaatcagagtaaaatgtggattttctagtaatatgaatgttagccacaggatgccttaaaatccacctgattcaatcccctccttttatagatgaagaaactgaagactagaaaaaataatagtcatacttgtccaagtttacatgctgtagtgaaattatctgtgcaatagcagtccttcatttaatattaaatacaagacattataatattttaccactcatctttattcttgaattctaaatttgtcagtaa

SEQ ID NO: 196375 - DNA, 601 bp, Human
tattggcaggttttatttgttcaggcagtaatttgctaggatatgaacacagtcaatggcctaagaataattacttttgattacccttattaatttgtatgaaatgttcatacaatagtttgttaagcaagcacacaacattataaagaattatggagagagacagacatatgtagaatgtaaagagtaaataattatgcagagaagacagacaaataagggttatggttatattacaaaaccggtataaaatcagagtaaaatgtggattttctagtaatatgaatgttagccacaggaygccttaaaatccacctgattcaatcccctccttttatagatgaagaaactgaagactagaaaaaataatagtcatacttgtccaagtttacatgctgtagtgaaattatctgtgcaatagcagtccttcatttaatattaaatacaagacattataatattttaccactcatctttattcttgaattctaaatttgtcagtaacttatatgtactcaattttttattttttggcattctgagttcaactgaattgtagcgtcatgtacataacacattgtgtagggatcaggttattata

SEQ ID NO: 196376 - DNA, 601 bp, Human
gagacagacatatgtagaatgtaaagagtaaataattatgcagagaagacagacaaataagggttatggttatattacaaaaccggtataaaatcagagtaaaatgtggattttctagtaatatgaatgttagccacaggatgccttaaaatccacctgattcaatcccctccttttatagatgaagaaactgaagactagaaaaaataatagtcatacttgtccaagtttacatgctgtagtgaaattatctgtgcaatagcagtccttcatttaatattaaatacaagacattataatrttttaccactcatctttattcttgaattctaaatttgtcagtaacttatatgtactcaattttttattttttggcattctgagttcaactgaattgtagcgtcatgtacataacacattgtgtagggatcaggttattatatgttaatttcctccatgctcctttgccatctagaacctgatctgctgttttaaacagcatgaggcctgttctcccatttaggctaacagtgggtgcagaagggttgaagcattatactttctaaactggttccttgttctggagagtatccatctgaag

SEQ ID NO: 196377 - DNA, 601 bp, Human
tgtggaactttgaacttgagatagattatttagggtatctggtgggaaaaaatgtctaagcagcaaaacattcaagatgtaacctggcttattctgaaagcattcagttatatacattcacaaatagatggtttgaaattggatcttatgtttaaaaatggaagcagagcataaaggtttgggaaatttgcaacttgaccatgtggtagaaaagaaaaacccgtcttctggggaggaattcaagccagctgcagaaatttgcataagtaacgaggagcggaatgttactagccaagaaaayggggaaaatgtctctaaggcatatcagagaccttcacagcagctccttccatcacaggcccagaggcctaggagggaaaaattggcttcatgggccaggcccagggccctgctactctatgcagctttgggacttggtgccctatgtccagctactccagttccagctccagcagtggctaaaagcagccaaggtacagctcgggctgttgctgggaacatttacccaatgcctgtacctgcattgtatcttggaagtaactaacatgcttatgattttacaggcttattggcggaaggg

SEQ ID NO: 196378 - DNA, 601 bp, Human
ttgagatagattatttagggtatctggtgggaaaaaatgtctaagcagcaaaacattcaagatgtaacctggcttattctgaaagcattcagttatatacattcacaaatagatggtttgaaattggatcttatgtttaaaaatggaagcagagcataaaggtttgggaaatttgcaacttgaccatgtggtagaaaagaaaaacccgtcttctggggaggaattcaagccagctgcagaaatttgcataagtaacgaggagcggaatgttactagccaagaaaatggggaaaatgtctcyaaggcatatcagagaccttcacagcagctccttccatcacaggcccagaggcctaggagggaaaaattggcttcatgggccaggcccagggccctgctactctatgcagctttgggacttggtgccctatgtccagctactccagttccagctccagcagtggctaaaagcagccaaggtacagctcgggctgttgctgggaacatttacccaatgcctgtacctgcattgtatcttggaagtaactaacatgcttatgattttacaggcttattggcggaagggacttgccttgtctca

SEQ ID NO: 196379 - DNA, 601 bp, Human
ctgtgattattagtggagactgtgttgaaattttactgggtgtaggagtgccaggtagttcagtcctgaggcccagtggtgttatcagtgggctaagtgtgcctgtctttaggctcctgtgtggcatacaagggcacgtgtgttagtgggctcaggtgggccaattgttgggcctccaggaagcttgcttcggttcagtagtggcagcagtgggcatgtgtgtggtgaattcctgggcccctaagcagtatgcatggcatgagaaatagcagtagtgatggtgggaccacccttggactcycaggcatcacatactggtgtttgcagtgcctgcaacaggctggatggaccagccctcaggagaagtgcacggacaccagcagtggtgaacaaggcagggctgttctcaggtccctgggtggcatgcttgggtacttgggggatagtgccaggggtgtgggcctgcccttagtgtcccctgatgggtgcatgggaataggctgtggtgaataggacagggcaatctccatgccccaggtataacaatgtatttcttttttacaaatatgcatttaccagttttctataatctctacctttt

SEQ ID NO: 196380 - DNA, 601 bp, Human
ctcaggtccctgggtggcatgcttgggtacttgggggatagtgccaggggtgtgggcctgcccttagtgtcccctgatgggtgcatgggaataggctgtggtgaataggacagggcaatctccatgccccaggtataacaatgtatttcttttttacaaatatgcatttaccagttttctataatctctaccttttcttattttgcagtgcattttcattatgtatttatgaaaaaattatatagagatttatgcattcaagtgcttgttgacatttgttacattgtgtaactacaaaacmaccttcactactttgcttattaaccatagagtgttgagtgagaaacccagagaaaaggatataaactttggacagattatatggattaaatccagctctacgtctatatgctatggtttgttttttgagttacttagctgctgtctgccttggtttcctatttgacacatacttgatgggattgcacctgaataatggttatggaaattaaaggaattaatttaaggagagtgcctcacacacagatattgaatgaatgttggctattaatattattaatagaagacagattttcacata

SEQ ID NO: 196381 - DNA, 601 bp, Human
gtttgttttttgagttacttagctgctgtctgccttggtttcctatttgacacatacttgatgggattgcacctgaataatggttatggaaattaaaggaattaatttaaggagagtgcctcacacacagatattgaatgaatgttggctattaatattattaatagaagacagattttcacatatttgtgagaataagagaaggcacatttttgtgagcattcttgtgagaataagagaaaccacatttctgaagcactagaattttcacacggtttttcaaaggaaggagatttatagrcacacaattttacaaagaagacaatagtttaatctgacaagatattaaatataaatagaaaaatctacataatatcaccaaaacaactagtctaaaattaaaaccaaaaagtaccccaaactggagaaaatatcatagaaagtatttcagaagttctgtttattgatttataagtaaagatattttaaactgggaaatccagaagtagtttgatcagcgacttttagattacttgtacctttttctcaaggatttatattttattgttacagacagtagtctcaccattttgcccagact

SEQ ID NO: 196382 - DNA, 601 bp, Human
cacttgttagctgtgtgatttcaattagttcttcacttttcccaaccttggttttgttatttataaaatgttaacaatagattttttattatactattattcagagaataaagtaaatatattaattacccatatataagtatacatgcatgtgtattttagatattctatttaatttataaatatatattgctttataaggtaatacttcatattactctataaatatatattatctgtacatatatttataaagtaaatatatattatgctgtatttccataataaaccattatatatwtttttttatgtatatattacatataatagtttatattatatataaaataatggttatatattaataatggttttatatattatatattatatattacatactatatataatatatgaaaccattatatattatatataaaaccattatttatacatttatatatataaaatgatttatgctggaaatgcagttctgtataatctaaatctaatttaacacaacaccatttaagatgtatttaatttccatctagttgagtatttttcaaaacatgattttttagtgcttatataagaaaa

SEQ ID NO: 196383 - DNA, 601 bp, Human
cttgttagctgtgtgatttcaattagttcttcacttttcccaaccttggttttgttatttataaaatgttaacaatagattttttattatactattattcagagaataaagtaaatatattaattacccatatataagtatacatgcatgtgtattttagatattctatttaatttataaatatatattgctttataaggtaatacttcatattactctataaatatatattatctgtacatatatttataaagtaaatatatattatgctgtatttccataataaaccattatatatttwtttttatgtatatattacatataatagtttatattatatataaaataatggttatatattaataatggttttatatattatatattatatattacatactatatataatatatgaaaccattatatattatatataaaaccattatttatacatttatatatataaaatgatttatgctggaaatgcagttctgtataatctaaatctaatttaacacaacaccatttaagatgtatttaatttccatctagttgagtatttttcaaaacatgattttttagtgcttatataagaaaaca

SEQ ID NO: 196384 - DNA, 601 bp, Human
attttcccaagagatttatgaactataaaataatattattatgttctcttattgcattgtgctctttagccatcttccattttatgtggtatagctccttaggatccatttggttgaaagctactgtgtatactcattttgtattgtattgtggcaaatgctgtaatctacagggttcctattcatttcacagctcactaattgtgtgaatgagaagaggaaatatatgcttttattctaaagcatgccaagcagatggccaaagttcattactaggagcattgtcagtgtggctgtcttytctaggtagtaagcctggcatcgatctgtcaaacacagagtgagggtccatttaacacagcacttgaaaatcactgagcctctgttttgttatgacttataaacattttatttttttatcatcaacctccaaagtggttggtcatttgagcaggtgcaaacacagtagaattcatatttgttttacctgagaagccaaatgaacttttattcatatggaaatcttggggaaaggaaaccgtacaagagattaagcttagtttcttgaaaagcgggtaatacagctattgagattcaaaac

SEQ ID NO: 196385 - DNA, 601 bp, Human; identical to SEQ ID NO: 40614

SEQ ID NO: 196386 - DNA, 601 bp, Human
agataatattgctttgaagatagtaagctatcttatatttcacccagcaatgaaacatgcagctttatttctagacagaaactgaagaggaaagctgagacctacgaagggctttcttagtctggaagataacagcatatttgaatgctgattcaaaccatccaggacagagtaaaattgcatttttgatagtgtccccaagacagttttaaatacattatgaccaactgatgactcaaactgatagagctgttacctcctgccactgaggatttcaaactgtacactttgtgaagaccawgcaaagtcaggaatattttataataaactggaacccaaatattcatgagacagtcccttcctaactgtctcactctccagatgagaaaattagtctgtgtccaagactggagttgataatggtagaattcagtaagctcgtgaggagtttatcttactgtttactggagatgttattactttatttatttatttatgaaatatcgaaatcactaggaggaatttggaccattgctgacatttcaatacatctgcataaaatggcagtgctcttcatattaccatagatccattcctgtct

SEQ ID NO: 196387 - DNA, 601 bp, Human
gttttaaatacattatgaccaactgatgactcaaactgatagagctgttacctcctgccactgaggatttcaaactgtacactttgtgaagaccaagcaaagtcaggaatattttataataaactggaacccaaatattcatgagacagtcccttcctaactgtctcactctccagatgagaaaattagtctgtgtccaagactggagttgataatggtagaattcagtaagctcgtgaggagtttatcttactgtttactggagatgttattactttatttatttatttatgaaatatcsaaatcactaggaggaatttggaccattgctgacatttcaatacatctgcataaaatggcagtgctcttcatattaccatagatccattcctgtcttgaattcaaaataaatgaaacattacaaaattttctctgtgctccattgtggcttacagatacgcctgaatataatggttatcaagtacatatgatgatctatcacactgataagcaaggtaaaccagtgtgagttgttcaggttgctctgagatttcataaatattttatattattttctaaaatctgaaaattcattttgctg

SEQ ID NO: 196388 - DNA, 601 bp, Human
tacctcctgccactgaggatttcaaactgtacactttgtgaagaccaagcaaagtcaggaatattttataataaactggaacccaaatattcatgagacagtcccttcctaactgtctcactctccagatgagaaaattagtctgtgtccaagactggagttgataatggtagaattcagtaagctcgtgaggagtttatcttactgtttactggagatgttattactttatttatttatttatgaaatatcgaaatcactaggaggaatttggaccattgctgacatttcaatacatctkcataaaatggcagtgctcttcatattaccatagatccattcctgtcttgaattcaaaataaatgaaacattacaaaattttctctgtgctccattgtggcttacagatacgcctgaatataatggttatcaagtacatatgatgatctatcacactgataagcaaggtaaaccagtgtgagttgttcaggttgctctgagatttcataaatattttatattattttctaaaatctgaaaattcattttgctgaattaattatgttcagtccttatcctcaaggggcttttcatgtacagt

SEQ ID NO: 196389 - DNA, 601 bp, Human
atttaacaattatgttctatcatgactgagagacaaaaataaagaaggaaaacatgtaaagtgctaggtttatccctcttctcatgcctattgccttttcttcattctcattctgtcttggtcatcttagaccagcacacttcatttagtaggttaatcttctaacaaatatggaaggaatgtctgttttatgccctcatgaaggttataatctaatagaggaaacctgccaataataaatagactcattagacttataaaattataagattgggcagtaataagtgctgaaaagaaggtyattttgtttttatgtcactgacatgatagattttacataatgttcggaaacatgaacttcaggatgaaaacagttaacaggaaggaagtctatgcttctgttgtttacaactgtggagcagataaaccaggaagaaaccagtatgcttctgatgaatgggaaaaggtgggccatgctcaagtgtctgagcctggagtggagatgggcatcctttctacttagatggtgtccatagatcaaatgaattctttctactctattataacagaagccttaattggaacccagcccaattcactg

SEQ ID NO: 196390 - DNA, 601 bp, Human
aaggaaaacatgtaaagtgctaggtttatccctcttctcatgcctattgccttttcttcattctcattctgtcttggtcatcttagaccagcacacttcatttagtaggttaatcttctaacaaatatggaaggaatgtctgttttatgccctcatgaaggttataatctaatagaggaaacctgccaataataaatagactcattagacttataaaattataagattgggcagtaataagtgctgaaaagaaggtcattttgtttttatgtcactgacatgatagattttacataatgtycggaaacatgaacttcaggatgaaaacagttaacaggaaggaagtctatgcttctgttgtttacaactgtggagcagataaaccaggaagaaaccagtatgcttctgatgaatgggaaaaggtgggccatgctcaagtgtctgagcctggagtggagatgggcatcctttctacttagatggtgtccatagatcaaatgaattctttctactctattataacagaagccttaattggaacccagcccaattcactgtggtcccaaaaagatcaccgatactgtatacacagccagccact

SEQ ID NO: 196391 - DNA, 601 bp, Human
taaaagggctatctccctagccagagtgcaagacctactagatggaaaatatatgctcccttttccactactatatattaaggctttgcaaagtatcctttgtcttgaggacaaagtatgtactcaagaaatatttgttgactgttgaatgaataaagaatctttatggaaattatgagatacttcacacagaacgcttactcaagtgtctgatgcagagttattttcctgtagcacagtttgttgcttttcctagctttgctctatacctccaacatgaggacagggaaagacaatagtmaagggatcagtgggttggggtcatgggtcaatgtttcaagtgggtaaaggattttagattgcagaaggtcaccctgaagtcggaaattgtaaggatccacattgcttcagtggtaaatctggccccattcatggcacaattaaaaactctctgaccttccagtattacattaaacagtaaaactcaacattctatttataaatgttccttttttgtccttacaagttacagtatggaaataaacaaagctcacccaaatgagaacaagtggaagttactattcagaacttactacaggaa

SEQ ID NO: 196392 - DNA, 601 bp, Human
acctttcttttacttgttgactcctgccctcattaaacttcatatgaaaaaggtgcctgaatggaatttaaattttctgaacttatctaaatctgaaaatctacctcagataggtgaaatttacattaattatagatttctagaaccggatgcacggcagtttttatcttcctctctttggtggcatttgatacatatacccagtgcccatggcaacagtgacccccaacttgtccaggaactgagatttatcttgccttcctctacgaaagcaattttaatggtgatgttaactcgtaawctttaaattagtcaaaaagtgatgtttgcttctctaaaaacaaaaatacttcctgggcaggatccaagcctattgcctttctttggagatgttagccatttaatttgtctaactcttatatagaattcattataaaccctgtctcagaactgtaccgacatttttgtgtgtcagtgtgtatagttattattttgtttggcaactttacactttcaggacgataaaatatttcagaaaactatttatgaatgatgtttatgtttagaaatcaatcagattgccttatttgaggtcacagaa

SEQ ID NO: 196393 - DNA, 601 bp, Human
ggcaacatatagtaataatcttaacaactcagattatctgtgctcagtcattctaattctagaaatctgtttttaaaatgataaaatgtgtgaacaaatatttataaataaatgtgtttactaaggccttgtaacaatgatagttgaatcacgatatgttcatatgatcattttgtgtagtcattataattatggatttgattatctttggtgccaggagaaaatgctcacaatagtgtataaacagaatataattagtaattgtcataattatagcatacttataaacacactatgttgmatactttttcatttaatcacactatgttgaatactttttcatttaatcttcactatagtttatgaagtagatactattatttcccatttacagatgggagaattgtgacacaaagaaataatgtacccgagtcacctgatgttaagtggtggacataggatcctggcagtcaaatacgctgtccataaaagctgggccattaacaacaaggctatgatggaaactgtgcaaggaatgtgtgtggaaagacaaatgacaggaaaaaataggaccacaatattaaccatgattgactctggg

SEQ ID NO: 196394 - DNA, 601 bp, Human
aagacaaatgacaggaaaaaataggaccacaatattaaccatgattgactctgggtgtattcataggatcaaagtttaaattgatcttcttcttatatcttctgcatattttataatctcatgacaattaatatgcattctttttctgaccacaagaagaaatcaaagagccaatcagaacataaaataaaaatgaataaaatcataattttctatagctccttatgacttttgaagcactttcatatttcttgtatctaattgaatccttataattagaatggccctataatttattacrcaaatcatgatattttttatttgtacaagagggtattattaatgaaaacagtacctgggcaaaccaggatgtagagtcaccatatataaaacaattctgtaaggtcaacagtgcttaagcatcttaattgcgtttcagagctaaaaaaaaaaaaaagtatttcaaaggcttgatcaagtcatatgacaaaatagtggttcccgaatagacaaaaatagattgctatcactttgtccatgttttttgccattaaaacaaaacaaaacctctggtgacaatttcctcaatggaagaaagttt

SEQ ID NO: 196395 - DNA, 601 bp, Human
tttcatatttcttgtatctaattgaatccttataattagaatggccctataatttattacacaaatcatgatattttttatttgtacaagagggtattattaatgaaaacagtacctgggcaaaccaggatgtagagtcaccatatataaaacaattctgtaaggtcaacagtgcttaagcatcttaattgcgtttcagagctaaaaaaaaaaaaaagtatttcaaaggcttgatcaagtcatatgacaaaatagtggttcccgaatagacaaaaatagattgctatcactttgtccatgktttttgccattaaaacaaaacaaaacctctggtgacaatttcctcaatggaagaaagttttgaatcatgtagttgacaatctaggaatatctaaaattttatttgacttaaaatattaaagccactgatatttctgaaatgtcataatattacgctaagaaagctgagatttacaaaagaggataactaatacttgtgaatataggaaattgtagattcatgtaatattcatctgtgtcagaactccaaaaaaactagaaaagcaactaaccaataatgaaactagagaagtattttcag

SEQ ID NO: 196396 - DNA, 601 bp, Human
catatataaaacaattctgtaaggtcaacagtgcttaagcatcttaattgcgtttcagagctaaaaaaaaaaaaaagtatttcaaaggcttgatcaagtcatatgacaaaatagtggttcccgaatagacaaaaatagattgctatcactttgtccatgttttttgccattaaaacaaaacaaaacctctggtgacaatttcctcaatggaagaaagttttgaatcatgtagttgacaatctaggaatatctaaaattttatttgacttaaaatattaaagccactgatatttctgaaatktcataatattacgctaagaaagctgagatttacaaaagaggataactaatacttgtgaatataggaaattgtagattcatgtaatattcatctgtgtcagaactccaaaaaaactagaaaagcaactaaccaataatgaaactagagaagtattttcagatggtaagttgagtgaacatttagctaaattatttttataaaagtaataatggagggtggcattatgtgaaatgggaaattctttgtattagttacttggttagaaagttgaaaactttctaaggttttattagatagacg

SEQ ID NO: 196397 - DNA, 601 bp, Human
ttgtttagccaagagtatttgcaaatgattttaaatttgaaacactttggccgggcacagtggctcacgcctgtaatcccagcactttgggaggccaaggcaggcggaccatgaggtcaagagatcgagaccaaactggccaacatggtgaaactaaaaatacaaatacaaaatactaaaaatacaaaaattagccgagcgtgttggcgggcgcctgcagtcccagctactcgggaggctgaggcaggagaattgcttgaacccgggaggcagaggttgcagtgagcagagattgcaccaytgcacttcagcctggtgacagagcaagactccatctcaaaaatagataaataaataaattaattaatttttaaaaaattaaatagtttaagcaggtcaacaggcattctagttttgacacccctccatccttccctacccaggtccccagcaggccctctactagccctggtggtgccttaccggaaactcaactaaagcacctgctctgggaacatgcagccccaaggcacacagctgttggaaaagcaggattgggattgtggcccctcctttctactgtgtcttgacattttgtgag

SEQ ID NO: 196398 - DNA, 601 bp, Human
gcctgcagtcccagctactcgggaggctgaggcaggagaattgcttgaacccgggaggcagaggttgcagtgagcagagattgcaccattgcacttcagcctggtgacagagcaagactccatctcaaaaatagataaataaataaattaattaatttttaaaaaattaaatagtttaagcaggtcaacaggcattctagttttgacacccctccatccttccctacccaggtccccagcaggccctctactagccctggtggtgccttaccggaaactcaactaaagcacctgctctggraacatgcagccccaaggcacacagctgttggaaaagcaggattgggattgtggcccctcctttctactgtgtcttgacattttgtgagatttaaaaattgcacatacttgcatagaaattcttactacggccctgtacattatcatgtttcacattgatatgaccggcttggctcctgaagcctttcattattgactctgaaatagaattaggctccatctttaggacattgtcataagcatagtctaatgtaaagaaatgtaaattggccagtaggtggtttagtttggaaagaatact

SEQ ID NO: 196399 - DNA, 601 bp, Human
aagaaatgtaaattggccagtaggtggtttagtttggaaagaatactgaattacttgactttttccttcctaacaccaacatcaggaatatacagaatttaatggtgagaggaaaattaactccatatgaggaaatatggcaaagagattatgctgatgggacctttgttagcatatttagttagaacagagtaaataatacctgctaaatcaatgccattttaaaaagacttaatttatatacaaagacttattttaaagataatttgatagttttccttttctttgagaaaaataagtyggatacttgtctaggagagtatggaagacaaattttgttattgattactcctgggtatgagacagtgaggaaaaagaactgatttcacatcttcttttgcctctgctcttccttgctgctgatcattgttatatgatagtgcaatggtataagtgtcaataaaccatctaatgaatgcattttgtgacatcctgtgcttacgtgtttcttctggaggcttatctgcattatctcatagtctgtgttcagtgaatacaaaatgtctaaacactgtgagtatatgacctaatctatcagaag

SEQ ID NO: 196400 - DNA, 601 bp, Human
aaattttgttattgattactcctgggtatgagacagtgaggaaaaagaactgatttcacatcttcttttgcctctgctcttccttgctgctgatcattgttatatgatagtgcaatggtataagtgtcaataaaccatctaatgaatgcattttgtgacatcctgtgcttacgtgtttcttctggaggcttatctgcattatctcatagtctgtgttcagtgaatacaaaatgtctaaacactgtgagtatatgacctaatctatcagaagatattagttaaattaaaattcatattaaayggatcacagaagaaagtattggaatgtgttattcagatcagattttactgtcttctcctttcttgggagcactttaaaaggtgcaaagatgcgtttttaaatctccaaagataattctgggcatggtcttatcccaccaggggtagtgcaaaatactattcaatgcttcccttaagcctacctttacctattaatttatcttggatccctagattttgcgctgtcttttagctttgtctgtataatatggcatgttatctttatgagaggatgaaatagatccattacagtaaaagatgt

SEQ ID NO: 196401 - DNA, 601 bp, Human
gatgcgtttttaaatctccaaagataattctgggcatggtcttatcccaccaggggtagtgcaaaatactattcaatgcttcccttaagcctacctttacctattaatttatcttggatccctagattttgcgctgtcttttagctttgtctgtataatatggcatgttatctttatgagaggatgaaatagatccattacagtaaaagatgtatgccattaatgagtttctagccagctatcaaggtatcatcaaatgtggtttatcttggtgaatgaaagcttgaatggaaaattaagytcccacactgactggagaagttcagtggatcgttttgttctttaatgttacacttcactgaacacacttcacagagccgtgaatcatgctttaaacaagctgcctttactttaacggcagcagacaatgcagcaaaggtgaataataagtgttagcaatcttaactttcttttgcagtactctctaccacgtgcctgatggacaatttacaaagtacatatgctattttatagattggaacgtgggatccagccagtggcctgaatatgacagaaagtcaaaagggaaagccagcgaaca

SEQ ID NO: 196402 - DNA, 601 bp, Human
atcatcttcctgatctagccaaattcctcaaaacatcacttattttatggctccaaatcttcgctcaattcttcttcttctcctcctccttcttcttcgatggagtcttgctctgttgccagtctggagtgcagactcatgatctcggctcactgcaaactccacctcccaggttcaaacgattctcctgcctcagcttcctgagtagctgggactacaggcgcgctaccactcctagctaatttttgtatttttagtagagatggggtttcaccatattggccaggatggtctcgatctattgacctcgtgatccgcctgcctcagcctcccaaagtgttcggattataggcgtgagccactgcacccagcctgctcaattcttctttatgttctgcagtaaaaatcctattcattttcttgtatccatctcaaatgctacccacttcatgaaaatctttgacagctccattaagttgcctgtgtcttggggagaaggaggaagtttgtatactttatgtaccagaatactccatcatggcattatcatttttttaattaaaaaactatgtatgtttgtgtttccacttgacataagctc

SEQ ID NO: 196403 - DNA, 601 bp, Human
cattcttgctctgataactcagtgtgttttatttcaaatgtattttatttctcatattttcagagacttccacaaagctagtcaaatataaaactattgatggtggtagagaaagaagaaataaagaaagtcatgagttttgatgtaaaattaggtataattttgaaaatcctagggtcttaatttctaaagccttctaagtgccagaacctcattttttacttcatatacacattctttttcctttgtcctttattaaatctgacttaaattaactaccatgatgaagacttataagcatttttgcctttatgttattttttattccaaacattattgtccatactataaaattgacaattttataattgtcaatactaaaatggttgaagactattttattatgatcagtatattaagttttgtataaaagaatgaatagaaaaatctgaattttgaattcagctcagccactagcaaaatatgtgaaaatgaaatatttttgccttaacattctcatttttttaggaagatgttatcacaataggaccatatacacttgtacaatctgaattttagctacaaccttgaactgagattc

SEQ ID NO: 196404 - DNA, 601 bp, Human
gaatgtggatgaagacgtaaaggttaaaagcctagaagcagggatgatagcactgccacagcgtgtgatggggatggtgggaaaggagatgatgaatgatactcaagtatgtatggagatgttggcaatgacttttgagcagtcaaatcttgattatttatgtaaggggataataaattagattcagagatgaaatgctgtttggagattagctaataggtacagtctcctttcccatcaaaccttttactggaaccacaatgaaatagtacatttgattgattcaaacttcagctttttytttcttactatctttcccttgtaaattaaactacccaaaattttaatgaccaaaatagaaattatcagcagaaagatagtaacaaccaactgaaggaatttaatagcataccatttaaaaaaaatgacgttttttcttaatacaagcatgaatgatagtcactatgccgaatcctcccttaagatatattactctgacatcagtaaattcctttcttgaaacattggtgaacagcacaactagcaaaactcaccttttttttcttgaaagtcgagttcaactattacacaatcattattt

SEQ ID NO: 196405 - DNA, 601 bp, Human
ccatcaaaccttttactggaaccacaatgaaatagtacatttgattgattcaaacttcagctttttctttcttactatctttcccttgtaaattaaactacccaaaattttaatgaccaaaatagaaattatcagcagaaagatagtaacaaccaactgaaggaatttaatagcataccatttaaaaaaaatgacgttttttcttaatacaagcatgaatgatagtcactatgccgaatcctcccttaagatatattactctgacatcagtaaattcctttcttgaaacattggtgaacarcacaactagcaaaactcaccttttttttcttgaaagtcgagttcaactattacacaatcattatttccataagactcactacaatttccagtaagtaaatattacttttcagggagaaagaagttattctcatcttcccaaatcccagtagattttctatagttacaggataaaaacagaaacttttcttagaattataattatggccaacaagacttagatttttgtacattttgaaattctctaaagttatgtttctgaaataaggtaaatacagtttgcagaaactacgtatatgat

SEQ ID NO: 196406 - DNA, 601 bp, Human
atagcataccatttaaaaaaaatgacgttttttcttaatacaagcatgaatgatagtcactatgccgaatcctcccttaagatatattactctgacatcagtaaattcctttcttgaaacattggtgaacagcacaactagcaaaactcaccttttttttcttgaaagtcgagttcaactattacacaatcattatttccataagactcactacaatttccagtaagtaaatattacttttcagggagaaagaagttattctcatcttcccaaatcccagtagattttctatagttacagrataaaaacagaaacttttcttagaattataattatggccaacaagacttagatttttgtacattttgaaattctctaaagttatgtttctgaaataaggtaaatacagtttgcagaaactacgtatatgattatgcttgcatagtttatgaaagatttatgtgtgtgtaagtatgaaaatcactcctggcaaagattgcctttgcttaatagacttgaggaagaaagtagaaaagaagaaaataaaagaatttttctagattgcctcagaatgtacttgaattttgtttaaaaaagtaaa

SEQ ID NO: 196407 - DNA, 601 bp, Human
gcataccatttaaaaaaaatgacgttttttcttaatacaagcatgaatgatagtcactatgccgaatcctcccttaagatatattactctgacatcagtaaattcctttcttgaaacattggtgaacagcacaactagcaaaactcaccttttttttcttgaaagtcgagttcaactattacacaatcattatttccataagactcactacaatttccagtaagtaaatattacttttcagggagaaagaagttattctcatcttcccaaatcccagtagattttctatagttacaggataaaaacagaaacttttcttagaattataattatggccaacaagacttagatttttgtacattttgaaattctctaaagttatgtttctgaaataaggtaaatacagtttgcagaaactacgtatatgattatgcttgcatagtttatgaaagatttatgtgtgtgtaagtatgaaaatcactcctggcaaagattgcctttgcttaatagacttgaggaagaaagtagaaaagaagaaaataaaagaatttttctagattgcctcagaatgtacttgaattttgtttaaaaaagtaaataa

SEQ ID NO: 196408 - DNA, 601 bp, Human
acacaaatcagttgcatttttatacaccaatagcattcagactgagacccaaatcaagaatgcaatcccatttacaatagccataaaaatataaagaacctaggaatacacctaattaaaaaatgcgaaatgtctttatgaggagcactaaagacaaaacaacaacaacagcaacaacaaaatcacgctgaaagatgacacaaataaatggaaaagcattccatgctcatttcatgctcatgagttggatgaatcaatatcattatattgtccatactgcccaaagcaatctatagattcmacactaatcctgtcaaattaccaatgtcatttttcatagaatttgaaaaagaaactattctaaaattcatattgaaacaaaaaagaggctgaatatctacggcaactctatacaaaaagagaaaagccagaggcatcacactacctgacttcaaataatactacaaggctacagtaaccaaaacagcatgggattggtataaatatagacacataaaccaatgtaacagaatagaaaactcagaaataaggctacactcctacaaccaactgatctttgacaaaatcgacaaaaacaaat

SEQ ID NO: 196409 - DNA, 601 bp, Human
tttcttatcttgagtcaatttatggaaatgctcctgtatttaagagatttacaattaattgttcattaattatatgccctttggtgagaactttactcttcatgcctgatcttgtttttcgttgttgttgtttgtttgttttgttttgttttgagacggagtcttgctctgtcgcccaggctggagtgcagtggcatgatctcagctcactgcaaccttcgcctcccaggttcaagcaattccctgcctcatcttcctaaggagctggaattacaggtgcctaccaccatgcccggctaatttttttttgtatttgtagtagaaactgggtttcaccatcttggccaggctggtcttgaattcctgacctcgtgatccacccacctcggcctcccaaagtggcctgttcttgttttaacagcattttcttttattattcttaacaatgataatagatttatgctcaagaaaaccttttatttatactttttcaataaattatttttcaagaatgggcactaaatacaaatgaataacttgataatctacagagattgtcattaactttcaaattgtacttattatgattaatatattaatt

SEQ ID NO: 196410 - DNA, 601 bp, Human
tgtagtagaaactgggtttcaccatcttggccaggctggtcttgaattcctgacctcgtgatccacccacctcggcctcccaaagtggcctgttcttgttttaacagcattttcttttattattcttaacaatgataatagatttatgctcaagaaaaccttttatttatactttttcaataaattatttttcaagaatgggcactaaatacaaatgaataacttgataatctacagagattgtcattaactttcaaattgtacttattatgattaatatattaattaatttttgaatggyaaaaatacttatattccagcaataagctattattggtaatggttaaaaaatattctcatgaactgctatattttgtttgctctattatatttaggtatattcactagtgactgctcaataattacaatatttaactactttgctagtttcttatatcagggttatgctaacttcatttaaatgaagatgaactggtttcagagcatttactatggtctaaagcagtttttggattatgaggttgttttattgttttatattaggtgaaaaataaaaattccaaagtatttttttcttctg

SEQ ID NO: 196411 - DNA, 601 bp, Human
aaagtggcctgttcttgttttaacagcattttcttttattattcttaacaatgataatagatttatgctcaagaaaaccttttatttatactttttcaataaattatttttcaagaatgggcactaaatacaaatgaataacttgataatctacagagattgtcattaactttcaaattgtacttattatgattaatatattaattaatttttgaatggcaaaaatacttatattccagcaataagctattattggtaatggttaaaaaatattctcatgaactgctatattttgtttgcyctattatatttaggtatattcactagtgactgctcaataattacaatatttaactactttgctagtttcttatatcagggttatgctaacttcatttaaatgaagatgaactggtttcagagcatttactatggtctaaagcagtttttggattatgaggttgttttattgttttatattaggtgaaaaataaaaattccaaagtatttttttcttctggaagaaatgcttcagtagctttcataatttattttatgcttattggccttttcattttattgtttctttttgaatcaattt

SEQ ID NO: 196412 - DNA, 601 bp, Human
tgctatattttgtttgctctattatatttaggtatattcactagtgactgctcaataattacaatatttaactactttgctagtttcttatatcagggttatgctaacttcatttaaatgaagatgaactggtttcagagcatttactatggtctaaagcagtttttggattatgaggttgttttattgttttatattaggtgaaaaataaaaattccaaagtatttttttcttctggaagaaatgcttcagtagctttcataatttattttatgcttattggccttttcattttattgtwtctttttgaatcaattttatattgtgcactgatatataaccaggtattcaaatttattaacatagattttcacataatgtcaccatataaattttataatctcaatttactgaatctctttctcacataaaattctttgaggcttaaaatttctttcccttttttcttaatttggttgatgaagaaatttattttattactgttgcttttactaaaagacatgtttactgtttagccattttcttccttcctactttgtacttcactattttttcagcattttcttattatttttctttc

SEQ ID NO: 196413 - DNA, 601 bp, Human
tattcactagtgactgctcaataattacaatatttaactactttgctagtttcttatatcagggttatgctaacttcatttaaatgaagatgaactggtttcagagcatttactatggtctaaagcagtttttggattatgaggttgttttattgttttatattaggtgaaaaataaaaattccaaagtatttttttcttctggaagaaatgcttcagtagctttcataatttattttatgcttattggccttttcattttattgtttctttttgaatcaattttatattgtgcactgatrtataaccaggtattcaaatttattaacatagattttcacataatgtcaccatataaattttataatctcaatttactgaatctctttctcacataaaattctttgaggcttaaaatttctttcccttttttcttaatttggttgatgaagaaatttattttattactgttgcttttactaaaagacatgtttactgtttagccattttcttccttcctactttgtacttcactattttttcagcattttcttattatttttctttctgctatttgggtttttttggagcgtctatttccc

SEQ ID NO: 196414 - DNA, 601 bp, Human
cattgtttcataagccctaaatatatgcagtttttatctctgaattatacctcaataaagctggaaaaaaagaaaaagggaaaatagtctggggaattaattttaggctgatgcacatttttatttagtcttctagatttcaacatagtgcttaatctctgcgaatctagagccacttcaattcaattacttcttcagttttctgccagggtcaggacaaaaagaatgggtagttctccagaaatgggttgaaatttctacctaatttactacttggtacagattatggacctctgaacamggacttttgttggggagaagaatgaaatatttcttgtactgtctctggttaatcaaggattattggtttcctggggccttatatttagtgtcaattcttcaaaaatgataggtaaagttctttatggggttcaggacatgctacccccaaatgtgtctccgtggtattaagaaagtctaggaaggtcactttcttttccccttctcccccaaagcacgtcataagactctcatctgagaggtaccctccctacacttggaagaaaagaacatccttatctctgaaatcacagggacacag

SEQ ID NO: 196415 - DNA, 601 bp, Human
ggttcatgctcctgcaccagttttgtttgtttgtttgtttgtttttacaagaatgcctacaacttaccagttaccttcaaacacaattttttgtacatatctgaattttgtgcctacaaacttttagcaagactccaggctactctgactttcactgttctgaatttgtatctttgctcataacctcacaactactttggttgggtgccagtagaggcaatgccagtgcttacttttcaccaatccttgagctgtatttggtttaggaatatgagtctattaggtgaagaaggaatgtaaratatttcagatagtggggaaaagtatatttgaaggcacagatgtgtgaaagagtttaggatatatgaataactctaagtagtctaccactgatgtagcacagaaaatgtaagggactggtgatggatgagtgtgaacagataggcaacatcaaagtagaaagcctttgtaagtttcctgaaggaatttagtttttatgatattaaagaaattttgaaggatttaaaatacatgaacagtatgatcaagttgggggttttaaagatcccttttagttttgaaggtggaattgttgttcact

SEQ ID NO: 196416 - DNA, 601 bp, Human
tttttgtacatatctgaattttgtgcctacaaacttttagcaagactccaggctactctgactttcactgttctgaatttgtatctttgctcataacctcacaactactttggttgggtgccagtagaggcaatgccagtgcttacttttcaccaatccttgagctgtatttggtttaggaatatgagtctattaggtgaagaaggaatgtaagatatttcagatagtggggaaaagtatatttgaaggcacagatgtgtgaaagagtttaggatatatgaataactctaagtagtctacyactgatgtagcacagaaaatgtaagggactggtgatggatgagtgtgaacagataggcaacatcaaagtagaaagcctttgtaagtttcctgaaggaatttagtttttatgatattaaagaaattttgaaggatttaaaatacatgaacagtatgatcaagttgggggttttaaagatcccttttagttttgaaggtggaattgttgttcactggacaagatttggtgagaacagccaaaaaatattgcaagaatacaagctgataagatctgaattatggaagactctaaagggatgag

SEQ ID NO: 196417 - DNA, 601 bp, Human
gtggaattgttgttcactggacaagatttggtgagaacagccaaaaaatattgcaagaatacaagctgataagatctgaattatggaagactctaaagggatgagggaaagaaatcagatttgtaagatatatgggggaaaaatgaagaatatatcatttgcaaattggactttatgaagtcagaatttaggaagacatctttctgataaatatgactggaaatgggattgaggtaaaaaagcagaattgaaataatacaggatgaatttaattttgaacatattgcattttattttcttrtaatatattgatctagttggcagttagatatgtaattccagagctcaagagaatgttctggcttggagataacttttggagttaagatgatggttggtctcatgaataatggtgtgatagttcactcagggagcacatacgtgtttcagtacatttacactattggacatttctttcttctcctgacactatttcagtgattctgtcctaaaacttactgtattctgtttggtttgacaaacaattataaattatgggcttccaaagaaggtaaaaagcatctgggattaaaagaataaa

SEQ ID NO: 196418 - DNA, 601 bp, Human
tttcttattaggtgtttatatatagtgacattaattaggtgcctaacctggaatgaatattcttaacttgaatcctataaattttatattctgagctctcttagctttagttctacatagtaattgattaaaaaaacaaacaaacaaaaagcatgaatttattttaactactttgagtaatctcatattggaaaagcaaacaaaacattttttcactacttcatcagaggattaataaaagaaagaaatgctttcgccatatagttgtttgaaaaacatttcatgttatatgaagaatacyttatgctacattcaaatataattatagccaaaggcactaaaatatttattttcatgtatgtcacagctttatgtctttaaaaactcaaaatttgtatttgctgtttttaacttttaaatttacattgttggcaagtatgatactccctgaccttgaagagaaacaaaacagtaccttcaaagtgaagcacacactttttgtgccctcgagcaatagcattccgtgtttactatttgtttacatcagaatttcagtgtgctccacagttctgataggtataaatatataggcacaccctaa

SEQ ID NO: 196419 - DNA, 601 bp, Human
tggagtggggataataataatgaataacttgaagtttgtttctattagagataaaaatttataaattatataacatcattcctggcacaaaattgtcagtgagtgatcgtttttaacgaccacagggtaatctaaaattaaaacataataaatggtgttcttcgttgctatttccccccggactttctaatatgttttttaacattttctccttatgggccaccattcctcttcttcaggccatgtgttggtgaacttcttctctatatcctctctcaattcatttctcttgcttggaaaytcatttatctccatttacctaattcatactcattctactcatacctttttctggtggtttttcctctgggatgatttaactgactgacttgggacatttttacttttcccttctctcacatctaatgatccttttttctataaaatgttatctttatgcatttaaatgcaaacttttagtattagtttatatttttctgtacaagttctctgtcctcaactagattaaaaggtgcttgagagaagcaactctgtcttaaagcagagtattttctttaaaatgataggtattcaaaaaact

SEQ ID NO: 196420 - DNA, 601 bp, Human
tgaatgaatgattaaatagatactaatatgacctcatttttaattttacagggtgtaatcaagaaaaaaagaaagtaaaggcagacttattggatgataatttgaaagtgtaaagagaaaacatactcttagaaaaaatgtaataaaatatttgagaaattagatctaaatttactttttaaatgaagggtattgagagatacaatagtcccctcaattctgtgcttaaggggaaaattatcttatttacactattactcattaaactttcagagttgaggaaaagcaagaataaggaaamaagatgggagaatgtttacagaattaaggaaatatgatgtttctcaatatgtgtgtaatacagttgaataataggagagtaaatttgtggtagaagattccttctcaaagaacgacatggcttgtgaatggtactagaactggaaaataatgagccattattagcactagttttgtctgatcaaattaatagaataaatgtaattgctcataagcactagtaaagaacaatcttaagcatttgctagttttaaataatttggtccagattttaacatagcatacattttccattatatga

SEQ ID NO: 196421 - DNA, 601 bp, Human
gtttatagtatatcatagcaatttgaggacacatgacatgtctcatttttttctttttggtacagcgtttggcaaactaagttcagagggctagatacatgttttttgtattttctcttttatttaggtaaaacttacatgatgcaaaattcatcattttcaccaaagtatgtaattcagtggttttcagtatgttcacaatattgtgcagatatcaccactatctagttccagatcattttcataacccctaaagaaaactctgtatccattaatcatttattctgcgttcattgtttgtttgttgttgttgttgttgttgttgttgtcgttttgagacagggtcccattctctgtcaccaaagctggagagtagtggtgctatcatagctgactgcaacctccaactcctggctcaagcagtcctcccacttcagcctcccaagtagctaggactgcaagcacacaccaccaggcctggctaatatttttattttgtacagatggggtctcgctatgttgcccaagtgggtcctggcctcaaacagttctccctgcatagcatcccaaagcactgagattacaggtgttagctactgtg

SEQ ID NO: 196422 - DNA, 601 bp, Human
tttatagtatatcatagcaatttgaggacacatgacatgtctcatttttttctttttggtacagcgtttggcaaactaagttcagagggctagatacatgttttttgtattttctcttttatttaggtaaaacttacatgatgcaaaattcatcattttcaccaaagtatgtaattcagtggttttcagtatgttcacaatattgtgcagatatcaccactatctagttccagatcattttcataacccctaaagaaaactctgtatccattaatcatttattctgcgttcattgtttgtgtgttgttgttgttgttgttgttgttgtcgttttgagacagggtcccattctctgtcaccaaagctggagagtagtggtgctatcatagctgactgcaacctccaactcctggctcaagcagtcctcccacttcagcctcccaagtagctaggactgcaagcacacaccaccaggcctggctaatatttttattttgtacagatggggtctcgctatgttgcccaagtgggtcctggcctcaaacagttctccctgcatagcatcccaaagcactgagattacaggtgttagctactgtgc

SEQ ID NO: 196423 - DNA, 601 bp, Human
tatcaccactatctagttccagatcattttcataacccctaaagaaaactctgtatccattaatcatttattctgcgttcattgtttgtttgttgttgttgttgttgttgttgttgtcgttttgagacagggtcccattctctgtcaccaaagctggagagtagtggtgctatcatagctgactgcaacctccaactcctggctcaagcagtcctcccacttcagcctcccaagtagctaggactgcaagcacacaccaccaggcctggctaatatttttattttgtacagatggggtctygctatgttgcccaagtgggtcctggcctcaaacagttctccctgcatagcatcccaaagcactgagattacaggtgttagctactgtgcccagccttgcatttgtttttacccatgaggccctggcaatagcctatctgctttctgtttctatggtttgagtactctggatatttctgggtgactagaatcatgtactgtgtggctttttgtgtctgcctgctttcacttagcataatattttcaaggttcatccatgctgtaacatgtatcaatacttcaatacttttatgattaaatg

SEQ ID NO: 196424 - DNA, 601 bp, Human
gttgttgttgttgttgtcgttttgagacagggtcccattctctgtcaccaaagctggagagtagtggtgctatcatagctgactgcaacctccaactcctggctcaagcagtcctcccacttcagcctcccaagtagctaggactgcaagcacacaccaccaggcctggctaatatttttattttgtacagatggggtctcgctatgttgcccaagtgggtcctggcctcaaacagttctccctgcatagcatcccaaagcactgagattacaggtgttagctactgtgcccagccttgcrtttgtttttacccatgaggccctggcaatagcctatctgctttctgtttctatggtttgagtactctggatatttctgggtgactagaatcatgtactgtgtggctttttgtgtctgcctgctttcacttagcataatattttcaaggttcatccatgctgtaacatgtatcaatacttcaatacttttatgattaaatgatattccattttatgcatattcatcatttagtttatctgtgaaaccactgattggcattcagtttatctccaaaatttggctattgtgaaaagttctgct

SEQ ID NO: 196425 - DNA, 601 bp, Human
atacttttatgattaaatgatattccattttatgcatattcatcatttagtttatctgtgaaaccactgattggcattcagtttatctccaaaatttggctattgtgaaaagttctgctatgcacattggttcacagtttttgtttaaacaccaatttttaatctttttgggtatatacctaagaatagcattgctgagttttatggtaattccatatttaactttttgaggagctgccaatattttttttatagcagctgcacaatttcactttctcactagcaaatgtatgaaggttcyattttctctatatcctcaccaacttgttactttcatttttaaaattataaaacatcctggtaggtgtgaagtggtatcttactgcggtttagatttgcatttccctaatgactaatgatgttgagcatgtttctgtgtgcttgttgacatctatatgtcttctttggagaaatatctattcaagctctgtgcccatttttaaacagcattgttttttttttgttgttgttgttgtaggagttctttatatattctgaatagtagaatattatcagttatatgattcacaatattttctcc

SEQ ID NO: 196426 - DNA, 601 bp, Human
attatctctgaggtaatctttcttcttttcttcctacctgcaggtttagtttgatcttattcttctaggtttctatggtgtaaatttatgttacttatttgagatttttcttcctttttaatgtagatatatacagctgtaaattccctttgagggactgctttcactgtatccattgagttttaatatgttctgcttttgttttcattcatcacagagcattttctaatttcccttctaatttcctctgcaactcattggtttctctcaaggccagtttctattaatttctttgttcctrtcaatgggctgtactttcttgtttgtatttttcacttttttttggttaaaaaatgggcattttaaacagtataatattgcaactctagaaataagatattcccctcacccagggttttttgtttactggttattgtagttctttgttgtttagtgaccttgctaaattaattttgtaaagtctgtattttttgttctgggtggccactgaaatgtgtgattgttaggttagtagtaccttagtaacttgacagagatttccttaaactcctggaacaaaacaacaagaaacaaaaccaaa

SEQ ID NO: 196427 - DNA, 601 bp, Human
ggtttccctggcttccccggttgaccagaacaattcgtttctattcaattcatttcagcagtcattttattggtaagcctgctatgtgccaggggatgtttggtgcttttgaagcaaaattaagtaaccattttgccgagtaaatcgctcaagtctagttcagaaggcttacatataaatcatcacctactacttggtatgataaatgctatggtaaaagtattcaaaagttgttgcaggagcaccagaaaaagaaacacctaaatatgtctgaaaagtgaatactcagtaccagaaagcwgtttcaccacagggcttcttccctttctaatataacaagggcatataaactatgatctatggaaatgtgttatctacttgaaagactagcaggccaggaagagtagtgaggcaaaagggtatgataacctcttgggtggaagggcactacatctgttacatttgcagtactttgtgtacccctggggaataaagtttatatgtgatcaaatgttacataaaaatcagacaagatcctaactgttcttttacttatgttaagctcaaatatgtagctttggatgtagttaacagattaatt

SEQ ID NO: 196428 - DNA, 601 bp, Human
taatgatgtgccagtgaatgttcgtctgttgtgaacatgtactgatttggtgctggatgttgatagtagggtaaactaggcctctaggaggggtagggagatatgtgaaatgtctgtaccttctgctcagttttgctgtgaacctaaaattgctagaaaaattaagtctattaattaattaattaatttgagacagtcttgttctgttgcctaggctggagtgcaatggcacaatctcggctcactgcaacctccacctcccaggttcaagagcttcttctgcctcagtgtcccaagtagytgggactacaggcacctgccaccacacccggctaagttttatatttttagtagagatggagtttcaccatgttggccaggctggtctcaaacttctgacctcatgtgattcacccacctcgacctcccaaactgttgtgattacaggtgtaagctgtgccgcccagcctaagtctatcacttaaaaaaaaagaatcatgaaaaattattgggaagctgaaataatgaaattatgttaagaagctgatttttgccaggatttttttaattaattcccctaacaactttaaatgtattgtta

SEQ ID NO: 196429 - DNA, 601 bp, Human
tgattacaggtgtaagctgtgccgcccagcctaagtctatcacttaaaaaaaaagaatcatgaaaaattattgggaagctgaaataatgaaattatgttaagaagctgatttttgccaggatttttttaattaattcccctaacaactttaaatgtattgttaaatatatttagaaattagaaaattgagttatagaagtaactaatttatcaataatttatccaatcagtatttactgggcacctactatatgctaggcattgtattaggcatggaagatattataatgagttcatatamatgttatattttaggagagtgagacaaaaacccaatagtaagccaacaagtaaaacaattgaaaatgacttaagtactgtgagaaaataaataatgagatagataataacagagaagattctctttagatagaaccaaaggaaagattttatatttaacttgagccttaaaggaagcaaaagagctcaccatttgaagagcattatagacagataaaacaacaggtaaagggctttgagatggaaaatagctttgtatttttgaatctgggagaaaacaggatatctagaccttaaggaa

SEQ ID NO: 196430 - DNA, 601 bp, Human
aaagtgctgggattacaggtgcaagccatggtgcctggccttcttcatctatattttaaagtaaactactactttttaaactataattaaatatagtagttgtaattttcatggttgttgggacaaaatgtgattatatatataaaaagtccacactccagttctttgcacatagtaggcaattagtcagcaatttttttcattaattttatccatagatcccatggaaacagcataccagatattgattaaatgatataattcaaattgaggtattataatcatggtgaaattagatgtyggatatgatgtattatatagcatatattacatatcacatattattggttatatataataagatttatggcataagatataagatataccatatttttgttatatagtcatggtgggattacaatagttaagttttttttgtaaagcactactatttcatataaaacctgaattttcttttaatattctagacttcattaattataattagaagaaaataaagttgactgttgtcctaaattaatgagaaaatttctgtcttctaagaaaagcaataattctgatgatgagtttcatgatt

SEQ ID NO: 196431 - DNA, 601 bp, Human
tgggattacaggtgcaagccatggtgcctggccttcttcatctatattttaaagtaaactactactttttaaactataattaaatatagtagttgtaattttcatggttgttgggacaaaatgtgattatatatataaaaagtccacactccagttctttgcacatagtaggcaattagtcagcaatttttttcattaattttatccatagatcccatggaaacagcataccagatattgattaaatgatataattcaaattgaggtattataatcatggtgaaattagatgtcggatatkatgtattatatagcatatattacatatcacatattattggttatatataataagatttatggcataagatataagatataccatatttttgttatatagtcatggtgggattacaatagttaagttttttttgtaaagcactactatttcatataaaacctgaattttcttttaatattctagacttcattaattataattagaagaaaataaagttgactgttgtcctaaattaatgagaaaatttctgtcttctaagaaaagcaataattctgatgatgagtttcatgattaactgtt

SEQ ID NO: 196432 - DNA, 601 bp, Human
tgattaaatgatataattcaaattgaggtattataatcatggtgaaattagatgtcggatatgatgtattatatagcatatattacatatcacatattattggttatatataataagatttatggcataagatataagatataccatatttttgttatatagtcatggtgggattacaatagttaagttttttttgtaaagcactactatttcatataaaacctgaattttcttttaatattctagacttcattaattataattagaagaaaataaagttgactgttgtcctaaattaatragaaaatttctgtcttctaagaaaagcaataattctgatgatgagtttcatgattaactgttacctcttttcttctttttcaatgttttcaggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcatg

SEQ ID NO: 196433 - DNA, 601 bp, Human
aaatgatataattcaaattgaggtattataatcatggtgaaattagatgtcggatatgatgtattatatagcatatattacatatcacatattattggttatatataataagatttatggcataagatataagatataccatatttttgttatatagtcatggtgggattacaatagttaagttttttttgtaaagcactactatttcatataaaacctgaattttcttttaatattctagacttcattaattataattagaagaaaataaagttgactgttgtcctaaattaatgagaaratttctgtcttctaagaaaagcaataattctgatgatgagtttcatgattaactgttacctcttttcttctttttcaatgttttcaggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcatgtaagt

SEQ ID NO: 196434 - DNA, 601 bp, Human
tgtgggtagacatgctaacatccctagctaattatttattattattattattattttagatatgtggtcttgctatgttgctcatgctagtctcaaacttttggactccagggatcctcctgccttagcctctggagtaactgggattatcgacatgagccactgtgcctggcttcaaatacacttgaaaaaataaattttgtggaaactcatagtttgatacattttaaaatgttaataatatatgtcctactacagaaaaaatatggaagcaaacaatctattttgtttttcctttatrtactaataatctactctttcagtcctagcagattttccattgggctgatcatcttttgagtttttatgatgattggtgattgatgacttgaaattttttggttagctataaaaagttgataacttttgaaagttatcaaactgatttgaatctaaattaggatgctattttatcatatcagtttgctgcattcataatcttctgtaggggcaggttgaaaataaatctcagatctgtcccatctttagtttttcaccgcccatgtagctcatacgtttgccattttattatgtctctatt

SEQ ID NO: 196435 - DNA, 601 bp, Human
aaatgttaataatatatgtcctactacagaaaaaatatggaagcaaacaatctattttgtttttcctttatgtactaataatctactctttcagtcctagcagattttccattgggctgatcatcttttgagtttttatgatgattggtgattgatgacttgaaattttttggttagctataaaaagttgataacttttgaaagttatcaaactgatttgaatctaaattaggatgctattttatcatatcagtttgctgcattcataatcttctgtaggggcaggttgaaaataaatctcagatctgtcccatctttagtttttcaccgcccatgtagctcatacgtttgccattttattatgtctctattatatacttcctgcctttaatatcatctccaggaatgcatatatacattttagtcagattttcatttaatcagcaatgttatctcaaagctttctcactgaaatcattgcagagatactgaaagattacagtatataatttcaagtactcatgttggcctttaatttctttttcatagtcccctgacacctgatggtttgcacagtcctcagttctttcctcttgtcaac

SEQ ID NO: 196436 - DNA, 601 bp, Human
tagtcccctgacacctgatggtttgcacagtcctcagttctttcctcttgtcaactgtttaatgtccatccccagagttctctgctggggctgtactccaaaaagctttttgtgccattttattcttctgaaaagcctactttcttcgacacctataaaactactacctctggcacttaatcatagacattccttattacttgaaattctttgtcctttcatctttcacacagactaatcccagctggaggcaaaatttcagaatatccttaagccagtgttctgctggtgaatctctgayctactgtcataatgctgataaaatgtgtgagggaatactgagtactcacattcaacagatctacagttacttcttaactgtgcaaatttgggcaccgtgtgtctaacttttctctttctcttactctcctgtgtagctttgggaaagtttcttactctgtcttgagtgacttatatcatttatacaatgggaataatgatactcacttcattgaatgaagatgtggattggccgggcgcggtggctcacgcctgtaatcccagcactttgggaggccgaggcgggtggatcatgaggtca

SEQ ID NO: 196437 - DNA, 601 bp, Human
cttaactgtgcaaatttgggcaccgtgtgtctaacttttctctttctcttactctcctgtgtagctttgggaaagtttcttactctgtcttgagtgacttatatcatttatacaatgggaataatgatactcacttcattgaatgaagatgtggattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgyggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagatgtggattaaatgttaatatctgagaatagagcaggactatagccttctttaacttagttaaatacatcagtgagacagcagagtttgggtatatttggaggagacacaacagaaggaaaaacgtaatgacag

SEQ ID NO: 196438 - DNA, 601 bp, Human
tcaaatatttgtttttcagggaacttaaaaaggctccaggtattatcacaaaaatggaaacactaaatcaaaagcagtttattctaaatgggaattgacttgcacagccatagctttaaattttgacagcacattgtttaattttgcatcctagttgaggaactctagtacttcttgtgaaaataaacaaaaaggctaggcgtcgtgactcacacctgtaatcccagcactttgggtggccaaggtgggcagatcacctgaggttaggagttcaagaccagcctggccaacatggtgaaamcccgtctctactaaaaatacaaaaaagttagctgggcgtgctggtgcactcccgtaatcccagctacttgggaggctgaggcacaagaatcacttgaacttgggaggcagaggttgcagtgagctgagatcacgccactaaactccagcctgggcaacacagtgagaccccgtctcaaaaaaaaagaaaaaaaaaaaagaaagaaatacaaataataaaaaaaaattacaaccaacaacaacaaataaaaactgttggggagtagaaacactattattattgtatttttaaaatgttggc

SEQ ID NO: 196439 - DNA, 601 bp, Human
aggtattatcacaaaaatggaaacactaaatcaaaagcagtttattctaaatgggaattgacttgcacagccatagctttaaattttgacagcacattgtttaattttgcatcctagttgaggaactctagtacttcttgtgaaaataaacaaaaaggctaggcgtcgtgactcacacctgtaatcccagcactttgggtggccaaggtgggcagatcacctgaggttaggagttcaagaccagcctggccaacatggtgaaaccccgtctctactaaaaatacaaaaaagttagctgggygtgctggtgcactcccgtaatcccagctacttgggaggctgaggcacaagaatcacttgaacttgggaggcagaggttgcagtgagctgagatcacgccactaaactccagcctgggcaacacagtgagaccccgtctcaaaaaaaaagaaaaaaaaaaaagaaagaaatacaaataataaaaaaaaattacaaccaacaacaacaaataaaaactgttggggagtagaaacactattattattgtatttttaaaatgttggcaaaaacaactaaaatcacaagtataaatttataattt

SEQ ID NO: 196440 - DNA, 601 bp, Human
accagcctggccaacatggtgaaaccccgtctctactaaaaatacaaaaaagttagctgggcgtgctggtgcactcccgtaatcccagctacttgggaggctgaggcacaagaatcacttgaacttgggaggcagaggttgcagtgagctgagatcacgccactaaactccagcctgggcaacacagtgagaccccgtctcaaaaaaaaagaaaaaaaaaaaagaaagaaatacaaataataaaaaaaaattacaaccaacaacaacaaataaaaactgttggggagtagaaacactattrttattgtatttttaaaatgttggcaaaaacaactaaaatcacaagtataaatttataatttcctatgaccccaaagtgacaactattaacatatttgttaactttgcttcaagtgtctcttttaatgtaaaagttataaaatattacagataatgttgaagtgccttcctcaccataattgtcttgatttagtattttccacatcagtcataaaatataaaactacattttcctcatccctctccaggtgtaaccaaaattgttcaatagtaccatgtaacaggattatatcatttttat

SEQ ID NO: 196441 - DNA, 601 bp, Human
cttaagtgaaagcctgaattccttttacgccctttctgaagcagtacctccccccaacacaccaaattctgctacaacatgtatgccagtaattttctcttctttgtaaaaaagcaacttgaaaagcaagtaatttttacttttaaggagacattctgtgattataatctcagacgatagagacattaggaattatgaaaagtatataacattttttaaaagggctaatatagttatttttaaactttttttctcaacgtgaatttaaacagtgagctgttgaagatataaacaaactggwttcagtgacaaggatattttgaaatttaatccagaaacatggtctatcacagatcagtgtaattctgatttatgctatactagattatgattcattagaaattatcccaggatagagcctcaacaaccatttattgaatatatattctgagaaacacacagtaaccacagcagtaataatagttctcaaatataaatgactatattttattaaaaaaggtatgttaagtgtttaatttttctttcagtactaatataataaagaatgtcttctcatgcagttccaaaattaatattatgt

SEQ ID NO: 196442 - DNA, 601 bp, Human
aatttgcttttaccaacatttagatttaaaatattctcattttactttgtggctttcaatacatacatcattaaggtcctttcctagttagaatataagctgtgggagggcagtaactatatctctaggacttagcatgatgcttaatacacagtagaaaatgagtgtttgttgaatgcataaatcctgtttttccatccaggccagtttgtccaattcaatgtataaaactacttataatcaggaatatgccacaaatggattttcccaagcattatattttattgatgtacatgttttrtttcctctgtgtaggtgtcaatgtcttgtttgaggcaggaatgatttgattttcttggtatctttcatagcacttgccacaatgctttacacgtagtcaagatggtcaataaatatctaccaaataaatgggtagatataaattatccacctaccctttttttctttccacactaaaggagtgcaattaactttacattgtacgtgtgattacttgaaaccatagctataatattatcacactttccttcagaaaaaaaaattgggtaaagttggtaaacttattaacagagttttgaag

SEQ ID NO: 196443 - DNA, 601 bp, Human
tgtgtaggtgtcaatgtcttgtttgaggcaggaatgatttgattttcttggtatctttcatagcacttgccacaatgctttacacgtagtcaagatggtcaataaatatctaccaaataaatgggtagatataaattatccacctaccctttttttctttccacactaaaggagtgcaattaactttacattgtacgtgtgattacttgaaaccatagctataatattatcacactttccttcagaaaaaaaaattgggtaaagttggtaaacttattaacagagttttgaagtagagcamtatgtcatagctatcgaataatagataaaggcattctgaaacacataatatttaaaacatagactcataaaaagtcattttcaagtatttcttaagcagatactgtcagatatattggacgatgagataatttgagagcacgtgttctgaaaaacagggtaagacacttggacaaagaagttttatctttaaatcctgcaaaataaacatacacaaaaatcagaatttttaccaattatattggcgtacttcaaatgagatttgattacctatatacactatcaaaaatagcatttttgt

SEQ ID NO: 196444 - DNA, 601 bp, Human
tgtaaatgtaccacattttctttatccaatccattgttgatgagcacctgggttgattccttgtctttgctattgtgaatagttctgtgatgaacatacaggtgaatgtatctctttggtagaacaatttattttcctttgggtgtaaatccaaaggatttggtgagtcaaatgatagttcaactcagttctttgagaaatctctaaaatgctcttcacagcagctggactaactgacattcccaccaacagtttataagtgttcctttttcttcacagccttgccaatatcagttatttyttgttgttgttgactttttaacaatggccactctgactgatgtgagatggtatctcaatgtggttttcataataattgtatacttcacattgcaatcacccaggaatataaaattcgtgtctatccaatttcttattcatggtttgacctagaaatgtggccaacattaacccagtaaccatttactgtattagtccattctcacagtgctataaagaactgtttgagactgggtgatttatgaagaaaagaagtttaatcgactcacagttccacatggctggggaggcatcaggagac

SEQ ID NO: 196445 - DNA, 601 bp, Human
gattagatttgggtggggacacagccaaaccatattaccatcagttttattctttcacctctttgtaggttcaaatgagcactcatcaataattcccccttcccatcccctctgaatagcatgtactcacctcacattgtatctcatctttttcatcttattccctattatcatttacttactccataattcctcacataaattatgtttgttttctacacaaatattaaatagattaagtaattttatgtctgttttcaatgagaatttaaatcctttgaaagtcagaattttaaattayaggttgataataagctgatttatgagccgagctttatgaactgagaaaaacattgaacatatttaaagcagggttcactccttagcagagctgcaaatgacagtgataccatagtgaagatttcttgattctggttctgaatcttagttatataggtccccaatgcttattatgcatttatttaggaagtattgaggtagttaaacacaagtgatttttaaactggacattaattttttttaaattatacattaagttctagggtacatgtgcacaacgtgcaggtttgttatacatgta

SEQ ID NO: 196446 - DNA, 601 bp, Human
tggtttgtagttctccttgaagaggtccttcacgttccttgtaagttggattcctcagtattttattctcttagaagcaattgtgaatgggagttcactcatgatttggctctctgtttgtctgttattggtgtataagaatgcttgtgatttttgcacattgattttgtatcctgagactttgctgaagttgcttaacagcttaaggaaattttgggctgagatgatggggttttctagatatacaatcatgtcactgcaaacagggacaatttgatttccttttttcctaattgaatayctttatttctttctcctgcctgattgccctggccagaacttccaacactatgttgaataggagtggtgagagagggcatccctgccttgtgtaaactggacattaatttttaatctgagtgtaacaaggatgagtgtttcccattcctcttaatccttgttgataggtgcaattagaagccaatttacaaatcggtggacaagaaaccaaggacaaaacctcaataagagatctcttgtcctttatcttgggggtatttctttttaagtactatcgctagtcatttagaatcggagcatc

SEQ ID NO: 196447 - DNA, 601 bp, Human
agtcctgttttcttctagaattacatatatattgtgtgtttatgtgtttgtgtgtgtgtgtgtgtgtgtgtaaagatctctcatcttgggatcaacattacaaataaaaacttaatttgagttcacataaaatcagaagcctgtatttaggaagtcaaaatttaagaagaaaacatgtttaggtgagcctgttaattatgtaaatagtaaaattagtttgaaacacgaaattgtcatttttgtaggctaaaatgaagtgttacacatttcatataacctaacctgtacatttttcctcctyataatgtctttaaaatgtttgcagaagcttttcttaccttaggacctaaatatacaacattaaagattaatctaaaaaagaatctggatccttttttataaataataattgtgatagattcctttctggtatttcacaagttttcttaagaacccagatctaattagaaatgaaaacaagtctaaatgattaaaatatggtttccttagaaaacaaaaacaaacacacacacacacacacacacacacacacacacaaaacctcatccctgcagcaccattcagggcccacttattctga

SEQ ID NO: 196448 - DNA, 601 bp, Human
tgtgtttgtgtgtgtgtgtgtgtgtgtgtaaagatctctcatcttgggatcaacattacaaataaaaacttaatttgagttcacataaaatcagaagcctgtatttaggaagtcaaaatttaagaagaaaacatgtttaggtgagcctgttaattatgtaaatagtaaaattagtttgaaacacgaaattgtcatttttgtaggctaaaatgaagtgttacacatttcatataacctaacctgtacatttttcctccttataatgtctttaaaatgtttgcagaagcttttcttaccttargacctaaatatacaacattaaagattaatctaaaaaagaatctggatccttttttataaataataattgtgatagattcctttctggtatttcacaagttttcttaagaacccagatctaattagaaatgaaaacaagtctaaatgattaaaatatggtttccttagaaaacaaaaacaaacacacacacacacacacacacacacacacacacaaaacctcatccctgcagcaccattcagggcccacttattctgaaagtgccagaggcctgtcaccattgttggaagcttagcaaag

SEQ ID NO: 196449 - DNA, 601 bp, Human
cttatcaatgcacagtgagatttaatgtgcactactcattatcctggtgagaccctttgttaaaatagtcaatttctatgctgtttgtaaggttgtgcagttgtaattcctggatgactgccagaaatagccttagtaacaaaacacccagcatccttctgttctcaaatcaatcagtcattgtgtaaagaactttttgatttataatgaatcttgtggccagtatttttaggttatttcactacactaagtcaacagtatgttacttctaggtatgttattataaatggactcattcccmtacatctctatacataagcttcttatgttatggtttgtcataacaggtgaagttgaatttgttaattaaaagagtatgtaatatgcatacaaataataatactagcattctgatatgcttttgtattccctctatacaaattatgggccacttaagaaacaaatgagcttcatagttttcctaaagtaattggtgcaatgttacaactaaacacagacgaacacacacacacatatatatatgtttatgtttatgtttttatacttcacatatatatgtagagtatatatgcatatagat

SEQ ID NO: 196450 - DNA, 601 bp, Human
tatgcatacaaataataatactagcattctgatatgcttttgtattccctctatacaaattatgggccacttaagaaacaaatgagcttcatagttttcctaaagtaattggtgcaatgttacaactaaacacagacgaacacacacacacatatatatatgtttatgtttatgtttttatacttcacatatatatgtagagtatatatgcatatagatgtttatgaatacatacagttggccagttggccctctttatccttgggttccagattcaatcaactagggatcgaaaataccrgggctagggaaggatagttgtgtctgtactgaacatgcagactattttttgcttttcattccctaagcaatgcagtataacaactatttacatagcatttacattgacttaattattataagcaatctagagatgatttaaagtatacaggaggatgtgcataggttatatgcaaatactatatacttcatataaaggatttgagcaccgatgaattttggtattcgacaggggccctgaaacccatttcccctggatatcaacagatgactatacaaatatgacatttatgtgtgtata

SEQ ID NO: 196451 - DNA, 601 bp, Human
atgaaagcacacacttcatagtaatgattaaatgacctaaaatgtatgaagtgcttagaatcgtgccaggtatattatattatattatattatattatattatattatattatattatattatattaatgtactgaataaatgttagctgtcatttgtatttttttcttgatggaaataatagcaaaatttctgatataaatgaaaacataaactcaggcatctcacttcctcaaccatttacccaatttcccatggaaattatcaatagagtaaacaaataagtaaaagtttgcattctyaatggaatctagggatggagccttcaaagtgtcaagtttttttttctatttagtctagtgcatataaaattagagtgaaggaagaatagaaggttggtaactgatccccttcataaaatatcagtgtgtctgagaattacatgggaggccatgagaaattgccatttgtattcccagtagtgttttgttttaaacattaaaagattctgtgttaatctaaacacaatatacctcacaaatttattactattagatattttaaacaattttgagactctctggtctgtttaactctctctg

SEQ ID NO: 196452 - DNA, 601 bp, Human
tttgttttaaacattaaaagattctgtgttaatctaaacacaatatacctcacaaatttattactattagatattttaaacaattttgagactctctggtctgtttaactctctctgtatttttatttccagaacacattgagctctgttgactttctgacttatcacgctttctcttacaagtcattcgttatcgtctctgaattctcagtgtcctccattatgagtaatctcccttcattcctaatctttcttcattatttgctatcttgtttcacttctcttctattcaaactgctcrttccgtagctctgccagtgctggctgctctgtctctcacactccacttattttaagagtctggttcagattcttttgactacctggatcaagcagtatgtactgattattttactgttataaactcaaaaatcttagtagtttatacctacagagattgtttctcattaacactgcttataaagcataggtcagctgaaggctctgttccatattttctcactcaaggactcaggctgatggagccactaccacgtggtgtgcttttacttctgggaagcgaaatgagagaacatggtga

SEQ ID NO: 196453 - DNA, 601 bp, Human
gagagaatgagagccaagtgaaaggggaaaccccttataaaatcttcagatctcatgagacttattcattactatgagaacagtatgggggaaaccactcccatgattcaattatcttccactgggtccctcccacaacacctgtatattaagggagctacaattaaaaagagatttgggtggggacacagccaaaccatatcaacatttattccatggaaatattataataattctagtatagagaaatattaatatttatgaagcatacaattgagagtgcacaacaaaatcagatttkggtggggaataaaacaaaactaaactaaaacaattaatatcctcccccaaaactctagaaacattttagacccatagttattctgaagacatcagttaagtttatttttcattgtcattaatggcaagtttgataagtttactcaatattatttgaaattattagcaggcttatttcaccattagcaagaaggaggtgctgaagcagcagctaaatctattactttttttttttaaatgatttcctattcatgccctacaagtgtgagggaaatctctgaattttataactcaattgccc

SEQ ID NO: 196454 - DNA, 601 bp, Human
aaaccatatcaacatttattccatggaaatattataataattctagtatagagaaatattaatatttatgaagcatacaattgagagtgcacaacaaaatcagatttgggtggggaataaaacaaaactaaactaaaacaattaatatcctcccccaaaactctagaaacattttagacccatagttattctgaagacatcagttaagtttatttttcattgtcattaatggcaagtttgataagtttactcaatattatttgaaattattagcaggcttatttcaccattagcaagaagsaggtgctgaagcagcagctaaatctattactttttttttttaaatgatttcctattcatgccctacaagtgtgagggaaatctctgaattttataactcaattgcccactttactttctttctgttgggcactgtgtggtaactacttggtttggtgaaaatgaactaaattaatatttctaaaacataagtttatgtttttgtaaactgcaaatacatattagattttgtatagtatgggaaatatacaatttaaacaagtttaatttttttatattttaaacttacgtagctttaatc

SEQ ID NO: 196455 - DNA, 601 bp, Human
aatgagtgttcaggaaagacccctttgagtaattgtcaggcaaatgtgataaccactatgctctggaaaccccattgcgaaagtgacatcaaagcaagcacatgaatgaaatgaaagaataagccatttgtgtgtataaagggacgagctttccagggagagggaatagcaagcgtaaggcctggaaaaaggaatgtgtacactcacttgaggattagcaaggcagacagagttgttgaaacaacagtgagaaagaccagaagaatgatggaactaatgttgataaagccatatcttgcartgctttgtaggcaaacatgttctataagtcattggaggatactgagcagaaagtggtaatctggtatgtgttttagaaagaaccttctggagttaggatagaaaagagattctagttgggcaagaatgaaaataggggaccagttggagtccattgtaagagttcaggcaatgtgactaggttggtagtggcagagatggtgtgccatgtgtacagaagttgagttgtgttttctttcaagtgtacacagagacaaattatttgttcacattatgcattgtggagagtttaggaatgcgt

SEQ ID NO: 196456 - DNA, 601 bp, Human
attgtacaaataaattttatttctagagtaagactagaaaaaagtttcaattaaaaattctctgagtggttttctttgaaaattttagtaagttaaattgaaactgtattcagcaaacatttactaagcagttccttggtgtcaaattttatcctatgccttagggatgttaggttcattatgatcacaaagatgaataagacaatttggaagagtttcacatagaatggtggaatattaaattagtgcttattaagttaataagatagctgctgtgtaggtgtctttgttagatttccasggagggaaactttaccattccctcagtttagagttacatgctttgatcgaagggtatgcctgccggctttcaagtgtttttactctcacaggaactgagacaatacagttacaataatatgtgcattcaaatttctcatatcttattggttgacttatatgtgaaataaccagaaataacacaacataaattattgctacatgttaaattacatgattctgtttataaattatatacaaattcactgaagagaaattaatgtggatagagtattcaggaggaaaagaaccagagatgtgt

SEQ ID NO: 196457 - DNA, 601 bp, Human
aacacaacataaattattgctacatgttaaattacatgattctgtttataaattatatacaaattcactgaagagaaattaatgtggatagagtattcaggaggaaaagaaccagagatgtgtcttatagaattcgaatactagagaaaaaagaatatcattttgggcagggaaataacaaagccagtaaaacaacagaaatggatatgatatatttgaatggttgtacagaaaaatagtgggaaatgagcattgttaagtcatctttggagccatactttccttaagatctcaggtttcrggttagctattctggttttgtttttcatttgtaaaaaggaaatcacactacaaattttgtagggttgtagtgagtatcaatagaggtgaaaatcttccaaataatatagcacatttttccctcataatagacacattaatgctagctattactatgatattcatttttctttccccttccaccttcccagtccagggctgcaaacacagcaaagttgttttaacacaatatatctactaactgaggatatggtaaaaacaacatattgttatttaaaaatatataatttattttttagtg

SEQ ID NO: 196458 - DNA, 601 bp, Human
tttgaggtttacagatgaattgtgcagaaagtagactttcctggaccccctccctttccatttccatacacattttcccctattattaacaacttccattagtgtagtacatttgttacagttgatgatttattattgatacatttatgattaaagtccatagtttacattagagttctctctttgtgttgtacaattttaatgagttttgataaatgcataatgtgtatccaccattatagcatcctacacaatggtttcaccaccctaaaatccttctgtgctccacatattcagcactatctcaattcttttgaatccttggcaaccactgatcttttactgtctctataattttgccttttcctggatgtcatataattggaatcataaagtacatggccttttcagaggctctgaacttgaccctctaaattctctggtgtctttcacttagcaatatgcatacaagtttcccccatgctttttcatggcttgaaagctcatttatttttataaatgaataatactattccattgtatggatgtaatacagtctgtttgtatattaaacttttaatgaaatgtctgaatgtgtcta

SEQ ID NO: 196459 - DNA, 601 bp, Human
aatagatctcttgaacctatttctcctatccaactgaagttttatttcctttgaccagcatcttgacaacctttcccgctacccctataatcagcccatcccctagtaaccaccattcttctttctacctttttttttttttttttttttttggagacagagtctccctctgttgcctggctggagtgcagtgttgcgatctcggctcactgcaacctccacctcctgggttcaagtgattcccctgcttcagcctcccgagtagctgggactacaggcgtgtgccaccacacctgggtatttttttttttgtattttagtagagatggagtttcaccatgttggccaggatggtctcgatctcctgacctcatgatcagctcacctcagcctcccaaagtgttgggattacaggtgtgagccagcgtgcctggcctcttctctctacttctatgaaattaattttttaatattctatataagaagagagtggatgtagtattttcaccataaaaatgataactatgtgaggtaatgcatatgttaattagctagactagtcatttcacaatgtatatgtacttcaaaacatcctgttgtg

SEQ ID NO: 196460 - DNA, 601 bp, Human
cctcatgatcagctcacctcagcctcccaaagtgttgggattacaggtgtgagccagcgtgcctggcctcttctctctacttctatgaaattaattttttaatattctatataagaagagagtggatgtagtattttcaccataaaaatgataactatgtgaggtaatgcatatgttaattagctagactagtcatttcacaatgtatatgtacttcaaaacatcctgttgtgtacgataaatacataaaattttatctgtcaattaaaaaataaaaagttaccactttatagcatattcrcttatatggtttgtatgtgacaaaattttgcttttcatgtgcctaagagaaaggaggttacagaatgaagtaacacatacataaattgtgctgtgtagtcaaccctccaaacacagacaaactactactttatgttcattttttacctgaagtctatatttcttaaaataccactgcattagtccattctcacactgctataaagaactacctgagactgggtaatttatgaagaaaagaggttcaattgacttacagttctgtaagctgtataggaagcatggctatggaagcctcagg

SEQ ID NO: 196461 - DNA, 601 bp, Human
tataaagaactacctgagactgggtaatttatgaagaaaagaggttcaattgacttacagttctgtaagctgtataggaagcatggctatggaagcctcaggaaacttacaatcctggcggaaggagaggggaagcaagcaccctcctcacgtggcagagcatgggagagggggaagggggaagggagaagtgctacacacttttaaacaaccaggtctcctgagaactctatcaggagacagcagtagaagactggtgctaaaccatcagaaaccacctccatgatgcaatcacctcccrccaagcccgaccttcaacacgtgcagattaaaattcaatgtgagatttgggtgaagacatagagccaaaccatatcaactactttatttctgttaacaaagttgttcactttttcaaacaatttttagtttctcccttacgtcttagaggaagtgctgtttccttcctgcagaaaatactccctctgtctgcactctacacctgaacctctagattctgaaagactgtaatctatcaatcactagagttgtttctatatatttccctttccatctgtacaaattattgaatgaatgaatg

SEQ ID NO: 196462 - DNA, 601 bp, Human
atttctgaagaaccaaaactaaaataacatgttttactaacttgagttaataattcagttataagaaaaaccaaagtactaaaatttaaaaggaggccttttttaaggaaccaagacatttataataaacattctaactataaaaggactaccttagtattctacataatatttgtggtttttttcttgttttttcacagaataaatgtcattaccaaaagtactttattgtcattgacatgtagggtatgtttcaagtcataggatcagaagataaaatgccaagctggcaaggtggctsatgcctataatccaaacactttgggagcccaagataggaggattgccttgaggtcaggggtttgagaccagcctggtcaacatagggagactctatctctataaataataaaaattaagaaaaaatgcctaaatgaaaaatatataaattttatattttaatagtggcctttaaaatctgtgatacagatcaatctatgttgatggtattactttattttactctcggaggtgtaaatttataatcatgtttatttatgcctacctcactatcaaactttcaactgatagattgtgtcaa

SEQ ID NO: 196463 - DNA, 601 bp, Human
ctttattttactctcggaggtgtaaatttataatcatgtttatttatgcctacctcactatcaaactttcaactgatagattgtgtcaatatgatttaatttaacttttgctttaattaagaagattagtattgtgcctcaggactgatgactctattgacatggagttaagccacatattcattatattctttgaatttttacgtttttttaaatatcaaaaagataactctgaattaaaaatcaattagaattctacacataatttttcatggagataaaaatacctataaagtgtacatatatatatatatatgttttgtgctgtataaacaaaattaaatatgcagtgccttttcaattacattacatggattcttttgataaatttatcagtaagggtatttgtaaataatcgaactcatttttcaataaggaattaaactttttttttttccaatgaagtaatgtattttttttctagccataaaaatctttagttcattcagttaaaaattgatttaaatcaattagaagtagcataatattggccgggtgtggttgctcacgcctgtaatcccagcactttgggaggccaagg

SEQ ID NO: 196464 - DNA, 601 bp, Human
acttagcaattttcctaaaatttactgaaaatttagttttaaatacgtgctgttctgctaatatgcctgtcacatattaaagtgattgctaaaattgattaaatattgacaaatatttatctaaattatggacctaaaagtaaacattgatgaaaattagatatattttcaaactgtggattaaaatatttccatagtagatgaggctacttctgcactaaataatatttttaaaattattattttttgttacaatgtacctctttattttagtggttccagtgatgtttatggttgcaartatatgtggagtcaccaacccagaaaaaattcttagtttgtatctttagtagaaccaaaccaattgaaactaagttgaatcaatgacttcttttcagttgtgataaatatggtattgaggtaattgaggcaacagagctcttgactgaaagtatccatgtaggacaaagaagataatttaatcttcagaggagaaatcaaacatattttccacctctcaatttttaaattatgccagacatttacaggtgtaaaagatttgagaaaaaattgagtaagacaaaggcaatttaaaattaat

SEQ ID NO: 196465 - DNA, 601 bp, Human
attacttttaacatttcgctttctcatgggcttctgactacacctgagatgataaaatgagatgaacgcatttgcagtaaattttcctattaaatggataaacttaatatttgaagcaaaggtgaaattgtaggttttgaatgttactggcatgataaagttataaacagaatagggctacaactgtcatctaagttggttcagaatatgcacctgaatattattttaacataataaaattaggtaagtgtttccctgcttcccttactattcttggtaatggggggtgctgggaggtgtrtttcagtataagttcagcaattcactagactgaagatatgttttggaaactggtaataatctagtgattttacaaaataagaaacattaaaaatagagaaaattttgcttgtaaatggacatacaaaaataagattcatacttagagaaatgtgtatttattttaaaatgttgatattactacttcaattttcaattagagcttcaatatttaggaagatattaaaaataatgttttaaatcatccacctaagaatttaaacatatttattttggagccaggcgctgtggctcacgcttg

SEQ ID NO: 196466 - DNA, 601 bp, Human
taacatttcgctttctcatgggcttctgactacacctgagatgataaaatgagatgaacgcatttgcagtaaattttcctattaaatggataaacttaatatttgaagcaaaggtgaaattgtaggttttgaatgttactggcatgataaagttataaacagaatagggctacaactgtcatctaagttggttcagaatatgcacctgaatattattttaacataataaaattaggtaagtgtttccctgcttcccttactattcttggtaatggggggtgctgggaggtgtatttcagtrtaagttcagcaattcactagactgaagatatgttttggaaactggtaataatctagtgattttacaaaataagaaacattaaaaatagagaaaattttgcttgtaaatggacatacaaaaataagattcatacttagagaaatgtgtatttattttaaaatgttgatattactacttcaattttcaattagagcttcaatatttaggaagatattaaaaataatgttttaaatcatccacctaagaatttaaacatatttattttggagccaggcgctgtggctcacgcttgtaatccca

SEQ ID NO: 196467 - DNA, 601 bp, Human
gctatattggtaagaaataattttttacaagacaaacctatgtttttttatgtaatattatatgtgagccattttccttactattctcaatttaaagccactcttaatttgattggacaattgggtgttttagaaaaaaaatgtatattgatagccagtgaatggaactacatgatagccattgtatattaaaaaatagaatccagttttgaatgtctaattatagtttttattttactttgacatttgtaaaattgcctgaattcatggcaaacaatattatgacttttcttcagaaatyttattataaaatgatcaatagatgattataataatttgtaatcccataacaatctcataaaataataatctcataacaataaggaataatcttggctacattaaataaactaaaatacagtataccattataactttaagtaataagaataagtcataaggatctgtaatcagcttattgatgaagttaatttcctataacaaatataaattttaagtggaagttagaagtcataaattctaaagttgattattttattgtttttagttatccatttaagactaaatcatatttattttt

SEQ ID NO: 196468 - DNA, 601 bp, Human
ttgacatttgtaaaattgcctgaattcatggcaaacaatattatgacttttcttcagaaatcttattataaaatgatcaatagatgattataataatttgtaatcccataacaatctcataaaataataatctcataacaataaggaataatcttggctacattaaataaactaaaatacagtataccattataactttaagtaataagaataagtcataaggatctgtaatcagcttattgatgaagttaatttcctataacaaatataaattttaagtggaagttagaagtcataaatgctaaagttgattattttattgtttttagttatccatttaagactaaatcatatttatttttcattaagattatgtattttaaaaaattgaccacgatttaaatttgttatcactaacatattacaaatcagtagaactgatcattgttatcatttcactaagcctttcaaattcatttggatctactaaataatacatttaatagcatattattacaatgttaggtacaaaaatccttctacttcaccatgtacatctggtaactttctggtactaacactaccaattaaataatgtcga

SEQ ID NO: 196469 - DNA, 601 bp, Human
gaaatttttttaactacaacatattctttcctgcttataatttttaaccaaaagttcttaaaggaataaaactctttaagataatttagttgcaatattataaacatcaattatttttacctgaaatttcagtaatagcttcagggcctgtattagaagaaataggttccctcgcaggtaataggaaacttcaccatgttgtttgaattaataggggatgattgtgttcatagtctcaaattagacaaaattgaaacagcagctgaaaggtgttatcaaggaaactaacacctctatctayctgctacatcattcttagagacttttatcctcatagttacaagatatccattgaaaggccaggcattttatctgtatcccaggctgggaagaagggagaaaagagaaagagcaacctgcaaaagtcttcacctttttattcagaaaggagatgcttcctctctgtatatcttattaactagaattattttgcttagatcgccctagctgcaagagaggctgcagaaatggctttcttttatctgagcttactgccacttcagttcttttgttagaaaagtgatattattgggtatgttat

SEQ ID NO: 196470 - DNA, 601 bp, Human
tgcaataaagaaatctgattaggtttgttgaactagcattgccccaacacttagccatggggccttttttttttctctgttaatctattatctctaattttatgttctctattagttaactttctgaatcaaagatgtgaagcattgctttaacatataagttcacttcaatttttttatcttcatcgtacacattctaaattgattaaatcacttgtaacaagactaagaatctagtctcctgattcctaatggaattatcagtgctcattttgctgatgtacatggaagcataagatcrtgtcacatctatttaagtgatagtttatgacttcatagaacttgtgtatagataacaatttgaagtttttaaaaaaattactgaaacaacatcattgcttcaatttttaatgtcttcttttaagaaagtacatacaataaatgtgtaaatttacatttagttataaaattaaagacatttaattttttaaaaaaatggctggtcttaggacaacctgttattatttattagtgaacttggtcagaaattcaagttttgttattaatcaaaaagataatcattggatacttaagaattttc

SEQ ID NO: 196471 - DNA, 601 bp, Human
tagttaactttctgaatcaaagatgtgaagcattgctttaacatataagttcacttcaatttttttatcttcatcgtacacattctaaattgattaaatcacttgtaacaagactaagaatctagtctcctgattcctaatggaattatcagtgctcattttgctgatgtacatggaagcataagatcgtgtcacatctatttaagtgatagtttatgacttcatagaacttgtgtatagataacaatttgaagtttttaaaaaaattactgaaacaacatcattgcttcaatttttaatrtcttcttttaagaaagtacatacaataaatgtgtaaatttacatttagttataaaattaaagacatttaattttttaaaaaaatggctggtcttaggacaacctgttattatttattagtgaacttggtcagaaattcaagttttgttattaatcaaaaagataatcattggatacttaagaattttctaaatgcataaaaatttatgaaatcattagaaagttgggaaaaatcctcacaacctagcaaacaaattcccctttttaatactgtcaaatcataatttggaagcaagcatat

SEQ ID NO: 196472 - DNA, 601 bp, Human
aagacatttaattttttaaaaaaatggctggtcttaggacaacctgttattatttattagtgaacttggtcagaaattcaagttttgttattaatcaaaaagataatcattggatacttaagaattttctaaatgcataaaaatttatgaaatcattagaaagttgggaaaaatcctcacaacctagcaaacaaattcccctttttaatactgtcaaatcataatttggaagcaagcatatgattaatgtaaagtccaattttgttagtattattaccttctgtggtaaaggagaaagtaygttagaaaacagttgataatttattttgtgtttattgcaagaatgaaattagttatctattctttataaatgatcagtactcaaggtggattaattatgtagattttaatttcatccacagttgtgaaactatacattttttacgattataatctttttgttggagtcttattagtctagcttatgacaaacaatgtacaagcagaactgaaagaaggtcattgtattttaaatctcatttacatgttagacaagaaatgacaattattaatgttctacttttggaatacaagtatatag

SEQ ID NO: 196473 - DNA, 601 bp, Human
agctagattgagattatataaattcatattccatcctaaacattaatgcacttgtttttttatttagtgatcttttcaccacctaaaatttattactactacatctatcaatcatctacctacctatttctattcatccatgcatcaatttatcaataagtattagcatataaatcagtgtgcaaaatttattttttaatgtctcgctcattcataatttctaatatgtatatatttggaataacctgccagtcactatacctactctttcagaaataaaaaatggaatttttatttattktttgattaaatggaatagtactacatggggaaatgatgactttatgaataaatattctggataataaaagtagtttttactagagcaactaaagaaaatatgctgtagtttaatacagcaactaaaaatagtttgattttcttaactcaaatattaaagtgcgtttagatattttattgtataataaatcatatacaaaatattgtttcaaaaattccactcattgagagaaattaatgattaatgttctacttcttttggaatacatgtaccatagtacaaaaagctagaaaataacta

SEQ ID NO: 196474 - DNA, 601 bp, Human
ctagtatttatggaactttttccttattatccttcatgcagcttagataatatatgaatgtttatatctaagctaacttgaaggaggaaagatttttgttgtagtcaatttacctattccttgattattatctttttagtacattacagataaatatatttacctataatgctatatttatataaaaattttaggacctataagttaatgttaccataaaaaagatccagggaagagaaagagagtaaatagatattagaacttacaagaaatagtaaataattatatagaataatgtagkctaatttattaaacttgctgtctttcaattaataaatttgcaaagtgtaatatgcttaacaaatgagtgcatacattcaagtaaaaatatttctatgaaaagacagataagataggaaggataaaaatggagatataatgttcatagaaagcacattcagacaaactaaggcaaatgaaatatcaatcatattgagaacatcataaaattcttttggaatgaaaaggtgtttttatgcccctcccttgttttatacataagataactgaggcactgagtggttgaaagacatactagaga

SEQ ID NO: 196475 - DNA, 601 bp, Human; identical to SEQ ID NO: 40615

SEQ ID NO: 196476 - DNA, 601 bp, Human; identical to SEQ ID NO: 40616

SEQ ID NO: 196477 - DNA, 601 bp, Human
aggttttgctttacaatattttgttcctgttttgaggaaaatcagcccaagggtaacattttttcccagtaagcttttctttttgaataaaacaaaatgtattttttgaaactgtaatagtaggatgttcagattctacaaaactttgctattccagaagaatagaataattactcggaaaaatgtttcccatacgtacatttacttttgttgaaatgaggcaagatttaagggctgaaaatacagagacagtccttattatctatacgttcaccaaggtaatagtctgggagacacagarttgaaaggggctgtcccattgaactcacagtggtttccagagagacagccctgtggaacatttaaatgaaagtgtgcttgtaaaaagtttctgtcatatagagtgccttgccctcgtctattttttctctcttctccttactcttgcctactcactgggccaaagtagaccagttgagggatttcactttaggtagctattaccactttataattccttttgtatcttaccaagtatttttacagtttttgtaggttgggcaaattttaaaacattgatattttctttctgtgttcacag

SEQ ID NO: 196478 - DNA, 601 bp, Human
gccctgtggaacatttaaatgaaagtgtgcttgtaaaaagtttctgtcatatagagtgccttgccctcgtctattttttctctcttctccttactcttgcctactcactgggccaaagtagaccagttgagggatttcactttaggtagctattaccactttataattccttttgtatcttaccaagtatttttacagtttttgtaggttgggcaaattttaaaacattgatattttctttctgtgttcacagaaacacaactggcagttcaaatgtacagtggaaatagtattttttttaaaaaaatgattaattcaagctataaaataaattatttcatgaagcattcatcaggtttctatcgagtgccagaagttacacgacacattgagtattctaattctcactatcgaggagattatggtttagttggagacagaataataaacttaaaacatcactgaatttggttttatgtgacttaagtcagtattttgtcaaattatgcaactttgtaaaaatttttataaaattaactttaaaataaatttctggaggacatccaattcccccaaaaataagataaattagatttagtca

SEQ ID NO: 196479 - DNA, 601 bp, Human
aatagtttaacataattattaaaggcatagaccaagttgtggcgtgaaatcctacattcctcaatcaatacagatttatttaatttctctgggtttctgcttttttgaatttatctcccatagataaatcgagagtatatgtcttatatattgttcgtattaccactgaacatgtactaaattcccaatatatatttgctattatccttattgtgaggagcttaaatgttgaattgttaaatttcggtagcagatgaaaccatttcccccaatatgaataccgtacttttgcaaatacagkttacctatggttaatgctacaatctgacactcagttgcattctcatttcattaataatttggtcctgattttagattattaataaacaaatattctggattactctctaatctcactgaaaagataaagtacatcaggaatctgtttccatgtacacattacagatagtcaatcttttaaaacggattttattattttagtgcagttccatggtcacagcaaaatcaacatcgtgggactttaaatatatcaattcacattcttcaagagtttttgtcagccttctctttcaaaaccaga

SEQ ID NO: 196480 - DNA, 601 bp, Human
aaaatagtggctaacctgtttccatctttatttattattattattttttctgcattgttagtaaccatgtaatagctgtcacgtctacctttctcactcatctttattctgggtgatgtttctttcctaatctcaggcctaatgtgttgcccctgctgtgtcctggaaatgaggttgcagtgatttacttttactagccattagagaaacactttagtattttgtcttatttcccttctttgaattccacaaacttcgaaagtatcaaaagtagtagtgtactctaaaactcttccaagarattttactatgtaaggctaaggaataaactagatttttattttcttatggcttctaataaaacatgtgtggttatagagcacatgtaatacatctagtgcactgaggagtaaaatatgaaatttcaattatttaatttttattaaattgaaattttaaaaccaaagcagtgcaagacatttttgcaataaacttaaacatatatttcattttaacctttgcctcatataagatgttgtattatagagcatgtgatttgtgcatgagttgtttccaacacatcagtgatgtactcagtggc

SEQ ID NO: 196481 - DNA, 601 bp, Human
ctaatatcacactgaacaaaagcaaactaaattgaatttcaaaagaaaaaaatattttttatctagaaagctgtaataattcattataataggaaattatcataataaaggtcaataaaagtgatttttcacatttttttaaagagtcaatatacagattttagttgctgtcagcagtattatagcaaacttgtagtctcaaaaactacatgtaaaatttaaaaactttgttttgagattgataaatttagagattttcagtttatacaattttcctttgacttcagtgttaataattctyagttgatgtaagcattagtaaattacttcacttggaaagataaacagacataacttttgaacaagaatatgtgctttgaagccaaattaattcttaaaaagttaagaaagatgaacaagttttaccaacatgttgtgtatattacaggaaaattgcttttagtacttagttcaattattggaaatttgtttgaaacaacttgggtatatggaactagtattttaactgatttttttttagctttttaggtttatgcaatcaatacaacttaagcgtcttaaatgaaaatttagtgtctga

SEQ ID NO: 196482 - DNA, 601 bp, Human
ttttgttgttgttgctggtaataaatcattttctaaaatctcttctccctctaagttatcaagataatactccttttcttgttttttggaccaatttttatagctttatgtttatctcaatctttggtgagaggaatttgattgggatttgtggttgaccagaggtcacttgaataaacctctctctctactaaaacttgaaagcaggcctacatgcaaactttgtagtccagttatcaatctcaggatccaaaattgttgttttgtgttttaacatggctctttgggcctgagatagaayggactcttaccctcaggaccttaaatctgatactctgaatgatgaagcagccccctttttagggcttctcttatcttccccacattttcatgacaaatgaagactattcccacctgcctctggaataggacagtcttccctgcccactacttgcttagttatttcctatcagttgtagcctctatttttttgtttttcatttttttctttatgtttttttattttgtctttattttttgtagcctctaaattagcacagaatacaagtactaacagtagtgggagccaggaaacacattc

SEQ ID NO: 196483 - DNA, 601 bp, Human
gccatagattttatttttaataaagtttaagcgtcattgtagttaaggacatttatttcagacttcagcaagaagttgtgtgtcagttccaatgttctgttgtgaatcgtcatttgttgtgtcttaccatattaatatattttactgtgatgttagtagagaaatcattgagtgcagtcatccaaacaccttttaaaactggaaatacataatctttaatgctttaaaatgtatttgcatatatgtgaaagtatcatctaaactgcaatcattataacccatgaagtgtgaagaaatcctrtattttctattttctttaacatgatggataaaaggtatttaagagagttgagaaactaacctttagtcctgtgtcaaatctgatagaattcatctttcaactatctgttaccactttctagacactgccaatagtaaaatcaattgttggagtaaatggaatggcttttggtataatgcacaaatgggtttaaattgaggattcaatatatgcgtgttttgtttaaatatttttgctttaagtgtaggttcatatgcagctgtaagaaataatacagagacattccatgtagactgatat

SEQ ID NO: 196484 - DNA, 601 bp, Human
tcctgcctcagcatcctgagtagctgggaccacaggtgcccgccaccacacccagctaattttttgtatttttagtagagacggggtttcaccgtgttagccaggatggtctggatctcctgacttcttgatctgcccatctcggcctcccaaagtgtcaccacaataatttttaaaactttttcaacattttgaaaataaaccatgtactcattaacaatcattccccatttacttaaaatgtccactctccaccatacctaataaaccactaatctgcttctgactataaaacttcttwgtctgaatatttaatgtaaacagtgatatagaataaatgctctttggctttaactgaactttcatctgtgtttcagtgtgtatcaaaattttattcttctttttgcagaataatattgtactacattgatataacaaattttatttatctgtttatcagaggatggacatttgaattgcttccactttttggatattataaataatactgctataaatattaatgtatgagttttggggtagatgtatattttaatttttcttgggtctataagcagaattcatgggtcaagtggtaaat

SEQ ID NO: 196485 - DNA, 601 bp, Human
atagtgaacattgtacacaataggtaattttcaatcctcactcccttcccaacctcctaccttttcatagctccggtgtctattattaccctgtctatgtccatgtgtacccattgttaattcctacttttaaatgagaatatgaggtatttgactttctgtttctgaattatttcacttaagatactgatctcctgctttatctatgttgttgcaaaagacatgatttcattcttttttatggctaagtagtattacatggggtgtatgtgtgtgtatatatgtgtgtatatatatatawaattttcttatatatatcaataaaaattatacatatctataagaattttatatataagaattatagatatatacatatatatatataattttctttatcgaatcatcagttgatggacacttaggtttattccacaactttactatggtgaatagtgctgtgacaaacatgtaagttcaggtgtctttttgatatagtgaattcttttcctttgggtatatacccagtagtgtgactgttggattaaataactgttctatttttagttctttgagtaacctctatactgttttccacaga

SEQ ID NO: 196486 - DNA, 601 bp, Human
gtgtctattattaccctgtctatgtccatgtgtacccattgttaattcctacttttaaatgagaatatgaggtatttgactttctgtttctgaattatttcacttaagatactgatctcctgctttatctatgttgttgcaaaagacatgatttcattcttttttatggctaagtagtattacatggggtgtatgtgtgtgtatatatgtgtgtatatatatataaaattttcttatatatatcaataaaaattatacatatctataagaattttatatataagaattatagatatatacatatatatatataattttctttatcgaatcatcagttgatggacacttaggtttattccacaactttactatggtgaatagtgctgtgacaaacatgtaagttcaggtgtctttttgatatagtgaattcttttcctttgggtatatacccagtagtgtgactgttggattaaataactgttctatttttagttctttgagtaacctctatactgttttccacagaagttatgctaatttgcattcccaccaacagtgtataagcattcacttttttctaaatgtgctacaacatgtgtta

SEQ ID NO: 196487 - DNA, 601 bp, Human
tatgttgttgcaaaagacatgatttcattcttttttatggctaagtagtattacatggggtgtatgtgtgtgtatatatgtgtgtatatatatataaaattttcttatatatatcaataaaaattatacatatctataagaattttatatataagaattatagatatatacatatatatatataattttctttatcgaatcatcagttgatggacacttaggtttattccacaactttactatggtgaatagtgctgtgacaaacatgtaagttcaggtgtctttttgatatagtgaattmttttcctttgggtatatacccagtagtgtgactgttggattaaataactgttctatttttagttctttgagtaacctctatactgttttccacagaagttatgctaatttgcattcccaccaacagtgtataagcattcacttttttctaaatgtgctacaacatgtgttaatatttgaggttttaataatagccattctgtctggtgtacgatggtatttcactgtggttttaatttgcatttctctgataatttgtgccgttgaacatttttgtcatgttttttggctgcttgtatgt

SEQ ID NO: 196488 - DNA, 601 bp, Human
atatataagaattatagatatatacatatatatatataattttctttatcgaatcatcagttgatggacacttaggtttattccacaactttactatggtgaatagtgctgtgacaaacatgtaagttcaggtgtctttttgatatagtgaattcttttcctttgggtatatacccagtagtgtgactgttggattaaataactgttctatttttagttctttgagtaacctctatactgttttccacagaagttatgctaatttgcattcccaccaacagtgtataagcattcacttttytctaaatgtgctacaacatgtgttaatatttgaggttttaataatagccattctgtctggtgtacgatggtatttcactgtggttttaatttgcatttctctgataatttgtgccgttgaacatttttgtcatgttttttggctgcttgtatgtcttattctgaaaaatctcttcaaatctttcacccactttttaatgggcttgtttttgtcttatagagttgtttgagttctttgtaaattctggatattagccctatgtcacacacatagttttcaaacattttcttccattctgta

SEQ ID NO: 196489 - DNA, 601 bp, Human
tatataagaattatagatatatacatatatatatataattttctttatcgaatcatcagttgatggacacttaggtttattccacaactttactatggtgaatagtgctgtgacaaacatgtaagttcaggtgtctttttgatatagtgaattcttttcctttgggtatatacccagtagtgtgactgttggattaaataactgttctatttttagttctttgagtaacctctatactgttttccacagaagttatgctaatttgcattcccaccaacagtgtataagcattcactttttkctaaatgtgctacaacatgtgttaatatttgaggttttaataatagccattctgtctggtgtacgatggtatttcactgtggttttaatttgcatttctctgataatttgtgccgttgaacatttttgtcatgttttttggctgcttgtatgtcttattctgaaaaatctcttcaaatctttcacccactttttaatgggcttgtttttgtcttatagagttgtttgagttctttgtaaattctggatattagccctatgtcacacacatagttttcaaacattttcttccattctgtag

SEQ ID NO: 196490 - DNA, 601 bp, Human
aatgtgatacatcaagctttgatttttgcttaggattgttttggctattcaggctatattttggtttcatattaatactatgattgttttttctaattctgtgaaaaattatataaattgcattgaatctgtagattgttttaggaagtatggtcattttaacaatattgactcttccaaactatgagcatagaatgtttttccattcatttgtgtcatctacagtttttttcatcaatgttttgtattttttcttttagagagctttacctacttgtttaaatgtattgctacatatttttgtgtgtgtgtgtgtgtgtgtgtgtgtgtgtgtgtgtgtgtgtgtgggtccattgcaagtgagactgcattcttagtttggttctcagtttgtatgttattgattatagaaatgctactgacctttatacattgattttgtatcctgtaacttttctgaagttgtttaacaaatctagaagtcttttggatagtctttaggattttccagttgtaagattttatcatcagttaacatatatcatttgacgtcctcttttccaatttggatgccttttatttcttcctcttgcttgattcc

SEQ ID NO: 196491 - DNA, 601 bp, Human
tgtgatacatcaagctttgatttttgcttaggattgttttggctattcaggctatattttggtttcatattaatactatgattgttttttctaattctgtgaaaaattatataaattgcattgaatctgtagattgttttaggaagtatggtcattttaacaatattgactcttccaaactatgagcatagaatgtttttccattcatttgtgtcatctacagtttttttcatcaatgttttgtattttttcttttagagagctttacctacttgtttaaatgtattgctacatatttgtgtgtgtgtgtgtgtgtgtgtgtgtgtgtgtgtgtgtgtgtgtgtgggtccattgcaagtgagactgcattcttagtttggttctcagtttgtatgttattgattatagaaatgctactgacctttatacattgattttgtatcctgtaacttttctgaagttgtttaacaaatctagaagtcttttggatagtctttaggattttccagttgtaagattttatcatcagttaacatatatcatttgacgtcctcttttccaatttggatgccttttatttcttcctcttgcttgattcctc

SEQ ID NO: 196492 - DNA, 601 bp, Human
tgatacatcaagctttgatttttgcttaggattgttttggctattcaggctatattttggtttcatattaatactatgattgttttttctaattctgtgaaaaattatataaattgcattgaatctgtagattgttttaggaagtatggtcattttaacaatattgactcttccaaactatgagcatagaatgtttttccattcatttgtgtcatctacagtttttttcatcaatgttttgtattttttcttttagagagctttacctacttgtttaaatgtattgctacatatttgtgtgtgtgtgtgtgtgtgtgtgtgtgtgtgtgtgtgtgtgtgtgtgggtccattgcaagtgagactgcattcttagtttggttctcagtttgtatgttattgattatagaaatgctactgacctttatacattgattttgtatcctgtaacttttctgaagttgtttaacaaatctagaagtcttttggatagtctttaggattttccagttgtaagattttatcatcagttaacatatatcatttgacgtcctcttttccaatttggatgccttttatttcttcctcttgcttgattcctcta

SEQ ID NO: 196493 - DNA, 601 bp, Human
atacatcaagctttgatttttgcttaggattgttttggctattcaggctatattttggtttcatattaatactatgattgttttttctaattctgtgaaaaattatataaattgcattgaatctgtagattgttttaggaagtatggtcattttaacaatattgactcttccaaactatgagcatagaatgtttttccattcatttgtgtcatctacagtttttttcatcaatgttttgtattttttcttttagagagctttacctacttgtttaaatgtattgctacatatttgtgtgtstgtgtgtgtgtgtgtgtgtgtgtgtgtgtgtgtgtgtgtgggtccattgcaagtgagactgcattcttagtttggttctcagtttgtatgttattgattatagaaatgctactgacctttatacattgattttgtatcctgtaacttttctgaagttgtttaacaaatctagaagtcttttggatagtctttaggattttccagttgtaagattttatcatcagttaacatatatcatttgacgtcctcttttccaatttggatgccttttatttcttcctcttgcttgattcctctagc

SEQ ID NO: 196494 - DNA, 601 bp, Human
atgctactgacctttatacattgattttgtatcctgtaacttttctgaagttgtttaacaaatctagaagtcttttggatagtctttaggattttccagttgtaagattttatcatcagttaacatatatcatttgacgtcctcttttccaatttggatgccttttatttcttcctcttgcttgattcctctagctagaaattccaggactatgttgaatatgagaggtaaaaatgtgcatccttgtcttgttccagtttttaaagagaatgttttcaactttttcctgtttagtatgatrttgcctatgggtttgttatatatggcctttattattttaggtaagtttatatgatacctggtgtgctgagtgtttttatcattaatgggtgctgaattttataaaattattttttctgaatctattgagatgagcatatggtttttgttttaaattctgtttatgtggtgaatcacatttattaatttgcatgtgttgaaccattcttgaatccctgaaataaaacccacttgattatggtgtattacatttctgatgtactgttgcatttggcttgctagtattttttagaggattatt

SEQ ID NO: 196495 - DNA, 601 bp, Human
gcctggctttggtatcagggtgatactggcttcatagaatgagttagggaggattctcttctcatcaattttatgcaacagttatagtaaaattgataccataaaattgattgataccatcaataaaattgatcaattttatagtaaaatttatactggtatcaatggcttcatgtggcaatcatatggcttcacatgtctggtaacatttggctgtacatccctctggtcctgggctcatatctgttggacaattttttcattactgattcaatgtcattactcattattgtctgttaargatttctatttcttcttgttacagtcttaggagaaattttctctagtttttctagtttgtatgcctagtgatactcatagcagtctttgatgatcttttgtatttctgtggtatcacttgtagtcacacctttatcttttctgattgtgcttaagacttctctccatttttcatggttgatctagctaacaatctatcaatattgtttatgatttcaaaaagccaatttttattttgttgatcctttgtatttttttgttgttctcaatttcatttagttcttttctgatctttgttatt

SEQ ID NO: 196496 - DNA, 601 bp, Human
aagtgattagacacttctctcttgctgcttttaggatttttttccttcatattggctttggataacctaataactatatgtgataatgagtttcatcttgtaaagtatgttccaagtattcactgagcttgttgtatttggatacctaattccctggccagaccagggacattttcctggattgttcccacaaataagtttccccagctttttcttcttctccctcaggaatgcctataattcataggtttggttactttacgtaatcttttatttctcaaagcctttttttagtgttttktttttttttttttgtctgacttggttaattcagaaggcttgtctttaagctctgattatttttcttctacttgctctaatggtaaggcttccaaatgtatcttgtaattatttcaataattttttttattttcagaagttctgtttttttaaaaattatctgtaataatttttaattaacatcctgatttttcttctgatttctttggtttttagctttctcttggatctcattaagcttcctcacaatctatattttgaattctttatctgtcatttcagaattttcatttagttttgg

SEQ ID NO: 196497 - DNA, 601 bp, Human
attttttctcttgagggcgtaactgtaatgtatgttgtgtagggctgtttggcttcaattctgggtgctttcaggggccaagcctctgtatgagttccttggttgtagataaccttggttataaatacagttcctttatgtggtggctttttcaaatgctgattatagtagcaatgtactcggcctatgagcaggactaacaccttctgtgggactgaggttatggaagtctcaggaaacttaccttattccgcagcacaatgctcttctgacagaagatttttaatttgattgtgcagtycaatctccagttcattaggtggtagttacgggtaacagctgtctgtggtatatacttgatctttgtttactgagaagggctctgttgtcacatgtagtgggctggtctgtcaaatgactggtgtcctgacttccctgctgaagggtacaggtgggacaaagctgggcagagctggaccaccaaactcaccctcagataccccaatgataagttaatgtatccaccttgactggagtgacagggagaggttatagtgaaagcctcccatgtttctcccagttccacatcatgggcaggcag

SEQ ID NO: 196498 - DNA, 601 bp, Human
cacatttctcatgcaatgggcgcagtaatcttcagctcacaagtggggagctcttgtgcagaggagagtgcacactccggtttttgttgttccaagggcacttcggcatgtgacactctcccttcccctagggagagctcaccctgaacgttagaattccgggaatcccacagctcccctttatcctgctggtcctttctggttgctgctgtccaagtagattctaaggaatgtctataagggatctactggtgttgaggcaagagctgagactctttgggtaggatagagatccacaatrtgtgcccaactggtatggcacctactacctcagcttgggtcttgagagtggagggatggtaaaactgcatgagctagcagcctagtgctttgccctcaagaaatttgtaaacacaacccacagcagtacttgggttcatgagggcagaggggctctctgacattccagaaatcagcagtatgacacaggggtgaggggagcataaagtacccccatctaccttatccatgggactccaagatcttcaggggtcaatctctgccagactcttgcttccttctttttgtgtgccccagcttt

SEQ ID NO: 196499 - DNA, 601 bp, Human
taaatttacatctgccaattaatttttatctttctaatgtctcttttgtcctctctcctttaccagttttgcattaagataatattttcttgtgtaacattttaatttaatgatttttctttgtattttttgttattttctttgtggttgatttaggacttatatatcttaatttataagaatctatttcatatttatacttatttaggatttttttttttttttttttttttttttttttttttttgagatggagtctagctctgtcgcccaggctggagtgcagtggcaccatctcagyttactgcaagctctgcttcctgggttcatgccattctcctgcctcagtctcccgagtagctgggactacaggcgcctgccacagcacctggctgatttttcttttcctttcttttttttctctttttctttctttctttcttttttttttttttttgtatttttagtagagatggggtttcactgtgttagctaggatgatcttgatctcctgacctcgtgatccacccgcctcggcctcccaaagtgctgggattacaggcgtgagccaccgcgcccggccacttatttagtttaatat

SEQ ID NO: 196500 - DNA, 601 bp, Human
ttttttttttttttttttgagatggagtctagctctgtcgcccaggctggagtgcagtggcaccatctcagcttactgcaagctctgcttcctgggttcatgccattctcctgcctcagtctcccgagtagctgggactacaggcgcctgccacagcacctggctgatttttcttttcctttcttttttttctctttttctttctttctttcttttttttttttttttgtatttttagtagagatggggtttcactgtgttagctaggatgatcttgatctcctgacctcgtgatccaccygcctcggcctcccaaagtgctgggattacaggcgtgagccaccgcgcccggccacttatttagtttaatatagaaacaatcctagaaagctctatttcctcttatccattttatgctctaatttttgtacatattatatgtatatatgctccaaacccaaccatacatcattatatatgctgcaaacccaacaatacatcatggagctagcagtctccacttaattgcttaccaataaaatttccattatttcagagagtacccttcaacttgaacttgcctacattcttttctaaataa

SEQ ID NO: 196501 - DNA, 601 bp, Human
ctgcaagctctgcttcctgggttcatgccattctcctgcctcagtctcccgagtagctgggactacaggcgcctgccacagcacctggctgatttttcttttcctttcttttttttctctttttctttctttctttcttttttttttttttttgtatttttagtagagatggggtttcactgtgttagctaggatgatcttgatctcctgacctcgtgatccacccgcctcggcctcccaaagtgctgggattacaggcgtgagccaccgcgcccggccacttatttagtttaatatagamacaatcctagaaagctctatttcctcttatccattttatgctctaatttttgtacatattatatgtatatatgctccaaacccaaccatacatcattatatatgctgcaaacccaacaatacatcatggagctagcagtctccacttaattgcttaccaataaaatttccattatttcagagagtacccttcaacttgaacttgcctacattcttttctaaataaagttaactcttttgggcagaacttcagaattctcagttcttattacctggctctcttcttgggcaaaatatgcac

SEQ ID NO: 196502 - DNA, 601 bp, Human
catcattatatatgctgcaaacccaacaatacatcatggagctagcagtctccacttaattgcttaccaataaaatttccattatttcagagagtacccttcaacttgaacttgcctacattcttttctaaataaagttaactcttttgggcagaacttcagaattctcagttcttattacctggctctcttcttgggcaaaatatgcaccactgctctggagctaatgggaaggagggtatgggttaaggttcaaattacatagatgcttgctattgttactgagatttgtgtttcttgaaaaaaaatacatataatttgctgtatatcttagaacaatttctggagactttaaatgtagatatataatatatacataattatatttcattaatgtataatatatacatactatatcattacacatataacatcatatataagattatagatacatgatatataataaaacaatgctaacacatatatgtataattaggtacatgattttgtgtatgatataacatatatgtatattattatattattgttatcaattgtgaatgtttcactggagaggaggtttgtgaaggtcctctga

SEQ ID NO: 196503 - DNA, 601 bp, Human
acattcttttctaaataaagttaactcttttgggcagaacttcagaattctcagttcttattacctggctctcttcttgggcaaaatatgcaccactgctctggagctaatgggaaggagggtatgggttaaggttcaaattacatagatgcttgctattgttactgagatttgtgtttcttgaaaaaaaatacatataatttgctgtatatcttagaacaatttctggagactttaaatgtagatatataatatatacataattatatttcattaatgtataatatatacatactatatmattacacatataacatcatatataagattatagatacatgatatataataaaacaatgctaacacatatatgtataattaggtacatgattttgtgtatgatataacatatatgtatattattatattattgttatcaattgtgaatgtttcactggagaggaggtttgtgaaggtcctctgatcccagttagaagtggattttccttgtgttttaagagcctctagctattggggtttcagtaccagacctgttagcaaccctgtcctattgggaaatgaaggagaactagacatgggt

SEQ ID NO: 196504 - DNA, 601 bp, Human
tacataagggcatagggtgtagattatgttaagtttgcgggaaaatacctgaatagtttttttaaaggaagtagccggaaaatggataacctggtctgctaggcaggagagatgcatctaagctcttatctggagcctctggattgaggcatttgggtgtggtgtagaactggaaactgagtcaagggtgaccaaaccctgcttttgctataagaaacttaaacctgtattcaaaatgaacaccaaggcaacataaaattataagaatttactatacttcattattcattttttgatctcrggacatgtgcttaactgctttgcatcttaggtgtcctcctgtaaaactggataaagtaccaggtgtatagtgctgttttgcatattggcttagaaaaaatttgtaaaccttattttttcaatgtctgctcataaaagctatccaatacaatttagttccctgtttttctttcagatatccaaatctgtcactctcatcatgccatttctataacaagtcagagagtctatcttcagctttatctgtcattgttctccctcattttgcagtttgttccttgggttgaataatacctctgta

SEQ ID NO: 196505 - DNA, 601 bp, Human
taagggcatagggtgtagattatgttaagtttgcgggaaaatacctgaatagtttttttaaaggaagtagccggaaaatggataacctggtctgctaggcaggagagatgcatctaagctcttatctggagcctctggattgaggcatttgggtgtggtgtagaactggaaactgagtcaagggtgaccaaaccctgcttttgctataagaaacttaaacctgtattcaaaatgaacaccaaggcaacataaaattataagaatttactatacttcattattcattttttgatctcaggayatgtgcttaactgctttgcatcttaggtgtcctcctgtaaaactggataaagtaccaggtgtatagtgctgttttgcatattggcttagaaaaaatttgtaaaccttattttttcaatgtctgctcataaaagctatccaatacaatttagttccctgtttttctttcagatatccaaatctgtcactctcatcatgccatttctataacaagtcagagagtctatcttcagctttatctgtcattgttctccctcattttgcagtttgttccttgggttgaataatacctctgtaaaat

SEQ ID NO: 196506 - DNA, 601 bp, Human
cttatctggagcctctggattgaggcatttgggtgtggtgtagaactggaaactgagtcaagggtgaccaaaccctgcttttgctataagaaacttaaacctgtattcaaaatgaacaccaaggcaacataaaattataagaatttactatacttcattattcattttttgatctcaggacatgtgcttaactgctttgcatcttaggtgtcctcctgtaaaactggataaagtaccaggtgtatagtgctgttttgcatattggcttagaaaaaatttgtaaaccttattttttcaatgyctgctcataaaagctatccaatacaatttagttccctgtttttctttcagatatccaaatctgtcactctcatcatgccatttctataacaagtcagagagtctatcttcagctttatctgtcattgttctccctcattttgcagtttgttccttgggttgaataatacctctgtaaaatgtttcacattagtcttaataaaaaaagtaatgtttatttttgtaataatttatgtaagatatagctcagtgaaaacatattctccttgcatgttatcacacacaattgtttttgaatgac

SEQ ID NO: 196507 - DNA, 601 bp, Human
aatgtattgacattttatacttctgatttcacagtatatttgccattacttgttagtaacaaagcatcagtcataaatttgaagtctgtggaattggttaattttacctcatttgagtaaatctcaaatgaggtaaagtataggaggtaggaggaaggaaggaaggagaaagggagtataataactaattggagaaaaatatatttgataaaataatccttgtctgtataaaacaattttcaataataactgatatgtttccctaaaggtagtttataatctattattctttttataatarttatgatgttatgtggtttggatttctttgtaatccacattagatagcatagaaactagtatataaccaataaatatttcgtgactgcatgtactttgtgtataactttatgtgccaaattcttgatacaaataatctgtaaattttctcctcatcagaaaattgtattctttgtctaccgtcattttgccattatcagaatgtatattttacatggcattcccaaattaaagttaattattctcccctatgaaacaatgtactttgtattttaacaaattgtttagctaaggaagaaaa

SEQ ID NO: 196508 - DNA, 601 bp, Human
atgtgccaaattcttgatacaaataatctgtaaattttctcctcatcagaaaattgtattctttgtctaccgtcattttgccattatcagaatgtatattttacatggcattcccaaattaaagttaattattctcccctatgaaacaatgtactttgtattttaacaaattgtttagctaaggaagaaaacaatttatttaggtaatgcaaatatgtcaacagataattgcattatagcagaagtttaatataaaagacacaaaagttttaggtgtgtcctgagaagtgattgatttctrtagggcagaagtaaaggagaaatttaaaaaatatattatgaatgttgcgatgcccaagtagatcttgagagtaacagaagtaatagagtttgacaaggctggagttcctgtaagaaaataagcatattactaaatccactttattctaattaattatttgttcagatcttaacttttataacaggatatgttgaggacctgaatgttctagtcatctgtttcccctgagcacataatgcaatcaatggcctgtgataggtgctcaagaaattgtcaatgcataagtgattcaatggataa

SEQ ID NO: 196509 - DNA, 601 bp, Human
ttggatatactaatttatatgactcgtacaattggtccctttaaattggcaatcaacatatactttattaaattatactacttccaagttctgaaagttatttttaataatagagtctctactatacaaatctaactggttatgtctaggaaaatttagccatcttgtctttttgtaaataattgtgaataaaaattcattttataaaatgtaaataataccaatgagtattataaagtaccaaacaaaaaaaagacatgcaaaatcttttatactttattttaaaataatttttgagtaygtactatgtctgccagaaaatgtgcaagattctgtggaaattgatcaatagtagatatacgtcctgccctccttgaggttatgatatcatagagaagataaatgttaagatactattaggcatatgttgaatgctagctaaaaaagtggcgggtgctatagaaactgcattagtcaaagttctacagaaaaacagaacatacacacacataaagaaatttaatttaaaggattggctcacacaattatagggacttcggaaagtctcaatctgtaagcaagccagcaggctggcaactcc

SEQ ID NO: 196510 - DNA, 601 bp, Human
tacctatgagccctccacacagagatatctagtaagaatataagaatatgggcctagagagattaggtttggtgttgttaactcaagtaatctaaatcttgggaatagatgaaatcacctggggaagtgtagggtgaagagacaggtatttagtcagtgacctgtggcacttaattcaccaagatttaataggaaaataacccaaaaaaggagattgagagagcagccaaatacataggtaatgtggagtgtgatatcagggaaaccaagaaaagggcttgttgtaagaaaagtgttgtgrtcaagaatgttacgtcctgctgagatgtcaagcaagacaaggataaagaggaatccattggactttctgacatggaattcattgcagaagcccaatttgaggtaagtgaggaaaaactggacttgaggaaatagaaacagcatgtgtgaaaataagagtggaaaaagtggaaaaggcctaagagtggaaaaagacctagtgtgccaaaaatgaaggtcaaggtgggcaggtggagtcaggtagtttttaggccatttatttgtaaacagttattttatctatgtgtctatctgtctgtct

SEQ ID NO: 196511 - DNA, 601 bp, Human
ctgctgagatgtcaagcaagacaaggataaagaggaatccattggactttctgacatggaattcattgcagaagcccaatttgaggtaagtgaggaaaaactggacttgaggaaatagaaacagcatgtgtgaaaataagagtggaaaaagtggaaaaggcctaagagtggaaaaagacctagtgtgccaaaaatgaaggtcaaggtgggcaggtggagtcaggtagtttttaggccatttatttgtaaacagttattttatctatgtgtctatctgtctgtctgtctgtctatctatctrtctgtctatctctatctatctatctatctatctatctatctatctatccctccatccatccatccattcaactgtcatctatttaatctatttttctttggggttaaattatgaaagagcaaggagagaagagatttaaaaactataaagacagggaataattgataacataacatccctgagaaaattgaagaggatgatatacaaaaacaaaatcatttagttttggatggagggtagaggtagaggggtctgtcattgtattagaaggagaggaggaaaaagaggtcaaagtgaagg

SEQ ID NO: 196512 - DNA, 601 bp, Human
tgctgagatgtcaagcaagacaaggataaagaggaatccattggactttctgacatggaattcattgcagaagcccaatttgaggtaagtgaggaaaaactggacttgaggaaatagaaacagcatgtgtgaaaataagagtggaaaaagtggaaaaggcctaagagtggaaaaagacctagtgtgccaaaaatgaaggtcaaggtgggcaggtggagtcaggtagtttttaggccatttatttgtaaacagttattttatctatgtgtctatctgtctgtctgtctgtctatctatctagctgtctatctctatctatctatctatctatctatctatctatctatccctccatccatccatccattcaactgtcatctatttaatctatttttctttggggttaaattatgaaagagcaaggagagaagagatttaaaaactataaagacagggaataattgataacataacatccctgagaaaattgaagaggatgatatacaaaaacaaaatcatttagttttggatggagggtagaggtagaggggtctgtcattgtattagaaggagaggaggaaaaagaggtcaaagtgaaggg

SEQ ID NO: 196513 - DNA, 601 bp, Human
tgagatgtcaagcaagacaaggataaagaggaatccattggactttctgacatggaattcattgcagaagcccaatttgaggtaagtgaggaaaaactggacttgaggaaatagaaacagcatgtgtgaaaataagagtggaaaaagtggaaaaggcctaagagtggaaaaagacctagtgtgccaaaaatgaaggtcaaggtgggcaggtggagtcaggtagtttttaggccatttatttgtaaacagttattttatctatgtgtctatctgtctgtctgtctgtctatctatctatctrtctatctctatctatctatctatctatctatctatctatctatccctccatccatccatccattcaactgtcatctatttaatctatttttctttggggttaaattatgaaagagcaaggagagaagagatttaaaaactataaagacagggaataattgataacataacatccctgagaaaattgaagaggatgatatacaaaaacaaaatcatttagttttggatggagggtagaggtagaggggtctgtcattgtattagaaggagaggaggaaaaagaggtcaaagtgaagggaaa

SEQ ID NO: 196514 - DNA, 601 bp, Human
gtgtctatctgtctgtctgtctgtctatctatctatctgtctatctctatctatctatctatctatctatctatctatctatccctccatccatccatccattcaactgtcatctatttaatctatttttctttggggttaaattatgaaagagcaaggagagaagagatttaaaaactataaagacagggaataattgataacataacatccctgagaaaattgaagaggatgatatacaaaaacaaaatcatttagttttggatggagggtagaggtagaggggtctgtcattgtattrgaaggagaggaggaaaaagaggtcaaagtgaagggaaaggtagcaagatccgacatttcaggaaaatggaaagtgtttaaagatctacagtgagaaattggagatgaactcactgggtaacagtaaacatagggcaattttgaacactcagtggaacttggagaccactgaagaaatttatcttctgttatgtaatatatttttctcagtggaattgagtagcttatatatactcatggaataaatggctatattttttccagattgtttagatgagtgtgacaacaggataacaaagct

SEQ ID NO: 196515 - DNA, 601 bp, Human
aaactatgcacatttctttggtcagaactttttaaggatatgatgtgtatacttgtataatattaatattgtataaaatgcctcatttggatttctaaatatctaataagatcttttcaagtttctaatacagcttaatcatggttttatgaaacagttataatgccacgtggagtcatttaaaagatttgtattagttataagaaaataaacagagcatatagtaaataataaaaattacagttcttaaaagtataagcactgaagtaacaaattaaccattaccctcccattttttcctttttttttttttttttttagaacaggcaacttagattagtttctgatcagtcaactatcttttcctttttgttttcttggatccctacttggggagctttttataaggcttattcccaggcaacagaattccacttaatctgttatgtgaaacagtgatccaagttccattttgccaccttgcctggaacacatgtgttccattaaccacattagctgaattcccagccatgcctgcccagaagcagacccaagcaggttgatgacatcatcccactcactccttctattttgtttcaag

SEQ ID NO: 196516 - DNA, 601 bp, Human
tttaaggatatgatgtgtatacttgtataatattaatattgtataaaatgcctcatttggatttctaaatatctaataagatcttttcaagtttctaatacagcttaatcatggttttatgaaacagttataatgccacgtggagtcatttaaaagatttgtattagttataagaaaataaacagagcatatagtaaataataaaaattacagttcttaaaagtataagcactgaagtaacaaattaaccattaccctcccattttttcctttttttttttttttttttagaacaggcaayttagattagtttctgatcagtcaactatcttttcctttttgttttcttggatccctacttggggagctttttataaggcttattcccaggcaacagaattccacttaatctgttatgtgaaacagtgatccaagttccattttgccaccttgcctggaacacatgtgttccattaaccacattagctgaattcccagccatgcctgcccagaagcagacccaagcaggttgatgacatcatcccactcactccttctattttgtttcaagtttataaatatatttatcttttttgggcat

SEQ ID NO: 196517 - DNA, 601 bp, Human
atccttaacttttgtggttgcagatatcttgagtatagtcttttccttttagaaggcaaatactgtaattttcatgtctgtctcccatgtctttctctaattacttcattacctgaatggtctcttcagaaatataattttctggtaaaaataaaattatatggagttaagtgacaactctgtgctttttgtatatgcagccactctatcatgcagatatggtagttaagttgctcagttttaatttggggcaatagactgagcagccatttaagaagctgaagagtagcttctctttttyggttttgtgtgaatcgtgggtgtaatttaaaaggcaaaaatggagaaagcctttctggtcctggatagtgaagcttacaggaataagaagagaaaaattgaatttaaaaacaacaacaacaaaacatctgtttcctcagaattagctgctactacccccttcttctttttttttttttcaatgtgtacgagaatccagaatttcttcagtgccacaactgaaacaaaaggtgtctggattagacataagtgtagactacagcaaaatgcttcaaaagatccaagtggcaccacttacata

SEQ ID NO: 196518 - DNA, 601 bp, Human
tcatccttaccagacaaactctgggattataaatacacataatactcttagcccttagtaatagaggtcaaaagataatcactgggtgggataaaatgtgaaggtataatccagaatagtcttaaaagaaggttcttagaatagttgcagataatatacattgtagtagaagggtgtggaaaataaaattaagaaagaaagtaataataaaatagagaaaatggtgaatggaagtcaatgataaggtaaacatatctggaaattaattcatgtcaaattttgtgtatatataatattttcmcctcattacaaaattatgccatatacctttctaaaaagagaaaataatataatgtaatatattgtaaaactcattgcatattttgtcctgatgctattaaaaagtatttcccacctaaagtttatgccacatgcattttatactatgagaaactgcatttgaatataaatttatgcacttttatctcaatgtctggatttcaacctcttgcaaattagcaattaaattgaactagatgcactcgtgatgtgatttaaatgccatttgactctttcagagcactcataaatatgattttat

SEQ ID NO: 196519 - DNA, 601 bp, Human
aggatgaacatatgccccattttttccagaaaatttcacttaatacatagcatcttgaattgataattaattgtgccctatttcactctcctgtcctggtttaaacaataaattatagggcaaccataactatagctcacagtaagaaataagagaaaaatagaagtaggctatacccaggataagtaattttgatatcaaggttgatcagatcatattaacttgttaccatcaaaatatgtcattttaatgattcacaagttggaaaacttaccttgtgaatattgatcactactgtgayatagattcttattattttatcttatttgaaaactactaaattgtctatgaatgtttctgagtgttgtctacacaaatttaagacactacactatgtgaaaatgaacccatggtagttccaaactactcaggtttgacatgccagccatcacatgagatgagaacagagagtaacttgcttgatggaaactgagtcagattgggtgcttaatcagccactgattaatcagaatgcaggtctgactaggagaaccacaaatcaaaatgggcattaggctgtgttccctattaaattaataac

SEQ ID NO: 196520 - DNA, 601 bp, Human
tgccagccatcacatgagatgagaacagagagtaacttgcttgatggaaactgagtcagattgggtgcttaatcagccactgattaatcagaatgcaggtctgactaggagaaccacaaatcaaaatgggcattaggctgtgttccctattaaattaataactgactataaagccaagtaacatttcaaatttcatttgattccatagatttaaaattggtggtatgacaactgaacgtattttaaaacatgccttttttttgaaggcaatgtatttctctgcagaaataaactcttgacrttaatgatattgactcttttatccagtttcaaaactctattttgtcaagaaagttataattattgatactacttgacagcaaagagcagactgctttaaatgctcatcaacgtcttttcaaaatagatcattattcttctaatttatttccaaataagaaaagagctgacagaggttgagatttgttcaaatatttcaatcctagagtatgtatatataatacatatgcgagatgtgatggggtgtgtatgtgtgtgtgcatttatgtgtgtgaatggcacataatctttccaaattacc

SEQ ID NO: 196521 - DNA, 601 bp, Human
gagaacagagagtaacttgcttgatggaaactgagtcagattgggtgcttaatcagccactgattaatcagaatgcaggtctgactaggagaaccacaaatcaaaatgggcattaggctgtgttccctattaaattaataactgactataaagccaagtaacatttcaaatttcatttgattccatagatttaaaattggtggtatgacaactgaacgtattttaaaacatgccttttttttgaaggcaatgtatttctctgcagaaataaactcttgacattaatgatattgactctttyatccagtttcaaaactctattttgtcaagaaagttataattattgatactacttgacagcaaagagcagactgctttaaatgctcatcaacgtcttttcaaaatagatcattattcttctaatttatttccaaataagaaaagagctgacagaggttgagatttgttcaaatatttcaatcctagagtatgtatatataatacatatgcgagatgtgatggggtgtgtatgtgtgtgtgcatttatgtgtgtgaatggcacataatctttccaaattacctggagaaaattgtatctgac

SEQ ID NO: 196522 - DNA, 601 bp, Human
ctaatcaatttgtggtgccagttaatgtgtcaaagtatctgtctgtctatatttgtctattatctatcatctatatatcatctacattgatctgttttccaaagtcttaattacattctattgattttttttctatttagctccacttatttttactaaaaattttagtaggatatttaatattgactaattcctcttttttcttctttttcaaaatttgctcttctatggaagtttattatgatatgtaaactttggaatacatttgccaagtaactaaaaaaatctgctttatttttarctttcagatttattgagataaagttgacatacaataaacttcacaagtttaaaatgtaaatttgaaatttttaacatacgtatacatcagcgagaaaataccacagtgaagatagtgagcatatctatccactcccaaaagcttccttgtatcccttggtaatatggaccacacaccttttctcaatactgctcctaatcataggcaactactgatctgctttttgtcagtacagattagtttgcattttctaaaattttatataaatcaaattgtatagtgagccacaatttaaaactt

SEQ ID NO: 196523 - DNA, 601 bp, Human
atttttactaaaaattttagtaggatatttaatattgactaattcctcttttttcttctttttcaaaatttgctcttctatggaagtttattatgatatgtaaactttggaatacatttgccaagtaactaaaaaaatctgctttatttttagctttcagatttattgagataaagttgacatacaataaacttcacaagtttaaaatgtaaatttgaaatttttaacatacgtatacatcagcgagaaaataccacagtgaagatagtgagcatatctatccactcccaaaagcttcctkgtatcccttggtaatatggaccacacaccttttctcaatactgctcctaatcataggcaactactgatctgctttttgtcagtacagattagtttgcattttctaaaattttatataaatcaaattgtatagtgagccacaatttaaaacttatgaattgttagtttctgaaattttccatttagtatttgtggaccacagttgactgcaggtaaccatgtaacagcagataaaggaacattactgtgtgtactcaatttgtgctcctttttgtctttcttttttcattttgcttaaata

SEQ ID NO: 196524 - DNA, 601 bp, Human
ggtctatttttgttaagtttacttatgctataaaattatttttggttattttgggtaatgtacattaacatattgaatacaataatcaaatatttgtacacttctttattgattccttcataattattcagtcactgaaagaacaatgataaaaaaaactctcattacaatcccacctattatcacagatgtattcatttttacctataatttcatcagttgttatttataaatatataaaaaggctacatttttagatatatatatagatttatacttgttatattctattcatctatgtttaaatattgcatggaatttgactttatcctttatgatttgtatacttaagttctatttttaattatacagtggcttgaataggattctttgattttaattgtcttatttaaattgcaatgcttttatttttaaactttctttgttcttctgattgtatctcttatagatttcagaaacctagaatattttttcttatccaatctgaagttagtgccttgatataagtttaacttagttgtattagctttaatgacatttgtgttatgatttactacagcttttccattttatattcatt

SEQ ID NO: 196525 - DNA, 601 bp, Human
catctatgtttctgtagatttgtattcatgtaagctttctttaattttaagtgcacatttatttctttcattatttcaactaccatattttatcatctagtatcaccaatgtattttatatttgcatttatatttgttcatactccgtttttgagttttatttatttgattatatttgtatgcttattttatattacattcatatttttcattaattctaatttgctactcttgttcagtatgctgtcctttatagttctttatgtcccttatatatccattttttttcctgtaagttcatttttttttttttttggaaccattatctacctcagatcataataacaaactgaggggagggagaaaaagactagtttctggtttataccttataaagcttttaggatgttagagagtgaggtaggggatgcctcaaagtacaaatctactgcttttatgatctggtctcatttgtccacacacctccttatattaaaatataacatgtccttttgaaaatgtttctatacctccacttaaggcctgcttaattctaagatttatgtttcaaagttaaaattactaaatccatacaatgacc

SEQ ID NO: 196526 - DNA, 601 bp, Human
atactatattaggtagaaaatcatattattgtgtgtgagatgcatggtaaattgagtgtatgcagtcttctgggaaaaaccattaataagtattaccttgttaaaagattttagaaaccatgaaatacaaaagcagggcatgtgaatgtatttatgcttttaatgcttgagtgcaatatgtaactacagctttatgaaaacttaagcaacatgtatatatatacatatataaataataaactttattttagagcattttaaagttcacagcaatattgaacagaaagtagagaaagttacrgtatactcaccagtcaacacacatgcgcaatctctcccactatcaatatgctgcaccagaatggttatatttgttactattgatggacttaacactggcacatgattatcacccaatgtccatagtttatattgtttcactcttgatattgtattttttgggttttgaaaaatgtctaatgatatttatctaccattatagtgtaatgcaaaataatttcactgccctaatcctgtgttctccctattcatcccgccctcctttcctcctcctcctcctccccccacttcttctttttct

SEQ ID NO: 196527 - DNA, 601 bp, Human
atttatctaccattatagtgtaatgcaaaataatttcactgccctaatcctgtgttctccctattcatcccgccctcctttcctcctcctcctcctccccccacttcttctttttcttttttcttttcttttgagacagagtctcactctgtcgcccaggctgaagtgcaatggtgcaatctaggctcactgcaacctccgcctcctgaattcaagcgattcttctgcctcagcctccccagtagctgggactacagtcatgtgccaccatgcccagctaatttttttgtattttttagtrgaggctgggtttcaccatgttagccaggatggtcccgatctcctgacctcatgattctcccctctgcctccccaagtgctgggattacaggcgtgagacactgcaccgggccccctcccttcttcttaacccataacaatcacttttttttttttaatgactccatagttttgccttttccagaatatcatacagttagaattatacagtaagtagtctttcaagactggcttcttgcactgagtaatattaattttattttctttcatgtgttttctttcttgggtagagagttcattt

SEQ ID NO: 196528 - DNA, 601 bp, Human
tttttaatgactccatagttttgccttttccagaatatcatacagttagaattatacagtaagtagtctttcaagactggcttcttgcactgagtaatattaattttattttctttcatgtgttttctttcttgggtagagagttcatttctttttaataaatagtacttattccattgagttggtgtacctcagtttatttatccacccatctcatgaaaaacatcttggtggcttttaaatcttggcaattatgaataaagctgctgtaaacattcatgaataggattttgagtgaacmtaagttttcaactcgttagggtgaatatcaagaaacatgattgctggattatatgagaagagtaagtttgattttataagaaactgtcaagctgcctgctaaagtgtcttctaaaatggcaccattttgcattcccactagcaatgagtgagagttcttgttgttccagattcttactaatgttagatgttgtcagtgttctggatgttagccattttaataggtatgtggtggaatcttaatgttgttttagtgtgcaattccttaatgatatatgatgctaaaaaattttcataagct

SEQ ID NO: 196529 - DNA, 601 bp, Human
cccatctcatgaaaaacatcttggtggcttttaaatcttggcaattatgaataaagctgctgtaaacattcatgaataggattttgagtgaacctaagttttcaactcgttagggtgaatatcaagaaacatgattgctggattatatgagaagagtaagtttgattttataagaaactgtcaagctgcctgctaaagtgtcttctaaaatggcaccattttgcattcccactagcaatgagtgagagttcttgttgttccagattcttactaatgttagatgttgtcagtgttctggatrttagccattttaataggtatgtggtggaatcttaatgttgttttagtgtgcaattccttaatgatatatgatgctaaaaaattttcataagcttactttctatccatagctcttccttggtaaggtgtctgttttgatctctccatttttaaaatgcgttgttcataaattttaagagttctctgaatattttggttaatagttctttattggaaggttttttgcaaatatttttttcccagtctgtcatgtcttctcattctcttgacattgtcttttgcagagcaaggttttaaattt

SEQ ID NO: 196530 - DNA, 601 bp, Human
ttttttctttcttttcctttttttttttttttttttgaggcagagtctcactctgtcacccaggttggagtgcagtggcgcgatctcggctcactgtatgctccgcctcctgggttcacgccattctcctgcctcagcctctccgagtagctgggactgcaggcacctgccaccacgcccggctaattttttttgtatttttactagagacggggtttcaccatgttagccaggatggtctcaatctcctgacctcgtgatccacccgccttggcctcccaaagggctgggattaacaggmgtgagccaccacgccaggcccaagttatttcttttatggataatgcttttggtgttatatctaaaaagtcatccccatacccaaagttacctagattttctccattgctatcttctataatttgtataggttagtattttatatttcactctatgatccattttgtattattttttgtgaaacgtgtaaggtctgtgtctagattcatttttctttttttaaagtttttctagcactatttgctcctttgtattgccttttttcctccgtcaaagattaggtgactatatttatgttggc

SEQ ID NO: 196531 - DNA, 601 bp, Human
aaattttgtttttttctagttctgtgaagaatgttattagtagcttgatcagaagagcatgaatctgtaaattgctctgggcattatagccactttaatgatattgatttttcctatctatgagtatagaatgtttctttatttgtttgtgtcatctttgatttctttgaggagtgttttgaaattctcacggtaaagatcttttacctccctgatttgctgtatttctaaatattttattccttttgtggcagttgtgaatgggattgcattcctaatctggttcttaccttggctgttscttgtgtataggaatgctagttattttcatatgttgtttttgtaactgaaaccttgctgaggttgtttaccaacttattgagcttttgggctgagaatgcagagctttctagatatagaatcatgtcatctacaaacagggatacttttaatccctctctttctacttgggtgtcgtttatttttttctcatgccacattgctcttgtcacgactttcaatactattttgaataggagtggtgagagagggcgtccttgccttgagccagttttcaaggggaatgcttccagctttttcc

SEQ ID NO: 196532 - DNA, 601 bp, Human
ccccaaggtcatcaaataggataaaagaaaaaaaatccaaagggcagcaactttaactactgaaggaacatcagcccacaaagatgagaaaaaaacagcacaagaactctgacaactcaaaaaactagagtgtgtttcctccaaatgactgcactagttgtccaacaaggattcttaactgggctgagattgctgaaatgacagaaatagaattcagagagtgaacaggaatgaagatcatcaaggttcaggtaaacattgaaaccgaatataaagaagcaaagtcaacattatagatgckgacagataaaatagccagtatagaaaaagaatataaccaatctgataaagctgaaaaacacactataataattttatattgcatttgcaagtattaacaccagaatagaccatgctgaggaaagaatctcagagcttgaagactgtttttctgaaataggagagtcagaaaagaattttaaaaaaagaatgaaccatgtcacatgtatacatatgtaactaacctgcacattgtgcacatgtaccctaaaacttaaagtataataataataatacaaaaaaaataaataaaaaaattcaa

SEQ ID NO: 196533 - DNA, 601 bp, Human
atgactgcactagttgtccaacaaggattcttaactgggctgagattgctgaaatgacagaaatagaattcagagagtgaacaggaatgaagatcatcaaggttcaggtaaacattgaaaccgaatataaagaagcaaagtcaacattatagatgcggacagataaaatagccagtatagaaaaagaatataaccaatctgataaagctgaaaaacacactataataattttatattgcatttgcaagtattaacaccagaatagaccatgctgaggaaagaatctcagagcttgaagacygtttttctgaaataggagagtcagaaaagaattttaaaaaaagaatgaaccatgtcacatgtatacatatgtaactaacctgcacattgtgcacatgtaccctaaaacttaaagtataataataataatacaaaaaaaataaataaaaaaattcaaaaaaaatttaaaaaaaaatgaaaagggccaaacaaaacctccaaaaaatatgggattagataaggagactgaatctacaactcaatggtgtccctcaaagagacggggagaataaaagcaacttggaaaatatatttcaagata

SEQ ID NO: 196534 - DNA, 601 bp, Human
gactgcactagttgtccaacaaggattcttaactgggctgagattgctgaaatgacagaaatagaattcagagagtgaacaggaatgaagatcatcaaggttcaggtaaacattgaaaccgaatataaagaagcaaagtcaacattatagatgcggacagataaaatagccagtatagaaaaagaatataaccaatctgataaagctgaaaaacacactataataattttatattgcatttgcaagtattaacaccagaatagaccatgctgaggaaagaatctcagagcttgaagactgkttttctgaaataggagagtcagaaaagaattttaaaaaaagaatgaaccatgtcacatgtatacatatgtaactaacctgcacattgtgcacatgtaccctaaaacttaaagtataataataataatacaaaaaaaataaataaaaaaattcaaaaaaaatttaaaaaaaaatgaaaagggccaaacaaaacctccaaaaaatatgggattagataaggagactgaatctacaactcaatggtgtccctcaaagagacggggagaataaaagcaacttggaaaatatatttcaagatatg

SEQ ID NO: 196535 - DNA, 601 bp, Human
aaatagccagtatagaaaaagaatataaccaatctgataaagctgaaaaacacactataataattttatattgcatttgcaagtattaacaccagaatagaccatgctgaggaaagaatctcagagcttgaagactgtttttctgaaataggagagtcagaaaagaattttaaaaaaagaatgaaccatgtcacatgtatacatatgtaactaacctgcacattgtgcacatgtaccctaaaacttaaagtataataataataatacaaaaaaaataaataaaaaaattcaaaaaaaattwaaaaaaaaatgaaaagggccaaacaaaacctccaaaaaatatgggattagataaggagactgaatctacaactcaatggtgtccctcaaagagacggggagaataaaagcaacttggaaaatatatttcaagatatgatccatgagaacttccctgatctagctcaagaggccaacaatcaaattcaggaaatgcagagaactcccacaaaatatttcacaagaagattatactcaagacacatcatcatcagattctccaaggtcaaaatgaaaaaataaatgttaaaagcagctatag

SEQ ID NO: 196536 - DNA, 601 bp, Human
agaaaagaattttaaaaaaagaatgaaccatgtcacatgtatacatatgtaactaacctgcacattgtgcacatgtaccctaaaacttaaagtataataataataatacaaaaaaaataaataaaaaaattcaaaaaaaatttaaaaaaaaatgaaaagggccaaacaaaacctccaaaaaatatgggattagataaggagactgaatctacaactcaatggtgtccctcaaagagacggggagaataaaagcaacttggaaaatatatttcaagatatgatccatgagaacttccctgawctagctcaagaggccaacaatcaaattcaggaaatgcagagaactcccacaaaatatttcacaagaagattatactcaagacacatcatcatcagattctccaaggtcaaaatgaaaaaataaatgttaaaagcagctatagagaaaggacaggtaacctacaaagggaagcccattagattagcagtggacacctcagcagaaactctatgagccagaagagattggggcctcatattcaacattcttaaagaaaagaactcccaaccaagagttccatatccagctaatctaagcttc

SEQ ID NO: 196537 - DNA, 601 bp, Human
aagagacggggagaataaaagcaacttggaaaatatatttcaagatatgatccatgagaacttccctgatctagctcaagaggccaacaatcaaattcaggaaatgcagagaactcccacaaaatatttcacaagaagattatactcaagacacatcatcatcagattctccaaggtcaaaatgaaaaaataaatgttaaaagcagctatagagaaaggacaggtaacctacaaagggaagcccattagattagcagtggacacctcagcagaaactctatgagccagaagagattggggsctcatattcaacattcttaaagaaaagaactcccaaccaagagttccatatccagctaatctaagcttcgtaagcaaaggaaaaataagatcctttccagacaagcaagttctgagggaattcattacctctagacctgccttacaagagttcccgaaagaagcactaaatatggaaaggaaagacaattgctagtcactacaaaacacacttgtatatttagaccacacaaacaagttggcataataaacaactgaaaacatgatgacaataaaaccaccacacaagcaaggtggcagg

SEQ ID NO: 196538 - DNA, 601 bp, Human
catcatcagattctccaaggtcaaaatgaaaaaataaatgttaaaagcagctatagagaaaggacaggtaacctacaaagggaagcccattagattagcagtggacacctcagcagaaactctatgagccagaagagattggggcctcatattcaacattcttaaagaaaagaactcccaaccaagagttccatatccagctaatctaagcttcgtaagcaaaggaaaaataagatcctttccagacaagcaagttctgagggaattcattacctctagacctgccttacaagagttcccraaagaagcactaaatatggaaaggaaagacaattgctagtcactacaaaacacacttgtatatttagaccacacaaacaagttggcataataaacaactgaaaacatgatgacaataaaaccaccacacaagcaaggtggcaggagatggagagagtgaagggggaactgccaaacacttttaaaaccatcaggttttgtgagaactcactcactgtcatgagaacagcatggtggaaactgtccttatgatcccatcacctccccaccaggttcctcccttgacatcttgtgattacaa

SEQ ID NO: 196539 - DNA, 601 bp, Human
tgcttctggtctacaatctcgcagatccctcctctgtttcaggtgaggcagaatgactggaaggaactggaattgtgtatttcccttctactccatggaagaatagacagagcttgagttgagtattttccttctcgccaaatatgttaggctctgatataacaccagcaatttaggctctggtaaaagaatttctcctgaggactggccttgttaaaaaggacagtaaatatatggtgaagtatttcaaaataggtcctgcaccatgactgggttcccctagagtttatcttttagtttycccccacttctggcacccagcaattcatcaattaattatcagcttaggattttccacctcagtgttacttgtccccattgaggtttctactcatggatatctgcttcagtaatttgtggttctctatatccacctatctggctctctaatgttggggacagcagtttgccctgtgacatctcttctctaaaaaatctaagaagcattgttgactcttcaatttgtttacctttttacttggtaagacataataaagacttttgagctccttaaatgctgggctggaagcagtatttttaa

SEQ ID NO: 196540 - DNA, 601 bp, Human
aattaattatcagcttaggattttccacctcagtgttacttgtccccattgaggtttctactcatggatatctgcttcagtaatttgtggttctctatatccacctatctggctctctaatgttggggacagcagtttgccctgtgacatctcttctctaaaaaatctaagaagcattgttgactcttcaatttgtttacctttttacttggtaagacataataaagacttttgagctccttaaatgctgggctggaagcagtatttttaaaaatggcactgttgctaggaaagaccaatkaaatcttaatgtttaatgattgtagtaagaatgcagcttgttttctaaaagtaagcaacacaaaatattctgagacatgtcattttcttttgtttaaaataaatttttaaattatttttttctgcgaaggggtttgaaataatagttttgtattgtgttttcagttggctatataaacttttaaaaatagataaaatttgacttggctttatttaaatagatttttgttagtagcatttgctctggcaaatcagttggttatgctagcagttctgcttacttttatcaagtcaaaatgat

SEQ ID NO: 196541 - DNA, 601 bp, Human
cagtaatttgtggttctctatatccacctatctggctctctaatgttggggacagcagtttgccctgtgacatctcttctctaaaaaatctaagaagcattgttgactcttcaatttgtttacctttttacttggtaagacataataaagacttttgagctccttaaatgctgggctggaagcagtatttttaaaaatggcactgttgctaggaaagaccaattaaatcttaatgtttaatgattgtagtaagaatgcagcttgttttctaaaagtaagcaacacaaaatattctgagacatgtcattttcttttgtttaaaataaatttttaaattatttttttctgcgaaggggtttgaaataatagttttgtattgtgttttcagttggctatataaacttttaaaaatagataaaatttgacttggctttatttaaatagatttttgttagtagcatttgctctggcaaatcagttggttatgctagcagttctgcttacttttatcaagtcaaaatgatgcatcagctgaaatttaaggctagagtcagtcaaactgccatctcaaaactagtctttaacatctggtttgatacct

SEQ ID NO: 196542 - DNA, 601 bp, Human
ggctcagtaggtgaaaaattagtaaaaggaaacatcagggtaaggagattctagctaaaccatcctaagaagattctgctgaagacaggccaaggtgatcagacatcccttgccggatgatgaagaatgaggaacccagtgagctattttgggtcattggacattaagaatgggagcttcttgctaaactgacttaacagggttctttgctaaaactggattttataaagaagttcatagatgtgcctaggtgaaggttcgaaagccttgggaaagtttgatcagagaatatttgtcaatrgctattcctgcttttagaacaattacaaaaatagtatataacttatgcattattttacttaaaataccgtgacatttttcaaaaagaaagactatcctaatgtgagaattgttattaataaggatattccgaaggaacaatataacatctgaaggcaatttcaaaagaggaacttgaaacattcaagcaaatttaaaataaagtgactattttaaaaatggaacagcaatttatatgtacatatttgagaatattcatataaaaagaagttgttttaaattttcattctatagaaaacta

SEQ ID NO: 196543 - DNA, 601 bp, Human
atgtgcctaggtgaaggttcgaaagccttgggaaagtttgatcagagaatatttgtcaatagctattcctgcttttagaacaattacaaaaatagtatataacttatgcattattttacttaaaataccgtgacatttttcaaaaagaaagactatcctaatgtgagaattgttattaataaggatattccgaaggaacaatataacatctgaaggcaatttcaaaagaggaacttgaaacattcaagcaaatttaaaataaagtgactattttaaaaatggaacagcaatttatatgtayatatttgagaatattcatataaaaagaagttgttttaaattttcattctatagaaaactatgtgcttcctagacatggtcacaacactcatatgggaagtaaagatggtaagaaacattctaatgaaaatgataatgctttttatgaaaaatttcacattttatgttagctttctcaggaaggatagaaaatctgaatgataaagacaaatagttaaagtaaaagttcaaatactattgtattacagtctaagatgttgttattactggcattgattccctagttattaagtgtcagagt

SEQ ID NO: 196544 - DNA, 601 bp, Human
tcttattctaaaatttgataaaattggctaaatacagacatacactcacaggtacacacatacattttctgtgactatactttgagagcctggtttcctagttacttttgcatactattgtaccttacattttggtaatccaaatgtgagtaagccatgattgtgccactgcattccagcccgtgtggcagagtgacggcatgtctctaaaaacaaacaaacaaacttatcttaatgcaaaagaaattggatacattttcatgattaatttgaatgtttccttcagctattctataataaytttatgcaaagttcatactgtcagaattaagaaagatgtattattgattttttttctgaagatacatcttcaatattatattttttataatctagtgttccattgccattgtaccttcatcacttgattcagtcacttcattcatttcttcaaatatttatagagcaaatgggtagaaaactagctgtgcctgctagagctttggcatcagttattattttcttttttaatctttagcataatagagagccatgttttctatcttaagagtaacagagctttataagtgagttaataaag

SEQ ID NO: 196545 - DNA, 601 bp, Human
tataatctagtgttccattgccattgtaccttcatcacttgattcagtcacttcattcatttcttcaaatatttatagagcaaatgggtagaaaactagctgtgcctgctagagctttggcatcagttattattttcttttttaatctttagcataatagagagccatgttttctatcttaagagtaacagagctttataagtgagttaataaagtaagagttgatatgatcaagattgagatttaggaaaatcatcctgtctcagtgtagtgaacagattgaaaaggacagtggtggatrtgagaagttgttagagtgttgcaagaatgcaggagtggttaagagaatggcatactggagagtggccaagtaacctgtgtccaaaaaaattaatttaaatttaaaatatatggtgatcattggtatattttctcagatttatttcactaaggaatctagtgggctaattagaaaataagggaatgaaattatgaataaaattctttgattaattctgttgtgaagggaagagagaaagtatggcaactactgtggaaagtatgttaactagaggaaagaaaaataagacctgaaaggctt

SEQ ID NO: 196546 - DNA, 601 bp, Human
agcaatgctgtgctgcttcagattcagaagacattgatagttgagttactccagggctggggttgggttaaacagttcaaaggaaagagagagtttagtgagtttaagatattggcaaaagtaatattgagatttatatcatggaaaaatcatctgaacatggtataatataaaaaaggagaaaaatctaatgaattgtaagactgtaggtctttaatgcgcatgaggctccagtgggattggaaaatattaccggtaaagaaactgaataaacaaagtggggagaaaaaagagtctaaartcatagagcaggaaagttgagtaattcattttgaaagtaaagtaaattcaggtgttgaaaatagtgttatgtgaccatgattggctgaagcactaaaaaaagtgttggtaatgattttgaatgactgacaagtcactctgagtcctgtgtgaagggcactctgtgtgaaggactctgagtgacttgtcagtttcaagctggtgaaagagaaacagaggtaggctggaaatgacttgtactgactttcaggaaataaatttacagaaattttatgatttggctgacataatacctgtagct

SEQ ID NO: 196547 - DNA, 601 bp, Human
agagcaataatgtggctatccttctattttgctttaaagctgggtcaggtatatatacatatatttttcttattgaatgaagccatgaacagaatatgagaaaaataagtacaagtctagttattcttaattaaactgatttgatcattacaaattatatgactgtattaaattatcacatgtgccatgatatatatatatattatttataaataaaaataaaaaacaaaaataaataaatattaatggatatatagaccatctccactgaaaaatatcttggaatttatatagtctaatycgtttattccacaattgaacaaattgacttctagagagataaacttactcactacagatcatttagctttgtaatgttagagctgaaagtaatatgcctgtcttctaaactccagcatgataggaataatttcattgtatgcatctagtcattcatttatccatttttttctaatttattcaataagtatctattgatatctatgatatactagacactgttccagatacaagagctataaggataggggaaaatccttgcattaatggaggttttcttctagtaggaagagagagaaat

SEQ ID NO: 196548 - DNA, 601 bp, Human
atttatccatttttttctaatttattcaataagtatctattgatatctatgatatactagacactgttccagatacaagagctataaggataggggaaaatccttgcattaatggaggttttcttctagtaggaagagagagaaattgaacagataaataagtataaagaggaaatacataatatactacctagtcattaagaggtatgaatacaaataaaatagacggaggataaggtatatatatggtgagtcgagggttttaattttaaatagggtaaatattagaaattctctggaraaaggaatgtatcagcaaacatcaagaggaagtggagaagcgaggcacatggatatgcagggaaaatgcattccagctagagaaaacagcatagtcaaagaccctctattaaattgtacccctaattaaaatgtgctgtaaattaatgattaatataatcatcaactactttatacatactcatattgtgatatgttttaattctcagtgtacttgtaatgcattataagactttaagctttgccaggacaggggtcatgttttgtttttggtaaatctacgcacacacagtgcgtggca

SEQ ID NO: 196549 - DNA, 601 bp, Human
gggaaaagaaattatggcttatccaaggtccttcattgacccagtgtggtaaagtttcttaattgtatttcagtttgtccacatgacagtaaaatatattcttgatggctattatttataagaaaagaaaatatttgatcaggaaagttgaagacatctcatttaaaagataatatgcaatgaaccttcattatgagatacttggaatggtacacaatgaactatcaaatgctgtttcaactacctaaaaaggataactgtctttaactgcaccaaatgatactaaacttgctgcctatcstattatgcttagtcactctgatttcttttattcctctattaactcacactaacactgagaagagcaattctctctgtttcattgtccttcccttcaaatatcctgttttaagagattacagatgccttgagataacactgccagaattatcccaaggctgacaggtttactaacaactgaatgcttttcagatcactgcactggactcagatccacctttgatatgaaccacatatggcttcagtcttgtttccctgaattaactctaatttcctagtgaccaaggtcagatgagtccag

SEQ ID NO: 196550 - DNA, 601 bp, Human
tgccttgagataacactgccagaattatcccaaggctgacaggtttactaacaactgaatgcttttcagatcactgcactggactcagatccacctttgatatgaaccacatatggcttcagtcttgtttccctgaattaactctaatttcctagtgaccaaggtcagatgagtccagatagggctcagctgttcttacctagcacatatgttccagtattgttggtaatttatttctgtaataaaaaattaaaatggaaatctcagccagaatctcttttaccaagggagaccttgctaygagcattagggcttattacatgtaactttttcataacaaaataagaattattattatagcactatagccaaatatttaagttagcattataaacaaaattggtcatgtaaaatttattgaaaaagaataatttgagttagtaccaaataccacaaaatttacattgttaattttaaaaagtcagaaattagtttgcttttagcaattttactgtattaatctatacaccaatgttaaactaattctgccagattatttaggaggtaaaacttttatttataaatgtctgtttattaattc

SEQ ID NO: 196551 - DNA, 601 bp, Human
cagccagaatctcttttaccaagggagaccttgctatgagcattagggcttattacatgtaactttttcataacaaaataagaattattattatagcactatagccaaatatttaagttagcattataaacaaaattggtcatgtaaaatttattgaaaaagaataatttgagttagtaccaaataccacaaaatttacattgttaattttaaaaagtcagaaattagtttgcttttagcaattttactgtattaatctatacaccaatgttaaactaattctgccagattatttaggagrtaaaacttttatttataaatgtctgtttattaattcaagagaaatagaatttgttaacaataaagtctttttcagattacttcaagatattttgggtgttgtaccacctgattaactttttaaggtgtctgagctgaagtcaacatttctaatattatgtataacaaaacatattacaatatagtattcaattttctttgcatggtggatgtgttgttgttatgacatttaaaacaaaattaatgttaaaggttttaaatttcattcatggagaaacctttcctgtagaacatacttaaa

SEQ ID NO: 196552 - DNA, 601 bp, Human
gcattagggcttattacatgtaactttttcataacaaaataagaattattattatagcactatagccaaatatttaagttagcattataaacaaaattggtcatgtaaaatttattgaaaaagaataatttgagttagtaccaaataccacaaaatttacattgttaattttaaaaagtcagaaattagtttgcttttagcaattttactgtattaatctatacaccaatgttaaactaattctgccagattatttaggaggtaaaacttttatttataaatgtctgtttattaattcaaragaaatagaatttgttaacaataaagtctttttcagattacttcaagatattttgggtgttgtaccacctgattaactttttaaggtgtctgagctgaagtcaacatttctaatattatgtataacaaaacatattacaatatagtattcaattttctttgcatggtggatgtgttgttgttatgacatttaaaacaaaattaatgttaaaggttttaaatttcattcatggagaaacctttcctgtagaacatacttaaaaagttaattctaaatccttgctttaggaggttacacaaa

SEQ ID NO: 196553 - DNA, 601 bp, Human
gcttattacatgtaactttttcataacaaaataagaattattattatagcactatagccaaatatttaagttagcattataaacaaaattggtcatgtaaaatttattgaaaaagaataatttgagttagtaccaaataccacaaaatttacattgttaattttaaaaagtcagaaattagtttgcttttagcaattttactgtattaatctatacaccaatgttaaactaattctgccagattatttaggaggtaaaacttttatttataaatgtctgtttattaattcaagagaaatakaatttgttaacaataaagtctttttcagattacttcaagatattttgggtgttgtaccacctgattaactttttaaggtgtctgagctgaagtcaacatttctaatattatgtataacaaaacatattacaatatagtattcaattttctttgcatggtggatgtgttgttgttatgacatttaaaacaaaattaatgttaaaggttttaaatttcattcatggagaaacctttcctgtagaacatacttaaaaagttaattctaaatccttgctttaggaggttacacaaatattgata

SEQ ID NO: 196554 - DNA, 601 bp, Human
atagtattcaattttctttgcatggtggatgtgttgttgttatgacatttaaaacaaaattaatgttaaaggttttaaatttcattcatggagaaacctttcctgtagaacatacttaaaaagttaattctaaatccttgctttaggaggttacacaaatattgataatgttattttcttatcacttttagacagtcaggttcataaaagcaagttcaatgagcataagatggtttctaaattttaatttatttttgacagcaaacaaaatgaacaaaggtgaggaatccatttgtgtacytaagatatctttaaaaagaagatacctttatatttgtcaaatatgttgctcccagtaaaagaaaagaagatctatgcaagtggttcaagagtaaaccttaccttattagcttttcataatattttagaagaaatttaaaacaaaattgcaaagcactattcttacactgatattttaccagttcactaaaacattcagaaaagaaatttaccctaaaatttgttagtcatttgagacttgcaaagagccaaataatttccaggttgcaaactttatttagtgttctagcagaaactaaac

SEQ ID NO: 196555 - DNA, 601 bp, Human
gtgtacctaagatatctttaaaaagaagatacctttatatttgtcaaatatgttgctcccagtaaaagaaaagaagatctatgcaagtggttcaagagtaaaccttaccttattagcttttcataatattttagaagaaatttaaaacaaaattgcaaagcactattcttacactgatattttaccagttcactaaaacattcagaaaagaaatttaccctaaaatttgttagtcatttgagacttgcaaagagccaaataatttccaggttgcaaactttatttagtgttctagcagaarctaaactaaaatgtctataagttttaaattgttagatgtgtgtttaaaatattttaaatatttacattgtatgctctttttaatacacaaaatcatttggcaattgtgaattttaaaagggggtgtatttcttattcctttaaagtttatttttgacaaaaatacattattttgttgatgtttcacaatccatgaaaactgctattataagcagatagtgtcttctgaactgattttattggtttgtgctgatgtagaaaaaaacaaatcggcttacaagcctcggcatttttataaaat

SEQ ID NO: 196556 - DNA, 601 bp, Human
ataatttccaggttgcaaactttatttagtgttctagcagaaactaaactaaaatgtctataagttttaaattgttagatgtgtgtttaaaatattttaaatatttacattgtatgctctttttaatacacaaaatcatttggcaattgtgaattttaaaagggggtgtatttcttattcctttaaagtttatttttgacaaaaatacattattttgttgatgtttcacaatccatgaaaactgctattataagcagatagtgtcttctgaactgattttattggtttgtgctgatgtagmaaaaaacaaatcggcttacaagcctcggcatttttataaaataaacattgctaaacattgacatcccaaatccatctaatataacatagaaaaataagtttctttaaggaaaggaggaataaaatagaaatacattctagtatttttagtggcagataggataagtttagtgggaaaataagatgatttacgaaaacttaaaaatgcatttttcttacagtgctttttttaagatatgcatttcatgcaatatctctgagacattatttaattgattctcttggctttatctggctaatt

SEQ ID NO: 196557 - DNA, 601 bp, Human
tttttaaggcaaggagctttggttctctcaactgtgtaggaaagaaaaatattttaactatttcttatcttttacttggctaccctcaaggtgagctctttatgatcctctaatttgttgttacctcaattatttgctaatagaaaattattttatgatgtgcttagcttactacctgtcttttattttatatatttctcttaggtactacattcttttggagagtatttcctaataaatttggcagcagctatggacagggcaaggatgtgtctcaattcctgagtctttcctggtgttmtgtctcagtcttcactttctctcatcacagtggccagaggaccttcaaagactgtggacattttggctgatcagcttagtccttatgtttgattttaatcaggtcccttggcaatgatcagtatctacttcactgaaagacactagccattgttacaggtgatggagcaaaatgtatttacaggtggctccttcaacatgccggttgttttccacgtataatctttagtttatactgcaactttatatttcctttcttctatgtcaatttgcatacaactttcatattcaacatagaaat

SEQ ID NO: 196558 - DNA, 601 bp, Human
tataatctatttaactttgagaatgttcaacaactttttgctttattaaaaataaatctagctaagtcttcttattttccccttacacaatatattttacagtggaagtatgaccccatgggtgtttaatataaatattttcaaaccagaggtcaagccaatggcagtgttctaaatcctcgtttattctactcaggacccaccttattaggaacattgccttattttttttcagcttcactgaggtacagttgacctcaataaaataataaaaactgtatatatttacagtgttggagartctttcctaataaatttgacagcagctatgcacagagccaggctgagtctcaattcctgcgtctttcctggtatcttatctgtatctacatacatatatataaagttatcataatcagtttaattaacatatccattatcctgtatttttgtgtatgtggtgagaatatttaagatctattctcttagcaactttcaagtataaatttgcagtataattatgtgtagtcactatgttaaatgacataagctaggcacagaaaaacaaatgctgcatgatctcacttacacatggaatgta

SEQ ID NO: 196559 - DNA, 601 bp, Human
aagtatgaccccatgggtgtttaatataaatattttcaaaccagaggtcaagccaatggcagtgttctaaatcctcgtttattctactcaggacccaccttattaggaacattgccttattttttttcagcttcactgaggtacagttgacctcaataaaataataaaaactgtatatatttacagtgttggagagtctttcctaataaatttgacagcagctatgcacagagccaggctgagtctcaattcctgcgtctttcctggtatcttatctgtatctacatacatatatataaarttatcataatcagtttaattaacatatccattatcctgtatttttgtgtatgtggtgagaatatttaagatctattctcttagcaactttcaagtataaatttgcagtataattatgtgtagtcactatgttaaatgacataagctaggcacagaaaaacaaatgctgcatgatctcacttacacatggaatgtaaaacaagttgaactcatagaagcagggagtagaatagtagttaccaggggtttgaggggatgaaatggggagatgttagccaaaggaactttgcattattgattg

SEQ ID NO: 196560 - DNA, 601 bp, Human
catgtcacctaggtagtgagcatagtctgcaatatgttttcaaccgttgcccccatcatcttcctcccttggtaatcccccgtgtctattgttgctatctttatgtccgtgaatactcaatgtttagctctcatttatatctgagaacgtgcaatatttggttttctgttcctgtgttaattcacttaggataatggcctccatccagctgcatccatgttgctgtaaaggacatgattttgttcttttttatgactgtgtagtattctatggtgatacacgtattttaaataaaagagtracttggctctgtgaaagcagaagttgcactgggaaaagttaaaccaacaaggaagacttttctattccaaaaaggaagagagagatcagaagtcaatctctgaactgggctgaaactctggagagttttaaaggatggtttgggagtttttaagggtgaaagagcttttaacaacaattgggtgggtatgggggattatgaccatatgtgtttgctaattgggattatccaagggaaatataaactttctcatatcttcgtcacagaaagtagttttacaacttggaagaagggaccctc

SEQ ID NO: 196561 - DNA, 601 bp, Human
gattatgaaacttgtaggaaatcttcccatgtttgagtcctggttttgccactaagtagccatataattttaggcaaatcattaacatcattgtgttttggttttcttgtttataaaaggggtacaaaaatacctacatatttttataaaaattaaaaattttagtatttgtaaataatttggaatagcatctagcacatgctaaaatttatatatgtgtaaacttttattattactattaatatttattttgcttgaaaaaaattctattattctttctggaggaagtatatgaatcaakacagacataaggctgactggtctcaacagtggttatggatttcaacttatttcttctggttttaatatggtcttccctggttcaactgtccagcatgctcttgcttcctctccagagaataaaacctctagtacctgcttgagtgggttgggggagtcatcatgctattcggagataggctgtaacaatgtaactgtttttaaaacatcccttcaataaattctactttttttaaacccacgtttattttggctttgaaagggatctagaactgactatctctggacatttgtggagtga

SEQ ID NO: 196562 - DNA, 601 bp, Human
atatttattttgcttgaaaaaaattctattattctttctggaggaagtatatgaatcaagacagacataaggctgactggtctcaacagtggttatggatttcaacttatttcttctggttttaatatggtcttccctggttcaactgtccagcatgctcttgcttcctctccagagaataaaacctctagtacctgcttgagtgggttgggggagtcatcatgctattcggagataggctgtaacaatgtaactgtttttaaaacatcccttcaataaattctactttttttaaacccaygtttattttggctttgaaagggatctagaactgactatctctggacatttgtggagtgagggtgtattctaaagttacctatttcctggtaggtgaccagcagataatcatatttcttaaactgagctttcatatttattatgagaactaaaacagtttgggtgacttttctatctaaatatattttgccattaaaataatagaaatgcttaaagaaatgaaaaatcagtgctggaaagtatttcaagaattttaagtgagtttatgttttgtaaaattcttattacactaattaactgt

SEQ ID NO: 196563 - DNA, 601 bp, Human
ttcttaaactgagctttcatatttattatgagaactaaaacagtttgggtgacttttctatctaaatatattttgccattaaaataatagaaatgcttaaagaaatgaaaaatcagtgctggaaagtatttcaagaattttaagtgagtttatgttttgtaaaattcttattacactaattaactgttagtattgtagatcagatatttcaaatgtgaaataatatgatagttcttagtaatttaacatgaaactatatacatttgtaaaggatacagtagcaacatgtcttaaagttggwtggttttcagttgtgattaaaaaaaaatgtttgatgtgtttatcacatggattacagtaaaatattcacaatgaatggatttgtgtactattataaaatataattatcttggccaggcatggtggctcatgcttgtaatcctagcactttgggaagatgaggcaggcatgttcagtgtttcactggggagcaaaggtttgcatttctacccggtcttagccctgattctgtccttgtctttatagagcactcattgtacctttttctttttcctagtaaatcataaggtacttatttcca

SEQ ID NO: 196564 - DNA, 601 bp, Human
tctgagttgctgtaagacaggggaaaaatagtgtgtccacgtatgccattaggaattttgtttttaccaaatgcatcctgctacctctctgattgtataaaagcaggttatcattttggacatattcttctgaatagataagtcaaaaataggaaaaaataatttctatcaaaatggtcagtagatatttttactgtatcagtgttgaaaaacacacagtataacccagctaaccttctcttttcaatcttaaattcaaaaaatgttttatgagtacactaaagtttttgtaacaatttamttttttaaatttgtggcttacaaatatagtatttgacttagagagttaacgaaaataagtgaggcataaatggctctcatgaatattatcagaattgttttacttaaaagaaggtagaaatagcagactatttaccaatgacatatctagaatatttaacactaaggattatttttaacatcccccttctttcatatggcaaatcatttttagtcaaaataatcaaatgagataatgaattgtaatttccagaaaaccataataaaactcttgattatatatatacaaacatgtatgaat

SEQ ID NO: 196565 - DNA, 601 bp, Human
gaggcataaatggctctcatgaatattatcagaattgttttacttaaaagaaggtagaaatagcagactatttaccaatgacatatctagaatatttaacactaaggattatttttaacatcccccttctttcatatggcaaatcatttttagtcaaaataatcaaatgagataatgaattgtaatttccagaaaaccataataaaactcttgattatatatatacaaacatgtatgaatatgtatatgatggtgccgtaagtaaataaacacacacacacacacacacacacacacacayatatatataaaacattacagtacatgtgtacatgtagtggacagaataatggcttcccagagatgtccatgtcttaatccccagaacctttgaatatgttactttatagcaatatactttgaatatagcatatgctttgaatatgtatcatagcaaaagatactttgcagatgcgattaagttaaggatcttgagatggggagattttcctggattaaccaggtgcgtccaatgtaatcacaagagctcttgtaaaagggagagtgtagggttgagtcatagttacgatgtgattatgac

SEQ ID NO: 196566 - DNA, 601 bp, Human
ttgcatttgctgaccctcatgtgacagacatattcgtagcatgttgcatggagtctttggcctttgtagtcagatgacctgtgtgcaaattttagtttcacctggatgaaacctgaagaagttactgagtccctattacacttagtgtcctcatgtataagcagatataaccatgttcacataattggattgtgataaagattgagcatattatatttttagtacttgaatcagaataggtagcataaagaattttaaagaaatgttttgatcacttctaatacgaggttttagaaaattwaaaaaaaaagtgttttgaagaaatgttctctaataattgaaagaatatgttagtggtctctatttatacatttttagaactgtcttgtctttgtatgtttagggatattaaatatatagccgagaaagcagagtattagtatgacccactgttaaccagctggaaacctgtttctaatgaaacctacctgggattttaccatcagccaatcagtatattgtaattagataactatcattttgtgggaagagagtgattgatatctactatataaagttaagaaaattcctatcataaggc

SEQ ID NO: 196567 - DNA, 601 bp, Human
tgcatttgctgaccctcatgtgacagacatattcgtagcatgttgcatggagtctttggcctttgtagtcagatgacctgtgtgcaaattttagtttcacctggatgaaacctgaagaagttactgagtccctattacacttagtgtcctcatgtataagcagatataaccatgttcacataattggattgtgataaagattgagcatattatatttttagtacttgaatcagaataggtagcataaagaattttaaagaaatgttttgatcacttctaatacgaggttttagaaaatttaaaaaaaaagtgttttgaagaaatgttctctaataattgaaagaatatgttagtggtctctatttatacatttttagaactgtcttgtctttgtatgtttagggatattaaatatatagccgagaaagcagagtattagtatgacccactgttaaccagctggaaacctgtttctaatgaaacctacctgggattttaccatcagccaatcagtatattgtaattagataactatcattttgtgggaagagagtgattgatatctactatataaagttaagaaaattcctatcataaggca

SEQ ID NO: 196568 - DNA, 601 bp, Human
aaacctgtttctaatgaaacctacctgggattttaccatcagccaatcagtatattgtaattagataactatcattttgtgggaagagagtgattgatatctactatataaagttaagaaaattcctatcataaggcattatctgaacaagcaaaatggttttccatttccaaacatgtcttgaacttttagtaacagagctcaaaatgtattaggagaagtatcatctctaaagacatgtttagtaaacaatctttttagtaaacagagctcaagatatactaggagaaaaatcatctcyaaaggcctgtatattttctttacatttgaccaatctacaagaatttcattactctttctttcctgcttagctctgtaaaataatgaacataaaatataaacataaatcatctttcttttttagaagaaagataaggaaaaacaaatttgacataaaatagagaaaaatgcaatattggacataaacaaatacctgttattagtgcagggacttagatagctggagcttagtgagaccaaagcagacagaccaaattgcaaaagggacttcagcaatacttaaaggatgggtagttcactg

SEQ ID NO: 196569 - DNA, 601 bp, Human
atcccacatgtcagtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaaattgatggatcatttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaa

SEQ ID NO: 196570 - DNA, 601 bp, Human
tcccacatgtcagtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtataattgatggatcatttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaa

SEQ ID NO: 196571 - DNA, 601 bp, Human
cccacatgtcagtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaagattgatggatcatttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaag

SEQ ID NO: 196572 - DNA, 601 bp, Human
ccacatgtcagtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaacttgatggatcatttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaaga

SEQ ID NO: 196573 - DNA, 601 bp, Human
acatgtcagtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaaatagatggatcatttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaagacc

SEQ ID NO: 196574 - DNA, 601 bp, Human
tcagtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaaattgatgaatcatttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaagaccttaat

SEQ ID NO: 196575 - DNA, 601 bp, Human
cagtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaaattgatgggtcatttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaagaccttaatt

SEQ ID NO: 196576 - DNA, 601 bp, Human
agtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaaattgatggaccatttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaagaccttaattt

SEQ ID NO: 196577 - DNA, 601 bp, Human
gtgagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaaattgatggataatttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaagaccttaatttt

SEQ ID NO: 196578 - DNA, 601 bp, Human
gagaatatgtgatatccgtctttttgtgcctgacttctttcatttagcataatattctcttgtttcatctaggttgtcgcaaatgacagaatttcattattttttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaaattgatggatcacttcccatgatggttgcactaattcacattcccaccaacagtatgcaagggtttccttttctccacatcctgatctgatggttttataaggagttttcacttttacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaagaccttaattttat

SEQ ID NO: 196579 - DNA, 601 bp, Human
tttagggctgaatagtattccattgtgtgtatatgtactgcattttctttattctctgatccattataaatataaggttgatcctataacttggctattgtgaaaagtgctgcaatgagtaacggaatgtgcacatctctttgacaaactgatttcaaatcttttgagtaaatacatagaagtaaaattgatggatcatttcccatgatggttgcactaattcacattcccaccaacagtatgcaagggtttccttttctccacatcctgatctgatggttttataaggagttttcacttytacttctttcacattctgtcttgccaccaccatgtaaaaagtgcttttcactttcctctgtgattgtgaggcctccctaaccacaaagagctgtgaggccattaagcctatttttcttcacagtctcaggtatatctttatcagcagcatgaaaatgggctcatacagaggaataccattgaaagaccttaattttatagaagtataagaaattcatgagcaaaaatgataaggatacaaaaagagtaatttcatctttaaaaatatatcaatccataacattttaatcaccaaatggtg

SEQ ID NO: 196580 - DNA, 601 bp, Human
aagagattctttttagctttaagagtattcataactgaaagtgaagtgatggaaaatgtattccatgcacatggtaaccaaaagtcagcagggatggctatacttagagttcaagtgaaaaacatttataggagacaaagaaggtcattatttaatgataaaggaggaaataaatcaagaggacataataattgtaaatatatatgcaccaaatattgattcacctgaatatataaagcaaatattaatggactgaaaaaagaaattaaaataatagtaaaaggcaccaataccccacttytattaataggtaaatcaaccagacagcaaattaacaagaaaatactgggcttgaactgcacttttgatattgttttgctctgtccccacccaaatctcatgtagaattgtaatccccacattttaaggagggacatggtgggaattaattggatcatgggggcagatttcccccatgctcttcttgtgatagtgagtgagtgctcacgagatctgatggttaaaaagtgtgacacttctccccacaacctgcacccactgccaccatgtgaagaaggtccttgcttccccttagtcttct

SEQ ID NO: 196581 - DNA, 601 bp, Human
aactatacaacattgagttgggcaatatttttttagatttgaacccaaaagtgcaggcaacaaaagcaaaaatagacaaatgggattacatcaaactaaaagtttctgcaaaggaaggaaaaaaaataatagtgcgaagggacaacctagagattgtgagaaaatatttgcaagccacacactcaataaggtgttaaatcaaaactatattaagaactcagacaactgaatagcaagaaaaaattatttaaatgagtaagggacctgaatagacatttctcaaaagaaaacatacaaatgrctaacagatatatgaaaaataattcaccattgttaatcattggggaaatgcaaattaaaaccacagtgacatatcacctcacactagttagaatagctgtaacaaaaaagacataatgtattggagtaatgacaagctagaagaaatgtaatattattagtagtctacttcataaaaatattttcccagaaccaaagcgagcaactagtaccaaaccactacctaatactaggtcatatacagcatgtaatataatataattacaatatctgaataactaatgaatataaaataaaagaa

SEQ ID NO: 196582 - DNA, 601 bp, Human
attatatttatataaaagaaattacagtctgggcaccttggctcatgcctgtaatcccagcactttacagggcaggtggattgcttgagctcaggaggtcaaggccagctgggcaacatggtgaaaccccctctgtactaaaaatacagatgaggtggcgggcacctgtcatcccagctactcaggatgctgaggcaggagaatcacttgagcctgggaggcagaggttgcagtgagccaagatcccaccactgcactccagcctgggtgaaagagcgagactctgtctacaaagacaaaaaacaacaacaacaacacacacacacacacacacacatacatacacacacaaagaaaagaaattacaactttttgataaccaggtgtggccattttcacaaacactatcaacacaagatttgttgcatatactgtttctaattcaaagaaatttgataaactatcattctgtttaaaatggagatactcttccccattaagtaagcatttattttgcagggaaaatatatcattatcagaataaaattgatctttcaactggcaccatgctagatatagcaaattaataaatactgaatag

SEQ ID NO: 196583 - DNA, 601 bp, Human
aaagaaattacagtctgggcaccttggctcatgcctgtaatcccagcactttacagggcaggtggattgcttgagctcaggaggtcaaggccagctgggcaacatggtgaaaccccctctgtactaaaaatacagatgaggtggcgggcacctgtcatcccagctactcaggatgctgaggcaggagaatcacttgagcctgggaggcagaggttgcagtgagccaagatcccaccactgcactccagcctgggtgaaagagcgagactctgtctacaaagacaaacaacaacaacaacaccacacacacacacacacacacatacatacacacacaaagaaaagaaattacaactttttgataaccaggtgtggccattttcacaaacactatcaacacaagatttgttgcatatactgtttctaattcaaagaaatttgataaactatcattctgtttaaaatggagatactcttccccattaagtaagcatttattttgcagggaaaatatatcattatcagaataaaattgatctttcaactggcaccatgctagatatagcaaattaataaatactgaatagtcaagcaaaatgac

SEQ ID NO: 196584 - DNA, 601 bp, Human
cctgggaggcagaggttgcagtgagccaagatcccaccactgcactccagcctgggtgaaagagcgagactctgtctacaaagacaaacaacaacaacaacaacacacacacacacacacacacatacatacacacacaaagaaaagaaattacaactttttgataaccaggtgtggccattttcacaaacactatcaacacaagatttgttgcatatactgtttctaattcaaagaaatttgataaactatcattctgtttaaaatggagatactcttccccattaagtaagcatttatkttgcagggaaaatatatcattatcagaataaaattgatctttcaactggcaccatgctagatatagcaaattaataaatactgaatagtcaagcaaaatgaccttagtttatggtgttttattacatatcacagagactcaagcaccatgttattgctcttacgttatgttaaaatgcttttagtcagttattatgctcctcagaataggcaaacatttgctgagagcctatgatttgaaaaatgattgagaattcagatggatggatgtttcattagtgttctttagtgtttatgctaa

SEQ ID NO: 196585 - DNA, 601 bp, Human
caactttttgataaccaggtgtggccattttcacaaacactatcaacacaagatttgttgcatatactgtttctaattcaaagaaatttgataaactatcattctgtttaaaatggagatactcttccccattaagtaagcatttattttgcagggaaaatatatcattatcagaataaaattgatctttcaactggcaccatgctagatatagcaaattaataaatactgaatagtcaagcaaaatgaccttagtttatggtgttttattacatatcacagagactcaagcaccatgttmttgctcttacgttatgttaaaatgcttttagtcagttattatgctcctcagaataggcaaacatttgctgagagcctatgatttgaaaaatgattgagaattcagatggatggatgtttcattagtgttctttagtgtttatgctaatggatgtagatattcatctgcattagatattacataagtgatatttttgttaatttgttgaccagaaacatataaaaataatgaagcacatgcatctttctatatctgttagatggatggatggatggataaatggatggatggactgattgg

SEQ ID NO: 196586 - DNA, 601 bp, Human
caagcaccatgttattgctcttacgttatgttaaaatgcttttagtcagttattatgctcctcagaataggcaaacatttgctgagagcctatgatttgaaaaatgattgagaattcagatggatggatgtttcattagtgttctttagtgtttatgctaatggatgtagatattcatctgcattagatattacataagtgatatttttgttaatttgttgaccagaaacatataaaaataatgaagcacatgcatctttctatatctgttagatggatggatggatggataaatggatgratggactgattggacagacagacagataatagatagcctccatacaaaaaagcttgtaatgtatttaggaaaatagaacatatctcaacaggtaaataataataccagggaacctaggctgaatgcccagtgagtgatcaagacagaaagtagtataagttgggctaacatattgaaatctgaagtggttaaggggcagaatttacactgcaccttcatgttagattagtattttaagaagagcacaggggagaaactgagaagcagaaattcccctaatatacttaagaattcttgcat

SEQ ID NO: 196587 - DNA, 601 bp, Human
agtagagaaaagatgatgttaaacaacttttcagttgagtttggtagatcttcatttgtccaactttttaaacaggttacttacattctatggttctcgtctttctacttttacattgcctactctcactaaaagagatgtatagatgtggacacatttaaatcaaaacaaaattacaggcaatgttgaatacaagctgaaatgtttaatatttttctggaagcaggaaaacactatgggtgaatttgtacacaaaaaatggaatgtgcagtatagtgtcttaggaaaaagatcacacttyagaagcaggctatttctgggtgggggaaaggaataaaaccaatcccttggaacagatatagaaaaatgcatgtgcttcaatatttttatatgtttctggtcaatgaattagcagatattacttatcatgtaatatctaatgcagatgagtatgtacctccattagcataaacaatacgttttatttatattgttgcctccactggaaaaaaacaaaataaaaccttgtctcctataaaataaattgataaaggaacaacgccccaaatgtttacaatacgtggctgtatgccccttgatt

SEQ ID NO: 196588 - DNA, 601 bp, Human
accattgaatacagcttattagtaattattcccttaaattactgcatttaatctttggaaacaccaatttttcacaacttttctggtctaaaaatagagatagctgttttatcagtgctctggtttcagtgtagaataaattgtagatatgaatgaaacatctttgcactctatccgttttcctttgtggattctttcttactgttttacaatgctgtaagctgagtccaccttttaggagacatattctttcttaaaacaaaattcatttaattcctcaatatctagcaaggctatccaytttaatgatcttgttaaacgtctatgtgttttttccagttgtttttctcttctgaaaaaacattggcacactttgaagcattttgaaaaatctctgccctcctctcatcttgctaacctttaattatgaaatttcaggttccttgaaatacttaacataacctctcttttcttaggttctccatatcgagacaaaattaccatagcaattcttcagctgcaagaggaaggcaaactgcatatgatgaaggagaaatggtggaggggcaatggttgcccagaagaggaaagcaaagaggcc

SEQ ID NO: 196589 - DNA, 601 bp, Human
actctatccgttttcctttgtggattctttcttactgttttacaatgctgtaagctgagtccaccttttaggagacatattctttcttaaaacaaaattcatttaattcctcaatatctagcaaggctatccattttaatgatcttgttaaacgtctatgtgttttttccagttgtttttctcttctgaaaaaacattggcacactttgaagcattttgaaaaatctctgccctcctctcatcttgctaacctttaattatgaaatttcaggttccttgaaatacttaacataacctctcytttcttaggttctccatatcgagacaaaattaccatagcaattcttcagctgcaagaggaaggcaaactgcatatgatgaaggagaaatggtggaggggcaatggttgcccagaagaggaaagcaaagaggccagtgccctgggggttcagaatattggtggcatcttcattgttctggcagccggcttggtgctttcagtttttgtggcagtgggagaatttttatacaaatccaaaaaaaacgctcaattggaaaaggtaaatgttacttgtttcagtttaaatttaaaacaattttt

SEQ ID NO: 196590 - DNA, 601 bp, Human
aattacagttaattttctacattaatgagtgtgtgaaaatagtatagtttctttttgccatttaatagtattcttaatcagttctttgtttttttgtaccagagtccttctaaaaatatgtataaacttcaaaaatattgaggctattgctatattttgcatttgaatgcagtcatttgtataaatgctttttgtattatccttgaaaagtttgtcacctcattcagattctatatttctagtgctataatttcctcatttttataaatatgatgaagactaggaaaataactctttcagctgctacatgatactttttgtatgcaaattcattgctctggatatgacaaaaccaacagtttaaagtcttctagtacattatttaatcttttgtatgtaaacatctcttttgtttttgaagaaactcacaatattttagacttaactttaaccactgtggcagagtgagatgatataatctttaatatttaagaggtttatgaactttagttggtaaatacaaagagcgaaaaagaggtattttgaaaataatgccatacaggaataccaggtaaatattttttctaatattctttgaagt

SEQ ID NO: 196591 - DNA, 601 bp, Human
ttagcagatgagaccctttcacacctgtccctgtccactgctgtagctttatcttttgctcctctccgatttgcacctttactacagccacactacattttaactctcaatttcccaagtttatactctcccttttgactggagtaaatcttgtctattattttaccttgcaaactctcacaaacattttatattaggcacttaaaatgagacattaacttgcccagaaagctttccctaatcaaaaggtataatgggtttgggcacagagcatagcttgtttctaagaagtggaagtagrttttcatttcctattgcaatgaaaaaaaatgtgactcatatatctcatctttatacttagtttatttcaggtactgtcataatctaaaaacatgtatctccttttgagaaagctgggaaggtattttgctcatttcaaaccattttcagcattaagtctagatatcttcacgctgcgaacccctaagcacatctccattatcccattaacagtattgtattcttgtttgttggcttctgtgtatgggtgccttttcacatattaaattcttcttgctgttaggacaaatacctagtattt

SEQ ID NO: 196592 - DNA, 601 bp, Human
tttcccaagtttatactctcccttttgactggagtaaatcttgtctattattttaccttgcaaactctcacaaacattttatattaggcacttaaaatgagacattaacttgcccagaaagctttccctaatcaaaaggtataatgggtttgggcacagagcatagcttgtttctaagaagtggaagtagattttcatttcctattgcaatgaaaaaaaatgtgactcatatatctcatctttatacttagtttatttcaggtactgtcataatctaaaaacatgtatctccttttgagamagctgggaaggtattttgctcatttcaaaccattttcagcattaagtctagatatcttcacgctgcgaacccctaagcacatctccattatcccattaacagtattgtattcttgtttgttggcttctgtgtatgggtgccttttcacatattaaattcttcttgctgttaggacaaatacctagtattttttgtttgtatctccaaggcctcaattagtgcctggtggcataatatctatctacctatctatctatttgtctatctatttacctacctacctatctacctatcatttaa

SEQ ID NO: 196593 - DNA, 601 bp, Human
taatgcctttttagaaactataagatatctatactttttattaattacatttgatgtaagaaattttagctgaacttaattttacagaagttaaaatttctaagtaaattttcagtgtaaaaattatagctgtaaagcataattatataataatatcatattactttttcttaaaatgcgtttcacagctatattgactaaagttgtgttgattcttgtcagaccttatgtattaattttttaacttgttcttcacaagttaaaaagtataaataaactttggacaaatgtcaattttttwattgtttttatatcactgcctttctttgagagctgagtgtctttcaatttccatgaatgatctatataatgactaattggatgaatttttaaaatgtcttgatatacaaatataaaatactgtactttgaaatgaggtgtcaatcttcattttgcttactgatctacttccaaatcagctaaaggatttttaggtcatttgtttatgataacccatactctttgtatccccacaaataattatttttaattaaaataatagcttaatagataattttaccaccttatttttataaatgac

SEQ ID NO: 196594 - DNA, 601 bp, Human
tctagctataaaactacagtgattgatcagtaggatcacgaaagatgctacatgtaaagtttcttttgactgctgaatagcttatgtaaataataaaacttttttttaaagatagctgctctaaaaccaaatatcaagaacaaggttgtatatatttttttaacatgagtgatttagccagtcattttccatctttcattgcttcactgttatattcatatagccttaggtcaattcatacttctgatgtatagcattaactgtttgatgtttttaaaaggctgccaatcaaaacagttayattcacaagaaaaaatttaacgggtcacattaaatgacatttatttttgttatttaacacaccaatattatgtaaaatattatatcttatatcctatgaatattttttccattttagttattattattatctaatgtggtagaataattttctgcaactaatcacagtgactgttttgatttgtttccactacatgtgacttactattcttgggcaaatggcctatagagtcagaaattaattggagagtgtctaagaatatatagtatatccataattagttaacaaataatttaaatg

SEQ ID NO: 196595 - DNA, 601 bp, Human
tagtgattttaaaagcaagatagttgtctttctctttcttcttccctccagctttccctttcttcttctcctccttctcctccctctccttctccttctcttctccttctcctccttctcctctccttctcctcctccttcctttcctttcctttctttcctttcctctttccttccttccttctttctttctttctttctttcctttctctctctctctctccctccctcctttctttctttctctctttctctgtccatctttctttctctctttccctctctctctttctttctccayttcttttcttctttcttctttttttagtataaccaggaaaattactgcctagtgcacttgggttttgagacttatttcatagtccaataaaaagatttaaaataaatttcaatcattatataaagtataaaagacaatttgtctctatttaatgataatacgttagaattttacttaaaagttagacacagtaaattttgggcaatgtacagcacagggaaacaattatatttcacaaaactctgtatagtttcagctttagagacttatataaatcaagatatggaatttgccttgtaa

SEQ ID NO: 196596 - DNA, 601 bp, Human
ttcctttctttcctttcctctttccttccttccttctttctttctttctttctttcctttctctctctctctctccctccctcctttctttctttctctctttctctgtccatctttctttctctctttccctctctctctttctttctccatttcttttcttctttcttctttttttagtataaccaggaaaattactgcctagtgcacttgggttttgagacttatttcatagtccaataaaaagatttaaaataaatttcaatcattatataaagtataaaagacaatttgtctctayttaatgataatacgttagaattttacttaaaagttagacacagtaaattttgggcaatgtacagcacagggaaacaattatatttcacaaaactctgtatagtttcagctttagagacttatataaatcaagatatggaatttgccttgtaaacctttaaacaaaaagaaaagaatgtatatttgctctagtaccataaatgaacagttctttgtgatatccttgaatttgtttaatttgccatgttaattgtaaaatcttgctcaaatctaaagattatcaagttttaaaatgggttag

SEQ ID NO: 196597 - DNA, 601 bp, Human
gagctggcaaaattcatcttattcaaagagaaaattaataaaatttgtattttgtcattatgtaatcgagaccattgattgacttatgaaagattgcttgattaaatttttactttctaatggctttgtaagctaaataaagtctatgacgacaatggtgatttacatgtttacaattttgagatagttgtaaaatttgtaaatataatttatttaagacaatttcaaattataaaagataatactattctggtaattgattagaatgggcttttttcaatttacattatctattactcarcaatataaacttaatattatatgaaattgcttaaaatggttttaaatgttcttatttgtagtctgaagtaagtatggggtactaaacacagagtttacctcttaaattgctagaaataatattgagtcatttcatagttgagcttgtatgcacatgtgtaagattttttcctaagaaagttagttacttagcctactcccttactataggcaaattattaattaacatttatactctattctgttttgaaagtaatgtaaccaaaatatctgaaaattgagattgccaagaagaaggtgt

SEQ ID NO: 196598 - DNA, 601 bp, Human
caaacgattcaatgttacacgtcctataacaattttaaatgtcaacgggatcaagttttgaccatgttatgtcatctaattaattcttctgttaaatgtttcaacagagagccaagactaagttacctcaagactatgtattcctccctattttggagtcagtttccatttctacagtgttgtcatcatcaccatcttcatcatcattatcatcatgttcttaataagtacatctaatagtaggtattaagcaacaagaaacactgtttccatatactggctgtcaggtgccacataaatyctttaatagaaatataattcatgaattgcagaactgcataatttaacacataatacataatgcatggcaatgactctgtagttaatggggaattcacaagtcacatttaatcatcacccattacaagtgctaatatattaatatttttattaatttaatgttattaaacaaatgctaaagttttgcctaattttattaggcaaaattaattgtatgcaatatattttcactaggtttctaaacctgaaaattttttaagcaattgaattagaaacattgttaaataagaattaaaatatt

SEQ ID NO: 196599 - DNA, 601 bp, Human
gacttgtttcctaaaggagaaaatgctattaataattgatattttaaaaatagattatccgggtaattgtgaacctttacagaagagtggcgtagacgtagaattaggaagaccattaaggaaactctttaaggagtccatcaaaggaaaattaggatatagccagagattgacaggaaggtaatagagcagtgtcaaaatcataaaactagatatatcaggatatgttgctggaatcttaggtgtgaactgtagaaagttatccaacctctctctgaatcagttttctctgacacacagwtacctaattaattcaaagtatgtttagactggcacaaactattatgaaaacaattttttaaatgtatttttaagttaacatataaaattgtatgtatatatcatatataacgtgttttgatgtatatatacattgtggaatggttagatatgtctaattagcaaatgcattacctcacatatttattatttttgcaatgagaacacttattcactcttttagcacttttcaataatatattattattaactatagtggccatgctgtggaacagagctcttgaaatttttcttcctgcct

SEQ ID NO: 196600 - DNA, 601 bp, Human
ttttaaaaatagattatccgggtaattgtgaacctttacagaagagtggcgtagacgtagaattaggaagaccattaaggaaactctttaaggagtccatcaaaggaaaattaggatatagccagagattgacaggaaggtaatagagcagtgtcaaaatcataaaactagatatatcaggatatgttgctggaatcttaggtgtgaactgtagaaagttatccaacctctctctgaatcagttttctctgacacacagttacctaattaattcaaagtatgtttagactggcacaaactrttatgaaaacaattttttaaatgtatttttaagttaacatataaaattgtatgtatatatcatatataacgtgttttgatgtatatatacattgtggaatggttagatatgtctaattagcaaatgcattacctcacatatttattatttttgcaatgagaacacttattcactcttttagcacttttcaataatatattattattaactatagtggccatgctgtggaacagagctcttgaaatttttcttcctgcctaactgtaaatatgtatcggaaaatgacacacatatggtctt

SEQ ID NO: 196601 - DNA, 601 bp, Human
ttttagcacttttcaataatatattattattaactatagtggccatgctgtggaacagagctcttgaaatttttcttcctgcctaactgtaaatatgtatcggaaaatgacacacatatggtcttaaatattttcatcatgttgtcttagaaatagtctaagttcataatcaataaagcagctaacgcacaaataagtcttcacatgtatctcaatcagttggggagagacactaacaaaattttgtttcatatatatgactctacaatataaattttgaggagctgtaacaataagcccsagataaacagaggttctagcaaatctatttccaatgagatgggaactaagacaaaagcaacatagggtcatattttttctcatttgataaattatcagctctcagttatcaagctaatgatgacaaaaaagttaatatttgtttgtagatgtctaacatgctataatttgtcatttcatgattaagtcatatttgtttgtaatcactgtcaatgtttctataggcataatcacaaaaaagacataatgaaatgccagaaattgttttccatattttatgtctgtgtgagtgctatctttg

SEQ ID NO: 196602 - DNA, 601 bp, Human
atgccagaaattgttttccatattttatgtctgtgtgagtgctatctttgttttgagatgtacaatgaagaatcaatgttcaaacaacatttgcatatctcatcttgtgatctgaaaagtagtatgatttgtctatttttttgtatcaagaatgggtttctggtatagaattgtcattgtatttaaattttaaagtagatgtctatgtcatgctaatcatttttatataatgtcataggaaaattttatttaatatatgtgtaatatatacattactagctggttgttcatttcagtatcgggtggagattttctttaaactagcccacttttatagaatattttaattatcatgggttgagtgtttaaagtgtgacatttgttataacttttacaatgaaaattttcaaaccttcaaggatgttatgtgacaagtctgttgaggatgattttaatattgatcttggacagttacagtttatgtatcttgtaatatttaatttttctgtgttcttctgtagaggtccttctgtagtgccatggtagaagaattgaggatgtccctgaagtgccagcgtcggttaaaacataagccacaggc

SEQ ID NO: 196603 - DNA, 601 bp, Human; identical to SEQ ID NO: 40617

SEQ ID NO: 196604 - DNA, 601 bp, Human; identical to SEQ ID NO: 34417

SEQ ID NO: 196605 - DNA, 601 bp, Human; identical to SEQ ID NO: 34418

SEQ ID NO: 196606 - DNA, 601 bp, Human; identical to SEQ ID NO: 34419

SEQ ID NO: 196607 - DNA, 601 bp, Human; identical to SEQ ID NO: 34420

SEQ ID NO: 196608 - DNA, 601 bp, Human; identical to SEQ ID NO: 34421

SEQ ID NO: 196609 - DNA, 601 bp, Human; identical to SEQ ID NO: 34422

SEQ ID NO: 196610 - DNA, 601 bp, Human; identical to SEQ ID NO: 34423

SEQ ID NO: 196611 - DNA, 601 bp, Human
gatgatcaagctgatcacattataaaactatttaaagtgagtgtatcaaaaggggataaaggtaaagagagagatgaggccgggcacagtggctcatgcctgtaatcctatcactttgggaggctgaggtgggcggatcacctgaggtcaggagtttgagaccagcctggccaacatggcgaaaccccgtctctactaaaaatacaaaaattagctgggcgcagtggtgcatgcctgtaatcccagctactcgggaggctaaggcaggagaattgcttgaacccaggaggtggaggttgcrgtgagccaagattgcgccattgcactccagcctgggtgacaaagcaagactccatctcaaaaaaagagagagagatgagtatgcatctgtggtagactgaataatggttccccccaaaagatatccatgtcctaatatctggaacctgtgaatggtgcctcatattgcaaaaagcacttcgctgatgtaattaaatatcttgatattatcctggaatatttgggtggacctaaatgtaatgacatgtatcctaatgagagggagacagaaggaaacttgatgacagaaaaggagaaggca

SEQ ID NO: 196612 - DNA, 601 bp, Human
cacattataaaactatttaaagtgagtgtatcaaaaggggataaaggtaaagagagagatgaggccgggcacagtggctcatgcctgtaatcctatcactttgggaggctgaggtgggcggatcacctgaggtcaggagtttgagaccagcctggccaacatggcgaaaccccgtctctactaaaaatacaaaaattagctgggcgcagtggtgcatgcctgtaatcccagctactcgggaggctaaggcaggagaattgcttgaacccaggaggtggaggttgcagtgagccaagattgygccattgcactccagcctgggtgacaaagcaagactccatctcaaaaaaagagagagagatgagtatgcatctgtggtagactgaataatggttccccccaaaagatatccatgtcctaatatctggaacctgtgaatggtgcctcatattgcaaaaagcacttcgctgatgtaattaaatatcttgatattatcctggaatatttgggtggacctaaatgtaatgacatgtatcctaatgagagggagacagaaggaaacttgatgacagaaaaggagaaggcagtgtgaccacagagg

SEQ ID NO: 196613 - DNA, 601 bp, Human
ggataaaggtaaagagagagatgaggccgggcacagtggctcatgcctgtaatcctatcactttgggaggctgaggtgggcggatcacctgaggtcaggagtttgagaccagcctggccaacatggcgaaaccccgtctctactaaaaatacaaaaattagctgggcgcagtggtgcatgcctgtaatcccagctactcgggaggctaaggcaggagaattgcttgaacccaggaggtggaggttgcagtgagccaagattgcgccattgcactccagcctgggtgacaaagcaagactcyatctcaaaaaaagagagagagatgagtatgcatctgtggtagactgaataatggttccccccaaaagatatccatgtcctaatatctggaacctgtgaatggtgcctcatattgcaaaaagcacttcgctgatgtaattaaatatcttgatattatcctggaatatttgggtggacctaaatgtaatgacatgtatcctaatgagagggagacagaaggaaacttgatgacagaaaaggagaaggcagtgtgaccacagaggcagatgtgatatggccagaagccaaagaatgcttactc

SEQ ID NO: 196614 - DNA, 601 bp, Human
catgtgggatggacatgaatctttgagggccttaagaaaattatattttaggcttgttctgtttccgagcattcctcatttaagggcattgaaacttcaccattgatttttttaaagattaaatcccattttgtcactaaatcatatttataaaattgaaagttaattcttatagcaaaatctcttttctttgcacttattaatccagcaagttttagtaaattatatctgatatactgttggtaatactgtgctagacacaagtatggaaaatgaaatatattacttcatactgtatgtyataactttcctctgcagaagtagcagttcctaaagaattaacaattaaaccaactttttcagggctttaaactgattttaactgttgactttacctcttttgccacccctatgccccatctatatttttggttaaaacctcctctcattactggaactgacttacttggcccttttttattatttaaattttgagggatttgttatatttaaaggttttgcccaaagtcatacaactagtaaataatcagtattgtactaggagatgattatttagtgttattatgcataatatataata

SEQ ID NO: 196615 - DNA, 601 bp, Human
ctcatctctaccaaaagtgcaaaaattagccaggtgttgtggtgcgtgcttgtggtcctagctactcaggagggtgaggcaggagaatcacttgaactcgggaagtggaggttgcaggaagccgagttcgcgccactgtactccagcttgggtgacagagcaagactctgtctcaaaaaacgaaaacaaaagctaggcatgatggcatgctcctgtagtcccagctacttggaaggctgagacagaaggatctcttgagcccaggaggtcaaggctgcagtaagctatggttacactactrcattccagcctaggtgacagagcaagactcttgtcttaaaaacaaaaacctcctgccttttcttgggggtaatttcattgccttttagtgaagtagtgggtaactaagattgttgtcttgctaattgctagcatttctgggaaaagtttggtacaggaagttgaaatagatggataaagtttgtattaactgtgaatttcagttattttatcctagtgtcccactaattggattgaatttgagaggatatgagagcagattttaaaaattttatggagtgtttagcctctttctaggaaa

SEQ ID NO: 196616 - DNA, 601 bp, Human
tacttgaaacttagagtttctgagaagtctttgaagtagatttgatacaagatatgtaaagtgatttgcaatgccttcttgagaagacaggacataaggaaagtttttaaaagttaaaattatacatgctatgaaagtcttaaagtgatttttaaactgatagattataaatccctttttaaaagtagtttttcttggctttttaaaaaccttaactaacatactatactgttttactcatcactactttggattttaattgctacacaacacatctattacagctatccctcattatgayagtttccttgatagctgttgaaattgtactgatactataaaatatgcttacgatggcctcttcatgttagcaatttcaaggaaaaatatttatcaaatagtactttaaaaataagcaaaaactgtcctatgaaatgcagtttatttgatctagagtgtgaatgagttgcaaggactgatgtacatattagaaataaactgttgggcaaaatgctgaagagctatattttcaataataggtcttttttatacctataaacaaattatatataaatgttggtggtaccagagcattgaaaat

SEQ ID NO: 196617 - DNA, 601 bp, Human
ttgcaatgccttcttgagaagacaggacataaggaaagtttttaaaagttaaaattatacatgctatgaaagtcttaaagtgatttttaaactgatagattataaatccctttttaaaagtagtttttcttggctttttaaaaaccttaactaacatactatactgttttactcatcactactttggattttaattgctacacaacacatctattacagctatccctcattatgacagtttccttgatagctgttgaaattgtactgatactataaaatatgcttacgatggcctcttcaygttagcaatttcaaggaaaaatatttatcaaatagtactttaaaaataagcaaaaactgtcctatgaaatgcagtttatttgatctagagtgtgaatgagttgcaaggactgatgtacatattagaaataaactgttgggcaaaatgctgaagagctatattttcaataataggtcttttttatacctataaacaaattatatataaatgttggtggtaccagagcattgaaaataaaacttgtttgtgataaacgtcatcactggttctctatcctgaaatgtaactgaatcataataa

SEQ ID NO: 196618 - DNA, 601 bp, Human
agcaatactttattgtaagacttcatcaaatattcatggttaaagagaagtagtaaatgtattcaatcaagtggtcttttgggattttgaaaaggattatgaagtctgctcagctgataacattgatagaggttgtttaacaagggtaattttaatctccgagtttagttttgttgtccagtcttgtctcttttttactgtcacaaatccaggtctgtaagaattgtgtcacattctaaggataaaagaatgatatatccattcatataatttatgttatttcctaaatatgtatatttttaagttatcatcttagtttgagtttggcatatgagggaattgtgacccatctagttgtgagattgctattcatttggtcagactctagtctcatctcaccactgctggtgatcttttcatgtcttggataatatgatttctttgacacatataaaataataagcaaccttttgccttggccagttcagactgtcatgaaggggtatagtcagctgtttctgcataatggaaatgtccatagcattgcccttattattgtacttggtatcaggtcacctgccttctcttatttacttttata

SEQ ID NO: 196619 - DNA, 601 bp, Human
aaatctcagtgaagagtcatcaataatggtagcctttattcattggtgttattcattagaaactgaagtctctaaaaagaaaagactaaacatgctaaaggacttctgaatttgacaactgggtattggcctttattttcagcattaacatttctcagcatttaaaaatactaaaaatgccttatcagctgttctcattaagatatttatttctcctagatttccatacccagtccttaaaaaacaaaactgcagatttttctactcttctgtcatttagttgcctgtttctccattattrtgtgtgcttttttagctttgtggttcttttgcaggctctggatctccatttgcaatccagaatattctttatattgagatggccttttgcttacttgacagatagccagatctaataataattgaaacttcctgtagatggcctaagttatatcttacttccaatggatgggtgtttgtggtataattgccacccattttcatttttttgcactcaattttaaggtaaaatactggcagacaattccttgtataccatctgccttttgaagatactattctcttaagatgtacagcattt

SEQ ID NO: 196620 - DNA, 601 bp, Human
tagaagttacttaaaatttcactcagctggttacagtggctcatgcctgtaatcccagaagtttgggaggctgagctggagggttgcttgagctcaggggttcaagaccagcctgggcaacatagggagattcccgtctctataaaaaaattttttttaattagctggatatggtgtcacacacctatggtcccagccagctacttgggggactgagatgagaggatcgttagagcccaggaggtcaaggctgcagtgagctgtgattgcgctattgcactccagctagggggacagagcragaccctgtcttaaaaaatacacacacactttgggaggtcgaggcaggtggatcacgaggtcaagagatcgagaccatcctggctagcatggtgaaaccctgtctctactaaaaatacaaaaaattagccaggcgtggtggcatgcacttgtagtcccagctactcgggaggctgaggcaggagaatcacttgaacctgtgagccgagatcctgccactgcaccccaccctggtgacagagtgagactctgtctcaaaaaaacacacagattcacacacacatacacacacacagccata

SEQ ID NO: 196621 - DNA, 601 bp, Human
agctgtcctggcaccatttgttgaacggagtgtctttcctcattgaattgccttggtacttttcttgaaaatcagttgaccataaatgtgaaggtttattaccgggctctctaatgatctatacttctacccttatgccactaccaagccgtcatgattaggttgatatagctttatattttttatttatttatttatttttaaaacgataatgtcaagtttagcctgtcaaatatacgagttgaatttgtggaacatattttgcctgtgtgctgcaaggtaaacagaagtttcttgaaaygctcgatggtgtagggttaaaaatgggtcctagccctggccaggcaggtgggaatgggacaaagaagggtagagatggaggcttcagagtggactggctgggcttgggccatgaccctcaaggacacaggagtacagggtcccaaagggcagcccctttctgagtgagcacccaagcaacacacataggggctgcatgttgcaaactcatcagtgctcaacccctggcacaaccaccccctactgtgtaatgtacctgacaaaaccctactttctaaggcactcctcccaggcccccgac

SEQ ID NO: 196622 - DNA, 601 bp, Human
tgtttcatggaatttaccagtaaagccatctggttgtagacttgtctttgtgggaagatttttagttggtaattaaatgtctctgttatagtcagttcacatagtcatttactttttgagtcattttggtaatttctttctaaaagctgtctgtttcatctaaattgtctcatttgttggcataaagttcatggcatattcccttttaattcttgtgatttttgtaaagttggtaggaatatcccttctttcatgcctgattttggtaaatgttgttttctctcttttttttcagtcattctaactaaaagtttgtcaattcatcgatcatttcaaagaaccaactttgtgtttatgtgaacttgtctatttttgttttctttttcattgatttctactctattattattattgcttcttattactttgggtttaatttgcccttccttatctagttaagagtgactcttaggttatattgatttgatgtcttttttcttttcttcttttagacagagtctcgctctgtcacccaggctggagtgcagtggtagaacctccacctcccaggctcaagcgattctcaggcctcagcctcctg

SEQ ID NO: 196623 - DNA, 601 bp, Human
aaaaaaagccgggagcggtggctcacgcctgtaattccagcactttgggaggctgaggcaggcggatcatgaggtcaggagatcgagaccatcctggctaacatggtgaaaccccatctctactaaaaatacaaaaaattagccaggcgtggtggtgagtgcctgtagtcccagctacttgggaggctgaggcaggaggatggcatgaacctgggaggcagagtttgcggtgaaccaagattgcgccactgcactccagcctaggcaacagagcaagactccgtctcaaaaagaaaaaaacaacaaacatattttgtatgactttggtcctttttcatttatttatgtgattttatatttaatttttgcatgaccttccagtgaacctttttcatttattctgtttgtctatttatctacctatgtagctatcttttgagacagagtcttgctctgtcgcccacattggagtgcagtaccacaatcatggctcactgcagccttaacctcctggcctcaagtgatcctcctgcgtcagcctcccaagtcgttgggcctacaggtgcacgccaccacacccagctaatttttactttttttg

SEQ ID NO: 196624 - DNA, 601 bp, Human
tgcagtaccacaatcatggctcactgcagccttaacctcctggcctcaagtgatcctcctgcgtcagcctcccaagtcgttgggcctacaggtgcacgccaccacacccagctaatttttactttttttgtagaaacgaggttttgccatgttgcccaggctggtctggaactcctgggctcaagcaatgcccccatcttggcctcccaaagtgctaagatcacaggtgtgagccatcatgcccagccctttttcatttattgagttttgttttctgttcaagcttagaggtcagcaaactttttttttttttttttttaaggataggttgtattttatgctttgcaagctacacacagtctctgttgcatactcttggtttttgttgttgttttggttgttttaaacaaccctttagaaaccattcttagttcacataccatacaaaaaaaggccacaggcaagattggcccatgggccatcatagtttattgatccctggcttaacattaagtctttcctggatgactgttccttgtacacttgtaaagaacatgtattttgctgttattgagtacaatgttctgtaaatatcagttgg

SEQ ID NO: 196625 - DNA, 392 bp, Human
ccttcttttgtgttaaataatattttctattgaaccatttcaattcctttgtggttttttaaattttttttaagttattttcttaggctggkttcagtgactaatgcctataatcccagtactttgggaggccaaggaggaaggatcacttgaggccaggagtttcagaccagtctaggcaacatagcaagaccctatctctttaccaaaaaaaaaaaaaaaagaattagcagagtgtggtggcacacacctgtagtcctagctactcaataggattacattttttttttctttcttttttttttttggaggcagggttttactcctgttgcccaggctggagtgcaaaggtgtgacctgggcttactgcaacctccgcctcccaagttcaa

SEQ ID NO: 196626 - DNA, 393 bp, Human
ccttcttttgtgttaaataatattttctattgaaccatttcaattcctttgtggttttttaaattttttttaagttattttcttaggctgggytcagtgactaatgcctataatcccagtactttgggaggccaaggaggaaggatcacttgaggccaggagtttcagaccagtctaggcaacatagcaagaccctatctctttaccaaaaaaaaaaaaaaaagaattagcagagtgtggtggcacacacctgtagtcctagctactcaataggattacattttttttttctttcttttttttttttggaggcagggttttactcctgttgcccaggctggagtgcaaaggtgtgacctgggcttactgcaacctccgcctcccaagttcaag

SEQ ID NO: 196627 - DNA, 601 bp, Human
ctgtaattgtcttttaaattagttgaaagaagaaaagagaaaaaataatctaacttttatatatatttttatgagtattcttaatttcttcatgtagatttcagtggtactatgttcttttagcctgaaggagttctttaatacttcttttgggcaggtcagctagcaccagatttcctcagtctttggttttctgggaatatctttatttcacctttattttgaaggatagttttgctggatacagaattcttggttgataggtttttttttctcctgttggtactttgaatatgtcatsccactgacttctgacctccttggtttctaatgagtcatttttctcttgctgctttaaagattttctgtttctctcacttttgacagtttgattatgacatgtttgggtgtagatctctttatgtttttcctagttgaagtttgagcttcctagatgtgttgaccagtgtttttcatcaaatttgggaagtttttgaccattatttcttcaagtattttttctgttccttcctttcctctcttatatgcttgaacaattttaatatagggtggtgtcagagttcagtttatattttataac

SEQ ID NO: 196628 - DNA, 601 bp, Human
gcctgggcaacatggtgaaaccctgtctctacaaaaaatacaaaaattagccgagtgtggtggcgggagcctgtagtactagctactagggaggctgaaataggaggatcacctgatcctgggaggttgaggctgtggtgagccatgatcatgccactacactccagcttgagtgacagagtgagactctgtctcaaagaaaaaaaaaagtttaaatttgaaatgggtagcttttgattcacaaatattaatacaaatgtctttgcaaaaggattggatttattattttgacaaagataayagttttatttataaggaataatcctttcatgttgtaacttttgtatgtgtaattttttaaattacacattaaaaattttgtatttttttatgtgtaattaattttgtatgtgtaattttttttaatttgtcttcctagcctagcatatatgttgagattgcaaaagatgaagaaattatattgagtatcagggaaatgttaatattattctgctttatttatttagcggaagatccatccaaaagctatgtgaaattacgagactttgtgcttgtgaagctttgtcaagatttgccctgt

SEQ ID NO: 196629 - DNA, 601 bp, Human
aggcggaggttgcagtgagctgagatggtgccactgcactccagcctgggcgaccgagcgagactccatctcaaaaaaaaaagaaatttgtgtaggccgggcgaggtggctcacgcctgtaatcccagcactttgggtggatcacgaggtcaggagttcgagaccagcctgtccaatatggtgaaaccatgtctctactacaaatacgaaaattagctgggcgtggtggcgcgtgcctgtaatcccagctactcaggaggctgaggcagaagaatcgcttaaacctgggaggcggaggttrcagtgagccgagatcatgccactacactccagcctgggcaacagagagagacttcatcttaaaaaaaaaaaaaagaaaagaaatttgtttaatagctcagcttttaaaagaacaggcatatgaatatatatatatatattttttttttaatggtgctttcttaaaaaaagaattcaaactccctacctagagcacaaagagcccatgataatctggaccctgcctaccttgctagcttcagcctgttagtactttgccacatgctctggctactttgccacatgctctggctttactcat

SEQ ID NO: 196630 - DNA, 601 bp, Human
cagcctcaacctcctgggctcaaatgactctcccacctcagcctcccaagtagctgggactgcaggggtacgccaccacacctggctaatttttgtagagacagggttcctacaggctgttctcaaactgctaggctcaagcgatctgcccaccttggcctcccaaagtgctggaactacaggcatgagccaccatgtccagccctgtctgctttttaactgtcactgtactagcaggtttctgacctttctccttttatcactgtatatgctttcctcaggtgaccttaaccagccttayggttttaactcttacctatatactgacattgcttaaatccttgcccttagactagaattttcttcagattttctattttctgctgcctcccaaatctctcctaggctgtgaaaactcacattttcacatccttctctcagtttttcctctcatatgtttctagagtccttgaccccttggtcttcttgtgctgttccagttcatgccctcatcgttttttatgtgatgtaataactcagcttcttgattggtctctatgcacttctttttgctaccatttctttgtagctgaaagagtga

SEQ ID NO: 196631 - DNA, 601 bp, Human
ggcaaggcgtggtggctcatgcctgtaatcccagcactttgggaggccgaggtgggcaggtcaccagagctcaggagttcaagaccagcctggccaacatggcaaaacctcgcctctactaaaaatacaaaaattagttgggtgtggtggtgggtacctgtaatcccagctacttgggaggctgaggcaagggcatcacttgaactcgggaggcagaggttgcagtgagctgagatcataccactgcaatccaggctgggcaatggagcaagactccatctcaaaaaaaaaaaaaaaattwaaaaaaaaaaaaaggccaggtgcggtggttcacgtctataatcccagcaatttgggaggctgaggcgggcagatcatctgaggtcaggagttcgagaccagcctggccaacatggtgaaaccctgtgtctactaaaaatacacaaattagccaggcatggtgggaggtgcctgtaatcccagcttctccggaggctgaggcaggagaattgcttgaacctgggaggcagaggttgcagtgagccaagattgcgccattgtactccagcctgggtgacgagcaaaattccatctcaaaaaa

SEQ ID NO: 196632 - DNA, 601 bp, Human
ggctcatgcctgtaatcccagcactttgggaggccgaggtgggcaggtcaccagagctcaggagttcaagaccagcctggccaacatggcaaaacctcgcctctactaaaaatacaaaaattagttgggtgtggtggtgggtacctgtaatcccagctacttgggaggctgaggcaagggcatcacttgaactcgggaggcagaggttgcagtgagctgagatcataccactgcaatccaggctgggcaatggagcaagactccatctcaaaaaaaaaaaaaaaatttaaaaaaaaaaaaaggccaggtgcggtggttcacgtctataatcccagcaatttgggaggctgaggcgggcagatcatctgaggtcaggagttcgagaccagcctggccaacatggtgaaaccctgtgtctactaaaaatacacaaattagccaggcatggtgggaggtgcctgtaatcccagcttctccggaggctgaggcaggagaattgcttgaacctgggaggcagaggttgcagtgagccaagattgcgccattgtactccagcctgggtgacgagcaaaattccatctcaaaaaagaagaaaatttgt

SEQ ID NO: 196633 - DNA, 601 bp, Human
gcctgtaatcccagcttctccggaggctgaggcaggagaattgcttgaacctgggaggcagaggttgcagtgagccaagattgcgccattgtactccagcctgggtgacgagcaaaattccatctcaaaaaagaagaaaatttgtcatctagttgcagctgagtagtgggatgattggcagaatatttaatttattcaacatataattattgagtacagttgctcaatgataaaatgttgttgctgcatttatatatactatacctatagggttatacatcacaatagctgggaacataartgaccaagttgattctacattacaatttgagaaagtaaattaactaactgtatcaggtacacatagttttggttttcctttgtaaatttaaagaaaatttaagttttatttgccatggattctgctttatagagccagtcttgaatgctgatggttcattggctgacactacttgctgaatcccaacttttccttcatagcatctttttactttgcagtgcaactgtatttcctaatttgtcattgtaattctgttcacattctgaatataaaattattatttgcctatgactaaatcat

SEQ ID NO: 196634 - DNA, 601 bp, Human
gtaaagcaacttcactactggtatgctgccaaattttgtaagatagctgtttattacttttctttaggttttcatacacaaacacacacacacacacaaacacacacacaaacacgagagacagagtcttgctctgttgcccaagctggagtgcagtggtacaatcatggctcactgcagcctagacctcctgggctcaagtgatcctcctacctcagcctccccagtagctaggactacaggcacatgccaccacacagggttaatttttgtatttttttgtagagatgggttttgccaygttgcccaggctggtcttgaacttctgggctccagtgatccttccgccgatgtgctgggattacaggcatgagccactgcccccagcctaggttttcttttagatagaaccaaaatatggtcctttcaaagtctgtgtgaattatgaatcagaataaaatgaaaaagaaaatttaataccctattcaataaatataattaaaaagtattatcctgtgtattttgaatctctgaaataactatagaatccaaagaaatagtgaaaaatttaaacagtactcagagctttatcctaaagtca

SEQ ID NO: 196635 - DNA, 601 bp, Human
taggaatggctttataatggtatacgctcaacctgaaattcctgtgagaaaaaggcatatagaagtcaatctgcatactagaatatcaaacaaagtgcatttgtacttaggaaggggctactgaatcacacaatggaaaactacaaacaggagtaggcttgtgcagcattagattagtttttaacgtgaatcaaagtatgtttcctataatttaagtaaaagcctgatatggttagactaggacaaggacttaaatcatagctttcaaagcaagacagacaggtggtaggaggaaaatatytcaatggtttatagcaaaaagaaattactactaggttaaaagaaaaacttataaatttacaccaaaagatgtaatctgtggtttttaatgctaccagaggagaaactgtgtggttattagacatctgcctttgttttgccaaatattattttttgccaaatattatttgccaaaataatatgacagacataagcagttttcttaagcttcagaattttgtaatgtgaggtttaaattgttatatattcagattaaattaattaaggcttacaattaacttctaatacatttacactatgt

SEQ ID NO: 196636 - DNA, 601 bp, Human
ggccaatttcactctaaaataccatcaacctctcaactctacacatactactatttatgccttccacactttttctatagtacaggaatagatacctaaagattgaacaatggagccacacattccagtttcatcaacactctgctctctggggtgtgcagggctttttacaaaacatacccaacatttcttcttgccttcactctttcagaaaacatctgttgataagacttgagtcacgtaagagaacagacagaagtcattttaacatctaatcagacactaccaaaatctagttatyaaaagtagtcatgggccaggtgcggtggcccacacctgtaatcccagcattttgggaggctgaggtgggaggatctgttgagctcaggagttggagaccctgtctccgcaaataattaaaaaattagccaggtgaagaggcctgtgcctgtagtttcagctactcgggaggctgaggaagattgcttgagcccaggaggtcaaggctgcagtgagctgtgactgtgccactgcattcagttctcttagaaaaaaaaaaaaaggagtcatttttccccactgtttggtgtaaaaggttgtt

SEQ ID NO: 196637 - DNA, 601 bp, Human
tgcataagtagcaagaagcctaatgttaatccccaaggccatcgagaaaatgtctccaggccatgtcagagacattcacgccagcgcttcccatcacaggcccggaggcctaggaggaaaaagtggttttgtggccaggcccagggtccccgtgctgtgtgcagcctagggacttggtgccttgcgtcccagctgctccagctgtgactgaaagaggccaacatatagctcaggctgtggcttcggagggtggaagtcacaagccttggcagcttccacatggtgttgagcctatgggtgygcagaagtcaagaattgagatttgggaacctctgcttagatttcagaagatgtatggaaatgcctggatgcccaggcaaaagtttgctgcaggggcagggccctcatggagaacctctgctaggccagtgtggaaggaaaatgtgaggtcggagccctcacacaagtccctactggggcactgcctggtagagctgtgagaagagggccaccatcctccagactccagaatggtagatctgctgacaacttctggaaaagctgcagacatttgatggcagcctgtgaaagcagctgagag

SEQ ID NO: 196638 - DNA, 601 bp, Human
cgtctggaactctggttagagaaatgttggaccatctcactttatccttcatgtttcttaatatctcatctggcaacacttctggcggagaagggcagttctgtttttactaacagatcccggaagcagctacacgtccaaattgggaaagaacttttcctcacatcaaggctggcctgggctgtgctcctggaaaactccctgcatgaaatcacaactaagtaggctttgacaaaaagaaattttagtcagagtactcagtaggaagacaaaaccggagcgcatgcatcctcagctagtmcccaggtcttgggcacctcacaaacctctgcagtctcagtatcgaaacggcaaactgctgggagacttaggaggagtacaacagcaattttgcgcaaactgtggctactattaatatgtcagctaatagagtatgcagtgaaaactgcgccagcactgccactactagctgtgcaaatgggtcagtcgcctatgaaacagggatgataagggaacagtgcttgtgactaaatgaagtaaagcaggtagagtttaacagtgactgatagcactgactaaaaaaattacacacacacacaag

SEQ ID NO: 196639 - DNA, 601 bp, Human
tgtgactaaatttattattttctttacctctgccatgaaatttttttagagataaaagctgaaactatagcatgtaagattaactgatgaaatgtattagattacagaaagaggttgtagaataccacttcctgacaatctgcatatatgggataccagatgacttctcaaattggcatgtctgcaaaagtttgggtaggtatgcatttgtaactgggatggagatcaagtcttaacactgtgagcagtaagcacatatagggtttatgctgggtagagctccagagatcagatgtcccasatctctccagaacgacatgtgcatttatcagaatacaatgccccaaattttggttgagaaaatgtagccacgatagaagataagctgtcttctgtcgtcaatactaggcactgacttcatccttctccagatagaagcaggacagtggtctaaagtcttggccagcacgaggagctctatcaacatttcattatttatatgagaaagtcagcaagctcctgcttctgtaacttcctaattcattgatctttgggcaggatagcgtagagactagatcatggcctacctatagatgtgtaa

SEQ ID NO: 196640 - DNA, 601 bp, Human
actcttggcatttcccaaatcatccagaaacttattgaccacctcatcaataatccttgtggcatgctttagggattcttgctgctgggggtttctaattgtttctactgacacttcaacggtgagagttcttcccatcaaacggtttgcagtcagatttaattcttctctttctcctaaaaatcaatatgagatgtaaacttatctgtgtcaaaaacattaaggcatttgtttgtgactaaatttattattttctttacctctgccatgaaatttttttagagataaaagctgaaactayagcatgtaagattaactgatgaaatgtattagattacagaaagaggttgtagaataccacttcctgacaatctgcatatatgggataccagatgacttctcaaattggcatgtctgcaaaagtttgggtaggtatgcatttgtaactgggatggagatcaagtcttaacactgtgagcagtaagcacatatagggtttatgctgggtagagctccagagatcagatgtcccagatctctccagaacgacatgtgcatttatcagaatacaatgccccaaattttggttgagaaaatgtag

SEQ ID NO: 196641 - DNA, 601 bp, Human
tctatggcccacttcacaattccctgaattcctcacatccagagaaaattagacctgctaggtcactcacaaaggtcagaaggaaaataacccatgggaattaatcccagtggtaggatttcatggcacccaaatttttaaattttaaaagcataaatgtaggctttttcttctgaaaatggaccatgcctgagacctcagaaccaagtgcagtcagtggcttcttccactcctgagtaaggccagactttctgaaaacgcccccacactgaccttcattttacttgtattttttttttargccttatatccttcactatgtagtctgctcagcaatcaaatccacaatacaaagttcttcctaaaacagtatttgttacctgagtaaactgcttccaagcacttgatgatgtaagcttgccggttccaggcctatgcatagcagccagagtataaatttctgcagtgattttttgcttggacctcagaagagccagcgtggtcttggtgttcaatcctgatgggtttggattacaggaactaatgcaccatgaagcataaaccgaggatttgaaggtggcctgttgcacataattgggtt

SEQ ID NO: 196642 - DNA, 601 bp, Human
tttggcactgtaaacaaaatgtaatgctccatggaattcaaaatggaattggcttcactattacatgtgaatttatagagttgggaagtagatgttcaaaatgacttatgtaaacctcaaagagctgcagacctttggactggattctagtatggcctccaatcaagggacatacaaaaagcataccaacatgttcatcatgtatcttttgttaacattacatcatctaagatgtacatgtacaaacatacaaccctctaaatttgctaaattaagtataactgataatagaattcttcaytgcaagttcctactctatttttacaatcctggcacgagagtgcctcagaaatttctagtttacacagggtgagctcagctcaccaactgttgtctacagatttgatctgctcttcccaaagaccatgaatctgtaataatgtggagtctaaatttcaactagcttcttcaaggtagttacataatgaaaactagagattctatttttaatcaaatttgcatttgtttccagaagggtttcatagagatgtttgaaaggatatctgaggtcatcttgcttaatcaaatcggctagaaaaac

SEQ ID NO: 196643 - DNA, 601 bp, Human
taaggcgcctttacatcacttcagtgaaaatagccataatgttatctgtgcccttgacaacgctttagcaatgtaccaacaaatactttaagagaaggctctgtgaaatctccgtggaaactcagcctgctagcacagtttattcctctggtaggggtgttcagcttgctgttcatgtaatatatgagccacagttaaaactgggacactgttgtttattattttactcatattgctttattatttacttattgcttatatacttataaattttacatgctgttttgaatgattccaaacrgaaatatttccaggcccccactcctcctatttatcaaaacttatatctaccattttttaaagagcccaaaaatgttatagacatatcaagaatgcttaaatctagaaaattaatgaaatgtatctacaaattaataaaaatcatcacttgtgccagagtgcaagtacgctatggatgtgtataggtatagatgctaagcatatcgggatagtttatttagattttagtatgtgtttctttctcctacatttttctctccattccaaggatagtcaggctttagactcccatcttcagaat

SEQ ID NO: 196644 - DNA, 601 bp, Human
aattcagttgtaaggcgcctttacatcacttcagtgaaaatagccataatgttatctgtgcccttgacaacgctttagcaatgtaccaacaaatactttaagagaaggctctgtgaaatctccgtggaaactcagcctgctagcacagtttattcctctggtaggggtgttcagcttgctgttcatgtaatatatgagccacagttaaaactgggacactgttgtttattattttactcatattgctttattatttacttattgcttatatacttataaattttacatgctgttttgaatrattccaaacagaaatatttccaggcccccactcctcctatttatcaaaacttatatctaccattttttaaagagcccaaaaatgttatagacatatcaagaatgcttaaatctagaaaattaatgaaatgtatctacaaattaataaaaatcatcacttgtgccagagtgcaagtacgctatggatgtgtataggtatagatgctaagcatatcgggatagtttatttagattttagtatgtgtttctttctcctacatttttctctccattccaaggatagtcaggctttagactccca

SEQ ID NO: 196645 - DNA, 601 bp, Human
aatacatacaaactaatgtgagggccaaccttgtcagtgctctgaaagatccatacaaataattagctaactactcatagggagcattattcccagtatttagcatctatctgtctggcatatgttagcaaaagttatgacagcaattcctaaaattctggagcagcaacattccctctttacttatcttcaggctcctatcacactaacaaaaaagaaaggtttcatgctgaatatgttataatgataatggcatatacaattatatgtgtatatgcatgtgtggatataaattatatayataatttgtataactgctttatgaaatgtgagaaattttgaaaacattgttccaatcctcgttgacccaggatctacagaagaatgcacacacacacacacacacacacacacacacacacatacatataaattatatgccatataacttatcaaaagagattcaggaactaattcagttgtaaggcgcctttacatcacttcagtgaaaatagccataatgttatctgtgcccttgacaacgctttagcaatgtaccaacaaatactttaagagaaggctctgtgaaatctccgtggaa

SEQ ID NO: 196646 - DNA, 601 bp, Human
aggatcttcaccattcagaagaaaaatacatacaaactaatgtgagggccaaccttgtcagtgctctgaaagatccatacaaataattagctaactactcatagggagcattattcccagtatttagcatctatctgtctggcatatgttagcaaaagttatgacagcaattcctaaaattctggagcagcaacattccctctttacttatcttcaggctcctatcacactaacaaaaaagaaaggtttcatgctgaatatgttataatgataatggcatatacaattatatgtgtatatrcatgtgtggatataaattatatatataatttgtataactgctttatgaaatgtgagaaattttgaaaacattgttccaatcctcgttgacccaggatctacagaagaatgcacacacacacacacacacacacacacacacacacatacatataaattatatgccatataacttatcaaaagagattcaggaactaattcagttgtaaggcgcctttacatcacttcagtgaaaatagccataatgttatctgtgcccttgacaacgctttagcaatgtaccaacaaatactttaagaga

SEQ ID NO: 196647 - DNA, 601 bp, Human
tagctgctccaaattcaatgtgaaatgaactaattttattaaattcatcatgtaacacagatttgtttctacccactaccccttgtttcaaccttaagaagaataatctggtctttgaagatatcaatccctgagagctttggcccaatctcagatattctttattctagaagatatgtggaagtccaggctcacatcttttcaagagtaggctcaaagcaagactagaaatcccaggcttttctgcctgagaagggacctcatatctacccaaatacaccagcctcctgggactccacakaaacaggaaacgcaatctggccacacacctcagagatacttcagaatgaaatattctcaacacacccactgggcccctgaccttctgtgactgatcaggtacagagtaacctccaaggatcttcaccattcagaagaaaaatacatacaaactaatgtgagggccaaccttgtcagtgctctgaaagatccatacaaataattagctaactactcatagggagcattattcccagtatttagcatctatctgtctggcatatgttagcaaaagttatgacagcaattcctaaaattctgg

SEQ ID NO: 196648 - DNA, 601 bp, Human
tatctatttgttttcatccccaacttacaagaaagattccatagtaggactttatatctcagacatcatcccactcacagaaaaccctcaacaaatgagcatggataatgttaattatgatgctagaggagaaagaaaggcaacaacctgtctctgcaagctcaggtacaaacgtatgtctaagtgatgtatctcaggaggtctggccaaccttaatgatgtttgtttgctagtttatttgttttcctactgggtttcttcttaacttgaataataatacattaaaatgcttttcaaattycccaaaaagcctcataaaatctaatttgctatcacaaagcaagtgcaattctattcccttcatagaaggctctaaatataagtattttcaaagtaaggccttttttgccctcggagtcaaaactgaaatgcatttcttctcagtagatttcaagcaattcaatgtgtcagttttattttctatatttagtatttaataaaatgaaaagtgatcactttttaaaaatatctaaacttattttactacctcagccacagagctccactgtgcataatgaagaggtctgtcaactcatttatg

SEQ ID NO: 196649 - DNA, 601 bp, Human
ctggccctgaccagtttcacatgtcccctcatgatgggcaaggtagagtttattaaaaaaaggagtttttgaggccaggcgcagtggctcatgcctgtaatcctagcactttgggaggccgaggcaggcagatcacttgagttcaggagttcgagaccagcctggccaacatggtgaaaccctgcctctaccaataaatacaaaaattagccaggtgtggtgatacacgcctgtagtcccagcttctcgggaggctgagatgggagaatcgcttcaacctgggaggcggaggttgtagtgwgccaaagtcgtgccactgcactccagcctgggtgaaagagtgagaccctgtctcaaaaaaaataaataaaataaaaattttaaaaataaaagttttggaaagtcaaggttaacagctgaatcagaatccttacctggtgatgagttatataagtgatgcctaaatgtccctgtgagtgtatgtccatgcagtcatggcattctaaaggttcatcttttttacttacaaaaaggcttcagcttacgtctatcattagttaagtttagaaagccttcagaaaggcctcacctgttcccactg

SEQ ID NO: 196650 - DNA, 601 bp, Human
ggttactgttatcttcacttataatgaaggcatatcatagaaatctctgcacattctcacttagctctcctgatttcccgttctccttgggcccacgcttccactgagcaagtgcacttgatagtagtaatggcaagaaaagcagacaggctcatgtctttgatttataaacatgccgagtgtgtcattctctcctctccctggccctgaccagtttcacatgtcccctcatgatgggcaaggtagagtttattaaaaaaaggagtttttgaggccaggcgcagtggctcatgcctgtaaycctagcactttgggaggccgaggcaggcagatcacttgagttcaggagttcgagaccagcctggccaacatggtgaaaccctgcctctaccaataaatacaaaaattagccaggtgtggtgatacacgcctgtagtcccagcttctcgggaggctgagatgggagaatcgcttcaacctgggaggcggaggttgtagtgtgccaaagtcgtgccactgcactccagcctgggtgaaagagtgagaccctgtctcaaaaaaaataaataaaataaaaattttaaaaataaaagttttggaa

SEQ ID NO: 196651 - DNA, 601 bp, Human
ctatgctaagtgcatgctttattcattttttaaaatcctacacaaactgaaagagacatcacagtctactgagccgtggaattaggcaggacaggtgcttttatatgaatttgtattaaacctactgcttaaatgtaatccatggtggttactgttatcttcacttataatgaaggcatatcatagaaatctctgcacattctcacttagctctcctgatttcccgttctccttgggcccacgcttccactgagcaagtgcacttgatagtagtaatggcaagaaaagcagacaggctcaygtctttgatttataaacatgccgagtgtgtcattctctcctctccctggccctgaccagtttcacatgtcccctcatgatgggcaaggtagagtttattaaaaaaaggagtttttgaggccaggcgcagtggctcatgcctgtaatcctagcactttgggaggccgaggcaggcagatcacttgagttcaggagttcgagaccagcctggccaacatggtgaaaccctgcctctaccaataaatacaaaaattagccaggtgtggtgatacacgcctgtagtcccagcttctcgggaggc

SEQ ID NO: 196652 - DNA, 601 bp, Human
agtgtgagtgaaacggtgcaatcattaacactatcgttaccacgacctcataagctgggaaaggtgggaattttacggtatgagaatcatttaaattctgcacatagacaaaatcccccttgtatttaatcaggtttggaaaaggcacgtctccttcatcaaacaccagtttgggaggaagacctgtaatgcctacagtaacgatctttgaagataatcaagtacgttttcttttaatcacagcaatcacagattcaaagtttaaaataaaaccgagcttggttatttttctgttttactyctggctgctattccatgacctccattgcatacaaccagtcagaatgtggatctgtggggaaaccaaggaagtggaacagaagtcagagagagagagagatgtcctattacgtaaactgacttgagatccccaaatccaggctgacaaatggagtcatgaattgtcctctaaaactacaataatactcagcatgttctaaatccaataaaatcttattagtgctactaatgaaagtttcaaattcagcccttcactgattttaaccacagagctacgtgtacaagtagaatttctaccatg

SEQ ID NO: 196653 - DNA, 601 bp, Human
ctctgtagcattaaagattcatccagttctatctagattatgatttctgctactctctaagatgcttagcccttacccttctctgtgatatatcatatgcaagctggaaacatggattctcctgaaagtgtgagtgaaacggtgcaatcattaacactatcgttaccacgacctcataagctgggaaaggtgggaattttacggtatgagaatcatttaaattctgcacatagacaaaatcccccttgtatttaatcaggtttggaaaaggcacgtctccttcatcaaacaccagtttggraggaagacctgtaatgcctacagtaacgatctttgaagataatcaagtacgttttcttttaatcacagcaatcacagattcaaagtttaaaataaaaccgagcttggttatttttctgttttacttctggctgctattccatgacctccattgcatacaaccagtcagaatgtggatctgtggggaaaccaaggaagtggaacagaagtcagagagagagagagatgtcctattacgtaaactgacttgagatccccaaatccaggctgacaaatggagtcatgaattgtcctctaaaac

SEQ ID NO: 196654 - DNA, 601 bp, Human
cttttttaaaaagttttccacagaacagatgacaaaacggtggtgaggatccacaaactggttcctccaatgtgtaagacattggtctaaaggaatgcattcctgctaagagatactcaatgcagaaggccagcttctccatccaataacaaaccaagtccatttaagtcttacatcaataataattttttaaaggaaactatccatcatagaagtagttaacattatttcagacagttaacaacttatattcaactctatactgtgaaccaaagatgactgcatcttaattcttttgttyatattatcatttccacctcaatatcttcttggcaatcaatgaattaaggatgcttaaaatgttcagccagaatttcagatttcatagtcctagtcctgaaaatggagaatttattttctatactgtttctgtagtgaaatacaacttagattgtcagattatcaggttttaatattatcatattttaattaatgtgattcattctttaatggattgtcatctaaaaaggacttcatttatttttctattttttgagaaccaaagatagatagatagatataaacccatacagtatggtag

SEQ ID NO: 196655 - DNA, 601 bp, Human
ttcttaggtcaagctgttggattcattcactcacccattcacacattcactacctagagaggcttcaatacctaattctttgatcaagttttcctatttcaagacaaaaaagatttctctgttgtcttttataatccttgaataaaggtgtcggcctgtgaaaagttgcttttgtttttaaacagcaaggtgataaagcagtcagggtgttttccattgggtacagagacacatttcagctctgtttttttcacaagagataatgaaaagaaattaatggataattggcaaaaaaaaaaaagtttactgagcaaaaaacactaataaacattaataatatttttttttaattcaaaaggaaataaaaagattaccatctgttgctatactggacagatttttaatatttttcttaagtgttgatgagtatataattggaatgacaagtctgaaaattggcttttttaaaaagttttccacagaacagatgacaaaacggtggtgaggatccacaaactggttcctccaatgtgtaagacattggtctaaaggaatgcattcctgctaagagatactcaatgcagaaggccagcttctccat

SEQ ID NO: 196656 - DNA, 601 bp, Human
ctgagagtggagtggaagatgactgaagacatagtcattaggaccctcagggaaaaggctggagcctggatgttcataagcaccttcttggtctccatagagactgaagtaaggaacctgaggtaatcctcttcttaaattctgcgcagagaaacaaagagagcacaaaattcagagcctgctacgcttcattcttaggtcaagctgttggattcattcactcacccattcacacattcactacctagagaggcttcaatacctaattctttgatcaagttttcctatttcaagacaaaaragatttctctgttgtcttttataatccttgaataaaggtgtcggcctgtgaaaagttgcttttgtttttaaacagcaaggtgataaagcagtcagggtgttttccattgggtacagagacacatttcagctctgtttttttcacaagagataatgaaaagaaattaatggataattggcaaaaaaaaaaaagtttactgagcaaaaaacactaataaacattaataatatttttttttaattcaaaaggaaataaaaagattaccatctgttgctatactggacagatttttaatatttt

SEQ ID NO: 196657 - DNA, 601 bp, Human
aagttcagcaactgctttacaacagcgttttcaaataaagcctcaggaagtatggctggattgcctcatgtggctgggatgcgaccagcatctttcccaggcttatctttcagtcgacatctgccacaaagacaggacaacctcttacacatcttatgtacacaagttaggagtgttggcaggggcagctttcttcttttgaactgacagggttgtcagcagaaaattccatagatctatgtgtattactaggctgtggatgtgggacagcagaggtcatgaaaagttgctaactgcatcrtccaattctctgaaacacatgtgcactgagctttaaaaaatgaaagggctaaaagaaccctgttctcgggtattctgcagtttgtggaggaaatgtgtttattttccactagaacctttttgaagtaccctgaacctccagcatgttcttgcctatgatgtgtttccaagcaatcgttaataaacatgcccaactagaaataatcttaaaacatgcgcacctactgagtgacagggaacatctgctgcgaggcagggaccgagtcctcccagaagtttgtctgaagattcaaacctgtga

SEQ ID NO: 196658 - DNA, 601 bp, Human
ccgtcgccccggaggccggcaccttgctcacaataagcctcaatttcccaccgctgcctgctcgcagctcctccccagcagctgagagcaatgtctcaagtggctcttcctcccctgcttgccttgcaatcatactgtccaccctgctttggctggcccccttcagctcctgagacagacaaggcctgctgtgttagccaccccccacctgttcgcagcccatggactcgccactgaatacttcggcagacacattccaggatcttcctggctagcactcctagtcttctaatgtcaggcrcactgtaaacagaagatacaggcaagacgctcccccaccccaccccaactcccagccctaactagaactgctaggtcctagtagatatgttggccctgttgggattaatttcaatttcttggtcaataaatccaaatatttagtgacaatattgtatttcagtaggagtcggaatactatttaataaactatttcagttgagctcataaagctctctcatgctattccaataatttccatctcatagccctaagagataggtagaagggtatcattgtccccatttcacaaatgaggaaa

SEQ ID NO: 196659 - DNA, 601 bp, Human
cccgtcgccccggaggccggcaccttgctcacaataagcctcaatttcccaccgctgcctgctcgcagctcctccccagcagctgagagcaatgtctcaagtggctcttcctcccctgcttgccttgcaatcatactgtccaccctgctttggctggcccccttcagctcctgagacagacaaggcctgctgtgttagccaccccccacctgttcgcagcccatggactcgccactgaatacttcggcagacacattccaggatcttcctggctagcactcctagtcttctaatgtcaggmgcactgtaaacagaagatacaggcaagacgctcccccaccccaccccaactcccagccctaactagaactgctaggtcctagtagatatgttggccctgttgggattaatttcaatttcttggtcaataaatccaaatatttagtgacaatattgtatttcagtaggagtcggaatactatttaataaactatttcagttgagctcataaagctctctcatgctattccaataatttccatctcatagccctaagagataggtagaagggtatcattgtccccatttcacaaatgaggaa

SEQ ID NO: 196660 - DNA, 601 bp, Human
tgcagagaggaaaaagttacatataatcacttatccctcccccatgggtaactcagttacctggagagaacagcagattgaaaggtactgttctgaaatgctaactggttctttttacatgagatgaacccaagaccaaatcggattaccctagacacaaatttgatgggcagttttaaagtaacgtgcagtaacttttcaagctcgatgtagaaatatccagaacttatagtaaactgtgtacatgcatggttatgtgagaaaagtgaagctgctgcacctgttcccaagctcactccamttcctccagaagcatgcctgtctgcctctcgggacacaggccgtactttattagacacaattatttcaagaagcttgagaattttctctttgcctttccatgtcatgtccaataaattcaaaggatgcaaagcaaattgttcatccaggaatagttaatttgagaaataaaaatatttatcactggtcctttaagattatcctgattcttgattttttctttttaaactgattaacatttcatcaggtttccattttaaaagaaaatggcactgaagagacaaggcaagttttccaagcg

SEQ ID NO: 196661 - DNA, 601 bp, Human
acgcattgtatttttaaatagaaacagtcacaaaaaaatagacaaatgtctacaagtaaaatagatgtgtgcattgagaaaggcaagggttaagtccaggcctggttctcaagctgagatgggactgccttgtttgaagaggactatttatgaatgaagactctcaggagtctggtggggggtgaggggtggagagcaactcccaaaatccagacaagagcctttggtattaggggaagattttctaattgttacagtcaggaatggggatcattcctttatgatagctgaaaatacatcsccctcctcactccctagaaacccttgagtctcgcctttaggcccttttagggtctgcttctatagctgatggcggtgatctcttttcctgggactcttaagtgtaggacatggaggaaccagaactctaattagcagcaggacctattatttttccaataaggttaacattcaagggaaagaaaagcctctttctttctcaggaagtgtgtgaggatataggctcacattgagaagagaaatgtgaaaagcatattagttacattgaccatgggatgcctggtttgtgagtgaaaatcac

SEQ ID NO: 196662 - DNA, 601 bp, Human
ggtaggctttttatagatgggagcttttctttgctatatttagcagattgaagatatctaacctattgagtcaagcctagcccctgactgcatctacatggagatggagtgaggtggtagaggtagaggatgccaataaaacgttctcaactgaaacaggaagaagtccagagaagctatggaaaaggcaaaagccaatgaatgtgagccttggagagccacagaggactgagagatgctgaactaccaagggggaagggatgactctgatgagcagggagctgggatctgtcaccccagmagtgcttcatctctcacaggtctggggccccttccaccactggccttcctcatccatacagcacggaagcaaggggctgggacagccaggatccccacgaaagggccaaaggccttcttccagatgggtcatccagtatagtacccaccagggggaacggaggaaaagaaatattgttgcagactcttggatctttgacaggcctcctcacctctccccaccatacgcattgtatttttaaatagaaacagtcacaaaaaaatagacaaatgtctacaagtaaaatagatgtgtgcattg

SEQ ID NO: 196663 - DNA, 601 bp, Human
tgggcttaatggtgcctaatgggcattcgggccagcaaggagacgtgaagcgtggagtggctcaggagctcttctagtctagggaagcggatgcctttctgaacctaacttatacaggcgattttataagttactctgagctttccatgggtggcctcatatcctgtcagtgactcacgtgttcaaccttgatcaccaatgttttcctcctagagtggtttggtcaagtgggctagccctgggggtaaggaggaatttgttttctttatggcaggctgcagctagactgagactcccttargtcatctactctgcactgtagcccggatggaagcagccttgtgggggcatggaattctcagagctccaaagacagaagcagccttctgcctcaaaatccccccagctcctcttggataagatggtctactgacaggcctatggtgataaaaatgagcaaaatgagaattaagtctgagttcaaaaacttgatgttggtaaataacttctagatggtgatagtacaaacaagatcctaataaacaaacaaacaaacaaacccaaaacaaaaatcttttggttatctcttctactagaagaa

SEQ ID NO: 196664 - DNA, 601 bp, Human
aatgaatggacagaatacaattacattgctctataatgacatatgcatgaaaacagataaatagaagtgaaaatcattactaaaacttgaggtggtggttgtctaggcagtgaccatctcttgcttgggagatcaagaaaggtgtcacagagaagtaaaagttgaagctagcgtagaagtttacaacgtgttcaagagggaggtggtctatttcaggccaagggaatgaatccaaccacctggagaataagtggttcagtaagactggaatacaggtgcagatgtgggcaaaggagaaaasaggctagagagatggagaatcgtgaagggtccactctacaaggggaaggtgggcttttttgtcataaattgtttttagcagattgatctatttagtcaagtccagccacaaactcttgaatttatgtggagatgcagtgaggagggcgggaagagaagaggtagaaataggtagagaatgccaataaaatgctgtgaggaatgggaagaggcagtggggaaagcctcagcctgtgattgtgagcctcaaagggccacagaaaactgacaaaaccaaactaccaaggggaaaggacgaccc

SEQ ID NO: 196665 - DNA, 601 bp, Human
cagctgcatttctaaatatccacaaacagaaatatagtttaaataccatcatattagccagaaaataaagacaggtaactagtgcccagccaaagggaaagagacaatatgcaagactggaatcatggacaggatatattcaaagatgtgtttcctcaggaatgaatggacagaatacaattacattgctctataatgacatatgcatgaaaacagataaatagaagtgaaaatcattactaaaacttgaggtggtggttgtctaggcagtgaccatctcttgcttgggagatcaagaaargtgtcacagagaagtaaaagttgaagctagcgtagaagtttacaacgtgttcaagagggaggtggtctatttcaggccaagggaatgaatccaaccacctggagaataagtggttcagtaagactggaatacaggtgcagatgtgggcaaaggagaaaacaggctagagagatggagaatcgtgaagggtccactctacaaggggaaggtgggcttttttgtcataaattgtttttagcagattgatctatttagtcaagtccagccacaaactcttgaatttatgtggagatgcagtga

SEQ ID NO: 196666 - DNA, 601 bp, Human
ctcagtgacacaatcaatgcaaggcccatttctgagaggaaagtgaatttccacttttggtcttccaacaagggtgtttttctcaatatcagttctttgaaggactttggtagcagtctctatcaaatttaaaaaagctatttagaaatgtcatcaggagaaagatgatatccagaacctccaggtagtcatggctgccatggctgcagacctcactcccatcatggccggaaggcaaggccaaggatcactccacttgctgtttccttaaagtgctactttctctcacgcttctggcttyctccctcctggaatgtcctgggaacccttgtctacctggcaaacttctacttttctctgtcactgccaggcagaggcacgagttcctcctccacacggtgaggtgtttactcaatggcccagtagagatctccaccttaatatgtttgaagagctttcactctagtttatcctcattgtaggaagcactacctgcccttctattctgctctgagagagccacctgctgagccatcaggtttgttgcctatagattcttttcagctgtcaccttgaaagactgaattttgttaacccagtg

SEQ ID NO: 196667 - DNA, 601 bp, Human
tttcctccaacttcaagtttccctcaaagactaaaacacaaagtctctcgtttttatgcttatttcatgaatatcttttcccaaggctttgagttccaggtctgtgtgtttaatatacctagcctaatactaattgcaaagttggtcctcagaactaagttagttatataatagtgaacattctttaatttcttcagagagtccttaatgaactcaaattcataatttttaatcaccgtaactatgtatttcttccatatgggccttagaatacaaatatttgttttcatgatataataataaacttctgtaaaaacaagactgtctaccccaacagactataaacgctttgtggctgagggtcaaagcttagctattaaaaaacgacaacaacaacaacaacaactgtgggtatatacaacatctctcatcaccacgcacttgatcagttcaaaggctgtttactgatgagtccaatctttggttgaaacccaatgcactttctggccacatccttaaaacaatttatgacaactttctattatctggcaggccaccaacgatcctaacagaacttacagagcaatggtcctgatgcgag

SEQ ID NO: 196668 - DNA, 601 bp, Human
cggctctgcccaaacccctttcccccaacccctggttcccttccagtattctagttcatgcctgaggccctatcttgaggaatcctcaacagccctggtcacaaacaaaataactccttctaggaattctattccgcctgccgagtttgctctgctaggtatcatgatctgttctacttctcacccagcctaagtttggccataataccggcccagctataaaacacactcattcacttagaattgctctgtgttctttctaggtttattaaaaaagactaacacacacagagtatgaagyttgaaaatgcatctttttctcattccctttatagctgaactcaaaatagcactcgtcccactcgccccttcagagaaggagctgctttgttggggaaggttttacatttctctcacctacttaacaccctgcatatacacttttctcaacttatctcagtaagttgattctccccaattcttgctttatgagatgactggcatgtccaacagaactttctgcaatgatggaaatgttacagatgtgatggctactgagcactcaaaatgtgcctctgagaaactgaaacttttactttat

SEQ ID NO: 196669 - DNA, 601 bp, Human
cttgccacataactggcaggggaacgtggccatgggctttgcttctcacaccttccttttcagatgtgctgaccaaatgctgtgccatttaagcacaaacagaacgatggtgctgggcacatcagcagagtccctgcagctgaactccagaccacgggagaggcagcatcgtgggcctggttctacccagacatggacctctcagctgtcactagctttgcttcctgctttcacacatcccagtttacatgcagtctcaagctgaggggagaaagtctgaggcacaggtgcgattcaggascagaaaggtaatctgcatcactatagctggggcatgtcctgggtcccccggattggctgtggagagaagaggaacagttttcttgcattagccatttgaaaacaatgcttttcctccctgaccgcttcagaatcaactacccacaatcaacacgttcctttaaatggtgctcatggaacacagttctccatgtgagagggccatctgcatacaagtctacacttttggcttctcagagggtgaggagtcaagcactgatggccagtggagcacactttccctctggtaaggagagttctt

SEQ ID NO: 196670 - DNA, 601 bp, Human; identical to SEQ ID NO: 120022

SEQ ID NO: 196671 - DNA, 601 bp, Human; identical to SEQ ID NO: 120023

SEQ ID NO: 196672 - DNA, 601 bp, Human; identical to SEQ ID NO: 120024

SEQ ID NO: 196673 - DNA, 601 bp, Human; identical to SEQ ID NO: 120025

SEQ ID NO: 196674 - DNA, 601 bp, Human; identical to SEQ ID NO: 120026

SEQ ID NO: 196675 - DNA, 601 bp, Human; identical to SEQ ID NO: 120027

SEQ ID NO: 196676 - DNA, 601 bp, Human; identical to SEQ ID NO: 120028

SEQ ID NO: 196677 - DNA, 601 bp, Human; identical to SEQ ID NO: 120029

SEQ ID NO: 196678 - DNA, 601 bp, Human; identical to SEQ ID NO: 120030

SEQ ID NO: 196679 - DNA, 601 bp, Human; identical to SEQ ID NO: 120031

SEQ ID NO: 196680 - DNA, 601 bp, Human; identical to SEQ ID NO: 120032

SEQ ID NO: 196681 - DNA, 601 bp, Human
gcattacccctacttctcattctgcagatttcagctcgaaatggtccctgaactccctgggtgggtcacattcccagttcagtgctctcacagcaccaccactagtggcacttaccacacagcaaatgcaggctgacaccttccagcaggactgtttgatgtgtctgccctgcctgcccctcagctgtaaactccagaagggtctatgccctgcacgctccctcagtgtgtactttctgaatgagtaacaaacatcccttctgtctctcttcctcttcatgatcaacaacacaataaagtrtgaaatttaggaatgtaagaaaagtaagcaaataggccccaaactggatcactaggtccagaataactggaaattgattgttcaattttcttatactcactctttcttcattcaaccctggagacatttatttgtataccaggattcttttatgcttaaaagattatagaatcaaatcttggtgatatgcagtaataatgctatgtacataaaactccttatctgatttaaaatatgtaatttacataatatagaagcaactcttatctagctatttactgaagtaaaaactgttatttg

SEQ ID NO: 196682 - DNA, 601 bp, Human
ccctagctctcagcaccgctccagccacacccacctcctttcactccctcacacaccatgcactgcccccacttcccagtctcagggggccttgtcccctctttttactgcattacccctacttctcattctgcagatttcagctcgaaatggtccctgaactccctgggtgggtcacattcccagttcagtgctctcacagcaccaccactagtggcacttaccacacagcaaatgcaggctgacaccttccagcaggactgtttgatgtgtctgccctgcctgcccctcagctgtaaaytccagaagggtctatgccctgcacgctccctcagtgtgtactttctgaatgagtaacaaacatcccttctgtctctcttcctcttcatgatcaacaacacaataaagtgtgaaatttaggaatgtaagaaaagtaagcaaataggccccaaactggatcactaggtccagaataactggaaattgattgttcaattttcttatactcactctttcttcattcaaccctggagacatttatttgtataccaggattcttttatgcttaaaagattatagaatcaaatcttggtgatatgca

SEQ ID NO: 196683 - DNA, 601 bp, Human
gactgcaggcatgtgccaccacgcctggctagttttttgtagagatggggtcttgctctgttgcccaggctgctctcaaatgcctgggctcaagtgatcctcctgcctcagcctcctaaagtgctgggattacaggcataagccacagcacccagcccaactttttttctttattatacgtttacttctttatctatgctgtattctttgggggttatctgacaatgcaagctcattgtcgctgctcttgctaagcttatcattatgatattgccattgtatgattttctgagtttttcaytgtcagctcccctttcacatggatgccagtgtgcttgcatctcagcaactttattctctacccctaacttgctgtgctggaaaccaggaacctgagtttctatgacagttatgacctaaagtgaaaataacaacattcagtgagggccaaggtctgtcctcagacaggcagagcaaaccagcagtccagggatctgagctgtgcatggtggtgatggactgggatctgatgcctggggcttagatctggcgaccttgcttttgaggacctaaaacctccctaggtcactctgatttctac

SEQ ID NO: 196684 - DNA, 601 bp, Human
caatatacaaagctatccaaataatcatatattaaaaaatacttttatccagcattgtctgagaacatgttaccacattaagtgcatttttcagataactaaaagccctttatattccaaaacttattttaggtttatgatgagatttttttatttttacttttctgaggcagggtgtcatgttgcccaggctggagagcagtgatggaatcttggctcactgcagccttgacctcctgggctcaagcaatcctcccacctcagcttccctcctgggctcaagcaatcctcccacctcagcttgtccagtagctgggactgcaggcatgtgccaccacgcctggctagttttttgtagagatggggtcttgctctgttgcccaggctgctctcaaatgcctgggctcaagtgatcctcctgcctcagcctcctaaagtgctgggattacaggcataagccacagcacccagcccaactttttttctttattatacgtttacttctttatctatgctgtattctttgggggttatctgacaatgcaagctcattgtcgctgctcttgctaagcttatcattatgatattgccattgtatgat

SEQ ID NO: 196685 - DNA, 601 bp, Human
tttcctgttgaggctagaaagtattttgcctattcatttcttaaaagtatattacttttatctactactacctaacatacactaatactatatattagatgaattgtatttgtacaactgacaatatacaaagctatccaaataatcatatattaaaaaatacttttatccagcattgtctgagaacatgttaccacattaagtgcatttttcagataactaaaagccctttatattccaaaacttattttaggtttatgatgagatttttttatttttacttttctgaggcagggtgtcmtgttgcccaggctggagagcagtgatggaatcttggctcactgcagccttgacctcctgggctcaagcaatcctcccacctcagcttccctcctgggctcaagcaatcctcccacctcagcttgtccagtagctgggactgcaggcatgtgccaccacgcctggctagttttttgtagagatggggtcttgctctgttgcccaggctgctctcaaatgcctgggctcaagtgatcctcctgcctcagcctcctaaagtgctgggattacaggcataagccacagcacccagcccaacttt

SEQ ID NO: 196686 - DNA, 601 bp, Human
atagggacagattgccttgtctcactatattgacaaattataggtgctccttgacttacaacatcccataaacccatcataaatcaacaatatatgaaaatgtaagttgcaaatgcacttaataccctggtaaatccatcaaagttgaaaaattctaagttgagccactgtcagctgggggctgtccacacttcctctatgcttcacttgttctaaaagcatctgatgggacctcctgtaagatcccgcttcacatacgatctgcaattgtaccagcagccaaatggtcaagcgtacgctmacgtatactacacacacgaccgactcccaccaggagccttccttgagttgagccacgttagctgttgtttctggtactggatgcccctctgatcagtgttaaaaaaccatcccgcaaatataaaagaaacaagactccattaccgatgtatttaaatggttttcccagcttggtgagttggcttaaagtttgttctactacatttgtggtccactggttcactttgctgtgttgataagcgttaccaccaattgcgctttctatagcctagaaaacaaagcacaaagcgcgtcccggtta

SEQ ID NO: 196687 - DNA, 601 bp, Human
caaaggaagggagctggcaaaggagactggtggagcactagcgatttaggagggaagcaggaaattgtactatcatgggagtgatgagaagtgacgttttagaatgcccagttaatacatagcccaagaaactagaaattattttcttagatcatggaaagtattttagaaaacagtattagttaaataacagtttataggctttaaacacctcatactgcactgtactacaaaattcaaatgtcaaagatggaaaaaacaatattcaactagacaagagtatgagataagtgtttccackcctcatctctttctttcctttcacttaatgtgtgaattatacaaaccaatatactgtacagaccaccttataggaacgctgtatttgttgagttaaaaattaacattccttttcttatcatgcgtacaagaattatatgtaaccaaagtcctttagaaataccaggcagatattgctgttattatattttgcacatgtattttgtttgttcttcacatacagctataattacaaaattgaataagctcccatttaaaaaatcacttgcagatatcatttttcacctgccattgagatctt

SEQ ID NO: 196688 - DNA, 601 bp, Human
gcatggagacagttaagtggttaccactgtgggcaactgtggggaaatctgggagacagtgtggaacacactttagctatcctaagagatgaggaagatgggttacttatccatcaaatcatgttagtcacagactcatggctgcttttcggggggcattagccccacccgcactgctcacctgcctgggtttgagccaagaggagctccagtggccagagaaagcctgcaggcaaaaacttgcatcagacagaggccttaagttcatgtgtatgaaaataagtgccaaggagatttggtrggatccctgcaatgtctgctacaaatgtcaagactcttggctggaaacctggccagaatatggttccacttcctgaaaccggaaacattggtggccaaagaagaaggagcaggcaaaggaagggagctggcaaaggagactggtggagcactagcgatttaggagggaagcaggaaattgtactatcatgggagtgatgagaagtgacgttttagaatgcccagttaatacatagcccaagaaactagaaattattttcttagatcatggaaagtattttagaaaacagtattagttaaa

SEQ ID NO: 196689 - DNA, 601 bp, Human
ctgtatgtgaagttttacctcctatgacttaaatgaagtgttatttctttaaggaagccaatcctccatgcagtttttagattccatccctatcagggcttcgatcctctaatcatatattttctctcctacatcatcaatttcttcttctgtcctggatcattaccatgagcacatgagcatgttctggtatcttccatcttcaaaaaatatgtggtcaaatacctccctttccctttgaatcccttcatagcacttcttcaaataataatctatacacattgcatctatttccccatcgctatttccccaactcactccagtcagactttcatctctactatttcactgagactgctcttgtcaaagatgtcagtgattttcatattgccaaatctggtgggcacacctttgtccttaaatgacttgttctcttagcagtatttggtcatgccttccctcttgactcactgtcttcacttgtttctgaaccacaggctttcatgggtttcttctctaactcattgctgcttcttaaatacctttgctggattcttctcttcccaacctctaaacattggagagtcccaggactccactt

SEQ ID NO: 196690 - DNA, 601 bp, Human
aagtcataacacaacaaccagactcctagagaattttattttattgactcaattagaatgggccttgcatacagaatttgaaacagataaacaaatgcaatgagaaaaggcaaaggtatggctctcttggcaaacaccattaaggcaagtgacctgtgggaaggagcaggaagggataggggaacaggtatgttttcttagaagctgctttcacaagcagatggcctctgtcccagtgctttggagctaattctccctgctttagtctacagtcggtgtctctggcagcagcctaaatctraagagacaaaacatgtcttccatcaccatggagaaacagcatctccccccagcattcaggaatttgcccttgaaaaagcaaaaataaaaaataaatataaaacaaaaaaaaccccaaaactctacatgattttttaagcagcgttcaactttttttttctttggagatggagtcttgctctgtctcccaggctggagtgcagtgacaccatctcagctcactgcaatctccgtctcctgggttcaagcaattctcctgcctcagcctcctgagtagctgggattacaggtacacgccacc

SEQ ID NO: 196691 - DNA, 601 bp, Human
aatgaactctacagagcatccctcacctaaagacagttatttcccaagagttcttttctatgttggttgtttggaacttttaatacattttgccatagaaacaaaaatatgagagatggtatatcctctgggaagtatgaaaatttttgagtgcaatactattgcaaaaaaaaatcatacagtagcagaaatacatttgccttaaaacattagacaatgtaatcgccactgtttaaacacttatgcaataatctcctgatataatgcaattaacaatttgtttgttaaaaatgaaaatacyggccaggcacggtggcttacgcctgtaatcccagcactttgggaagccgaggcaggcagatcacctgaggtcaggagttcaagaccagcctggccaacatggggaaaccccgtctctactaaaaatacgaaaattacccgggtgtggtggcgggcacctgtaatcccaactactcggtaggctgaggcagggagaattacttgaatctgggaggcggaggttgcagtgagccaagaccatgccactgcactccagcctgggtgacagagtgagactctgtcttaaaaaaataaaataaaa

SEQ ID NO: 196692 - DNA, 601 bp, Human
gtttgactgctcaaggactaagcaaacaatgaactctacagagcatccctcacctaaagacagttatttcccaagagttcttttctatgttggttgtttggaacttttaatacattttgccatagaaacaaaaatatgagagatggtatatcctctgggaagtatgaaaatttttgagtgcaatactattgcaaaaaaaaatcatacagtagcagaaatacatttgccttaaaacattagacaatgtaatcgccactgtttaaacacttatgcaataatctcctgatataatgcaattaamaatttgtttgttaaaaatgaaaatactggccaggcacggtggcttacgcctgtaatcccagcactttgggaagccgaggcaggcagatcacctgaggtcaggagttcaagaccagcctggccaacatggggaaaccccgtctctactaaaaatacgaaaattacccgggtgtggtggcgggcacctgtaatcccaactactcggtaggctgaggcagggagaattacttgaatctgggaggcggaggttgcagtgagccaagaccatgccactgcactccagcctgggtgacagagtgag

SEQ ID NO: 196693 - DNA, 601 bp, Human
aatcaaggaggtaaaattcgaccccttatgcatctggatttcctgatatgacccatcactgaagaatgaaataattccattcatgactaatttaattattaatttagtcaaaaatacttagtgaatgcctattacattctcaccaccatgaatttagctcttaaaaaaacccacagctttactgaggtaaatgtacatgcaataaactttacccattgtgatggttaattttaggtgtcaacttgactggatggtgggatacctagatggcaggtgaagcattgtttctgggtgtccctgygagggtgtttccagaagaaactggcatgggagttggcagactgggagaggaaaaccggctctcaatgtagtgggcaccatccaatccaatcggctggggccctgcaggggcaaacaggtgaaagaagaggggactctctctgtctctgccctcactctctcttctggagcgggatgcttgttctcctcctgcctttggacatcagactccaggttttggactctgggacttgcaccagtgacctccggtgggctctcgggcttttggcctcggactgggagctgcaccattagcttccct

SEQ ID NO: 196694 - DNA, 601 bp, Human
gtccatttccctcttactcaatcctaactctatgaggccaaatatcatgagatgaaaagacaaaaaggaacagaagaattgaaaggaaggcaaactgggagagaggctgtgaagaatgtttcagagttattttcaccctcttagagtcaaatgaaattgaagacttttggggaaaaagacaaaaatgaaaccccaaactcagcttcagtcccacatttgtcctccggattcttaatgccttaccctaagagtgtaagtcctgcctcccacacggtcccgggcttccagaacaaccacattmagtccagagtcatgcagaagtttggctgctgccatacctgggagaaaagacagtaagacatcaggatcaaatacaaggatgccagacaagctcctcatgctaacagccaatgagaaaagtccatgctggctcacgtgcaccgcctattgttacattcaacttacaagtggatacggtttgtcaatagaggcccagagtctgatgtttctggaaacgacaaaagggatttcattttttagtaaatttctcaaatcttaaacacatcctctgccactatatcaaaatgtctattttaatgac

SEQ ID NO: 196695 - DNA, 601 bp, Human
cctctggccacccctgccttcttgccttccaacaatcaatggctgttgatccccacagtacccactaacaaaccaccaacatgctattcgccacctccaagtctgtgtcttgaggaacccaactgcaacagccatccattgaaatgggcacagcagcctgtagcaatgtctaaaaaatctcaatcccagggctctggggtggcccagacctcatgagaaacttctgacacaggcttaatgggacctcatttgagaattgaggtgttttcttttggggcggagattggtggcaaggtcccarttgtttctattattcttatcagaaccttgctaaaggaaatgagacatagagcaatagctgctacaaacatactcaaataggtgaacagaccaaactgagagaagaaagtctgtagtcaaatctaactaaggccctcaagacaaagcttatttttacatcatagatcataattttaaaacaccattaatgtccttataaaggtttgtgccatgaacaaaagtgaatttcctgttttagaaaggtctccaacctaaacaacaactcctattatacattttgagttatttaggaaaggacctt

SEQ ID NO: 196696 - DNA, 601 bp, Human
tattcttcatagcaactgagactatgtggtacatttgttcatatatatatacatatattgagtgcctctccacgctggaatgtaatccccacgaaggtagaaatcttgtctttttcactggtgtattcccagtacctggaggagtactcattcaataaatctttgaagaataaataaatatctgatagtgtgttcatttgaaaccatgtttagtggccagaagagattcagagcacatagtaataatgctcatataaacaaagtcatacaatatctgtctttttgtgtctgatttatttcmcttagcatatcttcaacgttcacccatgttgtagcatgtgtcagaatttcattcctttttagggctgaataatactcctatatatggatatactatattttgtttatccattcatctgttgatacacagttgggttgtttccactttttggctattatgaataatgttgctttttgaatatttgtgtagtaactcatattacagatgaggagaatgagtcttaggataaacatcttcgccaggattacacagctgataagcagagttcaaattcaggtgtgcttaacatcaagctagttt

SEQ ID NO: 196697 - DNA, 601 bp, Human
ttttcttccttattttttaggtggattgaggggcatacagtaaagggagtaataaataactgaaacctaacattggcccagctggagagccaatatttaacaaaaatattgctggaattctagttgttattgttggcaatttggtgggaaagaaataattctggtttgaaataaagggagatctaaaagtaattctgaagggccagtccattcctaatcctttatttgaatttactctaggagcttcagtaagaaaagaaataagaacaatatttgaaggatggaaggtcaaggaagttartgcaatatttccgtattttttgccctgttgactttttaaaagataaatgttataatatttttctacatgaaaaatacatacacattatataaaatttggaaaatttataagataaaaggatgagagaacgagtgtcttccatatttctgcccctccagaagataattactagtctcattttgatgcatttttttctaagtataggtcttttaaaaaatgtttttacatagctgtgatcacattgaaaatacaattcatgtttgtgaagtgcactttgtaaatgataataactgaaagaat

SEQ ID NO: 196698 - DNA, 601 bp, Human
tttttgtatttttagtaaagacagggtttcaccatgttggccagggttgtctcgatctttcgaccttgtgatctgcccaccttggcctcccaaagtgctgggattacaggcgttagccaccaagcctggccctgccattttgatcaccttgctgttccttggtcacaccaggcttgctcccacctcagtgccttggcactggctgttccatcttcttctctcagggaaccacatggctcaatccctcgtctcctccaattctctatcagatatcaccttctcagtgaggccttccctgatsaccttatttaaacttgcataaccaattctcccatctcactttctggtatgccctctccccaccttcctgcttgattttttccgcactaattatcactatctgacatactttatattataactatatgtttcattactgtctttctccttcactagaaggagaattgtatgtgggcagagaattgtatctgttttgttcacgactgtgttcttaactcctagaatcatgtcaggcacataggaggtgcttgatatttatcaaataaatattttctgtgtttttctaattacataaaagcaa

SEQ ID NO: 196699 - DNA, 601 bp, Human
gaatataaattgttctaccaaaaaggcacatgcactcacatgttcatcgcagcactactcacaatagcaaacatatggaatcaacgtaggtgcccatcaaaggtggattagataaagaaaatgtggtatgtatatagcatggaatactatgcagccataaaaagagaattaaatcatgttctttgcagcaacatggatgcagctggagactattatcctaagtgaatcaatgtagaaacagaaaaccaaataccacatgttcccacttataagtgagagctaagcatggggtacatatggmtataaagatgaaaataatagacactgaggactactaaagggggaggtaaggagtacagcaagagttgaaaacctacctattggtactatgttcactacctgggtgacagaatcattcataccacaaacctcagcatcatgcaacatatccatgtaacaaatctgcacatgtacccctgaatctaaaataaaagttgacatttttaaaaaatgcatgccttagcaacaagtttcttggaccttcttctaaaggtttttatataaggaaagtactcaccctttttcctccagaaaggctctt

SEQ ID NO: 196700 - DNA, 601 bp, Human
acgaaaaagagctctgcattactaatcatcagataaatgccaatcaaaaccacgatgagataccatctcacaccagtcagaatggctattattaaaaagtcaaaaaataagagatgttggagaaaaaggagcacttatgcactgttggtgggaatgtaaattagttaagccactgtgaaaagaaatttggagttttctcaaagaagtaaaaatggaactatcatgcgacccagcaatctcattattaggtatatacccaaaggaatataaattgttctaccaaaaaggcacatgcactcayatgttcatcgcagcactactcacaatagcaaacatatggaatcaacgtaggtgcccatcaaaggtggattagataaagaaaatgtggtatgtatatagcatggaatactatgcagccataaaaagagaattaaatcatgttctttgcagcaacatggatgcagctggagactattatcctaagtgaatcaatgtagaaacagaaaaccaaataccacatgttcccacttataagtgagagctaagcatggggtacatatggatataaagatgaaaataatagacactgaggactactaaa

SEQ ID NO: 196701 - DNA, 601 bp, Human
cctgggatggaaggctggttcaacatatgcaaatcaataaacgtaatccgtcacgtaaacagaaccaatgaccaaaaccacatgattacctcaatagatgcagaaaaggccttcgataaaactcaacagcccttcatactaaaaactctccataaactaggtattgatggaacgtatctcaaaataataagagctatttaggacaaacccacagccaatatcatactgaatgggcaaaagccggaagcattctctttgaaaaccagcacaagacaaggatgccctctctcaccactcctaytcaacatagtattggaagttctggacagggcaatcaggcaagagaaagaaataaaggatattcaaataggaagagaggaagtcaaattgtctctgtttgcagatgacatgattgtatatttattatctggaggcagagcagagaggacatgtataattgaaattcatagagtcccaaaccctcatttcaaacatgacctccaaagactctttcccctgtcaagaacaacttgagaaacaatttcagctcatcctggataagagtgtcttcctcagttccctcctgaacaaaatacaggca

SEQ ID NO: 196702 - DNA, 601 bp, Human
agaataacccttgggcctcagatgcccacttaaggctatgtctgagctcttccaatttcatccagtccttgctctttggttttgtctccaccatggtgtctccctagcacccaaccttctagattccatctccatttctagccccatgattgctttcaactaacaattagctttgatctctctgttctgactgttggctctctctgagataaactcatacatgtcctgaggcccatcttaattttggatactccaggtcaccacctctctgggccaggatatcctggtcttcccttcccaygtgctggtcgtccctggaaagctgaagactgggctggtcttggctcttctctactgggactcagaaatctcagcatctcatttaagtaacatggatgcccacacagcctccacaagaagtctcttagtaaaacaccccaagtcaggtctttttatcatgctttcaacaaaagatgggtcacctaaatatgtctacccccaacactaaatactaatagaaaactaacataaaaattttaaaatgttattggtattctgcttcctacctagatatttattcattggaagacattatttagaa

SEQ ID NO: 196703 - DNA, 601 bp, Human
aacaaggcagaaaagagggcatgcaggagtggggacaggtaatcttatttttttactgtgagacagtgggggatggggtaggtataggtttatgtacctgagtgagactctgtccttcttacaagatcaccagagaggggaaaaagcccttttcatccccatcctggctaccaggatctaggatcttcctatgggtagtagaagctcccctcttttacccccctaacagaactggaagcagagtgacccaatgccctctcccaggaagaaactctgaattcagggacaatgtagcatcacytaaaccacagcatattgcaagttccctgacctgccaccagcacagccagggcccacactctctggaaccacttgtaaactgaccagtcctgtgtagatgcctctgcaaatatattgggaaaaacatgaacttcaggacccaacttgcattaacctatccctgctagtcacttggggacaaagaaaggcctctcacccttagtatagggttgggaagcagccttacctccagagcttctagggaacccagaaccttggcatagagttcacaaagtttcttcaacctgtgaatgaaaagaga

SEQ ID NO: 196704 - DNA, 601 bp, Human
catccacctcctaagcaagcttctctggctgtctccagccaatcagaagaaaagttggactttatctttcaatgtatcttgttcccaggaatttcttccttccacaaaatagacaccaaagcaaaaagaaaacaagtggccttctctatgccaagagcaaacaaggacaggaccaacttatttttatcatcaggaattaatcatgcacacccttcttaggaaaagagactttctcaaatgaaaaatgatcagcctttttcaaaatatgaggacaaatgctttccccttcaactgaagttcyccaaacaaccatctcacgagttgttgcaggaacttcaattaacaaactgctttagcctgggagtgcctcagaatgtaacttcacaaagcttgaatatctaccagggtgaaatatcttgaatggcttttttttttaaatcaactccacactctttattctccagacctctagcactgaatggcatttttttttattatactttaagttttagggtacatgtgcacaacgtgcaggttagttacatatgtatacatgtgccatgttggtgtgctgcacccagtaactcgtcatttaacatta

SEQ ID NO: 196705 - DNA, 601 bp, Human
tcggctaatataagtgttctgagcacgtttaaggtagctaagctaaactatgatattcagtacattaggtgtattaagcgcattttccacttataatattttcaatttatggtgggtttattgggatataaccccatcatattttgaggaacacctgtattagtatattgatgacaacacatgaaatatatagagagcctaagggtactcaggaaggaacccttcctacaagagaaggtggattgactttccccgtgttgattaaacaatgccgtttttcactacatgtttacttttttttcaatggagaaaactaaccccagctggagacctctaggaggcctggctagaccctaagaatgaaatattagaagacagaacaaaggcttagagaactaatcatactataaatcagaatatgtgaaaaccaagaattaattttaaacaaagagatagtttcccgccacttgtcatttggaaattatgttcctttaagggaaaaaaagagtccaacaaccaggtaagaaaaatacctgccccttcttttgcaggtgcgtgaacagacagtatatatttacaaaagatataggacatcataaag

SEQ ID NO: 196706 - DNA, 601 bp, Human
ggtagagatagctttatctgaacccaacattgtttatcctgaacaggccaagagaagagattggcatgaactgttgctttgccagttccagccagtaccagcaaaaacatacatgtatgttggagcatcagaggaaagcagctcctggtggagagtaagaaaaaggagtatttcagcttgtttctctttatttatttatgtatttatttattcattcaaaaaacacttgttgagtacctgcaatgaagtggactgctgtttcccaaaatctggtcccactaggcaagcctcctaaaagcartatggttgtagatcactggaaaataaatatgatgacaatgtgttatatacattgactaggggttctgggtcctctcccatctccataccatctgtattctgcaattcagagttctttctgggattttattcttagtctttttcttgttcagtctccagaattccttaaggagcgcggtttttttatttttcctctgcctgattacctgctcttcctccctttctatactttatgctccatacttggtcattagcagaggtgaaattaccatgtagctgataaactttatgctttatggcc

SEQ ID NO: 196707 - DNA, 601 bp, Human
ttaaagttagagtatatccagagatcatacttataattccaatttatatctaggactacagggttactacttcatctcatcattttttacatctgaatttctttatctccatgctaaaaaacctgcttctcagcaactcaagcctgattactcacttgttttatcacatactacaaatgtaacagccttgggataacaatgctaatactaggactagctaaattgttattgaaaaaaaatgtgaagttcttttttatctttaggatatataccattagaaatgaactatcaaatccgtgtrttttaaaatcagttagaatagttctcctcctcaaccacttgtatacatatttaggtataatttgtatcactttactaatcttgtctctggtgccattcttatttccctctaccctaatataactagcattttctccctgtattatgtttatctctgtaataatgagaagtctatgagaagtataatgagaagtataaagttaactaggaactaagacagaatttgaagtacaaaaatgaatgtggatttaaaaataaatgtatgcacaatagcactatatatatatatattttttttttt

SEQ ID NO: 196708 - DNA, 601 bp, Human
acctctgtctcccaggttcaagtgattctcctgtctcagtctccagagtagctaggattacaggcaccccccccaccacgccagccaattttgtatttttagtagagacagggttccaccatgttggccaggcttgttgcgaactcctgacctcaggtgatccactggccttgaagcctcccaaagtgctgggataacaggcatgagccaccgcacccagccctgctctgatattctttgcatgtaggtttattgtcttgtggtaacaagatggatgctgagattctaagcatcaagttcycattcaaggctgaaaggagagtgaaagggtggcactagccttgtctgcaactaagcttttccttcgccaaaagaccccagcagacatttgctttagtctcattggctagagttgagtcacatggctaccctcagctgtcagggatcctgggaaagtaagtatttcacaatactaggctacataatggaagcaggcatgggagaggaaatatcaatggatactagaataacctacagacaacatttgaattaggatttcatagcagcgatttcagccacattgtaccatgctacccttctg

SEQ ID NO: 196709 - DNA, 601 bp, Human
gcagtagaagaaaggagaatcataggccagtctcaatattgcttataaacatagatataaaaattctaaacaaaatgttagcaaagcatatcctccaacagaaagataatatcacgttgggtagctccaggaaggaaatgttgaataatactagacaattttctggaaatagcagattaggtaaattataacaaaatacaaagagactagacaagttgcactgtatagacacacacacacacacacacacacacacacacacacacgcacgcacacatctttaaagcattaaagagccagygagctaacaagatagtgaagaatcactgggccaacatctggaaaggattaacctacttttccctgggtggcagggggagttgctgaccactgaagaagctcccgaaggctgagcagtgctttggacctagtgcaaagctagggtgacaggtcaagtccagagccccatgaagtgtgtactgatttctgggggagtgtttgtcaactccttgtgctgtgggttgggctgcatctaaggaccaagggtaaatggcaagaaaactaggccaaatgtgcatttcggcccagcttcaaatcctct

SEQ ID NO: 196710 - DNA, 601 bp, Human
cctccctgtcaccctcagtggccctcacaagctatcctcactcccagaatgggaggctctgggttccctcctaatgcatttgaaggccacaggggtgggggtggcaggtgcctgcaacagacatgtacacacacacacacacacacacacgcacactcccctcccccagctacaggcaatccctgagcaacctagggagcaaccctagagctccaaggaacacaagagtttgaggccacttctttagcctttgaactggttattcatcctcattcttacctggcattatttggaatgcttyatttcctctgtacctggccttcactcttgggaagtctagcttgtttgtgcagtttcctactgtttaaacaagagattgtttaaactctagccactgatttccacagctgttgccagtgtttttctttctcactgaagccaaacatggagtggctggagtctggaaacatgccttgagaaatcaaagttcccatctgacattgcagcctacttcctagagctagtgtcactgaggaaggggtcatttactcattctaatgtcaggattcccacaccaataaccacatcatttctcaacaaa

SEQ ID NO: 196711 - DNA, 601 bp, Human
gggtcccttttttgattttgttgctgctgctgagtcccgctgtaaggttaggtccacactaccctgaaagtcctgttcctaaagaaaaaacaacttcagctttctggaggggagaactgctcaactctaccatatttttatttcacaaaaatacaaatatggctgtgctattgcataacctactggacaaaggcatcttgccatggcattggacttggtagcccgaggctgctttcaggaatgtaaggcagaaaataaaataaaaacaaaaaaagaggctaggcgcggtggctcatgcctrtaatcccagcactttgggaggccgaggcgggcagatcatgaggtcaggagatcgagaccatcctggctaacacggtgaaacttcatctccactaaaaatacaaaaaattagccgggcgtgctggcaggtgcctgtagtcccagataccagttactcagaaggctgaggcaggacaatggcgtgaacctgggaggcggagtttgcagcgagccacgattgcgccactgcactccagcctgggtgacagagcgagactccgtctcaaaaaaaaaaaaaaaagaaaaagaataaaaaacaacc

SEQ ID NO: 196712 - DNA, 601 bp, Human
acaaaaatacaaatatggctgtgctattgcataacctactggacaaaggcatcttgccatggcattggacttggtagcccgaggctgctttcaggaatgtaaggcagaaaataaaataaaaacaaaaaaagaggctaggcgcggtggctcatgcctgtaatcccagcactttgggaggccgaggcgggcagatcatgaggtcaggagatcgagaccatcctggctaacacggtgaaacttcatctccactaaaaatacaaaaaattagccgggcgtgctggcaggtgcctgtagtcccagmtaccagttactcagaaggctgaggcaggacaatggcgtgaacctgggaggcggagtttgcagcgagccacgattgcgccactgcactccagcctgggtgacagagcgagactccgtctcaaaaaaaaaaaaaaaagaaaaagaataaaaaacaaccaaacaaacaagaatgcaaggcattgttaacctctggatctttgccattgcatggccatgcacatcaacacaatggtaatattagaccataattattgcatatgcagcacgtggcaggtgtgtgctaaaacacataccgtgccta

SEQ ID NO: 196713 - DNA, 601 bp, Human
tccgtctcaaaaaaaaaaaaaaaagaaaaagaataaaaaacaaccaaacaaacaagaatgcaaggcattgttaacctctggatctttgccattgcatggccatgcacatcaacacaatggtaatattagaccataattattgcatatgcagcacgtggcaggtgtgtgctaaaacacataccgtgcctacactttggacaacaaatggcacctttaaatcacagccgctgtggttgatccctcaaggtcagtaccgctcccatagtaataataatgactacctcccctactgagctcccaktatgttccaggccctgtgccagggccttcacctccattatcttacttaaccctcacatggatcctaagttaggggttattgcgccatttcacagaaagagtctgaagttcagaggcccagtaacctgcctaagagagtaagggaattcagattaaggtcttttgactttatgctgtctcttgctagtccagattctactgtcagggactgtggactccaggaagctgccttacagtttgtgcttgtcctggctctttctggcagctctcttctgatggtcatcctgtgtccatcattgtg

SEQ ID NO: 196714 - DNA, 601 bp, Human
cacatttaagatggtaagcatcattcttttcattgaatacttaatctcatcgaatgaaaagatgaaaaatagaaatatatatcattaaaccatcctctcacatactttaacctttcagagaatacatattttcaaccaaggtagacaacaatgttaaggcaaaaaagtagtgggttggttaaagtttagtttatttgatctgaatgagtgcctttttgctagtgttttccaatacatcatatcatttctggaatgagaagtactcattgtagtagatgtttttatgattatcaggaaactrtattagggaaaagcaggaagatatttagttcaatattccagataagatgattaataaattgtatactaaaagtaactctacttattttaaaatatcttaactctcactgtttttctccacttctaggggaaaagtgggtgtttccccaatgtgatagtgtattgggttaataatacaaattgtatttgtgacattttctgcattgctttttgacaacttcagctttcataatctaatacagtcaatattcgtttttgtaaataacactgaagtgaaaaggaagattgccattttctagat

SEQ ID NO: 196715 - DNA, 601 bp, Human
gtcaacagtctgtggcacatctagtcccagcttactctaggatggtttttactattcaccaaggaactactcgttacctttgttagattgtgtttacagtgcaagttttagcaagacagtgtatagttccaagcctgagcctctcagatggatactgaggatacaccttagtggtgtttcctctacctgatcccttccttttctgagactatgcctatctactacgttcatagaggattcacatcgatatgctaaattcactcattgcttaatatttatatttatgtatttgataaatatrtaagtatttacagagcaaaatctactctgtaccagatattgttccaagctgcagatagagtggtgaacaaatgatcaaaatttctgccctcatggtccttctaatctaaagagagaagacaagtaaacaagaacagtaaataaatattagctaacatttttgcctgtatccttcatggatcttgtgaatagaatccctcttctaattctggtttagaagatcctgattcttatataataggttcctgactggtttctacagtgagcagcttttatgaattttgtgaatttgacatgcttt

SEQ ID NO: 196716 - DNA, 601 bp, Human
gagtttgaaactagcccgggcaacatagtgaggcccccattgctacacaaaaatttaaaatataattttaaaaataaataaaataaaacattctctttatcagttcttctcttctgcatggcataaaggaagcagctggacctgaatgccaagtggattgattcattacttgcattagtaaataagatgctccatcattatgagtgtgtttcattgagttgtggagatcttttgttaaattttgcaatgctgtgtcttgcagaaaaaatgaaaatgttggattccatttttttttttttttgctttccatgagtttcctgcacatcataatgcaggtagggtgaggggtatggagagggagaacccagccagaaatggagcaaggcattttgcagaggctacttcaaaggagaaattgacaattacatgcattctcacgttcttcctgcttttcacgtcctctctaaataaaagtagagactataaatatataccacccatttgtttttagagagtggtgtgataaagatttatttaaaacaacataggctttgctgacagtaacagctcagcaagaatttttttttttctttttgtattg

SEQ ID NO: 196717 - DNA, 601 bp, Human
aaccagccaacacagcaccagggagattctgcacattttattaaattggggcctgtataggtataatgtattcagttgccatcaaaggtaatgtttctgacacagtagagggtctggttactttgcaagtcttaggttggttgcttttttgttgttttagaacaccattcaaatttaagatattactctttttgattgattctgtttgcttttatgttctaggggaaaacatatccatttcggggcgcctttccaccagtatggaatcccattgcatatttggattacaataatctgtggmggacaatagataacatggggaaggaggtaaaatgtgtgttcagtttgcacatgacccattactgaaataacaatggcaactgtttaatatccttccatagtgcagggaacattgctctggacaccaatgcatatcatttcccatgtacccaaactgcaaagttggtcgtatttccacttcacaaatggaaaaatgagtgcccagagattatgtaatttactcaagacctcatagcaagggaaccagcataccaacccactctcttatacaaatgcctgtgtgccttcaactctatgctac

SEQ ID NO: 196718 - DNA, 601 bp, Human
caaactggtagaaaaaggattagaaatcttggtctgtcaatttcctcatatccttggccacacataatgaccccaagagcacttgttggcaatgggagggaagaaggagatcacatcagtcataaggccaccattgccctgactcctggcatctgtcctgcttcttactttttatgagcagagtgaggtcaacaggcaccatggaaagagcactgcgttgaagttacacattccgggacttcgcttgcttgctagcatcagtctgtagctgtaaagtggtgacagtaatacctaccactamggtgttgtgagaattaaatgaggcaggatcttggacttagaaagctgcccagatatggtggctactgttgataagcattctggttatactcatcggattccctcctcccacctcttccctggattgggtcattccctccaatgcagcccttctctttcctcatgtatgctaggagccagggttatcttaccatttttgtcatgcattggctggtcataagccctttatgtaaaggtgatggagatgggtcattttctgtctgtgggtgaatagacatccttatatattcagtgtgtgtat

SEQ ID NO: 196719 - DNA, 601 bp, Human
ccctattgggcagaagaggatataggttgtttgggtagtttgacatcatcttctatatgccagagaaaagcaggaggttcaggtacaggtttcaggagaatgtcggttaagacaaatccaactatgaatggaagagcaattgatatttttcttgccctgggagttagatatagtgatgtcttctgctgtttttgggctttctttttttttttttttttttggaagtggaactcaatattttaatgattttacttaagataaatagtataaaaggaaaatgttaaacggttgtgttctgtgracagtggggctaaaacaaatataaaataataataattggttatagaggaccaagtacagaagatgagagtttccttggaaactggggaataccaaaataatctgtttcttaacttggcgatgtagtcttaaaaattaaagctaccatttattgagcattggttgtgggtgcaagtttttatgtgtacaatgcttttgggctttcttcagctttattattaactaggttagggctcaaataaccttccaggtgttaatggagttatttaggcaattcttagaaagtgatattctaatctct

SEQ ID NO: 196720 - DNA, 601 bp, Human
tttgtaataaacttttggaaactagaaaggaccttgtactttagaactgtgaaatgtttccaacacaaagccagcatgtttaatttcctcaataaaacaccaaagtaagttaaagcttatttatccatagttgggattagatcaaagagattatttcattcatgacttgagatttgacagaaataaccaacactaactgccctttgggaagggaactgtaaaaagtatacaagacaagttgactaaaaatgttttcagataaatcatttaatcttttatcagatattgatgattaaaaaaactatatacatctaaacttactgattcttgcataaacccagaatctaactaaaataattaataacaagctataacttgaggtgttaaatcatgcaaaattatgactatatcccataaagttcaatagttcagatttcctaaatagtccacagctttctctgaaatactattctctacattaacatacatctttgcttctcaaagtgatctcaaataacagccctaaaggaactgccaatccaatttgaggaacactttaatttgtgggtagggagaggaggaaatatctgttttttgcact

SEQ ID NO: 196721 - DNA, 601 bp, Human
ccttaagtgagttagaaaaacaggattttctttattttcttaatgtaaactttttgttaaagcaacgatattattgacttgcagcatttcagctttgttttctcttttgtattttcttccccactgaactgcagccagtgcattatgaagagaagaactggtgtgaggagcagtactctgggggctgctacacggcctacttccctcctgggatcatgactcaatatggaaggtattacgcaagcactacgccaattaatccaagacctgtgccaaatttaaaaggaaaagcagagttcartgcaaattctagaaatagttgtcaaaatccccatttcttatgtcctagataatacttgtatatttctggatgtccatagaaaaataaggatgtcattacatagaacaatagctgtcagcatacagaacaatagcagaacagtggggaggatttcagatgtgaacagtgcttgtgagaatgaagcaagctacagtgtcctccaaggggacttcgtgagctcaacttgacatttagtctcacatgactgccttaggctccttggcaccagtcaacacagaaggacattggatgtgtttatcc

SEQ ID NO: 196722 - DNA, 601 bp, Human
gaccggatgttgatattttcacaccctcgggagaggtaactgagaaaagtgtaaggcgaggtgaagacacatgcttcatttttttttttaagagccttaggcttatgtatctttctctaggtttctcttggggaaaatggtttatgacactagcttggggtgtggagtgagatacgccagccagactggaaataattcatattgtaaaggaataaatgcacggagggagataagtaaaattattttctttcggtaccaatattgaaagaacgagagatgtgtgataatctcgagttgagcrgtgttcctgactccatctctcataccgattcctttttttttttttttgagacggattttcacccaggctggagtgcagtggtgcgatctcggcccactgcaacctccgcctcccgtgttgaagctattcttgtgcctcagcctcctgagtagctgggattacaggcgttgtcaccacacccagctaattttttgtatttttagtagagacggggtttcaccatgttgacaaggctggtctcgaactcctgacctcaagtgatccacctgcctcggcctcccaatgtgctgggattacagg

SEQ ID NO: 196723 - DNA, 601 bp, Human
agtgtaaggcgaggtgaagacacatgcttcatttttttttttaagagccttaggcttatgtatctttctctaggtttctcttggggaaaatggtttatgacactagcttggggtgtggagtgagatacgccagccagactggaaataattcatattgtaaaggaataaatgcacggagggagataagtaaaattattttctttcggtaccaatattgaaagaacgagagatgtgtgataatctcgagttgagcagtgttcctgactccatctctcataccgattcctttttttttttttttgagacggattttcacccaggctggagtgcagtggtgcgatctcggcccactgcaacctccgcctcccgtgttgaagctattcttgtgcctcagcctcctgagtagctgggattacaggcgttgtcaccacacccagctaattttttgtatttttagtagagacggggtttcaccatgttgacaaggctggtctcgaactcctgacctcaagtgatccacctgcctcggcctcccaatgtgctgggattacaggcgtgagccatcgcgcctggcctcgattccttttatgagtgccttatt

SEQ ID NO: 196724 - DNA, 601 bp, Human
accctatatagctaatgattttttcctccgttatatttgaagtaatttgtggtaacaactgaaaccatcgttatcctgtatatgaaaagataaattataccgcttagagctttagaaattaccaataacactaatgggaaagagataccttctttacttgggttgaggtttcttttatattttctcttcagattactttcttgaaagagtgctgttaatgtcatttttttaggtaaatacgagttcacagtataccagcaaaagtaggatttacatattattttgaagattctgggtgcamagcaacacctgtccctggtatacacccaagggagaggaaatcaccaccttgtgaagatatctgcactctcgcgttcattgcagcattattcacagtagccaagatagggaagcaacctaaatgtccatcgatgggtgaggaatggctaaagaaattatgtgtgtgtgtatacgtttatgtgtgtgtatagacaatgtacaatggaacattattcagccttaaaaaaggagatcctactgtttaccacaacatagatggacctgaaggacgttatgttaaatgagataagccagacaccaa

SEQ ID NO: 196725 - DNA, 601 bp, Human
taccagcaaaagtaggatttacatattattttgaagattctgggtgcaaagcaacacctgtccctggtatacacccaagggagaggaaatcaccaccttgtgaagatatctgcactctcgcgttcattgcagcattattcacagtagccaagatagggaagcaacctaaatgtccatcgatgggtgaggaatggctaaagaaattatgtgtgtgtgtatacgtttatgtgtgtgtatagacaatgtacaatggaacattattcagccttaaaaaaggagatcctactgtttaccacaacayagatggacctgaaggacgttatgttaaatgagataagccagacaccaaggaaaatattgcataatctcactcatatgtagaatatttttttaaggagctaaaatacacagaacgaaacagtggttactactggtggtggggaaggagaggaaatggggagatataggtcaaggatacaaaatagcagatatgtaggatgaacaagtttagagatacagggggaccaatgttagtaaaattgtattagagatttttgttaaataagtggattttagcagctcttgttaaagtaattatgtg

SEQ ID NO: 196726 - DNA, 601 bp, Human
tatattaatctgcttcaccattttgctgtctatattccatagcatcatgttgtaaacctcagttgcacaatgaaatttattttttaaaaaattagggtgcaataaaatgtgtaaattctttacactcataagtatgagtataggtgttaactttgaaatcgtatcagaaaaagtatatgatatttgatttatacattttaatttctacggagcatattttatttaaatttattgaacttgaagcaattttcgttcttttcagccttcaccttcagcctataccagaagttcccagacatamaagagctttgtgttcttacataagtgctactaacctaaagccacatttcaaaagcggtttgcctataagaaattagggaagtcatcacagtgtgttattatcctaacctatggtcatgtatctttttatgtgcctcagatgcatgatggagttggtggaaggcaggagattagtagagaacttcgaaagaacagaaggatcatttgcattggacagtagtgtttcacaatagaaattgatgtctgggagaatgcccctcaagctttccctttttcactttaaagaagcttgtttgcttcc

SEQ ID NO: 196727 - DNA, 601 bp, Human
ttgcattggacagtagtgtttcacaatagaaattgatgtctgggagaatgcccctcaagctttccctttttcactttaaagaagcttgtttgcttcctctcacttccataacgtctatattggataaaacactagtggttattataacaaaaataaactttgcagttggaggaacactaatatctgagacagtagaaatgacatgagtaaagaagggctgcttcagaccattattaactggtgacttgatgtttttcttttggcttgctgatggcgatccatgtccctatttcagaccacrcttttcccatcagtgatactcttacactaataaacatatcccaagggcaaacaggtacactaaaatgagcttattcctatctttcaagaccatgatgaaaactatcctaatgagtcttcactgattactaaaaccagatggccagtcagcatctgaattcctaaatcattctgtattattcatgagacagcatatttccttaagtattaatgtttgggtctgtaacttttttttttccactcctctcagctcatacctatgggtacatattcttaatactatgtttttaaactgcatggg

SEQ ID NO: 196728 - DNA, 601 bp, Human
aataaacatatcccaagggcaaacaggtacactaaaatgagcttattcctatctttcaagaccatgatgaaaactatcctaatgagtcttcactgattactaaaaccagatggccagtcagcatctgaattcctaaatcattctgtattattcatgagacagcatatttccttaagtattaatgtttgggtctgtaacttttttttttccactcctctcagctcatacctatgggtacatattcttaatactatgtttttaaactgcatggggtaatgggacttactaataactaataatwctttttttttttttttttgagacagagtctcgctctgtcagtggtgcgatctccgctcactacaacctctgcctcccaggttcaagcgattcttatgcctcagcctcccaagtagctgggactacaggtgtgtgccaccatgcccggctaatttttgtatttttagtagtgacaggtttttgccacgttggccaggctggtctcgaactcctggcctcaagtgatccacccacctcagcctcccaaagtactgggattacaggtgtgaaccactgtgcccagcctctaatgactcttaaa

SEQ ID NO: 196729 - DNA, 601 bp, Human
tcattacccccattcccacccccactactgggatgtctagcaaaattccttgcacatcgtttttgaataaatcatacattattggattttttgttttcaaacattttaattaatcattagaatgacatcttagctggaagtgaaaccttccatctatgctcctctgtactgctacctccctactctggccctctacttcccgctggcctgttagtcaggaactacagcgttaattgaaattgagtgatctgctaaggttaatctgacttttctggttttctaaggttatcagtgacagggsttaggcttggactgctaagattattctctgccacaggagataacctggtatgaaattggactggtgtgttttcttacatgtgtcttcctatttttctgattcaattcctttccctttttaaaacccactgactcttaaaaaaacctacaatctttctgtcgtgtagctagtttggttttttttttcttttagctgtgctgttaacagttctgtagtagctgtgactaccctttggggactggggaagaaatgggaaatgttgaacatttggaagctgcagctaatatgggattgttcttt

SEQ ID NO: 196730 - DNA, 601 bp, Human
tttcaaacattttaattaatcattagaatgacatcttagctggaagtgaaaccttccatctatgctcctctgtactgctacctccctactctggccctctacttcccgctggcctgttagtcaggaactacagcgttaattgaaattgagtgatctgctaaggttaatctgacttttctggttttctaaggttatcagtgacaggggttaggcttggactgctaagattattctctgccacaggagataacctggtatgaaattggactggtgtgttttcttacatgtgtcttcctatttytctgattcaattcctttccctttttaaaacccactgactcttaaaaaaacctacaatctttctgtcgtgtagctagtttggttttttttttcttttagctgtgctgttaacagttctgtagtagctgtgactaccctttggggactggggaagaaatgggaaatgttgaacatttggaagctgcagctaatatgggattgttctttgggggcgggtctcttagtcacagtactgtgactgtattgatacatgtaatctgaagagaatcttagaatatttccaccagaaaggtttttggag

SEQ ID NO: 196731 - DNA, 601 bp, Human
agctaatatgggattgttctttgggggcgggtctcttagtcacagtactgtgactgtattgatacatgtaatctgaagagaatcttagaatatttccaccagaaaggtttttggagataaactagttttcatttttataaatgtggaaacttgagtcccagatcaccataagtgacttatctagattcatacaacttgtcaatggcagccaggaacctgacatgcttagcatagaaatcagactatcaagaactatgacagtaaaggaggaattctctgttattttggaaccgtataccgstttttacagcccagtcaagatgtaggaaattgcttcttacttcggagaaaggcaccagcgagcagtgttacagagcttgattagaatgatccctggtaagaagtgctatgttactacaagttcaccaaacctaaaattgtgggaggaaagtattcttgtttcttagttaagtgttggtgtaaagagttccttttaacatctgaaatcaagaggcaattgaagatttcaaaggacccatcaggaattttggagttcagggcaggcaaagaaaatctttagaaaagattttaaatggcctaa

SEQ ID NO: 196732 - DNA, 601 bp, Human
gacttatctagattcatacaacttgtcaatggcagccaggaacctgacatgcttagcatagaaatcagactatcaagaactatgacagtaaaggaggaattctctgttattttggaaccgtataccgctttttacagcccagtcaagatgtaggaaattgcttcttacttcggagaaaggcaccagcgagcagtgttacagagcttgattagaatgatccctggtaagaagtgctatgttactacaagttcaccaaacctaaaattgtgggaggaaagtattcttgtttcttagttaagtrttggtgtaaagagttccttttaacatctgaaatcaagaggcaattgaagatttcaaaggacccatcaggaattttggagttcagggcaggcaaagaaaatctttagaaaagattttaaatggcctaattctttatatgctttgccacatttttcttctgctagttcatctttacacgtcactatataggcttctggagaatagcatgtgtaaatttaagtaataaagatgaaccatgtggcaatacagttgttctttaggtacaattatgtgattgattatgggggtgggatggaatagg

SEQ ID NO: 196733 - DNA, 601 bp, Human
caagacatgttagctaattggatcttcacaggaactctatgaggtaagcagggtagaaaggtggcagattattggtttataggtgaagaatctgaggttggattatttgccaagatcacatggttaataaggagcatagcctgggccaaagcccgaatcccttcactcccagctctctaagtgctgctgacagatgtttgctgattatggtgtgaagttgtatactttagtatttctttctgagacatacaaacccctgtagtaaaattctttccactactaccaaagaagctcaaaaaaacttaaaataggcacttattgcttccaaaagtaccacagaaagccaggaatctgtattcattgcctagccacttgattcttatgacaaagattttgaaactctggggaaaggctatgtgtcaacttgttttatgtgtcatgattgttaaaatgctagagaaaacagcaaagagccagttaaatctgtgtctgctcaaataagacaaggggcaagagtgtggaaaatccagaacaagattccctgagagatcatctagaccccgttctttctagtcagaagtatagttgtgattaatatgac

SEQ ID NO: 196734 - DNA, 601 bp, Human
ccaagatcacatggttaataaggagcatagcctgggccaaagcccgaatcccttcactcccagctctctaagtgctgctgacagatgtttgctgattatggtgtgaagttgtatactttagtatttctttctgagacatacaaacccctgtagtaaaattctttccactactaccaaagaagctcaaaaaaacttaaaataggcacttattgcttccaaaagtaccacagaaagccaggaatctgtattcattgcctagccacttgattcttatgacaaagattttgaaactctggggaarggctatgtgtcaacttgttttatgtgtcatgattgttaaaatgctagagaaaacagcaaagagccagttaaatctgtgtctgctcaaataagacaaggggcaagagtgtggaaaatccagaacaagattccctgagagatcatctagaccccgttctttctagtcagaagtatagttgtgattaatatgacattaatcttttgcaaagtttaattcttggattcagccatctgctttaattttaacacatctgttttgtaacctaaaataattttaaggtgtttgtttatttgtttgttt

SEQ ID NO: 196735 - DNA, 601 bp, Human
atgtgtcaacttgttttatgtgtcatgattgttaaaatgctagagaaaacagcaaagagccagttaaatctgtgtctgctcaaataagacaaggggcaagagtgtggaaaatccagaacaagattccctgagagatcatctagaccccgttctttctagtcagaagtatagttgtgattaatatgacattaatcttttgcaaagtttaattcttggattcagccatctgctttaattttaacacatctgttttgtaacctaaaataattttaaggtgtttgtttatttgtttgtttgtttkgagattacgattcttaagaatagatacaagttttaaaccttggataaaactaatttttattcttctggttcagttgtagaacaaatacaggttaagttgtcttccagctcttttagataaagcaatattagtggttttatagtgctaagtgaaaagagacattagaatttcaccatattaaactatctcccaagagtaatatgagtgagggaagtgttccttttaaaagtcatgcttctaggctgagcatggtagttcatgcctgtaattccagcactttggaggccaaagcaggagaat

SEQ ID NO: 196736 - DNA, 601 bp, Human
ttcctgccctcacaaacaagtaaataagtgattcatctatagtgtgattagtactgatagaaatatgccattttgtgtgtacattattactaccttccttttgaagattaggcttttttgttagactcttgaagttatggaccttttggatggaaaatacatgtcatatatgccatctctcctcctctatgaccaatatccgtgatccctcatagcattcctgatgaatttagcctcagagttttttttgagagggagtctcgctcttgttgctcaggctggagtgcagtggcgtgatctyggctcactgcaacctctgcctcttgggttcaagcgattctcctgcctcagcctcctaagtagctgggattataggcatgcgccaacatgcccggctaatttttttgtatttttagtagagatggggtttcaccatgttggccaggctggtcttgaactcctgagctcgtggtccacccacctcagcctcccaaagtgctgggattacaggcttgagccactgcgcccggccagcctcagagttcttaatacagcattatcagccctaatagccctagtctgccaattgaaattggcattg

SEQ ID NO: 196737 - DNA, 601 bp, Human
atatccgtgatccctcatagcattcctgatgaatttagcctcagagttttttttgagagggagtctcgctcttgttgctcaggctggagtgcagtggcgtgatctcggctcactgcaacctctgcctcttgggttcaagcgattctcctgcctcagcctcctaagtagctgggattataggcatgcgccaacatgcccggctaatttttttgtatttttagtagagatggggtttcaccatgttggccaggctggtcttgaactcctgagctcgtggtccacccacctcagcctcccaaartgctgggattacaggcttgagccactgcgcccggccagcctcagagttcttaatacagcattatcagccctaatagccctagtctgccaattgaaattggcattgtcattattagcctatttcctatactctagtacctatttgagttataagtttataacttttaaattgttttggtatcaaaaggaatttttttttagggttttgctctgtcacccaggctggagtgcagtggcatgatcatagctcactgcagcctccaagtcctggactcaagcaatcctctcaccttaacttccc

SEQ ID NO: 196738 - DNA, 601 bp, Human
ttattagcctatttcctatactctagtacctatttgagttataagtttataacttttaaattgttttggtatcaaaaggaatttttttttagggttttgctctgtcacccaggctggagtgcagtggcatgatcatagctcactgcagcctccaagtcctggactcaagcaatcctctcaccttaacttcccaagtagctaggactacaggtatgcacaaccatgcctagctaatttttgtattgtttgtagagatggggtcttgctatgttgactaggctggtcttgaactcctggcctyaagcaattctccctctttggcctcccaaagtactgggattacaggtgtgagccaccatacctggtcaaatttattcaatttaaagtttttggcagaccagcacctgacagcaggtttctctctagatatcctgggtttgggtacttgtaaatagagactggctcggtgtggtgtctcatgcctgtaatcccagcactttgggaggcctaggcaggaggattgcttgaagccaggagttggataccagcctgggcaacatgatgaggctctatttctacaaaaaataaaattagccaggcc

SEQ ID NO: 196739 - DNA, 601 bp, Human
gtagtatctcctaacagagtatctgacaagacttcttggagagtgaagtttaaatggtgagaggaagatgaccagtcggttgccctgagggcaaggaggcattctagccatgtaggcagcatggaagaagtccctgactggaaacaaagctgtcaggtgaagggcatttaaaacaggcagagggaggatgatgaagaagataagggaggaggggtaatctggggcaccttattaaagacctggaaacagaggtaaggtaaggatcttggaattaatttctaggacacttggaaactactayaggacttaatctcctaagagcagtaataggagttagtgattagtgatagattagagggagcatagtactgaaaatgagaggtagcatggataagattgcatcagtctaggagggtgagcaatgattaaggaacagatgatatgcagaacacacagcaagaagaattgatgttatattgcaatatatcccttgtgctgaataaagggcagatgagttgaaaggaaaggacttaacatttgcaaagtctgagtatagcttttaaatctcttcagttttatttaatcaggctaacgctgttca

SEQ ID NO: 196740 - DNA, 601 bp, Human
ttgcaaagtctgagtatagcttttaaatctcttcagttttatttaatcaggctaacgctgttcaagaatacagtgtagaggactgtagagcctatcaaggtaatatcaaagagagcatccaactcaggctgcatatagtttttgccactaatatcctaaaagtaattgagtttaaggtataaatcacttccattacatgtttacctgcaatgggaatttgcttaagctataactaagtactttgccttcttagtactgagctgtagtgtgttagccaggaccctctcagaattcttggaayggaatgagaaggaaaagcagtacacaaagaatatgacgtcatctctttaagggatgaggtgttttatttcttgaaatgcagctgctcttttttactttttctttgctcttacttttggcctattttttctgtcctggcatttgccttctctttttcacccttaggattctaagtgccatttcagtattcagaatctcttaactacagtttgcaatttaggacttaaaaagaggtaagcaagggataaataggcacagcacagaggcagtgaaattattctgtatgatactataaaggtgg

SEQ ID NO: 196741 - DNA, 601 bp, Human
aggtataaatcacttccattacatgtttacctgcaatgggaatttgcttaagctataactaagtactttgccttcttagtactgagctgtagtgtgttagccaggaccctctcagaattcttggaacggaatgagaaggaaaagcagtacacaaagaatatgacgtcatctctttaagggatgaggtgttttatttcttgaaatgcagctgctcttttttactttttctttgctcttacttttggcctattttttctgtcctggcatttgccttctctttttcacccttaggattctaagwgccatttcagtattcagaatctcttaactacagtttgcaatttaggacttaaaaagaggtaagcaagggataaataggcacagcacagaggcagtgaaattattctgtatgatactataaaggtggatacatgtcatgatacatatgccaaattcatagaaggtacaataccaagagtcaaccctaatgtaaactagggactttgggtgataatggtgtgtcaagataggttcatcaattgtaacaagtgtacctggtgcagggcattgatagcgcggagggtgtgtggggttaagaatt

SEQ ID NO: 196742 - DNA, 601 bp, Human
attgaacccatcaccccttcctcaagtttacttcagtatttctcattcactctattgctccagtcagaaacttggttgtcttccttgactccttattctttcttgaccttatagccttattaccatggtctcttaatttaatgactcaagtaactcttcctgcactttttctgtacctaccgctataacttttggtcatgctagcattatgtcttgcctgtgctgttgcaacaaattcctaataggcctctctacctaggagagtaatttggttaacaacaacaacaacaacaacaacaaaaaaaaacccaaaacaataatttggttaattactgtttcagagtaacctttcaggcatgtaggtttgaccctctgatcacaggcttaaaactttgaaagtgttctctacttctgttgccctttttatgaagcccaagtctaacatggcttatggtggaccctgaacaaactaacctgcctcttcagtcttattcttgctgcttatttgaggcacactatactccagacaagctgaactttcttggaacactccacttctaactaacctagctaactgctgtatctccttttgattcctagc

SEQ ID NO: 196743 - DNA, 601 bp, Human
ctgcctagcacaggcactctgcacactttataaattatctgtttgctgaatcagtgactaaatgaacttccagcttctctttcactgctctgtctattcaagttttgacattctaaaaaattgacttgtgttgttcatcctccaggcatcaagaatatgacatgacaaggtgtgtgtcactgtttttaatgtatacttgtaattttctctttaagtttaattgcctgttttgaatagcaatatagtcccatgactaatgaagttccaaaatgatatatatgtatgtatgtatgtatgtatrtatctattagtctccatcctacccctaccccacagctagctacccagttcttctccaagagacaaaaatattactagcttcttatatttgtagagcattacctctttttcatttttcaggaaaatctctgcttatatatctctatctacatgtagtataaatatgtgtaaatatatacctttttcctacagatgttatattgtatatactggagtgtaatttacttaataataatgatatcttggagaacttttgagtagataaataatagtctcattctttcttgtactgcatttcatt

SEQ ID NO: 196744 - DNA, 601 bp, Human
tagctgctgcatagccaatactgtagtatttaatagccttcaactcttgacattttatacatacatgaatatatctgtaggggaaaaaatcctagaagtagaagcactgggtcagataattgtgtatgtgtaattttgatagatcttgctgatttgtcttccatagatatgaatttaccttactatctgcaaaaatgcctgtttcctcatactcttatccacacagtgtacattacacttttgaaatttgctagcttggattgtgaagttcaggctgtgactatagcatttttttttttttaagtggccctgtaagggatgacatgcttaatttatgaagtgtttatgaggtccaaacatataatagaaaacacctaagttctggtgtttatctgtcatagccaatatagaaaaataaagagtatatcctatattatgtctgattatgagaagaaagtaattttttagtgaaaattttttgagaaataaatattatagttttaacctaataaacctaaagagccctttaaagtgcacaattcagtgattttttttttggtatattcatgaagttgtacaattattaccactgtccaatttc

SEQ ID NO: 196745 - DNA, 601 bp, Human
aagtggcattttattgtgattttgatttgcatttccctaatgactaatgatgttgaacgtctttccatgtgttcatttaccatttgttttgtttgtttgtttgtttgtttttaaaggatagagtcttattctgtctcccagactggagtgcaatggtgtgatgtcagttcactgcaacctctgcctcctgggctcaactgatcctccccgctcagcctcccaagtagctgggactacagatgcacaccacatccggtcgatttttatattttttgtagagacatgtttcgccacgtttccyaggctggtctcatacttgtgggctcaagtgatccgcccaccttggcctcccaaaattctgggattacagacttgagccaccatgcccagccatttgtatgtcttttttggagaaagatctgttcaaatcctttgttcactttataatttggtatgttttctctttttttttgagacagcgtctcactctgtcacccaggctggaatgcagtggcatgatcataactcattgcagccttacctcccaggcccaagtgcttctcccatttcagcttcctgagtagctaggaccacaggcaca

SEQ ID NO: 196746 - DNA, 601 bp, Human
tggtgtgatgtcagttcactgcaacctctgcctcctgggctcaactgatcctccccgctcagcctcccaagtagctgggactacagatgcacaccacatccggtcgatttttatattttttgtagagacatgtttcgccacgtttcctaggctggtctcatacttgtgggctcaagtgatccgcccaccttggcctcccaaaattctgggattacagacttgagccaccatgcccagccatttgtatgtcttttttggagaaagatctgttcaaatcctttgttcactttataatttggtatgttttctctttttttttgagacagcgtctcactctgtcacccaggctggaatgcagtggcatgatcataactcattgcagccttacctcccaggcccaagtgcttctcccatttcagcttcctgagtagctaggaccacaggcacaagccaccttgcctggctaattttttttagaggggattggggtaggggagagacaaggtctcactatgttacccaggctggtcagactcctgggctcaagtgatcctcccgtctcagcctctcagaagtgctgggatgacaggtatgatccacc

SEQ ID NO: 196747 - DNA, 601 bp, Human
ttttttgagacagcgtctcactctgtcacccaggctggaatgcagtggcatgatcataactcattgcagccttacctcccaggcccaagtgcttctcccatttcagcttcctgagtagctaggaccacaggcacaagccaccttgcctggctaattttttttagaggggattggggtaggggagagacaaggtctcactatgttacccaggctggtcagactcctgggctcaagtgatcctcccgtctcagcctctcagaagtgctgggatgacaggtatgatccaccgtgcccagtcaayatttatttttttattgttgaggtataaaacttctggatactactgccatatctgatacatgctttatagatattttttctcattctgagggttgtcttttccctttattgatagtatcctttgaagcacaaaaatttttaattttgattaagtccagttatctattttttcttttgttgcttttgcttttgttatatctaagaaaccattgtctaatccaagatgagacctacctttatgtcctactacttatgtaggcctttccatggactatattacctaaaatgtttatgttcttcc

SEQ ID NO: 196748 - DNA, 601 bp, Human
cctcggtgacatgcaatttactcatgtaacaaacctgcatatgaaccccaaaccttaaataaaagttaaaaaaaaatgcctctgcagaccaaatatttctcttggtttctgatctactttttaggtactatcccatgtatttcctgccagtatcttaaacttaccaaaaacagaatccattgcctttatccccatatttctgtatttgtattctgtctgttggttagtggagacaccatatatctggtttctcaaatagaaatcttattgataatgccagcttccctcattccttgaggaygtttgctcctggcccacccacactctcagcaaaatgaccttgcttgtcatttcaccaccaagaaatataaacaaccagtaaagaactacaagtcagccacatctacccaactaccagcatctgtgcctatatgactgccttccttcctttgctgtggacacattttttctgttcctgttttgtgcctctttcctccacttgtactctggatcttgtctcctttcacctgcccagtcacaacttcagtggtctctctgtgctgcatcaacagttattttctttactgagtcatttccatca

SEQ ID NO: 196749 - DNA, 601 bp, Human
gttatccaaaggaatgtagatacgaagaatagccttttaattaaggctaataggttttgagatttatttagttaacttatttagtaaacttcatgaagtgttatttctagtactgtgtggtttttttttttttttacattgttactatttcagctagaattgtaatcatattacatcgtgattttagaattttggtttttatgttctctttacaagtggttttggacggtgttttaaccttccttttccccagccccaaatatgctgaacaacatcaggaaactacagtgatttaatactyttttttttgaaatggagttttgctctcgttgcccaggctggagtgcagtggtgcgatctcggctcagtgcaaccactgcctccggggttcaagtgattctcctgcctcagcctcccaggtagctgggattacaggcatgtgccaccatgcctgtctaattttgtgtttttagtagagacggggtttctccattttgggtcagggtggtctcaaactcccaacctcaggtgatccgcccgcctcagcctcccaaggtgctgtgattacaggcgtgagccaccgtgcccggcctgatttaat

SEQ ID NO: 196750 - DNA, 601 bp, Human
gcctcacagctgctgtgaactcagctgtgaactagaaaacatataataggatcctgttttcagagaccaaaaggcaattgtcaacatgtaaaacttgtttttgacagctcaatgaatatatgagcttttatgacaaatagcactaataccagatcttaagtaactatcttaaagattagaaagtcttgaaatatgaattccatgtatttatttttcttcactgaagcaaagatggcttaaatttgcatgtatgtgctgttcagtcatttgtggcttttttctttttaaaaatcatgtatcktgatatttaccaacagatattaaaagttgagatgtgaactgttttccctttaatttcgtcctaacaaaaagttgagccttaagtggggtaaaaatgtttctgaaaatgagctaaacatgaaatggctttgattaaagattatatttcaaaatatttattatatttatatttgatttagcagattttatttatataaatttttgacatctaagtttggggtgaacattatttttatgttaagttggaccatatgaaattgtcatttttttaggtcaaatggttgaatgtagactaaatggg

SEQ ID NO: 196751 - DNA, 601 bp, Human
gtgtccccctggagaccagtaatctgcacacccagccacacaccccaaagtctctacagcagccagagctgccctctcaggcctgctcagcgcagccctcaggtgggtagcccctgagcaggcaattggattatggaatactacccgcctcggcccactgggcttgggcaagtcttcactggccgatgagtgacttcagcctggggaactggagcagttcagcatggagagcccataaatcagcctggtgatgggtccccctggcttttctgaagggcctggatttttagaaggtgagggrccagtggctggccctcaggattcccacaccctcaaccaccagaacttgacccaccactgctcctgctgtggctcaaggctgaacatcatcctcataggagactccttcccaggtttctctaaggagattgcagcaaccctggctggagtgcctggctttgaggtgtcagtagcagggttggagttggggctagggctagaagatgagctgcgcatggagctattgggcctggaagggctatacatgctgagagacccagtgccctgctacccgatcctgctctggagtattcatcaccat

SEQ ID NO: 196752 - DNA, 601 bp, Human
gtagcccctgagcaggcaattggattatggaatactacccgcctcggcccactgggcttgggcaagtcttcactggccgatgagtgacttcagcctggggaactggagcagttcagcatggagagcccataaatcagcctggtgatgggtccccctggcttttctgaagggcctggatttttagaaggtgagggaccagtggctggccctcaggattcccacaccctcaaccaccagaacttgacccaccactgctcctgctgtggctcaaggctgaacatcatcctcataggagactccytcccaggtttctctaaggagattgcagcaaccctggctggagtgcctggctttgaggtgtcagtagcagggttggagttggggctagggctagaagatgagctgcgcatggagctattgggcctggaagggctatacatgctgagagacccagtgccctgctacccgatcctgctctggagtattcatcaccatccctcttcttggccctgtcccccattactgtccatttcctcccttaccccagctagtagagacgccactctgtccctcagatcctctttgtagcatgaacgaagga

SEQ ID NO: 196753 - DNA, 601 bp, Human
cttttctgaagggcctggatttttagaaggtgagggaccagtggctggccctcaggattcccacaccctcaaccaccagaacttgacccaccactgctcctgctgtggctcaaggctgaacatcatcctcataggagactccttcccaggtttctctaaggagattgcagcaaccctggctggagtgcctggctttgaggtgtcagtagcagggttggagttggggctagggctagaagatgagctgcgcatggagctattgggcctggaagggctatacatgctgagagacccagtgccytgctacccgatcctgctctggagtattcatcaccatccctcttcttggccctgtcccccattactgtccatttcctcccttaccccagctagtagagacgccactctgtccctcagatcctctttgtagcatgaacgaaggagcccaaaaatgagaaaaagcaaggagtttgttcaggtggcccttgaattctgtacaggggtgggcctggaggagctcaagggagggtcacaagcacttgtaactttgaaccaactgcctggaggtcagaacctgttggaaagttggggatataaacgg

SEQ ID NO: 196754 - DNA, 601 bp, Human
gtcccccattactgtccatttcctcccttaccccagctagtagagacgccactctgtccctcagatcctctttgtagcatgaacgaaggagcccaaaaatgagaaaaagcaaggagtttgttcaggtggcccttgaattctgtacaggggtgggcctggaggagctcaagggagggtcacaagcacttgtaactttgaaccaactgcctggaggtcagaacctgttggaaagttggggatataaacgggaacctgggaggcagggcttgtccggattcctagagatgggcattgccagctyctcctcaccaccttttcacctctcaatggaggacagtgccacagtgggtattatttttaattaaatattttaataaaaaattgagaaaactccttgcaggtgttttttgtttcactttacccctaacagatgacattttctgtactaatttatgtttacaactagattgaaacaaaatggaagacttttaaatatgtctctggattttaagttttaaaaagccatagagtttttgaaactataagttatcttttatatggtagtattgattttatataacaatgtaaacttagaattttc

SEQ ID NO: 196755 - DNA, 601 bp, Human
aagttcatgtattggcatccttctgtcccaaacacataagaggaaaccaaaaaggcatagctgagctcaaaaacaagatcatggattagtaatggaacaggaattctaagagatggatgaggctgaagcaggcatggatgtcaaaagtttgattcctataggatgatgcgggagaaagagactttaaaggagaatcagagtcaggtccactgtttgaagacaaggacttgtgcggctcctcttaaaaatgctggtttttaaatgccgctgatttgctcctggagctagatttataagaaawtttccatcaaggaaggcagcccagtacagttatggtagaaatacaggggtattcagccactgtgcactgggaaaagtcataccaattattgtgactctgtctgttctgattggtcagttatctcacctttagaaatcattaacaggatacctagaaaacccccatgtctggaatttgagaaacatttctaaataactcatgagacaaagcatcatgaaaattagaaaaataggtggaactgaacaataacaaaaaaactacatgtaaaaacttgtaagatgctgctaaaacagttctggg

SEQ ID NO: 196756 - DNA, 601 bp, Human
gaacaggaattctaagagatggatgaggctgaagcaggcatggatgtcaaaagtttgattcctataggatgatgcgggagaaagagactttaaaggagaatcagagtcaggtccactgtttgaagacaaggacttgtgcggctcctcttaaaaatgctggtttttaaatgccgctgatttgctcctggagctagatttataagaaattttccatcaaggaaggcagcccagtacagttatggtagaaatacaggggtattcagccactgtgcactgggaaaagtcataccaattattgtgrctctgtctgttctgattggtcagttatctcacctttagaaatcattaacaggatacctagaaaacccccatgtctggaatttgagaaacatttctaaataactcatgagacaaagcatcatgaaaattagaaaaataggtggaactgaacaataacaaaaaaactacatgtaaaaacttgtaagatgctgctaaaacagttctgggaaagaaatgtgtagctttagcggcttataaagaaaatagaataaggatggtgaatgacttaagcattcatcttaagaatttaaggggaaaaaac

SEQ ID NO: 196757 - DNA, 601 bp, Human
gagttagagttccaccatgttggccagggtggtctcaaactcctaatctcaagtgatctgcccacctcagcctcccacagtgctgggattacaggcctgagccaccacatctggcttataaaactttaaaagaaaatgtaagagactgttttagggatctcaatcttaggaaaaatttcatagcataccaaaaaacaacaaaaaaaatccataatggaaaaacatacatttgactacattagaattaagaatttaaatgcatcaaaagcaccataaagaacatgaaaagataagccacaaytttgtagaaaatatttgctatacatacaacaaaagattaatatcaagaatatatatagaattcctatagagaaatagcccaaacaaagaggccccaacactcaagtcagtactcaaaaggcctgaatggctaacaagcacaaaaacaggcaaaacctcattaaatcagagaaattagaaccataatatgatacattaaatctgactaatattgttttcatgaatgtggagtaattgctagggggattacaaatcattatagatactgtgtgttaggcccatctttcattgctataaatac

SEQ ID NO: 196758 - DNA, 601 bp, Human
ttgttatctttgggaggggaatgtatggggtttcaaaagtgttttttaacctagctggtggtagttacacaggcatttgctctattattatttttctttaatgtggaagtatatgtgatataattcacagtaaagtaaatggtgaatcagagagagtcaaagggcaatgagttagtgaagatggaatacaggagttttctcaggtggatcagagaaatgggatggtattggaaggccacatggaaagattgttgcattttctagggaaagatatttctagtcctgattagtcttattaacrtctatgcatgatccctattaacaactgagacttgagcatctcattgttctccccctagtggcatcattctcccagtcatccaggcttgaaaccttcttgttatgcctgtatgttgtcaccatatcatgattttttcctttgaaaaatttttcatgtatcttattattgtttctcttattacttaacacctttgttaacaggtgtttactacttaactttctaaataaatcattggatgtctttgttaaagaaaaaaattaaaatttaaaaagaaaaattataaatttgtattataattta

SEQ ID NO: 196759 - DNA, 601 bp, Human
agatcagatgcttttgactctgcaaacttgtgatttaaggctttctggatgtgtacactggtggttgaggtcatagaggttccaatattgaggagactgctgatactggatgttgtctccttgatttttttttttttggagacaggatctcactcttgcccaagctggagtgccgtggcacaatcacagctcactgcagccttgacctcctaggctcaagcaatcctcctacctcagcctcccaagttgctgggcctgtaggtggacaccaccatgccctgttgatttttaaattttttttatagagttgaggtctcggtatgttgccaacctagtctcaaactcctgggctcaagccatcctcctgcttctgcctcccaaagtgctgggatcacaggtgtgagccactgtgcccagcctccttgatttgctttatcctctcattgccaatctctctagcctgtctttggagattaaagtttctgtgaatttgcgacctgtagtcctggtacgaattttgctccaccggcccacctttttttcgcacacctagttatggtacattaagtcactccttgcctagaagggtgggaataccatg

SEQ ID NO: 196760 - DNA, 601 bp, Human
aatctgcatcatggtctgaaagttttcattattttttattttaatcttaatttttttttttttttgaagtggagtctcgctcttgcccaggctggagtgcagtggagcgatcttggttcactgcaacctccacctcctgggtttaagtgattctcctgcatcagcctcctgagtagctgggattacaggcgcccaccaccacacccagataattttgtatttttagtagagactgtgtttcaccatgttggccaggctggtcttgaacccctgacctcaagtgatctgcccgcctcagccwcccaaagtgctgggattacaggcgtgagccaccgcacccagcctggtctgaaagttttctgtgctcagtcctctttcctcccccttttatctttagcagtaaacctcttgtactcccaactctctcatctgcttctcagaggactccaaatgacacatatcacttccactggttatttacctaatttgtctctgaaattgaagtaaggattatttaatttcccttttttaactcccttttgactcctcccagtatttttttaggtcatcaatttcacccacccccagcacctgcatctcc

SEQ ID NO: 196761 - DNA, 601 bp, Human
tgatagcagtgaagttgttaagaattggctcattatctgggggcaagactcaagcaatgtcattttattttgtgaaagctccctaggagtttctggtacacatgagggttgagaatttgtgttaccgtttatacatttttataggaatgcctggacttaagacatatagacatcttcatcagcttaattgaagtgagtagagaagcatagtgattaatagcaagtacttttacatctgaccaaggtttagacccatgctgcttattcactgtgtaactttgagctttatttttctcatctwtaaatgcagttaccggctgggcgcagtggctcacgcctgtaatcccagcactttgggaggctgaggcgggcagatcatgaagtcaagagatggagaccatcctggccaacatggtgaaaccctgtctctactaaaaatacaaaaaattagctgggcgtggtggtgcgcacctgtagtctagctactcaggaggctgaggcaggaaaatcgcttgaacctgggaggtggaggttgcagtgagccgagcgagatcgcaccactgcagtccaacctggtgacagagcgcgactccatctcaaa

SEQ ID NO: 196762 - DNA, 601 bp, Human
tagtatgtattttagttttttctttaaaaagcaacaccagtatatcatttgagagtacttaacatcctcactatttgaaatctataagattatgttcatttattacttatatggatttttatatgagctcatataaaaggtaggccacaaggccgggcgtggtggctcacgcctgtagtcccagcacttatggaggccaaggtgggcagatcgcctgaggccaggagtttgagatcagcctggccaacatggagaaaccctgtcctctactaaaaatacaaaatttagccagggccaggcrtggtggctcatgcctgtaatcccagcactttgggaggccgaggagggcagaccacttgaggtcaggagttcgagactagcctggccaacatggtgaaaccccgtctctactaaaaatacaaaaattagcccattgtggtggcacgtgcctgtaatcccagctacttgggaggctgaggcaggagaattgcttgaaccccagacacggaggttgtggtgagctgagattgctccactgcactccagcatgggtgacagagcaagactctgtctcaaaaaaaaaaagagctgggcatggtgg

SEQ ID NO: 196763 - DNA, 601 bp, Human
ttgagacagggtctcactttgtcacccaggctggagtgcagtgtcatgatcatggcttactgcagccttgacctcctgggctcaagtgaccctcccacctgtctccagagtagctgggactacaggtgtgcaccaccacacctggctaatttttgtattttttgtagagatggggtttcaccatgttgcccaggctggtctcagactcctgggctcaaatgatccgcccaccttgacctcccaaagtgctaagattacaggcatgagccactgcacccagccgagttactgtattcattargctaaagtaatttaagagttatttacttcatcaatttacttgaaaaataaaaggttaattgtcaaaatatactctcaaaagactatgtgtatgtgttgtgaacagattgacctggagagcatcttttcacttaaccctgaccttgttcctgatgaagaaattgaacccagtccagaaacacctccacctccagcatcctcagccaaagtaaacaaaattgtaaaggttagtgatgaaaattcagagtgcaggacactgggagagagcgggagttgtagatgtgtgtgtgttctagtttga

SEQ ID NO: 196764 - DNA, 601 bp, Human
gatcatggcttactgcagccttgacctcctgggctcaagtgaccctcccacctgtctccagagtagctgggactacaggtgtgcaccaccacacctggctaatttttgtattttttgtagagatggggtttcaccatgttgcccaggctggtctcagactcctgggctcaaatgatccgcccaccttgacctcccaaagtgctaagattacaggcatgagccactgcacccagccgagttactgtattcattaagctaaagtaatttaagagttatttacttcatcaatttacttgaaaartaaaaggttaattgtcaaaatatactctcaaaagactatgtgtatgtgttgtgaacagattgacctggagagcatcttttcacttaaccctgaccttgttcctgatgaagaaattgaacccagtccagaaacacctccacctccagcatcctcagccaaagtaaacaaaattgtaaaggttagtgatgaaaattcagagtgcaggacactgggagagagcgggagttgtagatgtgtgtgtgttctagtttgaaattggtaggctttgaagagtttaagaattgattaatttgctttttc

SEQ ID NO: 196765 - DNA, 601 bp, Human
tgctatttgtttcttaaagaaagatgggaaatgatagtgtagttcacttctatattgactgtcatgatataccttaaaactgtgctaaatcctccctagcagttttatctttataaaaattaaaagcacattattcttctggcttttaaagataattctccttcctttctctcaagacctttcagtattaaatttttgtttcaaaatacaactctttttaaaacaggtagtattgcaaagttgttgaatctgcggttctttgtgttcatctcaacaagcatttgtggttttgttgttgtttttttgcttttttacattgtgccaaatactatgctggacaaaatacaaagatgaatgatgacatggctttcagcctgtaggaacttgatatctttcagggaggacatagataagcatttaaatatagtataatagaagcaacaaaactttgtttcataaactatgcagttgaacctgaggcatattttcaactcatgagtttaatcatattgagagtcaccacttagaggttattagttaccacttatacatggattattttttatattcatcttcaaaatgagggatcttcattggagga

SEQ ID NO: 196766 - DNA, 601 bp, Human
taacctctctttgtttcagtttcctcatcgatgagatgggaatagcagtagtaatgacctcataggttgttgtgaagaaagtccttagatcagtgcctggctcatattaattcctgaatatttttggagggtaggggaaaatatataaaggaacttgaatattgatagcattaatagtaattcattaagattatagtttttcttcattttgttttatattcttacatgtctgcctacttttgtttaattgaaagaagctcagatcatgatacatatgagggagtaaagatagaaaacatartgaacattttttcctttcatagaatcgacggactgtagcttctattaagaatgaccctccttcaagagataatagaggtaaagtaaaaatttatctcttaattttggctattgacttcttagtatgttcctgacaaggtaaatcaaaagtaaacattacccttgatgttggtatttatttaaattttacctggctaattttaagaggtgcttttttgttttgttttgttttttgttttttggttttttttttgagacagggtcttgctctatcacccagtctagagtacattggcatgaa

SEQ ID NO: 196767 - DNA, 601 bp, Human
attttgtccaggtgcggtgactcaggcctgtaatctccacactttgggaggctgaggcgggtggatcacctgaggtcagtagttcaagacccccctggtcaacatggtgaaaccccgtctctactaaaaatacaaaaaattagccaggcatggtggcagtgcctgtaatcccagctacttgggaggctgaggcaggagaattgcttgaacctgggaggcagaggttgcagtaagccaagatcgcacgactgcactccagtctgggcgacagagcgagactccatctccaaaaaaaaaaaaagatttttaaaatgtatgggatgatggctgggaacggtggctcacccctgaaatcccagcactttgagaggccgaggcgggcagataacctgaggtcagaagctcaagaccagcctggccaacatgatgaaactccatctctactaaaaatacaaaaactagccaagtgcagtgacacatacctgtagtctcagctactcgggaggctgaggcaggaggatcgcttgaacccaggaggtggaggttcagtgagccgagattgtgccactgcattccagcctgggcaatagagtgagaccct

SEQ ID NO: 196768 - DNA, 601 bp, Human
ttttgccgggtgtggtggctcacgcctttaatcccagcacactgggaggccgaggtgggtggatcacctgaggtgaagagtttgaggccagcctgaccaatatggtgaaacctcgtctctactaaaattacaaaaatgagccaggtgtagtggcgtgcgcctgtagtctcagctactcgggaggctgaggcaggagatcacttgaacctgggaggcggaggtcacagtgagccgagattgcaccactgcactccaacctgggcaacagagcgagacttcatctcaaaaaaaaaaaaaaaaattatattttacacacatattttaggaggatttctttgcagtttaaagttttaagacgtggagcggtttatatatacatatatattttgttttcacatatatattttaaaggattattaaaaaacaagcttggctttggcttttatgtaaattatttagattgaattttgtagctaaaattacattggtgaaagctaagtctgcacgtattactttgaaagcctcttttagcttatgtcagtttattgaacagaattattataaactatattatattttacatacataaatagaaaacctg

SEQ ID NO: 196769 - DNA, 601 bp, Human
cccagtcaatttcctgaacagtcttcctctgcacaacagaatggtagtgtttcagatatatctccagttcaagctgcaaaaaaggaatttggacccccttgtatgtaaattatgtatcaaggatttagtcattttaggcatacatgtattctctcttggtcatccttttaagtcctcaaagagtaaacactctaaatacaagcttgattgcagatttcattttaccactgtggaaaatttaacttcttcttattagtctgttaattgggttttttaaagtatattttggagcaaaaatttktttgtgaaattatagcaatgtttcagtttgagtttaaaattctgggcagatgataatttgtcagatgttacagaagaatgtgttgggctccttgattctttgaattaaaaagtctgtgtttctaaaccaagagatgacatgtatcaatatgtttgagtcatttttctggactctcatctgtacattgtcctattttagttttggtaaagcagctcattaagtaaagctcacgtagttgttataggcatgctttgtcactgtgtaccttttatgtgtgtgtggtgaagttatacataaaaa

SEQ ID NO: 196770 - DNA, 601 bp, Human
tattagtactctaaaaaagaaaactatacttctacagctcatcttttcttttcagcacgtagaaaatctaattgtgtgaaagaagtagaaaaactgcaagaaaaacgagagaaaaggagattgcaacagcaagaacttagagaaaaaagagcccaggttcgtaacataaacatatattttgtttatgtaccaaccagagattagattatatcagtgaaggtgattgatgtgaacaaaataattaaggcattttttttgaagaattttaagaattccttaaattgatattgaggaataatawaaactcttgtgcaaataagttaccgtaacacatttttactgcattgttcttttcatgttttattggtatgtgttaacgctaaaatttgttccattaagaaaaagccattgtgttacagaattctaatgtgtatggtgtaacatttaagaatttttattttaaaaagacctaaaaatacattgggaaaaatacccagttaaagtgcatgattaaactataaattttattattgtttttctatggttagtaagttcacatgtcttagtgaaaggggggaaattccttggattttcatttatg

SEQ ID NO: 196771 - DNA, 601 bp, Human
ttgctgaaacactggattaaattagaagatgaatctgattaaatgaattttcctagaatttcagcttttctagagttatttgccagtggtaacatgagcattatttctctgttgctgcattttataggataattaaggtatatgtataacagatggatttttgaaataggtgaagggtaacttcaatgaagagtccttaatttggagttaacagaatgcataccgactaagagaattgtgtttgtaaaacacaattttacaaacacaaagtggttcagagcttattatgaaaccacaactrtgaaactatataatatcgtcagtttaagtttaggcttggttatgacaaatggcacaatttaattttaattttcaaaccaaatataaatgtaacaaatacattattatatttataatggtgaattctctctgtcttctaataggacgttgatgctacaaacccaaattatgaaattatgtgtatgatcagagactttagaggaagtttggattatagaccattaacaacagcagatcctgtaagattctttgtaaaccattattctggaactttttatgcttcaaataaaaacgtgtttga

SEQ ID NO: 196772 - DNA, 601 bp, Human
tatatttataatggtgaattctctctgtcttctaataggacgttgatgctacaaacccaaattatgaaattatgtgtatgatcagagactttagaggaagtttggattatagaccattaacaacagcagatcctgtaagattctttgtaaaccattattctggaactttttatgcttcaaataaaaacgtgtttgacacttgctaaattcatattgtgttcagctatgtagtttttcctttccttgtgggtgctcattccccatattttaagaagaaaatcaagaaattatccacattaaygcttattttccataatttggtatatgagatatgctccctatagagatgtccttctcgaagcaaaacctccctgtctttgggagggcaaagcaacacttaaaggagtgatagcagaagactcactttcctttctgactgtgagttatactttgatctcagttccaagcttatctttgtcttgggctgtagatcccaccatcatttctaatttactattggtaatttgttagttttaaatgttattctggcttttaacaataagtgatggttgttgagggctgcagtggaccagaaatctag

SEQ ID NO: 196773 - DNA, 601 bp, Human
cccaggctagagtgcaatggtgtgatctccgcctcccagttcaagcgattctcctgtctcagcttcccaagtagctgggactacaggcgcctgccaccacgcccggctaatttttgtatttttagtagaaacggggttcacctttttggtcaggctggtctcgaactcctgacctcaggtgatccacccgcctcggtctcccaaagtgggaggcctgtaatcatgcctgggattataggcgtgagccaccacgcccagccgggaatgcttttataactaatttgtacttataaaaataatmcatctgacatagcatatacagaatgtgttagttacaaaaaagacatttgtgttagatagatgtattatatagaattgaatagaattgttgataatacttgtatcccacatattttaggccttgctattccttcatgtgtttcacttactgcattagagctcaccctttaggacaggaattggcaaacattttctgcaagggtctttggctttggagctatatggtctttgtcacaactactgaactctgtcattgtattgtaaaagcagccatagacaatacataaatgatgggtatgac

SEQ ID NO: 196774 - DNA, 601 bp, Human
actgtgctaatccttgctttatgttaattattattaaaatgaggcatgtattgggaacaaaatttttataaaaaatacttatgcataagaattggcatatttataaaatagttcaaattatttggctcagtaatcgtctgagaatcctgtttcttgccatagttatctttgctagcaactttccctatgatcaacctatgaaaatatgtcacttagtagaatagaaatgttgacttttgttgtgtatagcacatcttgaagtggataatacagctttttttttttttttttggagacacagtcttctctgttgcccaggctgaggtggagtggcaggatctcggctcactacaacctccacctccagggttcaggcaattctcgtgcctcagccacctgagtagctggaattacaggcatgcaccaccatgcccagctagtttttatatttttagtagtgatggagttttaccatgttggccaggctggtcttgaactcctgacctcaagtgatccacccaccttagcctcccaaagtgctgggattacccaccatgcctggcatcacaacttctttttttttttggtccagagataaagt

SEQ ID NO: 196775 - DNA, 601 bp, Human
tcactacaacctccacctccagggttcaggcaattctcgtgcctcagccacctgagtagctggaattacaggcatgcaccaccatgcccagctagtttttatatttttagtagtgatggagttttaccatgttggccaggctggtcttgaactcctgacctcaagtgatccacccaccttagcctcccaaagtgctgggattacccaccatgcctggcatcacaacttctttttttttttggtccagagataaagtctcactgtcacccaggctggtgggcagaggcataatctcggcccrctgcaacctccacctcccaggttcaagtgattctcccacatcagcctcccgagtagctgggactacaggcatgcaccaccactcccggctaatttttatatttttagtagaaatggggtttctccatgttggccaggctagtctcaaactcctgacctcaggtgatctgcccaccttagcctcccaaagtgctgggattataggaatgagccatcatgcccggcctcctcacagcttcttaatgtgaacttaatgctactaacaatagtagtaccctctacagaattatttcctaaagtg

SEQ ID NO: 196776 - DNA, 601 bp, Human
actgtcacccaggctggtgggcagaggcataatctcggcccactgcaacctccacctcccaggttcaagtgattctcccacatcagcctcccgagtagctgggactacaggcatgcaccaccactcccggctaatttttatatttttagtagaaatggggtttctccatgttggccaggctagtctcaaactcctgacctcaggtgatctgcccaccttagcctcccaaagtgctgggattataggaatgagccatcatgcccggcctcctcacagcttcttaatgtgaacttaatgctastaacaatagtagtaccctctacagaattatttcctaaagtgatggttttccaaataacaaaataagcaagtttccattacactcagaattttagaagtaattatatctgacaaccattaaaatttgtgcaaagctaatttgttttttaagcttacctatcatttatgctatgtataaatttctaaaacccctggaggaaatattacataatttacgttttagtgttttacatgacactaataatcactgaaataaaatactttttatttctagattgatgaacataggatatgtgtgtgt

SEQ ID NO: 196777 - DNA, 601 bp, Human
ttggccaggctagtctcaaactcctgacctcaggtgatctgcccaccttagcctcccaaagtgctgggattataggaatgagccatcatgcccggcctcctcacagcttcttaatgtgaacttaatgctactaacaatagtagtaccctctacagaattatttcctaaagtgatggttttccaaataacaaaataagcaagtttccattacactcagaattttagaagtaattatatctgacaaccattaaaatttgtgcaaagctaatttgttttttaagcttacctatcatttatgctrtgtataaatttctaaaacccctggaggaaatattacataatttacgttttagtgttttacatgacactaataatcactgaaataaaatactttttatttctagattgatgaacataggatatgtgtgtgtgtaagaaaacgaccactcaataaaaaaggtatggcacttaatgagctctaataaaagattgattttatcttatttgtaatgtatttttataatagcaaatcaaattggtttggaaaaaatgtaaatcatttcctttgatttgtatgtaaccattatgcagatttctatgg

SEQ ID NO: 196778 - DNA, 601 bp, Human
ttagtaaacattgtgtttttaccctatgtttatgtttcttaactttatcaatatttatccttctcctctatctcttatacttaactattatggattgaggagttacatgtttttttgtgggtagggttgggaggtaggggtttgatctacttagcaggctcatccctagttctgtttgaccagaactttttcctgctccttttgttctgtactttcttcagttttgccttttacaaaacaaaacaaagacagcagttatataaaatgttctacttgtagatctgttttccatctttttttktttttgtttttttgaggctgagttttgctcttgtcgcccaggctggaatgcagtggcatgatctcggctcactgcaacctccgcctcccagttcaagcgattctcctgcctcagcctcctgagtagctgggattacaggcgtgtgccaccacgttcagctaattttgtatttttagtagagacggggtttcaccatgttggtcaggccggtctcgaactcctgacctcaagtgatccacccacctcagcctcccaaagtgttgggattacaggcatgagccaccacgcctggcctccatc

SEQ ID NO: 196779 - DNA, 601 bp, Human
attctttttgcttaagtataaattacttgtctaaattcaaggtaatcaacatttttctatttatttagatggtctatagataatatttttgcagtttttttcctctattaactttttaaaattgagattaccactcttgtttattctgtttctgttgaaattataatactttgtgtttgtttttattgtatatgccttattgtgaccattatttattatggaaatattgcttgaaattatgctttaagtagtttaagtaattttagcatatgatatttaaaattcttaaatcaattcttcratattgttatttaaaatttttaacaaagatttgtttagaatcttgctattaagttttatttattaataaaatactttgtattactcagcattactattattcatcaaaatattggtgacacattctgactgatgcattttatttttaaggtttactgctagaccactagtggaaactatatttgaaaggggaatggctacatgctttgcttatgggcagactggaagtggaaaaactcatgtaagtaatttattaaagttacattctggtacgaagctacagtttcttttccttatagct

SEQ ID NO: 196780 - DNA, 601 bp, Human
atttaaaatttttaacaaagatttgtttagaatcttgctattaagttttatttattaataaaatactttgtattactcagcattactattattcatcaaaatattggtgacacattctgactgatgcattttatttttaaggtttactgctagaccactagtggaaactatatttgaaaggggaatggctacatgctttgcttatgggcagactggaagtggaaaaactcatgtaagtaatttattaaagttacattctggtacgaagctacagtttcttttccttatagcttaattctgygaactaaattcttaagagttattcctgagtaatgtctgttctttattttctttttaaaatatagactatgggtggtgacttttcaggaaagaaccaagattgttctaaaggaatttatgcattagcaggtaactgtcctttttccatataatttggaatattcttctgtggtattattcaggtaactttgaaataaggctttaaaatattgttcagcaactataatgctatattaactgtctattatgtcaattataggttattagattgcttgaaaagaactataagattatatattca

SEQ ID NO: 196781 - DNA, 601 bp, Human
ctagaccactagtggaaactatatttgaaaggggaatggctacatgctttgcttatgggcagactggaagtggaaaaactcatgtaagtaatttattaaagttacattctggtacgaagctacagtttcttttccttatagcttaattctgcgaactaaattcttaagagttattcctgagtaatgtctgttctttattttctttttaaaatatagactatgggtggtgacttttcaggaaagaaccaagattgttctaaaggaatttatgcattagcaggtaactgtcctttttccatawaatttggaatattcttctgtggtattattcaggtaactttgaaataaggctttaaaatattgttcagcaactataatgctatattaactgtctattatgtcaattataggttattagattgcttgaaaagaactataagattatatattcacaataattttttttttttttaagaagacaagaactgtaggctgggcgtggtggttcacgcctgtaatccctgcactttgggaggccaaggtgggtggatcacttgaggtcaggagttcgagaccagcctggccaacatggtgaaactcc

SEQ ID NO: 196782 - DNA, 601 bp, Human
tattcctgagtaatgtctgttctttattttctttttaaaatatagactatgggtggtgacttttcaggaaagaaccaagattgttctaaaggaatttatgcattagcaggtaactgtcctttttccatataatttggaatattcttctgtggtattattcaggtaactttgaaataaggctttaaaatattgttcagcaactataatgctatattaactgtctattatgtcaattataggttattagattgcttgaaaagaactataagattatatattcacaataattttttttttttttaagaagacaagaactgtaggctgggcgtggtggttcacgcctgtaatccctgcactttgggaggccaaggtgggtggatcacttgaggtcaggagttcgagaccagcctggccaacatggtgaaactccatctctactaaaaatacaaaaaaaaacttagccaggcgtggtggcgggcgcctgtaatcccagctactcgggaggctgaggcagaattgtttgatcatttgaacccaggaagcagaggttgcagtgagccaagatcatgccactacacttcagcctgggcaacagaccaag

SEQ ID NO: 196783 - DNA, 601 bp, Human
ttttctttttaaaatatagactatgggtggtgacttttcaggaaagaaccaagattgttctaaaggaatttatgcattagcaggtaactgtcctttttccatataatttggaatattcttctgtggtattattcaggtaactttgaaataaggctttaaaatattgttcagcaactataatgctatattaactgtctattatgtcaattataggttattagattgcttgaaaagaactataagattatatattcacaataattttttttttttttaagaagacaagaactgtaggctgggygtggtggttcacgcctgtaatccctgcactttgggaggccaaggtgggtggatcacttgaggtcaggagttcgagaccagcctggccaacatggtgaaactccatctctactaaaaatacaaaaaaaaacttagccaggcgtggtggcgggcgcctgtaatcccagctactcgggaggctgaggcagaattgtttgatcatttgaacccaggaagcagaggttgcagtgagccaagatcatgccactacacttcagcctgggcaacagaccaagaccccatctcaaaaaaaaaaaaaaga

SEQ ID NO: 196784 - DNA, 601 bp, Human
aatatagactatgggtggtgacttttcaggaaagaaccaagattgttctaaaggaatttatgcattagcaggtaactgtcctttttccatataatttggaatattcttctgtggtattattcaggtaactttgaaataaggctttaaaatattgttcagcaactataatgctatattaactgtctattatgtcaattataggttattagattgcttgaaaagaactataagattatatattcacaataattttttttttttttaagaagacaagaactgtaggctgggcgtggtggttcaygcctgtaatccctgcactttgggaggccaaggtgggtggatcacttgaggtcaggagttcgagaccagcctggccaacatggtgaaactccatctctactaaaaatacaaaaaaaaacttagccaggcgtggtggcgggcgcctgtaatcccagctactcgggaggctgaggcagaattgtttgatcatttgaacccaggaagcagaggttgcagtgagccaagatcatgccactacacttcagcctgggcaacagaccaagaccccatctcaaaaaaaaaaaaaagaactgtaagattg

SEQ ID NO: 196785 - DNA, 601 bp, Human
aaagctttgtttagtcctttcagatttagctatgttgcttatagtttgccttgtataatatatgtctaggtctggaatcagctagggatttgggcagtttgtatataaaagtttgtcccagaagggagagtaccacactctctgcagcactttcccttctgggacaaacttcacttttccagctgctatgaactccactcccaaactatatcctttcatttctttaccagagagactgcaagttttcagtcaagttttagttgccctgtgtgacagcagcaaagcttgccctctgtcaaaragctgtttaaaaaaaaaaaagtcaggtggagtgggggtcagtcagtactattcccttccaggtattaacctcctccatttcagctggagtttgattgttttctagtgccttcagagtttgtattttaactagactttatctgattatagatatgataacaaataatcttggagttgagatatcattaataagtctttatttttaaataaccatggtaagattagacctaaatgagctgtatgtcagtattattgtcttgatcatttataacattttgtttacctttgcattttttttttc

SEQ ID NO: 196786 - DNA, 601 bp, Human
tttatttttaaataaccatggtaagattagacctaaatgagctgtatgtcagtattattgtcttgatcatttataacattttgtttacctttgcattttttttttcctgtagattgccacaatctctccaggaatggcatcctgtgaaaatactcttaatacattaagatatgcaaataggtatgagagatagttctccattttgaaatttgaggggagtacagcagtacatagtataatttaatatctgcctcgtgcggtggctcacgcctgtaatcctagcactttgggaggcccaggygggcggatcacaaggtcaggagatcgagattatcctggctaacatggtgaaaccccgtctctactaaaaatacaaaaaattagccaggcatggtggtgggtgcctgtagtcccagctactcgggaggctgaggcaggagaatggcctgaacccgggaggcagagcttgcagtgagccgagatcacgccactgcactccagcctgggcaacagagtgagactccgtctcaaaaaaaaaaaaaaaattaatatttgatagggtaaatcttactacattgttctttcaattttcaagaaaaaa

SEQ ID NO: 196787 - DNA, 601 bp, Human
tccaggaatggcatcctgtgaaaatactcttaatacattaagatatgcaaataggtatgagagatagttctccattttgaaatttgaggggagtacagcagtacatagtataatttaatatctgcctcgtgcggtggctcacgcctgtaatcctagcactttgggaggcccaggcgggcggatcacaaggtcaggagatcgagattatcctggctaacatggtgaaaccccgtctctactaaaaatacaaaaaattagccaggcatggtggtgggtgcctgtagtcccagctactcgggargctgaggcaggagaatggcctgaacccgggaggcagagcttgcagtgagccgagatcacgccactgcactccagcctgggcaacagagtgagactccgtctcaaaaaaaaaaaaaaaattaatatttgatagggtaaatcttactacattgttctttcaattttcaagaaaaaaatgttttgcatattattccttaagatgacaatatagaatcattttgtcaaattctaaaaataagtggaaatgggtaatttgggaagggattgataactttagtaaagttggtctttttatcctaga

SEQ ID NO: 196788 - DNA, 601 bp, Human
tgctcttattttgaatgactgtttagtgttaaatttctcttctcaaatgttaaatttgtgattttaacctagagacaaaattcctctttgtaatccatttctagtatagcagttctcttaattcaagtatagcagttctcttaattttgctggataaaagtatctgtcctatatctttgttttaatcactatggaaatgttattttttaatcttttattaaaatgtaaaatacttatgcatatagaaaagtacctaaagtataagtgattaattaaatggataatggatacttataaagtraaaactcctgtcattggtttgggaaatagagcattattggccccccaaaaggttccccatgtgctccttcctgttcacaaatcctgaataacatgccttattcatctatctctaccctgatgtaacccatggattaacttctgtggaatacttttcttgtttttttttttcctctttttaaaaataattttactatgaatctatttctgagtaacataggtagctgatttgaacattacacaatggtattataaccccccgggttttttttgcatcttgtttctaaagggattttcttaa

SEQ ID NO: 196789 - DNA, 601 bp, Human
tctcaaatgttaaatttgtgattttaacctagagacaaaattcctctttgtaatccatttctagtatagcagttctcttaattcaagtatagcagttctcttaattttgctggataaaagtatctgtcctatatctttgttttaatcactatggaaatgttattttttaatcttttattaaaatgtaaaatacttatgcatatagaaaagtacctaaagtataagtgattaattaaatggataatggatacttataaagtgaaaactcctgtcattggtttgggaaatagagcattattgkccccccaaaaggttccccatgtgctccttcctgttcacaaatcctgaataacatgccttattcatctatctctaccctgatgtaacccatggattaacttctgtggaatacttttcttgtttttttttttcctctttttaaaaataattttactatgaatctatttctgagtaacataggtagctgatttgaacattacacaatggtattataaccccccgggttttttttgcatcttgtttctaaagggattttcttaatggtagtaaacactgttggacaatatcaacctattgagct

SEQ ID NO: 196790 - DNA, 601 bp, Human
gcagttctcttaattcaagtatagcagttctcttaattttgctggataaaagtatctgtcctatatctttgttttaatcactatggaaatgttattttttaatcttttattaaaatgtaaaatacttatgcatatagaaaagtacctaaagtataagtgattaattaaatggataatggatacttataaagtgaaaactcctgtcattggtttgggaaatagagcattattggccccccaaaaggttccccatgtgctccttcctgttcacaaatcctgaataacatgccttattcatctrtctctaccctgatgtaacccatggattaacttctgtggaatacttttcttgtttttttttttcctctttttaaaaataattttactatgaatctatttctgagtaacataggtagctgatttgaacattacacaatggtattataaccccccgggttttttttgcatcttgtttctaaagggattttcttaatggtagtaaacactgttggacaatatcaacctattgagcttttgcaaaaaaagtgattaaaatataatcacttctttaaaaatgtaatagggccaggcgcggtggctt

SEQ ID NO: 196791 - DNA, 601 bp, Human
gactaaccatctgggacactgtattaatcggttctcacactgctacaaaggaatacccgagactgggtaatttatgaaggtttaattgactcacagttcagcatggccacagaggcttcaggaaacttacagtcatggtggaaggtgaaggggaagcaaggcaccttcaccaggcagcaggaaggagaagtgccaagcaaactggggaagagcctcctataaaaccattagatcttgtgagaactcactatcacgagaacagcctggaggaagttgcccccatgattcagttacctccacstggtctctcccttgacacttggagattatggaaattataatttaagatgagatttgagtggggacagaaagcctaaccatatcagacacataattgtttcaattttatttccaaatctctaggaataaagatttttaaccttccttgatactcataccaatgttttgtgaccttaagagtcagtaatttttttttttttaacagccaaaaataattcattcctcctttatactaaatctgccttattttttttaggccaatactttgaggtggtgggtaggtggcattacattaaaattt

SEQ ID NO: 196792 - DNA, 601 bp, Human
tttttttgtatttaagacatagcttagtgattgaagtgttatttctcaggacaaaataggtttaataacttccttactacttaatggtatcaaagcctcgggaaagttacttaacctctctctgtctttatttcctcatctttagaatagacagctaatgaccatgtccatcttaaaggattgtttttgaggactaaaagaagtgatctgtgtaaaatgtttagcacagtacctgggatatattaataggaatagttatccctattgctactttagtgagcagttctgtctaaaaaattcrgttagacagatgtgaaagcaatgttttttcatatccttatattagaatcatatactttgaaagttttatatgggaattgtgggatagtttgtaacagtacacattgctgctaagtgattaagttgacaagtctagttcatcagatgacaattagagatactttatttatttatttatttatttaagatggagtcttgctatgtcacccaggctggagtgcagtggcacaatctcagctcactgcagcctctgactccggggttcaagcgattctcctgcctcagcctcccgagtagctgg

SEQ ID NO: 196793 - DNA, 601 bp, Human
ataaaacttaaaatcttataatctttatacattataaataaaattattttacatgtagctattttaattgagcatgataactaccagaaatctgcagggtttttttgttttgtttcagcagtgatccatttattggtctaattgttattgtttacatttttctgttcatataatttaattgcaataacatcaactttgatgagccagtagtaaataaaatggaaaatttaaaaaattttttaaatcataacaagtttttttctttgaatactgaatctacatactgttctcatttaatttrcacaataattatatttgatataatataatatgaattatataaagttacctaagcagatttcctaaaactaaacaaccacttaagtgtttctacagatttcagataaattttacctataaaggtgacatcatcaatcttagtatgttaactgaattgcgtgtatattgaataggctggtattttctcgttcctctgcatgagtgtttttaactttagatacctcttatgtatttatagggtcaaagaattgactgtagatccaactgctgctggtgatgttcgtccaataatgcaccatcc

SEQ ID NO: 196794 - DNA, 601 bp, Human
gctggtattttctcgttcctctgcatgagtgtttttaactttagatacctcttatgtatttatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgtgagtgtactatggttgtaaatgttataatcttagttcatttcatcagtagcagaacttaactgaaaactatcatttaaatgargtgtcaggctgtgggtgtggtggctcaagcttgtaatctcaccaatttgggaggctgagtgagaggactgcttgaggccaggagttcaagaccagcctggacaatttaatgagaccctttctctacaaaaaatttaaaaatcatccagatgtggtggtatacacctgtaagtctagctactaggcaggctgaggtgggaggattgcttgagcacaggaattctgggctgtagtggactgtcatagcatcactgcactctagcctaggtgacagagcgagaccttgtctcttaaaataaat

SEQ ID NO: 196795 - DNA, 601 bp, Human
gtacatattattattgctatattgtcttaacaaagtagattaaaatggaacagcatctaagacacgctctagagatcggagaagttttttttgtttgtttgtttgtttgtttgtttttttgaggtggaatcttgctctgtcacccaggctggagtgcaatggcacgatctcagcttactgcaacctccgcctcccgggttaaagtgattctcctgcctcagcctcccgagtagctgggattacaggcgcacaccaccatgcccagctaattttttatatttttagtagagacggggtttcmccatgatggccaagctggtttcgaactcctgacctcaagtgatccgcccgcctcagcctcccagagggctaggattacaggagtgagccaccacacccagccgaagtttttttttgttttttgttttgttttgttttgttttttaatcatcatctgaacatggcctgggatcagagaagctctgacttgctataggacgaaaatatgaatatattgtatatagttgtccctcagttatacatggaggattggttccaggactgcctgaatatacccaaattgcgcatacacaagtcccac

SEQ ID NO: 196796 - DNA, 601 bp, Human
agacggggtttcaccatgatggccaagctggtttcgaactcctgacctcaagtgatccgcccgcctcagcctcccagagggctaggattacaggagtgagccaccacacccagccgaagtttttttttgttttttgttttgttttgttttgttttttaatcatcatctgaacatggcctgggatcagagaagctctgacttgctataggacgaaaatatgaatatattgtatatagttgtccctcagttatacatggaggattggttccaggactgcctgaatatacccaaattgcgcatrcacaagtcccacagctggccccgtggaacttgcaaatatgaaaagttgggcctctgaatatgaaggtttcacatctctcaaatactgtattttcagtctgcattggttgaaaaccagatataagtggacaagcactgttcaaacatgtattgttctagagtcaactatatgttttttgttgttgatgaagtaaaattgtgaattgtccattgaaatttctataaaaactggtataaatatattctgtagtatatttaagaaattagttagttaagagttaagtcctttacaacactaatt

SEQ ID NO: 196797 - DNA, 601 bp, Human
ggactgcctgaatatacccaaattgcgcatacacaagtcccacagctggccccgtggaacttgcaaatatgaaaagttgggcctctgaatatgaaggtttcacatctctcaaatactgtattttcagtctgcattggttgaaaaccagatataagtggacaagcactgttcaaacatgtattgttctagagtcaactatatgttttttgttgttgatgaagtaaaattgtgaattgtccattgaaatttctataaaaactggtataaatatattctgtagtatatttaagaaattagttagttaagagttaagtcctttacaacactaatttgatagtcatgaaagacattttctttacatcatctaaagatactatcttcatatcttttttaacaaaagaaacttaaacatgtaaattaaattgttagtgaaaagtagacaatactgaggaaatatttcatacatttacagcctgcaataactgtatttttgaaaagttgggctgttccaaaagagagtactctttcagcatagttcggcaataaagcttaggctaagtgaaaaatattccctactcatctaagttttagttgtcttatt

SEQ ID NO: 196798 - DNA, 601 bp, Human
attctctatatcattcctctgtattatgatctgccatttcacaaaataaggttttgttaaaccaaaattaagtgtacagctaaaggaaaaggaaagaaaaattggagtgtatgaccaggcgtggtggctcacacctgtaatcccagcactttgggaggccgagacgggtggatcacctgagtttgcgagttcgataccagcctgaccaatatggagaaaccctgtctctactaaaaatacagaattagctgggcatggtggcgcatgcctgtaatcccagctacttgggaggctgaggcasgagaattgcttgaacccagcaggcggaggttgcagtgagccaagattgtgccattgcacaccagcctgagcaacaagagtgaaactcaggaaaaaaaaaaaaaaggaaaattggagtatttttgcattttctaattaatatgtttcctaatcaagacacatacctatgttaaccagttctgtctggtgctatatagtctaattataattagtcattaaagtcaattgatgttcggaaaattgagattgtatgcatcctaaaagcaaatccacgtataagagcttttatgtccaaatagct

SEQ ID NO: 196799 - DNA, 601 bp, Human
atcttcacattgagtaggctgaggaggaagaggcaggctggacctggtgtctcagggctggcagaagtggaggaggtggaagggatggcaggagaggcaggcatactcagcgtaacttacattgaaaaaaatccacataagtggacccaaacagtttaaacccatgttgttccagagtcaactgtatttcttaattatactgtctgtgaataaagatgttttatgtctattgacattttagagaatactatcttaagtatgtttgattatatttaacagaattgtaatttggtttctgttkcacaaagaggcttattggattatcgaatttttgtccttgtaggaatctattcggtggttagaagatgaaaaggccctcttagagatgactgaagaagtagattatgatgtcgattcatatgctacacaacttgaagctattcttgagcaaaaaatagacattttaactgaactgcggggtaattctttttccattttaatgtttgaaatctgattggtattggtatgtatattggtgagagggcttcttcgtattgcaagaggacatacgaagtgaaaattaggggcactgtttagcatc

SEQ ID NO: 196800 - DNA, 601 bp, Human
ttgagtaggctgaggaggaagaggcaggctggacctggtgtctcagggctggcagaagtggaggaggtggaagggatggcaggagaggcaggcatactcagcgtaacttacattgaaaaaaatccacataagtggacccaaacagtttaaacccatgttgttccagagtcaactgtatttcttaattatactgtctgtgaataaagatgttttatgtctattgacattttagagaatactatcttaagtatgtttgattatatttaacagaattgtaatttggtttctgtttcacaaagakgcttattggattatcgaatttttgtccttgtaggaatctattcggtggttagaagatgaaaaggccctcttagagatgactgaagaagtagattatgatgtcgattcatatgctacacaacttgaagctattcttgagcaaaaaatagacattttaactgaactgcggggtaattctttttccattttaatgtttgaaatctgattggtattggtatgtatattggtgagagggcttcttcgtattgcaagaggacatacgaagtgaaaattaggggcactgtttagcatctattttcca

SEQ ID NO: 196801 - DNA, 601 bp, Human
accaaatctagaagttcttaaattcatttcaaaatttcaaaaaagttaactttttaaacatcactgtactttcaaaaaggggaggaaaattgagattccaactttattctgaagtctacagagtagggtttcgtaaccttgacactgttaacatttggggctaggcctttctttgttgaggagtgttatcctgtgccttgtacaatatttaccagcatcgttggtctctgtccactacatgacagtagcaccacaccagttgggataaccaaaaatgtctctagacattaccaaatgcccsctgggggccaaaaatcatatccagttgagagccactgttattgaaagatagcttatcttcacagctgcatgtaatttgtctgacaatttactaacctatttctagtttttacatgactctagagcagtacatgaccagaaaatgcgtaaaatcaagaaatatatcatttagtcatccccccttcacaatcccccttcctcacagtgaggacaaaatgtaaatttctaaaaattcaaatatattttacatgttcatagctttaaaaaggtaaaatagggggtgctgagcacggtggctcat

SEQ ID NO: 196802 - DNA, 601 bp, Human
ctgacaatttactaacctatttctagtttttacatgactctagagcagtacatgaccagaaaatgcgtaaaatcaagaaatatatcatttagtcatccccccttcacaatcccccttcctcacagtgaggacaaaatgtaaatttctaaaaattcaaatatattttacatgttcatagctttaaaaaggtaaaatagggggtgctgagcacggtggctcatgcctataatcccagcactttgggaggccaaggcgggcagatcacctgaggttgggagttcgagaccagcatggccaacayggtaaaaccccgtatctactaaaaatacaaaaattagctgagcgggtggtgcacgcctgtaatcccagctactcgggaagctgaggtgggagaattgcttgaacccatgaggtggaggttgcagtgagcctagatcgcaccattgcactcaagcttgggtgacagagtgagactccatctcaaaaaaaaaaaggtagactatgtattttacaatgtgaaacctgcctatactctaggaggaattccaataaattaaaacagagaactgtaaatgtgccaaacagaacagaaagctattga

SEQ ID NO: 196803 - DNA, 601 bp, Human
tgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccgggtaagagccagcccccaggccctctccctcccccagagagttggattgggctcaccatcccctcccacargtcagacagcccctattcaagtccataagcatttactgaggtggcttggtgcagggaaatggcagggccttcatagccataagtatgggagttcacatcttgactgttccttactgcctgtgtgacctcaggcaagtgacttaacctctctgagtctcagctgcctggttgtagaatggcagtggtaagagctagtgggtcctcatggggattaactgggatgttgtctataagatacttgacacatagtagggcagctcacttaccctcagggcactctggacatggttgcaggagaga

SEQ ID NO: 196804 - DNA, 601 bp, Human
gagggcgtggtcaccaaaagtcggccagttatgatcctcactgagttcatggaaaactgcgccctggactccttcctccgggtaagagccagcccccaggccctctccctcccccagagagttggattgggctcaccatcccctcccacaagtcagacagcccctattcaagtccataagcatttactgaggtggcttggtgcagggaaatggcagggccttcatagccataagtatgggagttcacatcttgactgttccttactgcctgtgtgacctcaggcaagtgacttaacctctytgagtctcagctgcctggttgtagaatggcagtggtaagagctagtgggtcctcatggggattaactgggatgttgtctataagatacttgacacatagtagggcagctcacttaccctcagggcactctggacatggttgcaggagagacgaggtagagtctgagtactcggagagggaaggcaggtgggcaggccatgggctgatgggagcaatgggctcacctgagcctgcttgttgcctgcagctcaacgatgggcagttcacggtcatccagctggtgggcatgttgcggggcat

SEQ ID NO: 196805 - DNA, 601 bp, Human
cctggaggatgacccctccgatcctacctacaccagttccctggtacaggaagccgctgggagggagactgggggcggggcctatcagccaggggctcgggcctggggggcagcccggagtcacagggtgaagggcctgtgcccccctcaccagggcgggaagatccccatccgctggactgccccagaggccatagcctatcggaagttcacttctgctagtgatgtctggagctacggaattgtcatgtgggaggtcatgagctatggagagcgaccctactgggacatgagcaaccargatgtgagtgaggctacgccagagtggttgggtaggtgggtgctggctggggatcatggcagtggctcactcagggtttccctgccttcggcccaggtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctgggttagtacct

SEQ ID NO: 196806 - DNA, 601 bp, Human
ctccccctgccaccaactcttcccaggcccatgaaaacctgattggggtaggggcccaccttcctgtagcccctgcctacctaaggtacctgcgtcttcacagagggtcaggctgttgtggccttgggacctagctatgtgactgggcaagccatgccatctctggggctcagtctccccttctgtacagtggagaggggcaggtctggggcattttccagggcccaccagctccaagggtgccaggccccaaggatgactaagcatgcctgtggctggctagaggaggtgccaggcctcmctgggacaggtgtctgggagtacccagctctgcagccccttccccttgccaagccagggcattcattgccaaggatctgttagggccggcacctccaggcttcctgcccttgacctcccagctggcttcagcccaggatgcactaatccagccctgtccagtccctgcctttgaagggccctcttagtacttcttcctgggcaggagagggaagaaaggaggctgtgataggaatgtcacccactgccttatccctaaagccactgcttcctttctcctcatttaccttgccagatccaa

SEQ ID NO: 196807 - DNA, 601 bp, Human
agcactttgggaggccaaggcaggcagatcacctgaggtcgggagtttgagaccagtctggccaacatggtgaaaccccatctctactaaaaatacaaaaattagccgggcctgttggtgggcgcctgtaatcccagctactcaggaggctgaggcagaagaatcgcttgaacccgggaggcagtgattgcagtgagtcaagatcgcgccactgcactctagcctgggtgacagagcaagactccatctcgaaaaaaaaaaagtctcaatatggggaaagatccactagaagtaagagccrtggcttctacctcgtggcttgtgggtgtgatactcccaacagtccccaaagctggtggtcctcaccgcgtgacagtgagcagagcagctcagagggggtcactgctcacctgggtgcatggctgaccacagccaggctggctctcagtgggatgcccaaggtgctagactctgcttagtctccctcgggccctgggcttgaggcattgggcccggcccagacctcatttcatgcactgagacctttgttccagggcccctcacccctctgaaggtgttcgggcaggggcaatgtgataag

SEQ ID NO: 196808 - DNA, 601 bp, Human
gtaagagccatggcttctacctcgtggcttgtgggtgtgatactcccaacagtccccaaagctggtggtcctcaccgcgtgacagtgagcagagcagctcagagggggtcactgctcacctgggtgcatggctgaccacagccaggctggctctcagtgggatgcccaaggtgctagactctgcttagtctccctcgggccctgggcttgaggcattgggcccggcccagacctcatttcatgcactgagacctttgttccagggcccctcacccctctgaaggtgttcgggcaggggcartgtgataaggccatgaggggtctgcagcctccagccccactggggaggtggccagtgatttccaccttcctggcccctctgcatgcccctcccagtggaacttcctagggtccctgagtcagtcacttgcaaataattatggcgtgcccactctgcattaggcccctctcacaacaacccagtaagggggtgctatttatttattaaagcgattttttttttgagtctcgctctgtcgcccaggctggagtgcggtggcgcaatctcggcttactgcaagctctgcctcccgggttcaca

SEQ ID NO: 196809 - DNA, 601 bp, Human
aggctggctctcagtgggatgcccaaggtgctagactctgcttagtctccctcgggccctgggcttgaggcattgggcccggcccagacctcatttcatgcactgagacctttgttccagggcccctcacccctctgaaggtgttcgggcaggggcaatgtgataaggccatgaggggtctgcagcctccagccccactggggaggtggccagtgatttccaccttcctggcccctctgcatgcccctcccagtggaacttcctagggtccctgagtcagtcacttgcaaataattatggygtgcccactctgcattaggcccctctcacaacaacccagtaagggggtgctatttatttattaaagcgattttttttttgagtctcgctctgtcgcccaggctggagtgcggtggcgcaatctcggcttactgcaagctctgcctcccgggttcacaccattctcctgcctcagcctcccaagtagctgggactacaggcgcccaccaccacacccggctaatttttttttgtttgtttgtatttttagtacagacgaggtttcgctgtgtgagccaggatggtctcgatctcctgacct

SEQ ID NO: 196810 - DNA, 601 bp, Human
aggggtaccctggagtggggccagggcatggctctcccccgagggagttcctctctggctgtccccagggcagctctgcacagcctcagtacctggcgcacctcccttgacatccttcttagggacagtcaggcactctgtgtggggcactcaagagagccaggcccgtcagcctctagctcctgccagaatgcaggcctgaggggtgaggggcggggcaggggcaggggcagggacaggaactccggcgtgctctccatccgcaaaggttcactgaggccccgagccccagccactgagccaccaagtcagcctgggccaggcctgggtgccctgtctgcaatggaggcagagacggggtctcggggcagttctgaggatgctgggtgcacagcgggggcctcgccggcaggaatcacttatgctctctcctgggccaagctttgtggatgcccagcctggggccgcggggagctggcaggtcagtggcagacactggtgggcagacctagtgtctggtagaacaggcatcaaggaagtggtgaccggagggaagccaagtgcactcaaaccctcgggtgagtcatcaccgccgggtctt

SEQ ID NO: 196811 - DNA, 601 bp, Human
ccctgtagaccacccccctcaccaacttccgtcctccgccccacccccgcggtgatccggtgaactgccggccccctgctgtgcaccgagtggggcagtgaccctgacgtggcgtctcctgccgcccctgccaccgccaccacctccggtggcccagcctccgcattccccacccccatggaggaatgcaccaggcctcccttcctggatgcacccctcacccacatgcttccaaaccctggcattttctgctccccctttactcccaccccttcccctaggctcccagacaaaggggaastggctggatcctcttaaagggacagtgtcccaccagcttactgctgaactcccctcctcaaccccagttccctagttacagttaattagcattagcagacagcccatgagtgatacccatgcaggccccaggctgtggagagtttcctgggtaggaaacagcccttaaggtccctcatctcatccaggtcccagtctttcctacctgcctctctcctagattgtggccctttggagcctggttcttctgtccctgtgtgaccgacacatagcacccaaacagtggcagagcgggacggac

SEQ ID NO: 196812 - DNA, 601 bp, Human
ggaggccgaggtgggcggatcacgaggtcaagagctcaagaccatcctggccaagatggtgaaaccccatctctactaaaaatacaaaaaattagctgggcatggtggtgtgtgcctgtagtcccagctactcaggaggctgaggcaggaggatcacttgaacctggaaggcagaggttgcagtgagccgagatcgagccactgcactgcagcctggcgacagagcaagactccgtctcaaaaaacaaacaaaaagaaaacttgttctaattcttacaaaggtgcctgtagccgaggcagsggcccaggtgaggtggaggagggcgggagtggacgtctcagcccggcccctctcctgcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtgagcgccccctgccttgcacactcacctggggtgggggtatccaagcagaccccatgctccaggtctctctcccatcattgtctctcctggtctccttt

SEQ ID NO: 196813 - DNA, 601 bp, Human
ggcgggtgcctgtaatcccagctactcaggaggctgaggcaggagactctcttgaacctgggaggtggaagttgcagtgagccaagattgcaccactgccctccagcctaggcaacagagcaagactctgtctcaaaacagaaaacctcagacgtcagctttcttactggccatgactgcagcatggtgctggcacaaaccaccagaggtggggtggatgccacaagttaaggacaccatccccagcataactgctccctctttagacaccagccacaagttcaggggtccccaacccacwcacacttctgaccgactggctacaaattcagggactcccaagaccctgccaagtttgatcgtttgctaacagactcacagaactcaggaaatcctccatttttatcccagttttattatgaaggacacagctcaggtccgaccaaatgaagaagcatctcccctccctcccctagcacatcaatgtgatcaccaaccaggaagcttcactgagcttcagcagccagagtttttattgggatttcattacatcgtcatgactgattgagtcattggccgtatgatcaagcttagtctctag

SEQ ID NO: 196814 - DNA, 601 bp, Human
aacgtggcttgatcccagatgggcttttaatgacttcctcctgaactggatttatcctcaggccttgtcctggccgccttacaggatcacagcgagtagacagacccgaatgactcagagggacgagggctggctgggcacgcacagttcctgctcccagttccataggaagagtgaaagaaaagaaagctggccaggtgcagtggctcacccctataatcccagcactttgggaggccaaggcaggcagatcacctgaggtctggagtttgaggccagcctggccaacatggtgaaaccrtctctactaaaaataagaaattagccaggcatggtggtgcgtgcccgtaatcccagctactcaggaggctgaggcaggagaatcgcttgaacccaggaggcggaggttacagtgagccaagatcacaccactgcacttttggacaattgctagctttccttttcttttgagacagagtcttgctttgtcacccaggctggggtgcagtgttgtaatcaacagagtgagactccatctcaaaaaaaaaaaaaaaaaggaagggattgggggaagagcctggggctgggggctgcagagatg

SEQ ID NO: 196815 - DNA, 601 bp, Human
tgaactggatttatcctcaggccttgtcctggccgccttacaggatcacagcgagtagacagacccgaatgactcagagggacgagggctggctgggcacgcacagttcctgctcccagttccataggaagagtgaaagaaaagaaagctggccaggtgcagtggctcacccctataatcccagcactttgggaggccaaggcaggcagatcacctgaggtctggagtttgaggccagcctggccaacatggtgaaaccgtctctactaaaaataagaaattagccaggcatggtggtgcktgcccgtaatcccagctactcaggaggctgaggcaggagaatcgcttgaacccaggaggcggaggttacagtgagccaagatcacaccactgcacttttggacaattgctagctttccttttcttttgagacagagtcttgctttgtcacccaggctggggtgcagtgttgtaatcaacagagtgagactccatctcaaaaaaaaaaaaaaaaaggaagggattgggggaagagcctggggctgggggctgcagagatgctgaaattgatgacgcccttgacactcttttcttcccaccc

SEQ ID NO: 196816 - DNA, 601 bp, Human
aggccttgtcctggccgccttacaggatcacagcgagtagacagacccgaatgactcagagggacgagggctggctgggcacgcacagttcctgctcccagttccataggaagagtgaaagaaaagaaagctggccaggtgcagtggctcacccctataatcccagcactttgggaggccaaggcaggcagatcacctgaggtctggagtttgaggccagcctggccaacatggtgaaaccgtctctactaaaaataagaaattagccaggcatggtggtgcgtgcccgtaatcccagctactcaggaggctgaggcaggagaatcgcttgaacccaggaggcggaggttacagtgagccaagatcacaccactgcacttttggacaattgctagctttccttttcttttgagacagagtcttgctttgtcacccaggctggggtgcagtgttgtaatcaacagagtgagactccatctcaaaaaaaaaaaaaaaaaggaagggattgggggaagagcctggggctgggggctgcagagatgctgaaattgatgacgcccttgacactcttttcttcccaccccggcggctcttgcagcgg

SEQ ID NO: 196817 - DNA, 601 bp, Human
aggtggaggtttcagtgagccccgactgccattgcactccaggctgggcaacaagagtgtaactctgtatcaaaaaaataaaaataaaaaaaacacactcaaaaaataaaaagacattttctttagtccatgtctgatccaacaagaaagaggaggaaccaagtcaagaatgagtgaagaagctgggcgcagtaactcacacctgtaatctcagcactttgggaggccaaagtgagaggatcacttaaggccagaagtttgagaccagcttgggcaacatagcgagacctgcatgtctacaaaaaaaaaaaaaaaattaaaaattagccaggcatggtgaaatcactgaacacataaaggctgggcatggttgctcacacttataatcgaaacactttgggaggctgagatgggaggatcacttgaggccaggagttcgaaaccagcctgggaaacattgtagtcacagctacttgggaggctgaggcagaaggatctcttgagcccaggaagtggctacagtgagctataattgcacgactgcactctaggctgggcaatggagcaaaaccctgtctcaaaaaaatggggcagggctgat

SEQ ID NO: 196818 - DNA, 601 bp, Human
tgagctataattgcacgactgcactctaggctgggcaatggagcaaaaccctgtctcaaaaaaatggggcagggctgataaagattagattactgtgtgactttgagcagctgctttctctctaggctttgggggtctgtttgaacaatgagggagttggataccttggagctttctaagatttctgtggcgcctttattgacaccttgagaagtagcatgcagtgtttctacttttgggcaattggtcacttctttttttttgagacagtctcactctgtcgcccagtctggggtgcagkggtgtgataccagctcactgcaacctccacccacaaggttcaagcaattcttgcacctcagccccctgagtagctgggactacaggtgaccacatgtggctaatttttgtatttttagtaaagacagggtttcaccatgttggccaggctcgtttcaaactcctgggctcaagtgatcctcccttctcggcctcccaaagtgccgggattacaggtgtgagccaccgtgcccggcccaagtgctagctttctctctctctttttttttttttcgagacggagtctcgctctgtcgcccag

SEQ ID NO: 196819 - DNA, 601 bp, Human
ggcccaagtgctagctttctctctctctttttttttttttcgagacggagtctcgctctgtcgcccaggctggagtgcagtggtgtggtctcggctcactgcaagccccgcctcctgggttcacgccattctcctgcctcagcctcccgagtagctgggactacaggcacctgccaccatgcccggctaattttttttttatatttagtagagacagggtttcaccatattaggcaggatggtctcgatctcctgacctcgtgatccgcccgtctcggcctcccaaagtgctgcgattacrggcatgagccaccacgcccggccctaccaagtgctagctttcatttgacgcagtgaatgtttcttgtacacctggcaggtgcctggcactgcataggcactgttgagatgtgaaggtggccctggggacagaaaattatactgggcttgactgtgtgtctccatcccttgacatcagccaagccagcagctgctttacatacatgatgagcagacagctgcttgaaagagatgaggaaactcccagaccaacggctcttaccagagggccaagggaggtccccacagagtcagaggctgc

SEQ ID NO: 196820 - DNA, 601 bp, Human
tttttttttttttttttttggagacagggtatcactgtcattgaggctggagtgcagtgatgcgatcacagctcactgcagcctcaacctcccaggctcaagtgatcctcccacctctgcctcccaagtagctgggactacaggcacgggccaccacgcctggctaggcattctgttatgtaattatcaattgtatcttatagttcagtgatcacattttggaaatgtaacattgataccattatctaatacacagaccatattcaaattttgcctattgtctctatactgaactactgarctgtcctttatagcaatctccccctcatccacagtccagtccatgatcaacattgcatttaatcgtcatgtgtcatcagtatcttttttttttttttttttgagacggaattttgctcttgttgcccaggttggagcgcaatggcgcaatcttggcttattgcaacctccgcctttgggcttaagtgattctcctgcctcagcctcctaagtagctgagattacaggcgtgcaccattatgcatgcctaatttttgtatttttattagagacggggttttaccatgttgccctggctggt

SEQ ID NO: 196821 - DNA, 601 bp, Human
gagcgcaatggcgcaatcttggcttattgcaacctccgcctttgggcttaagtgattctcctgcctcagcctcctaagtagctgagattacaggcgtgcaccattatgcatgcctaatttttgtatttttattagagacggggttttaccatgttgccctggctggtcttgaactcctgacctcaaatgatccacccacctcagcctcccaaaatgctgggtttacaggcatgagccactgcgtctggccatttcctcagcctttcattgcccttcatgatcttgacatttttgaagtgtrcaggccagtcattaaagtaaaatgtttttccttttttttttttttttttttaaaaagagacagggtctcactgtgttgcccaggctggtctcagactcctaggctcaagtgatcctcccgcctcagcttcccaaagtgctgggattacaggcgtgagccatcgtacctgccctcgcatttgggtttgactgatgtttcctcttagggagacaggctctgcaggtttggcctgatactgcataagtgatcctctgtccttccgagtggatcttgccaggagacatatgatgtcagtgtgcc

SEQ ID NO: 196822 - DNA, 601 bp, Human
gccagtcattaaagtaaaatgtttttccttttttttttttttttttttaaaaagagacagggtctcactgtgttgcccaggctggtctcagactcctaggctcaagtgatcctcccgcctcagcttcccaaagtgctgggattacaggcgtgagccatcgtacctgccctcgcatttgggtttgactgatgtttcctcttagggagacaggctctgcaggtttggcctgatactgcataagtgatcctctgtccttccgagtggatcttgccaggagacatatgatgtcagtgtgcccttkgctgaggatgttcactttgattacttgttttttctgtactgtaaggatttttttccctttgtcatcaataaaccatttgtgagatttgagtctgtaaatatcctgttcccaaaaacccttccccaaatgatttgagcatctattgatgattcttgcctgtagcgattattactagggtggctaccaaatgctgaatttctaactctgttcttccttctgcatttgttactgtaaggaagagcttctcccccatacgagaatagtctttttgtttgcttggttgtttttttgagatagggt

SEQ ID NO: 196823 - DNA, 601 bp, Human
cttttatgaggcaaaatgaaaaccagctcacgcctataatcccagcactttgggaggccaaggtgggtggattacctgaggtcaggagttcaagaccagcctgaccaacatagagaaaccccatctgtactaaaaatacaaaattagccaggcatggtggcacatgcctgtaatcccagctactcaggagcctgaggcaagagaatcacttgaacctgggaggcggaagttgcaatgagccgagatcactccattgcactccagcctgggcaacaagagcaaaactctgtctcaaaaaaaraaaagaaaagaaaagaaaaccaggtccctaacaccgaagagttaaaagaaataagtaaatttggcaaattggtctttttgtgagttagcttataggcaactgatcgagggtctctttcccgtcttcaccctgcaattgtggctcagggcaagctgccagctccctcctgccaatgcaggagcaatagagcttggcctcctcttgcagggcgagtttgggagtcagatatgaagccactaatccgggacctttttgggacccaaggcactcatctgccccaagcataccaggcaggccagg

SEQ ID NO: 196824 - DNA, 601 bp, Human
ctgcaacctccacctcccaggttcaagcaattcctgcctcagcctcccaagtagctaggactacaggcgcccactgccacgctcggctaatttttgtattttcagtagagacggcgtttcaccatgttggccaggctggtctcaaactcctgacttcaagtaatccatccaccttggcctccccaactgttgggattacaggtgtgagccactgcgcccggccagtcctagccctttgggaggctaaggcgggcggattgcatgagctcaggagttcgagaccagcctgggaaatgtggtrtaaccccgtctctactaaaaatacaaaaaaaattagctgggtgtggtggtgtgcacctgtaatcccagctactcaggaggctgaggtacgagaatcgcttgaactcaggaggcagaggctgcagtgagctgagattgtgccattgcactccagcctgggtaacagagtgagattctgtctccaaaaaaaaaaaaaaaaaaaattcgagaccaaacatacctgggatttggaaggatagatctgttcccccagggtggagacaatggtccattgaatgggaacagctgagcatcttgtgtg

SEQ ID NO: 196825 - DNA, 601 bp, Human
cgcccggccagtcctagccctttgggaggctaaggcgggcggattgcatgagctcaggagttcgagaccagcctgggaaatgtggtgtaaccccgtctctactaaaaatacaaaaaaaattagctgggtgtggtggtgtgcacctgtaatcccagctactcaggaggctgaggtacgagaatcgcttgaactcaggaggcagaggctgcagtgagctgagattgtgccattgcactccagcctgggtaacagagtgagattctgtctccaaaaaaaaaaaaaaaaaaaattcgagaccaarcatacctgggatttggaaggatagatctgttcccccagggtggagacaatggtccattgaatgggaacagctgagcatcttgtgtgggtggccagtgcctacaagcgtgccacctttctccagctcacacctgtggcagacatcagtaattgattacagaattcctcccctgaaaccagaactcggtgttctggccatctgctacttcccagtcacacgaagtagaatcctccacctgctcaccctggatctggtgcccttcgccttggtttcctgttggggctctgagggacaggtggg

SEQ ID NO: 196826 - DNA, 601 bp, Human
cctagccctttgggaggctaaggcgggcggattgcatgagctcaggagttcgagaccagcctgggaaatgtggtgtaaccccgtctctactaaaaatacaaaaaaaattagctgggtgtggtggtgtgcacctgtaatcccagctactcaggaggctgaggtacgagaatcgcttgaactcaggaggcagaggctgcagtgagctgagattgtgccattgcactccagcctgggtaacagagtgagattctgtctccaaaaaaaaaaaaaaaaaaaattcgagaccaaacatacctgggakttggaaggatagatctgttcccccagggtggagacaatggtccattgaatgggaacagctgagcatcttgtgtgggtggccagtgcctacaagcgtgccacctttctccagctcacacctgtggcagacatcagtaattgattacagaattcctcccctgaaaccagaactcggtgttctggccatctgctacttcccagtcacacgaagtagaatcctccacctgctcaccctggatctggtgcccttcgccttggtttcctgttggggctctgagggacaggtgggcactggcctgac

SEQ ID NO: 196827 - DNA, 601 bp, Human
cagagggacttccaggtgctcacccctgccccatcaacacaggtcggaaaagggctctgggaaccattgaaagaagagcgagcaggccaggcatagtggctcacgcctgtaatcccaacactttgggaggttaaggagagaggatactttgagaccaacctgggcaacatagcaagaccccgtctctacaaaaaaattttaaattaaccgagcttggcaatgtgcacctgtcatcccagctactcggggggctgaggtgggaggctcgcttgagcccaggagttggaggctgcaatgagcyatgatcgcaccactgcactccagcctggggaacaaggcaagaccctgtgtccaaaaaaaataaaagtaactgcattggtcgggcatagtggctcacgcctgtaatcccagcactttgggaggctgagccgggcggatcacctgaggtcaggagttcgagactaccctggccaacatggcaaaaccccgtctctactaaaaatacaaaaattagcccagcatgatggtggtgagtgcctgtcatccaggctactcaggaggctgaggcaggagaatttcttgaactcaggaggcggaggtt

SEQ ID NO: 196828 - DNA, 601 bp, Human
cctgttattctggcactttgggagcccaaggcaagaggatcactcgaggccaggaattcaaggctgcagtgagctgtgatctcaccactgcactccagcctggaccacacagcaagaccctatctcaaaaactaaaataaaattcagagctttccttaaggatttgaataaaattacaaatccatctttagaaataaagtgctcaggccaggtgcagtggctcatgcctataatctcagcactttcagaggctgaggccagcagatcacctgaggtcaggagtccaagaccagcctggccaacatggtgaaaccccgtctctactaaaaatacaaaaattagctgggcctggtggcaggcacctgtaatcccagcactttgggagactgaggttggcagatcacctgaggtcaggagttcgagaccatcctggtaacccgtctctactaaaaatacaaaaaattagccgggcaaggtggcaggtgcctgtagtcccagctactcgggagactgaagcaggagaatggcgttgaacccagggggcagagcctgcagtgagccaagatcgcaccactgcgctctagcctgggtgacagcgaga

SEQ ID NO: 196829 - DNA, 601 bp, Human
aggagtccaagaccagcctggccaacatggtgaaaccccgtctctactaaaaatacaaaaattagctgggcctggtggcaggcacctgtaatcccagcactttgggagactgaggttggcagatcacctgaggtcaggagttcgagaccatcctggtaacccgtctctactaaaaatacaaaaaattagccgggcaaggtggcaggtgcctgtagtcccagctactcgggagactgaagcaggagaatggcgttgaacccagggggcagagcctgcagtgagccaagatcgcaccactgcrctctagcctgggtgacagcgagattccgtctcaaaaaaaaagcacttggaggaagcctcacagagtcctgtgctggaccacaccctggggatccagtcctggcctccagccccatttctgtaccaccctgagaccatgggatcttcctcaggttggattaccttgtatccaaggtgtggaccctatgggctcctgctaggtgtaacttgacacaacgggttccgttgtcaggtgcaatttagaaactctgggctaggccaagcgcagtggctcacacctgaattcccaaactttggaagg

SEQ ID NO: 196830 - DNA, 601 bp, Human
tgggcctggtggcaggcacctgtaatcccagcactttgggagactgaggttggcagatcacctgaggtcaggagttcgagaccatcctggtaacccgtctctactaaaaatacaaaaaattagccgggcaaggtggcaggtgcctgtagtcccagctactcgggagactgaagcaggagaatggcgttgaacccagggggcagagcctgcagtgagccaagatcgcaccactgcgctctagcctgggtgacagcgagattccgtctcaaaaaaaaagcacttggaggaagcctcacagagycctgtgctggaccacaccctggggatccagtcctggcctccagccccatttctgtaccaccctgagaccatgggatcttcctcaggttggattaccttgtatccaaggtgtggaccctatgggctcctgctaggtgtaacttgacacaacgggttccgttgtcaggtgcaatttagaaactctgggctaggccaagcgcagtggctcacacctgaattcccaaactttggaaggccgaggcaggagggtcactagaggtcaggaggtcaagaccagcttggacaacataatgagatccca

SEQ ID NO: 196831 - DNA, 601 bp, Human
ctgggaggcggaggttgcagtgagccgagatcatgccactgcgctccagcctgggtgacagagcaagactccgtctgaaaaaaaaaacaaaagaattcctgtcttctctccgaaacaaagcagcatcagtgcccccgcaggtgggagggagcgcttgcaggagggagcagtgggtccgccacgacggtctggggagcaggtggggagggggcagagggtgcagcgtgtggtgggagggaggaagccacactgctatcttcaggtgcttcccgcagctccatttgcaaagagcggatgggtytggggaaggaaggggtccccaccctgtgccaatacagcgtatcagaggtatgttctctgggctgtctacgggttggcttggggtcctggggaggggcaggccaagcgggcagtactaggatcgggtcccagcatgacccggcttcaccttcccagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctg

SEQ ID NO: 196832 - DNA, 601 bp, Human
ccgtctgaaaaaaaaaacaaaagaattcctgtcttctctccgaaacaaagcagcatcagtgcccccgcaggtgggagggagcgcttgcaggagggagcagtgggtccgccacgacggtctggggagcaggtggggagggggcagagggtgcagcgtgtggtgggagggaggaagccacactgctatcttcaggtgcttcccgcagctccatttgcaaagagcggatgggtttggggaaggaaggggtccccaccctgtgccaatacagcgtatcagaggtatgttctctgggctgtctacrggttggcttggggtcctggggaggggcaggccaagcgggcagtactaggatcgggtcccagcatgacccggcttcaccttcccagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggtgagtggttcagccctgcccatcatggccctcacgggaagccatgggggagcccagg

SEQ ID NO: 196833 - DNA, 601 bp, Human
ccagcatgacccggcttcaccttcccagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggtgagtggttcagccctgcccatcatggccctcacgggaagccatgggggagcccaggagagctgtaacctcccaagcccctggcccctcccagcctccttggctcttcagttacyctgtgggtcctgttgctcctataacacacttagtggcagccaggcacggtggctcacgcctgtaatcccagcactttgggaggctgaggtgagtggatcacctgaggtcagtagttggagaccagcctagccaacatggtgaaacccccattctttactaaaaatacaaaaattagctgggcatggtggcgggtgcctgtaatcccagctactagggaagctgaggcaggagaatcgcttgaacctgggaggcagaggttgcagtgagccgagatcgcgccattgcactccagcctgggt

SEQ ID NO: 196834 - DNA, 601 bp, Human; identical to SEQ ID NO: 196806

SEQ ID NO: 196835 - DNA, 601 bp, Human; identical to SEQ ID NO: 196807

SEQ ID NO: 196836 - DNA, 601 bp, Human; identical to SEQ ID NO: 196808

SEQ ID NO: 196837 - DNA, 601 bp, Human; identical to SEQ ID NO: 196809

SEQ ID NO: 196838 - DNA, 601 bp, Human; identical to SEQ ID NO: 196810

SEQ ID NO: 196839 - DNA, 601 bp, Human; identical to SEQ ID NO: 196811

SEQ ID NO: 196840 - DNA, 601 bp, Human; identical to SEQ ID NO: 196812

SEQ ID NO: 196841 - DNA, 601 bp, Human; identical to SEQ ID NO: 196813

SEQ ID NO: 196842 - DNA, 601 bp, Human; identical to SEQ ID NO: 196814

SEQ ID NO: 196843 - DNA, 601 bp, Human; identical to SEQ ID NO: 196815

SEQ ID NO: 196844 - DNA, 601 bp, Human; identical to SEQ ID NO: 196816

SEQ ID NO: 196845 - DNA, 601 bp, Human; identical to SEQ ID NO: 196817

SEQ ID NO: 196846 - DNA, 601 bp, Human; identical to SEQ ID NO: 196818

SEQ ID NO: 196847 - DNA, 601 bp, Human; identical to SEQ ID NO: 196819

SEQ ID NO: 196848 - DNA, 601 bp, Human; identical to SEQ ID NO: 196820

SEQ ID NO: 196849 - DNA, 601 bp, Human; identical to SEQ ID NO: 196821

SEQ ID NO: 196850 - DNA, 601 bp, Human; identical to SEQ ID NO: 196822

SEQ ID NO: 196851 - DNA, 601 bp, Human; identical to SEQ ID NO: 196823

SEQ ID NO: 196852 - DNA, 601 bp, Human; identical to SEQ ID NO: 196824

SEQ ID NO: 196853 - DNA, 601 bp, Human; identical to SEQ ID NO: 196825

SEQ ID NO: 196854 - DNA, 601 bp, Human; identical to SEQ ID NO: 196826

SEQ ID NO: 196855 - DNA, 601 bp, Human; identical to SEQ ID NO: 196827

SEQ ID NO: 196856 - DNA, 601 bp, Human; identical to SEQ ID NO: 196828

SEQ ID NO: 196857 - DNA, 601 bp, Human; identical to SEQ ID NO: 196829

SEQ ID NO: 196858 - DNA, 601 bp, Human; identical to SEQ ID NO: 196830

SEQ ID NO: 196859 - DNA, 601 bp, Human; identical to SEQ ID NO: 196831

SEQ ID NO: 196860 - DNA, 601 bp, Human; identical to SEQ ID NO: 196832

SEQ ID NO: 196861 - DNA, 601 bp, Human; identical to SEQ ID NO: 196833

SEQ ID NO: 196862 - DNA, 601 bp, Human
cctcaagatgagtggggaggagttcaccagaaaacatagaagcaattccttcagtgttagaaaaactgagggccctctcatcatctgcctatctttctgagaaattggtgctgaccacaatgtccctgggtgccttttcttagctgtacaatgagggcaacaagctaggtgatctctacaagcgtacaattttcttgccttcagtcttattcataactttggtcatgttctccttttcttttattattattatttttttgagacagagtcttactctgtcacctaggctggagtgcagtgrtatgatctcaactactgcaacctctacgtcctgggttcaagcaattctcctgcctcagccttctgaatagctggcacgcgcactatgcatgcgcataggtgcacgcgccgctacgccctgctaatttttgtatttttagtggagacagggtttcaccatgttggccaggctggtctcaaactcctgacctcaagtgatctgcccgcctcagcctgccaaagtgctgggattacaggcgtgagccaccaggcccggccatgttctccttttcctgagagaccatttcaaattcatatagaa

SEQ ID NO: 196863 - DNA, 601 bp, Human
gcagctggaagaattaaatgaaaaattgcatgtactttatcaaaccacagagaagcatgcgaaggtgaagagtggtattgcttgtagcagaccataagacaggacaattaaactaagctcaagagctaaggaggaaggttccagagcggtctttcctttcattctgatggtgtttctctcccctctgtaccaccagaacaatgttccatgtgccttcgaacatgaaggatgacattacataacactaatatgtattacatttaaaagtttaaaatgtttattctcatgtttgctacacacratgtggacacttgcttggactgacaaagtcttcatatcacctagaaaattataatgaacagggactaattactacaattgtgaataaatccagctattgtgacaggcaaagagaattcatggctctaaatatggacatgtttaatttaatatttgtatactaatcaaattatctttggggatgcatacatttgtttcttttaggaaaaatccatatcctaagaatatcatcaattttccattcattcctaaattgaagcttctatgactttattttttaaattgcttaaaatccttcaag

SEQ ID NO: 196864 - DNA, 601 bp, Human
ggtggtctgggaaataattatttccattttactggaggtttccaagctcaggagaaagagccagccgcttggtgagaatattatagtagggattcatacataggttggtttaaaatgactttcccgggccaggcgtggtggcccatgcctgtaatcccagcactttgggaggccgaggccggtggatcacgaggtcaggagatcgagaccatcctggctaacacggcgaaactccatctctactaaaaatacaaaaattcatctgggcatggtggtgtgtgcctgtagtccaagctactcrggaggctgaggcaggagaatcacttgaacccgggaggcagaggttgcagtgagccgagatcgcaccactgcactccagcctgtgagacagagcaagactcagtcaaaaaaaaaaaaaaaaaagactttcccaaaacttattccactccctagatcccaggatttattgcttatttggcttaatttctcacagatgatttcatggggctaaggaaaaagcaacaggatcaggggctggagctggctccaatgttacactgggagtatctttacgaagggtcagtgtgatgcagagatgtgt

SEQ ID NO: 196865 - DNA, 601 bp, Human
aataatttttaatggccaaaaaagctcacagataagagtggtggtctgggaaataattatttccattttactggaggtttccaagctcaggagaaagagccagccgcttggtgagaatattatagtagggattcatacataggttggtttaaaatgactttcccgggccaggcgtggtggcccatgcctgtaatcccagcactttgggaggccgaggccggtggatcacgaggtcaggagatcgagaccatcctggctaacacggcgaaactccatctctactaaaaatacaaaaattcakctgggcatggtggtgtgtgcctgtagtccaagctactcgggaggctgaggcaggagaatcacttgaacccgggaggcagaggttgcagtgagccgagatcgcaccactgcactccagcctgtgagacagagcaagactcagtcaaaaaaaaaaaaaaaaaagactttcccaaaacttattccactccctagatcccaggatttattgcttatttggcttaatttctcacagatgatttcatggggctaaggaaaaagcaacaggatcaggggctggagctggctccaatgttacactggg

SEQ ID NO: 196866 - DNA, 601 bp, Human
tgcatgatagattggatttttcctgcttatttgaagaaaagcactaaagtgaaagaaagagaaaacctgtgaagacacagataaaaatataatggaagaaataatttttaatggccaaaaaagctcacagataagagtggtggtctgggaaataattatttccattttactggaggtttccaagctcaggagaaagagccagccgcttggtgagaatattatagtagggattcatacataggttggtttaaaatgactttcccgggccaggcgtggtggcccatgcctgtaatcccagcaytttgggaggccgaggccggtggatcacgaggtcaggagatcgagaccatcctggctaacacggcgaaactccatctctactaaaaatacaaaaattcatctgggcatggtggtgtgtgcctgtagtccaagctactcgggaggctgaggcaggagaatcacttgaacccgggaggcagaggttgcagtgagccgagatcgcaccactgcactccagcctgtgagacagagcaagactcagtcaaaaaaaaaaaaaaaaaagactttcccaaaacttattccactccctagatcccaggat

SEQ ID NO: 196867 - DNA, 601 bp, Human
actacgtggggtgcagtggctcacgcctgtagtcccagcattttgggaggctaaggcaggtggatcacttgaggtcaggagtttgagaccagcctggtcaacatggtgaaaccccatctctactaaaaatacaaaaattacccaggcatggtgatgcatgcctgtaatcccagctactcgggaggctgagtcaggagaatcacttgaacccaggaggcagaggttgcaatgagccaagatcatgtcactgtactccagcctgggtgacagaatgagactcaatctcaaaaaaaaaaaaaaaattaatatgtagaactatttttacaaagcttgcaggtgatgtggtgctggaagatattcaatatattgaaaggacaaattttttctttaaaagcatccccataaaatggaacaaccacagaccaatattgaaagggttcccatgtgcatgatagattggatttttcctgcttatttgaagaaaagcactaaagtgaaagaaagagaaaacctgtgaagacacagataaaaatataatggaagaaataatttttaatggccaaaaaagctcacagataagagtggtggtctgggaaataat

SEQ ID NO: 196868 - DNA, 601 bp, Human
ccatctttcaaggggataggaaacacatgataaatagagaaaacccacatgtaaggcatttatgtcatattgctccaaaatgaagtgaatggggatgacagtggcagagccagtcacataaccttctcagcgtcaataaaattccctgggctgtaagtgaatagtcccatctgttatgcacatttgtttatcacaaagcttgagagtttatacataacgagctgcctttgaattaaggtattgcacatccaaggattctcttttaatacatttgagagatggtactttaaatgagcacttygactaattccctagtgtaatgtctacttggaaatgttattgctatgtgtcactaggtcctgccttcacatatgttcaacttaaaaaaaaaaaaaaactacgtggggtgcagtggctcacgcctgtagtcccagcattttgggaggctaaggcaggtggatcacttgaggtcaggagtttgagaccagcctggtcaacatggtgaaaccccatctctactaaaaatacaaaaattacccaggcatggtgatgcatgcctgtaatcccagctactcgggaggctgagtcaggagaatcactt

SEQ ID NO: 196869 - DNA, 601 bp, Human
gatagaactttggatgacacatgaagtctcattgtctttttttcaccaaaatagccagcactacaaacccactttgtcaaattatttggttggcttcaagacagcgaatatgggatcttataaccaagtaaagcaaatatggccatctttcaaggggataggaaacacatgataaatagagaaaacccacatgtaaggcatttatgtcatattgctccaaaatgaagtgaatggggatgacagtggcagagccagtcacataaccttctcagcgtcaataaaattccctgggctgtaagtsaatagtcccatctgttatgcacatttgtttatcacaaagcttgagagtttatacataacgagctgcctttgaattaaggtattgcacatccaaggattctcttttaatacatttgagagatggtactttaaatgagcacttcgactaattccctagtgtaatgtctacttggaaatgttattgctatgtgtcactaggtcctgccttcacatatgttcaacttaaaaaaaaaaaaaaactacgtggggtgcagtggctcacgcctgtagtcccagcattttgggaggctaaggcaggtgg

SEQ ID NO: 196870 - DNA, 601 bp, Human
acaaaactttactgaactcttaaccaaaatcagtgcctaattaaaaagaaaagtcaagtttgggaattatggtctgccctggctgaactgagttcctaaaacacatattacaaatgaataagatcacattcttctgatataactcaataaataatttgaattattttaaaataactacctaaaattcctaaataattacataaattatattacctgaatatttacctaaaaataaatagattttaaaataaataaataaaaaataaaatagattttaaaataaaataaaaaataaatgcartaaggcccctaaatatctggcatcatgctataaagtagagagccaaagaatataaaatatgaaatattttacccactcaaaaaaactataaataatacaaggtatatgattcatgtgagaatcaagatttgaggatgaacataaataaaacagagactttgagaggagaaaataataatttgggaaggtcccagaaaggaagcaatacttgaactatcccttgaaaaatgactatgatttgtagaaagtcaaaaaggaaaattttatctcatcggaaaaaatagcaaaagtgaacttgta

SEQ ID NO: 196871 - DNA, 601 bp, Human
agcagccagtggtgtaaagagggtgagaagggaagagatcagcaaaccagcaccaagcattttttttgctccaaatatccctgctaaatatccacttgggatcagagtcagtattatcccatagttgatggagctaaagatgataccctgagtttctgggctccattgatacacagaggcctgggggaaaaataggaaaactctttgtcaagaagtcctattatgaaaatctactttacagtcagagttgcttgaggttagtgagaccctagtataaaatattgatttttgtttctctctrtattcttcctaccttcccaaataaccaattatacccctaatttgcttgtcttagtagaaggagagaaaaacagaagaaatgaagaaaagaggtaaagaaaatgattatatagatgaataataggaagaagtaaatggaagaaaacattgagagatatttcatctgtgaaagcacttcctctattttgcttctagtaaaagttgagtaacatcttgactcttatatcaaagaattttttaaaacacacacacaaaactttactgaactcttaaccaaaatcagtgcctaattaaaaagaaa

SEQ ID NO: 196872 - DNA, 601 bp, Human
agtttttacataagctatgcaataggatagatggaattttggcacaaggaacaggggcaaagaactttccaggcatataaactaacgggagcagagccagagggaagtgcagtgcagatctatgtggagagcagccaatgtccagtgccactggagccatgcttgcacaggggagttgagtggaacaaggttggggccagatggctaagaacttttgtattcatgcaataaagaggtcaggctttactctgtaagcatgaaggaacacattgaaaattctcaagcgggtgagtaaaaatgygccatctttattttagcaagctaacttggttttggtgggaagaaggttgaaagaaaccagtctagaagagagagatcagcagatagtatttgcaaatagaggagatggttacaactatgatggaaggaagcaagaacgcaggagggttgcttgaggtaaaagtctgcaggatgcagctgtgtagtggacctaggagtgagaagctggatggaattttagttctgctcttcgagtatatactctcagcacgacaggctggggagaacagcaatgataaagctgtagaggcctgagtaggat

SEQ ID NO: 196873 - DNA, 601 bp, Human
atatctgaggataaattgataataattataagatttaggaagttttggccgggcgcggtggctcacgcctgtaatcccagcactttgggaggccgaggcgggcggatcacgaggtcaggagattgagaccatcctggcttgaaaccccgtctctactaaaaatacaaaaaattagccggtcatggtggcaggcgcctgtagtcccagctactcgggaggctgaggcaggaaaatggcgtgaacccgggaggcggagcttgcagtgagccgagatagcgctactgcagtccggcctgggcgraagagtgagacaccgtctcaaaaaaaaaaaaaaaaaaaaaaaaaaaaggtttaggaagtttttacataagctatgcaataggatagatggaattttggcacaaggaacaggggcaaagaactttccaggcatataaactaacgggagcagagccagagggaagtgcagtgcagatctatgtggagagcagccaatgtccagtgccactggagccatgcttgcacaggggagttgagtggaacaaggttggggccagatggctaagaacttttgtattcatgcaataaagaggtcaggctt

SEQ ID NO: 196874 - DNA, 601 bp, Human
atacagcccctgccctcaaagagcttctggtccaattggagagaaaaatgtgaataaaattgattgtcactagtgaaatgccatgtaggctttggaagtctacattaaaaaacaacaagacacatatttcacagagacctatagtaagaaatgcattttacagggtaacataacacacacaccaatatgcataaacacttgtacatacaaccacacacatatgcctcaaacgatggtttcatgaatcgatatttaactttaccatgtccaatgcactccaacaatttctattctattctaytcattttttaaaataatgattttaacccgctcaatggattttatgactcactaatgggtcccaaactgaaatttgaaaaaaaagatgtaaaatataaatataataaaactacaatgtacgtggaagtatatctgaggataaattgataataattataagatttaggaagttttggccgggcgcggtggctcacgcctgtaatcccagcactttgggaggccgaggcgggcggatcacgaggtcaggagattgagaccatcctggcttgaaaccccgtctctactaaaaatacaaaaaatt

SEQ ID NO: 196875 - DNA, 601 bp, Human
taatatgaggctaggggcaggaaatgaaagacttacaaaaatcggtaagatacagcccctgccctcaaagagcttctggtccaattggagagaaaaatgtgaataaaattgattgtcactagtgaaatgccatgtaggctttggaagtctacattaaaaaacaacaagacacatatttcacagagacctatagtaagaaatgcattttacagggtaacataacacacacaccaatatgcataaacacttgtacatacaaccacacacatatgcctcaaacgatggtttcatgaatcgatawttaactttaccatgtccaatgcactccaacaatttctattctattctattcattttttaaaataatgattttaacccgctcaatggattttatgactcactaatgggtcccaaactgaaatttgaaaaaaaagatgtaaaatataaatataataaaactacaatgtacgtggaagtatatctgaggataaattgataataattataagatttaggaagttttggccgggcgcggtggctcacgcctgtaatcccagcactttgggaggccgaggcgggcggatcacgaggtcaggagatt

SEQ ID NO: 196876 - DNA, 601 bp, Human
tgtggcagggaaaaatttccaatgcacttacaagagacagtattatttgtattcaagccatacatccattatggattcccaaaagaaatatttttgtacaatacctggttaacatgtacaaaccaaaataattagcatcattaatgagaaagccattcaggccaggactatatttaatgacaccatttggctataaaaacaaaatcaagtgtagaaaattgtcttattattggaattccttatttgaagaacattctatgttaaaagattctgaggactagttttctttaaatcccctctmattactggattcactgattcttttattttaaagctaaaaatcaggcaccatgatgacacccaagtgatgaaaacatagaatggattccttgcctcaagcatttcacagtctagtggaaagaaaaggagaaataaataattacacaccaacataacctagagaggaaatatcataaaggagagaatgccagaatctgatagggtaagccctggaagggcccatggggaagggaacatttgaattgaactttgcaagattaacttggtagagaacaggtgaaaggcatcttggacagaaata

SEQ ID NO: 196877 - DNA, 601 bp, Human
tggatgctgcagcagctctatcacttagtattgtgcaacctggggcaagttatctcacctctaagtgtcctgtttccacatctgtgaaaagggaattataacaatgcctctctcaaggtcattgtgaaggttaaattaatggttatatgtaaagccagaatgtaataggtaacacagaactgtttctccttattaccattatcattttcgtagaagtataggaagtaaactcacatctctgatgttaacatggagcagagtactgatatacgttggtaggtatgttaggatgatggtgcayaaccagaaatggctgaaaaaacccaggaaaatggcccaaagtggtaggcatgtgaccatcgcctttatggggacagctcgtccaggagaactgggctgaaaagaaagatctaatcagcatgagtattagagcagccaagatggtgcctctcagaggagatccacaccctgccctagagacctctgcatgggccacaggtacaaggtgtgcactgtacctgttgagccagtgaggacaggatgtgctccttttccctaacacttatgcacgggtgatgcatggggtcatcataaatcactg

SEQ ID NO: 196878 - DNA, 601 bp, Human
tccttgacatgtgtctttcattctggtcataactaagaactgtttcatgctcatgtacctctaggaagtcatacgtgctgtcttctgcaccggaacagctcattttaatcaatctaacatctattcatcttgagaaaataagcttatatttttcttcctctgggaaatctgacctaccagagtctgatttagaggctcatgtaaatagagtaattgtgttgccatccagatctttagagcaccgtgtgtatctccaacacctaaaacaatacctgccacttgaagatgttcaataaactgrcccaacctgactgatgaggaatccagtggcagtggaagagatgattcctgcgatgagcccaaatccccttgagattcccatgaggaaacttgcatatctgtgggaagatgattttataaatgattttatatagaaagccacctacagcttctgcagcaactcaactttaatgcaattcagctctaatggcaaagtcattttgcttaatgcagtttttcattcacctaaagacattcagggcaatgtctatttgccaaacctgaaattaccaatctaccaagtcaataaccagggagcaat

SEQ ID NO: 196879 - DNA, 601 bp, Human
cctcccagttgtgtattgcaatgttgatcacaaggaatataaggaacaatgtgcagtagttacttaagaaagtttatgaaactattggaaacaaaatggccaaaatgcacatggggttctgagttgagatggttatttctttaaacaaaaataaaatacactaatgtttttctgaaaatttggatttcaacatataatattactcatttaaaattatgcctaaaatggcattgtggcattgtgtttgtgtcttctctgtttttttttgttgttgttgttgctgtttgttttgtttttttttgtttctgtattggctgttgacaactatcactacaacccatctcaattcaacatgagttctctttggtcttctgtgtgaccctcctcagaaagccctactaagtcatttccagcattatagtcacagtggattcctagcagtttagtcaaatattaacctgggaacttgatcacatagaaatgtagtaaaaacaaaacttctctttgtaagttggttctcgtcagtccttccatccctgcctgggtctgtcttttcatcttcctcatgagcctgcatttccaaacaccgagcaagcctcct

SEQ ID NO: 196880 - DNA, 601 bp, Human
ttctacaccagttctagtagccctcccagttgtgtattgcaatgttgatcacaaggaatataaggaacaatgtgcagtagttacttaagaaagtttatgaaactattggaaacaaaatggccaaaatgcacatggggttctgagttgagatggttatttctttaaacaaaaataaaatacactaatgtttttctgaaaatttggatttcaacatataatattactcatttaaaattatgcctaaaatggcattgtggcattgtgtttgtgtcttctctgtttttttttgttgttgttgtttctgtttgttttgtttttttttgtttctgtattggctgttgacaactatcactacaacccatctcaattcaacatgagttctctttggtcttctgtgtgaccctcctcagaaagccctactaagtcatttccagcattatagtcacagtggattcctagcagtttagtcaaatattaacctgggaacttgatcacatagaaatgtagtaaaaacaaaacttctctttgtaagttggttctcgtcagtccttccatccctgcctgggtctgtcttttcatcttcctcatgagcctgcatttc

SEQ ID NO: 196881 - DNA, 601 bp, Human; identical to SEQ ID NO: 32229

SEQ ID NO: 196882 - DNA, 601 bp, Human; identical to SEQ ID NO: 32230

SEQ ID NO: 196883 - DNA, 601 bp, Human; identical to SEQ ID NO: 33241

SEQ ID NO: 196884 - DNA, 601 bp, Human
acatggctctctaaatttctttagatctctgaatgacattgaaacaatgacatttaataaactgtcacttccccagagatgtttccaatggcaatcttttcaaaagtggccattcctcccccatcaatgctctatctctcactctgcttcatttttgttcatagccctcatcactagctgaaattaccatgtatatttacttgtttactatttcattgtctgcatctcatgttagaatatatgctccgtgagggcagggacgtttatcgaactcctaggcctagagcattgcctggtaggtaataaatgctccacacatgtttttgaatgaatgaacaaatctctcaagtgccaagggtctttgaagcttctgtatttcttataagatttgtcatgtttcctgcctgctctaatgagcggaagggagctttgtgaattccttgtgtcctacatggatgcccatggagacaaggctggaaacctggtacatgaatcagaagccctccaatctagagagaaggaacccaccctttcttctgtgcaggaagccaccattgcagagaaggggcagccccaggtttggatgccccctggcagagtg

SEQ ID NO: 196885 - DNA, 601 bp, Human
gacagtgaccgtctcaatgggtacctaaatgaatgaatgattgaaacaggttaaatagtgctggtggggggactaggtaggagcacatcagataagatggctaagatggcctctctttctacctactattcactctatgtggaatgattttctctcagctctgtacatggctctctaaatttctttagatctctgaatgacattgaaacaatgacatttaataaactgtcacttccccagagatgtttccaatggcaatcttttcaaaagtggccattcctcccccatcaatgctctatcyctcactctgcttcatttttgttcatagccctcatcactagctgaaattaccatgtatatttacttgtttactatttcattgtctgcatctcatgttagaatatatgctccgtgagggcagggacgtttatcgaactcctaggcctagagcattgcctggtaggtaataaatgctccacacatgtttttgaatgaatgaacaaatctctcaagtgccaagggtctttgaagcttctgtatttcttataagatttgtcatgtttcctgcctgctctaatgagcggaagggagctttgtgaat

SEQ ID NO: 196886 - DNA, 601 bp, Human
aatatatagtaaatatgcatgttatacatacatttgcacatgtgtataatatccgtatatacatatatgtacacacatatgttttacccaggtatacttacccaaaaggtgaacatgaaattacatatatcgaaccttttctagggaaggtctaacttggtagacattttattctcaaaaactttgacaattaactctccattctagctagagtggaatgggtatatataactttgtacctgctcaaaatttccagttgaaattacctctccatgtgtttttaaaattctatttttgaaayagtttagctttagcattgggaaaggatacagaacctttacataaatacatttgtccctttacataaagaaattctaggccaggtatgagttggatagtttatgatctccttgcaaagctgggctagtcactgcaaagttgcaatgcctattaagcccattaagcttaccacctaaacacataaagtgataataagtgtttcaggtatcattttctttcttatgtgtcaattctaagctttatcagaaagtactaaaacaaacccatataaattactgatagttggactcaaacagaatca

SEQ ID NO: 196887 - DNA, 601 bp, Human
tggccaacatggcaaagtcccatctctactaaaaacacaaaaattagccaggcctggtggcacatgcctgtaatcccagctatttgggaggctgaggcatgagaattgcttgaacccaggaggcagaggttgcagtgagccgagattgcaacactgcactaaagcctgggcaacagagtgagactctgtcaaaaaaaaaaaaaaaaaaaagaaaagaaaaaaaaccacaaaaaagatgtttactagttttatgatataagtttataagcagccagagtaggtgtgtaggtgtatatggccraatacagagattttttaggataagatgcctcctaagcaaaaaaacaaaaaacaaaaaaaaaaactgaactcagttgggcaattaatctaatttctacctatctccactgttttaaactagaaatggaaattgaaggtcaatgttgtaaatattacaattatagttaagcattactgcggtgaaacaagtccataactccatgtaaaattcctgcccaaagaaaggtgtttagatatattttaaagaaatgggttctgagttcaacctctcttttccttcatgggcatcttgccttaaaac

SEQ ID NO: 196888 - DNA, 601 bp, Human
aattgtttactattatgggtacaccatacccagtggctgggtgtggtgactgatgcctgtaatcccaacagtttgggaggctgaggtaggcagatcacttgaggccaggggttcgaggccagcttggccaacatggcaaagtcccatctctactaaaaacacaaaaattagccaggcctggtggcacatgcctgtaatcccagctatttgggaggctgaggcatgagaattgcttgaacccaggaggcagaggttgcagtgagccgagattgcaacactgcactaaagcctgggcaacagrgtgagactctgtcaaaaaaaaaaaaaaaaaaaagaaaagaaaaaaaaccacaaaaaagatgtttactagttttatgatataagtttataagcagccagagtaggtgtgtaggtgtatatggccgaatacagagattttttaggataagatgcctcctaagcaaaaaaacaaaaaacaaaaaaaaaaactgaactcagttgggcaattaatctaatttctacctatctccactgttttaaactagaaatggaaattgaaggtcaatgttgtaaatattacaattatagttaagcattactg

SEQ ID NO: 196889 - DNA, 601 bp, Human
aaaatacaccatgcactatcttgctcattaataattcaaatctactcttatttattcaagcaacaaatagtggggggcttttagcttagtttttctttttgttttttagtatcggaattgtttactattatgggtacaccatacccagtggctgggtgtggtgactgatgcctgtaatcccaacagtttgggaggctgaggtaggcagatcacttgaggccaggggttcgaggccagcttggccaacatggcaaagtcccatctctactaaaaacacaaaaattagccaggcctggtggcrcatgcctgtaatcccagctatttgggaggctgaggcatgagaattgcttgaacccaggaggcagaggttgcagtgagccgagattgcaacactgcactaaagcctgggcaacagagtgagactctgtcaaaaaaaaaaaaaaaaaaaagaaaagaaaaaaaaccacaaaaaagatgtttactagttttatgatataagtttataagcagccagagtaggtgtgtaggtgtatatggccgaatacagagattttttaggataagatgcctcctaagcaaaaaaacaaaaaacaaaaaaaaa

SEQ ID NO: 196890 - DNA, 601 bp, Human
gaattcccatgtctggaggcagtacctactacacactgagtgctccatcacatttctcaagtgggactgtctcactaatgctataccagggcatcaggaataatggctcctatttattgatcacctatatcccatagccttcaacctaaatttgtatcttctttttacatataaggaaaatcttaaataagaaatatcctgaactcaggtctttctgcctccaaagaacaagttgctttccattatacctttataacaaatggcttcttggttccaacttcaagaactatacaatcataaygtgaagtaaaaatgtgcaaacttgtatctctcctctattgatttgttatataatttggggaactcttctaaccagaatttctcattgagagaatcatatacttcctgactacatcaaagaggtgttatgaggcaacattcattcaaagtgagttccagtcttctgaggctacataaatgctaactgttgttagtaatatgtaagaattatttaaatatagaatactattttgctaagcactacaaatggagtacttcattatacagtgagaatataaaatacaccatgcactatcttgct

SEQ ID NO: 196891 - DNA, 601 bp, Human
aataccctcattgccatttcatagataagcaaagagaggcctggaatgcttaagtcttgcccatgcattttgctaataagggccatcctgtaatttgagcctagttgtctaatttttagtccagaattatttccagttcactctaaggaattttcacatagtattaagagagaggggttaaaaaaaggagacatggttgtttaataagttgtaatagcctccttactgatttcccttacccccattttctcctttcttctagctaggctggactccagaggcaccatgatcttcctaaatyatggctcttgaaactctgatgattctcctgtggttcatacaattaattgacaatgcttaggttggtgctcaaggtcatccatagaatgacctatcaatgacctatcctcattccacagcattatttctcactactccctgtgtatacctggagtggctcaattggagagtgcttgctctatgaaaaggacagacctagctcatgttgagccaatggtggtctgtgggaagggacacccagtgataccagctctaccaattttttaagagaatttggaagatagtttttaatgtcaaatct

SEQ ID NO: 196892 - DNA, 601 bp, Human
cttaagtctttgctcaaatgccacctccttgatgagcctatcctggcaccctactgaaaattctaactcctgtccctaatcataagtccccttgacctgccctactttttttctctttagtatatattactcctagcatactatataacttatcattttatcatgtctctcttcccactgtaatattccaagaaaagcatttttgactactttgtttgctaatttcagcctatatctagaacagagcctggcaaatgatgggcattcagtaaacgcttattgaataaagcacttccatccycaaatggcaatttctgtttctaaaacccatgcagaactagcttgtgtctacccctgtggttccaaatccctatctatggaaacagaattttaaattcatcaattaaatattgagcactatgccaggcactgtgctgggtgctggggaaacaaacatgaagaagacagggtctctgcctgcaaagagctttaggttagtcagggagatgtttgcaaacgcaaactactataatacaacacagtaagcgcaatgttcaagacaaacacgtcattaaggaaacacagatgaggggtgtatgtg

SEQ ID NO: 196893 - DNA, 601 bp, Human
gcatctaagggggctgtatggctccaagactggcttgtctccatgtccaaagagccaaacgatgagagttgtcaacagacggctccactgaaatcccctattccttggcctgttcagtacatttctcctccaagaattccagcccaaccataactgtgttatgatgaagaaagatgacccaccagcacttctagaccaatggctgtcctgtaacacctcaaagttcctccgatcccagagggtgataccatctaactcctttgcataaatgcacgctttccaaagttaccaccctcctagmattctacacagtttcaaaggatataaggcaacttagaatggtaaggagagatgaggagggcagtgatggtgacatttacatcacatattgaaagtcagctctctctaggacagcctactggtaaactgttatattaacattttggctgctctcacatgtatcacactctggttgacatggcagtcttctcactagagtatgtatgagctctattttggaattgcagcatcagcacactgcttcattcactataggagctcactaaacgtttctggaagccttcttaagtctttgctcaaa

SEQ ID NO: 196894 - DNA, 601 bp, Human
tgggttgtttgtttttctcttactgattttcatgatttctttatatattctggaaataggtcctttgtcagatacatgtattacaaatatcttcttccagactgtagctttcctttttattctctgagtgctgccatttaatgattaggagttcttaatttttaataaagtctaatttatccatctttctattctggttagtaatttttgtgtcttatttaagaaatctttgcttactccaaatcttgtatctttaaactcaggaagctcagaagccatttagaagttgtctgtttatttracagtgtgtaaaatgctgacaattaagctttcttcagatataagagaggaaagatgtggaggggtcggaataaaagaagcacagtggtactgaggcagggagaaacttacagaatgccctggtggtttttaggaggtggagaggaggggaagggaggcagtaatcaaggacttacaattggggtaggcaggggaattttttcttgagacaaaataacagttaacaaccatcaaacaagtctgatatatatcaagcccatgctctttcgttaaagacagtatttaacacctcactaagcaa

SEQ ID NO: 196895 - DNA, 601 bp, Human
aatttattcatctattttttggtatggacatttggatcttttccactttggggctattatgaacaagcctgctgtaaacatccttgtccatgtcttctggtggaaatatgtactcatttatcttgagaattagaaataccagatcatacagtagatatagatttaggcctggaagatattgcaaacaatttcccaaagtggttgtaataatttgccctcccactggcaacacaggagagttctagctgttccacatttttactaacccttggcattgactgtctttttgcttctagccacmctgttgggtgtgtaatggtgtttaattatggctttaatttgcatttccctgatgactaatagttcttgccatttggatatcttctctttttgaaatgtctgttcaagtattttgctcatttttaattgggttgtttgtttttctcttactgattttcatgatttctttatatattctggaaataggtcctttgtcagatacatgtattacaaatatcttcttccagactgtagctttcctttttattctctgagtgctgccatttaatgattaggagttcttaatttttaataaagtcta

SEQ ID NO: 196896 - DNA, 601 bp, Human
cagcagacactggctacactaataataaccagtatacttcattgaatattggctaggagagaggcactgtgctctgggcttttatagattttatctcatttagtgcttacaacaaaaattctgaggagttggtgacctccttattttatggatgataaaattgaggctcaggggcttatgtgacccatctaaggtcacatagacagtaagtattagagcagggtttcaaacccaagtggggctgactcccaagagcctcagtcaaccactgcatatactgttggaggcaggttttctctgmcatggcaggaaatgattcagtgaggggcagaaagaaattcatgacccatatggtggtggtggtacaggaactgcagtaactcactttctgggttcactgtagttctggccattgcaagatttgccatcacagagccctaaatagaatgtgagagttttcactctattccctctttagctctgggtcctgcgttccttagtgttattcagccaagcagaaccaacacgagatgtatatcttcatattagccttgtgtacttactgggatcttatgatttggaggggcatgagatatcctca

SEQ ID NO: 196897 - DNA, 601 bp, Human
agggaaaaagggaataaaaatagatggaacaaaaaaagatggaaaatatagactttaatccaatcataccaataattacattaaatataagtgatctaaacaagtaaattgaaagacaaaaattaccaaattgattaaaaaagcaacactcaactacatgccctctacaagaaaattcattttaaatacaaagccatatataggtttaaagtcaaagaatgggaaaagatgtaacatacaaacagtaatcataaaaggatggagtgactatcttaaagttttatgatagaaatggtatatraaatttaaaaatacacaatggccatatctatatctaaatctctttaactctctattaaagaacccacagatccctgataaatcaaattaggaaataaaatggaattaattttattttataccttgcctcatatgctctattgttaccaaaccaatacttactaacacctttttattttattctttgaaatcatatgttatgacatttatttccttagctgaagttcagagaaaatagaataataagtgagtagaaatgttggactgacagctgcatattatttttgactagctaaaaaca

SEQ ID NO: 196898 - DNA, 601 bp, Human
aaaattttaaagcaatttaaaagaagccaaatgtaaagtaaaagtaaaagcaaaatgaaataatcaaaatgctcaatgaatacaaaagtgggaaaaaagagggaaaaagggaataaaaatagatggaacaaaaaaagatggaaaatatagactttaatccaatcataccaataattacattaaatataagtgatctaaacaagtaaattgaaagacaaaaattaccaaattgattaaaaaagcaacactcaactacatgccctctacaagaaaattcattttaaatacaaagccatatatrggtttaaagtcaaagaatgggaaaagatgtaacatacaaacagtaatcataaaaggatggagtgactatcttaaagttttatgatagaaatggtatataaaatttaaaaatacacaatggccatatctatatctaaatctctttaactctctattaaagaacccacagatccctgataaatcaaattaggaaataaaatggaattaattttattttataccttgcctcatatgctctattgttaccaaaccaatacttactaacacctttttattttattctttgaaatcatatgttatg

SEQ ID NO: 196899 - DNA, 601 bp, Human
agtcaataaatataaaagttcttataataatggaatacaatattgaacacagtaagtgctcagtaattgttattataattgcaaataccatttttaaaatatatatacatagggactgaaagaagcttcactacttaattggttataaggtgatcataccaatgatatggaatctaattatattacatttttatgatatacacgaagataaagtaattattaaaagtatatatagtatgtatattgtaaactccagggcaactgataaaaaaattttaaagcaatttaaaagaagccaaaygtaaagtaaaagtaaaagcaaaatgaaataatcaaaatgctcaatgaatacaaaagtgggaaaaaagagggaaaaagggaataaaaatagatggaacaaaaaaagatggaaaatatagactttaatccaatcataccaataattacattaaatataagtgatctaaacaagtaaattgaaagacaaaaattaccaaattgattaaaaaagcaacactcaactacatgccctctacaagaaaattcattttaaatacaaagccatatataggtttaaagtcaaagaatgggaaaagatgta

SEQ ID NO: 196900 - DNA, 601 bp, Human
gtgtggctcaccactaccatcctgtcctgagaatacagcttttcttcattttctcacatgaaaacttgagctactaagaaggctttcttcccctctctggccccccttttatagatgaaaacctatcctgttattttctcctaaaataaaagtagtattaccacttattgccttgaaacctggatcaacttatttgacttctctgtgacttatttttctcatctggaagatgaagataagtgaatacaacctaccctcactgggttattgtgaggattgaatgagtcaataaatataaaakttcttataataatggaatacaatattgaacacagtaagtgctcagtaattgttattataattgcaaataccatttttaaaatatatatacatagggactgaaagaagcttcactacttaattggttataaggtgatcataccaatgatatggaatctaattatattacatttttatgatatacacgaagataaagtaattattaaaagtatatatagtatgtatattgtaaactccagggcaactgataaaaaaattttaaagcaatttaaaagaagccaaatgtaaagtaaaagtaaaa

SEQ ID NO: 196901 - DNA, 601 bp, Human
ttatggcagcagcagcagtaacaactataacagtcataatggttatctactctgtatctacatgggattgtttgagtgtggctcaccactaccatcctgtcctgagaatacagcttttcttcattttctcacatgaaaacttgagctactaagaaggctttcttcccctctctggccccccttttatagatgaaaacctatcctgttattttctcctaaaataaaagtagtattaccacttattgccttgaaacctggatcaacttatttgacttctctgtgacttatttttctcatctgkaagatgaagataagtgaatacaacctaccctcactgggttattgtgaggattgaatgagtcaataaatataaaagttcttataataatggaatacaatattgaacacagtaagtgctcagtaattgttattataattgcaaataccatttttaaaatatatatacatagggactgaaagaagcttcactacttaattggttataaggtgatcataccaatgatatggaatctaattatattacatttttatgatatacacgaagataaagtaattattaaaagtatatatagtatgtata

SEQ ID NO: 196902 - DNA, 601 bp, Human
tggtgagggcaatattgagcaaaccaggtatcacattttgagagaactgccttaggcttatcccaatttatgctgtattctttgctaatggctccattcttacaatgcgatgttaccagtacttatgctaaaccaataatttttcagattttggtaaaccttaatatttttatggacctgaagattctccctcactttggtagataccgtacaaactaatcagagttggagaatctctatttaaaaaattacccaacttaaaacacttatactgttagtgggaatgtaattagttcagccmctgtggaaagcagtgtggagatttgtcaaggaacttaaaacagaactactattcaacccagcaatctcactactgggtataaaccaaaggaaaataagtcattctaccaaaaagactcatgcactcatatgttcattgcagcactatttgcaatagcaaagacacgtaatcaaccaagatgcctatcaacagtggactggatgaagaaaatgtgctttatataccccatggaatactatgcagccataaaaaagaatgaaatcatgtctttgctgcaacatggatgcagccagaggccat

SEQ ID NO: 196903 - DNA, 601 bp, Human
aattctttgtaactaattgaatttcatatttatacattttaaaaattcaatatgatttatcttccctatatgttattaaaaattaaatcattaggtagggaggaatagcagcatgaaataaaattatatgatacccagaggccatctggcccaccatttagcttcttatttgtacatacatatttcttgaacaagtgtctatgatgttatggaaatctccagaagatcaacaacataaaaagctaccaatcccctatgacaagattcatgaaaacactgaatcaccttcttatgcaatacrttaaaaaaatctgtaaatctcttctgctaccagtttctgcttttaatggagtagccacaataggtagcaagtcacacagagatttaaaaccaggccttcaagaggtcaggtcctgtctctttccattatacccagacacatccaccaaaaatactcgaaattacttcttcattttctttcctaacagtacaaactcttctaaaatgtttttcctcacttctgaactccgcttcagagaactttatgataaaggctccgtactacttatagtgtccctttatcatgtttcaaggacctgat

SEQ ID NO: 196904 - DNA, 601 bp, Human
caaagtgcagcccattaccagcaggccagtcatgaccttcacctaataggtaagccacagtttcatgagcagcaggagttaaaagtttagaagcaaagagtactttgccaaggtctaggaaagggtagaagaggacaaggggaagcttccgtgatgaaataagaaatttaatcactgtgtttctaagaggtcttttatttatatcttaaaaactcaaccacagagtcagggggaaaaaaagctgaatccagctgaactgaaagaatttaaatgttaattcgccagtgttttttttttttttccactggtgttatttttgctttttaaatgaaagcaagaagagtgagaggaagggaaagacaggtagggggaagtgaggagaaggtatgatgctgagtgacaagtgtgtgaagggaggcagctgtggagtgccaccgagtcccagcggtgggaaccaagtttgcctacaatgctagtggaatcaggtgacttcaccctcagggatttccccctccaggcactgcagggctttgattggaagctcagagtggagagtgctttaggaaggaaagcaaatgatcatttagtgtctttttcttcc

SEQ ID NO: 196905 - DNA, 601 bp, Human
caacttgtgttactgctctattattgtggttactgatacctcaaaaataggtcacactgggctgggcacggtggctcacacctgtaatcccagcactttgggaggccaaggcaggcagatcacgagatcgggagatcgagaccatcctggctaacacggtgaaacctcatctctactaaaaaaaaaaaacaaaaaattagccggctgtggtggctggtgccaagatcgtgccactgcactccagcctgggtgacagagcaagactctgtctcaaaacaaacaaacaaacaaacaaacaaacaaaaggtcacactggtcaagagaaaatgatgctgtcttaatccttaaatttctctgaaaagatgaccctctatcttcatctactgaatatgtttgtgttcatttctaaatcgcactgtgaaaccaaagcctgtttttggaccactgatctagagcttaggaggagacgttcatctttatgattcaatgatggccccataagtaatcttatacttgaagttattgatggccaaagtgtacagatcaatttggcagagaactgctttcaggtccttcctggctttcaatgcaaatagtttta

SEQ ID NO: 196906 - DNA, 601 bp, Human
aaataccattcttggtaaaaattattttctcataggaggagaaatggctttttctataggtagatgactatagaactaaatattcaaactaagacacatttcagtgtaaaagaaggtgttgataattatggtaggaggactagtacccagaagaactgtcctgggccagttggggtgggtggttgccctatcaatggatcatgaagaacaatgtaaaaataaatcactttcttcgaagtagacaataaattttgtgcccataaacattcattgacttcactttttaaaactttttttttttatagaaagtaggttttaattttacttaattttttttggtctataaagaaggaacagttcctgcaccccctttcaccacctaaatattttttatttatgccagagggaggcatagatggggcagggtgtgggtggtcatggggaagggagtgctttaaagggttttactcaattgaatatttaatctatttctgtcttcttcagtagctactcctcccatgccctcaccccaccttatgataaaaggatctaaaaagagggaaactgcattctccgagacaaagtactaaaagtagctgta

SEQ ID NO: 196907 - DNA, 601 bp, Human
ggaacgtgttggttttctatttgtacatccatctctgttctatcacaaatgggctcagatttccacatggctatttacctgatcttgttaattttcctattaggaagcccagtgatctgggtaaaataccattcttggtaaaaattattttctcataggaggagaaatggctttttctataggtagatgactatagaactaaatattcaaactaagacacatttcagtgtaaaagaaggtgttgataattatggtaggaggactagtacccagaagaactgtcctgggccagttggggtgkgtggttgccctatcaatggatcatgaagaacaatgtaaaaataaatcactttcttcgaagtagacaataaattttgtgcccataaacattcattgacttcactttttaaaactttttttttttatagaaagtaggttttaattttacttaattttttttggtctataaagaaggaacagttcctgcaccccctttcaccacctaaatattttttatttatgccagagggaggcatagatggggcagggtgtgggtggtcatggggaagggagtgctttaaagggttttactcaattgaat

SEQ ID NO: 196908 - DNA, 601 bp, Human
atattcttatgatcagcagactagggttttacagtagatattatttttgctacaaaaaataaagggtattattgcttttgtttccctgagccaattgcctttgaagtctgtagcctctatgccccactaaagctcatgatgagaatgcaatcacaatgcaaaacagttggtgagtttgccaacactggacttggctccaccatcttctctcaaatagagacctcctctaagccactcagatggcacccaaagtcattgttcttttaatggttggacactaaaaatcataaaatcttttttkttggcttggtataagcatcacctagttttttattcttgagaaagaaaagctatttgattgtcagaggctagtgatgacaaagtgcttgtagcacggccacagagctaagacctttattttgctacacagctattgagacacaggctcttctccactattccgtcttagagcttggttaatttctcatgctctatcagtgcaaatgccacataaaaattatcagatgcgaccagaaagtttcttaaagtatggaagatgttccacaaatgcaacaacagtaaaggaacatccactatgagg

SEQ ID NO: 196909 - DNA, 601 bp, Human
agcagacatggttgtgtggacatctaggcagagaggtcccgagacagccccagtggatttcccatagttctagagtgtaatggaagaaccaccaagtactttctgaatttttccaagaggggtacagaggtaggctgagagagcaggatacccaaggagaccctttggccaggacaaggaagatggagggtaaccacgtggcctcttaacaggggagcaaatggaaacatgggcacttcctgccatgaggaatatatgcagatgactggaaccagcaggctgagaatatagtggcggataytgattggctaaatttaaacaaggtcactgtcactcttaacaaccatatctcaacattttgacaatgtataagggtttcattttatttattatttatttttcgagacaggtctcactctgttgcccaggctggagtacagtggtgcaatcatcaccttttttttttttccacagttgatcaggaatcatgtgtaagtgttttaaattcagcatctgtttgggagtggtctgaattgactgagaaaaccctgaggtggctaagattatattcttatgatcagcagactagggttttacagta

SEQ ID NO: 196910 - DNA, 601 bp, Human
caataaggttgtatgctgatgtaggtctctgagtatgggctctgcatccccccgccccatcttggtcacaaccttcaaagggtggtaaaattctgggatccaagtgagttgagaaatctgaaacagacagcacctgtgcctcaccacctggagagggaggagtgaccaggaaagcagccagcctccagaatccctctcccatgtcctatgttaacagtagagcagacatggttgtgtggacatctaggcagagaggtcccgagacagccccagtggatttcccatagttctagagtgtaayggaagaaccaccaagtactttctgaatttttccaagaggggtacagaggtaggctgagagagcaggatacccaaggagaccctttggccaggacaaggaagatggagggtaaccacgtggcctcttaacaggggagcaaatggaaacatgggcacttcctgccatgaggaatatatgcagatgactggaaccagcaggctgagaatatagtggcggatactgattggctaaatttaaacaaggtcactgtcactcttaacaaccatatctcaacattttgacaatgtataagggtttcat

SEQ ID NO: 196911 - DNA, 601 bp, Human
aacagataaaaatagaattataaatatctcaggaccattaggtattttctctttatataatgcagaagagattaatcaacattgatttggctgaatggctgtgtccatctatggcatgggcattttctctaaatgaaaatgtagctgttgagctaatcatgatcatttcctttttagagagctgtaagagtgtggcagattcttttttttttaaatcatgagttgtgtgtttcttttgtgaacaagcctaatccttgcattttgttcttagggcaaagttggcctgtagtcgtctctatgwaaggctgggtacataagatgctgagaaagatgatgaggagtcagctgaatggagcacagcatggaggtttactatggatcacacagcaagcaaaatttggactctgattattttatcttttactttccagcagcattttggctgccttcctgtttgtggttcacatattaacacaaagcttacttaagacaagaaggtattcaacctgcaaacctttgataaggggaaagtgtttgctcgagaacttctgtttttggaatgctgtttgcatttgcagaggaatatattaattgatggttt

SEQ ID NO: 196912 - DNA, 601 bp, Human
taaacatgaacagataaaaatagaattataaatatctcaggaccattaggtattttctctttatataatgcagaagagattaatcaacattgatttggctgaatggctgtgtccatctatggcatgggcattttctctaaatgaaaatgtagctgttgagctaatcatgatcatttcctttttagagagctgtaagagtgtggcagattcttttttttttaaatcatgagttgtgtgtttcttttgtgaacaagcctaatccttgcattttgttcttagggcaaagttggcctgtagtcgkctctatgaaaggctgggtacataagatgctgagaaagatgatgaggagtcagctgaatggagcacagcatggaggtttactatggatcacacagcaagcaaaatttggactctgattattttatcttttactttccagcagcattttggctgccttcctgtttgtggttcacatattaacacaaagcttacttaagacaagaaggtattcaacctgcaaacctttgataaggggaaagtgtttgctcgagaacttctgtttttggaatgctgtttgcatttgcagaggaatatattaatt

SEQ ID NO: 196913 - DNA, 601 bp, Human
tatcacatgagaaaaaaatcttgtgcagcattgtaaaaatgcataaataataaacatgaacagataaaaatagaattataaatatctcaggaccattaggtattttctctttatataatgcagaagagattaatcaacattgatttggctgaatggctgtgtccatctatggcatgggcattttctctaaatgaaaatgtagctgttgagctaatcatgatcatttcctttttagagagctgtaagagtgtggcagattcttttttttttaaatcatgagttgtgtgtttcttttgtgaasaagcctaatccttgcattttgttcttagggcaaagttggcctgtagtcgtctctatgaaaggctgggtacataagatgctgagaaagatgatgaggagtcagctgaatggagcacagcatggaggtttactatggatcacacagcaagcaaaatttggactctgattattttatcttttactttccagcagcattttggctgccttcctgtttgtggttcacatattaacacaaagcttacttaagacaagaaggtattcaacctgcaaacctttgataaggggaaagtgtttgctcgag

SEQ ID NO: 196914 - DNA, 601 bp, Human
attctagttggaataactaaaagttatgaccatagctcctttatcacatgagaaaaaaatcttgtgcagcattgtaaaaatgcataaataataaacatgaacagataaaaatagaattataaatatctcaggaccattaggtattttctctttatataatgcagaagagattaatcaacattgatttggctgaatggctgtgtccatctatggcatgggcattttctctaaatgaaaatgtagctgttgagctaatcatgatcatttcctttttagagagctgtaagagtgtggcagattyttttttttttaaatcatgagttgtgtgtttcttttgtgaacaagcctaatccttgcattttgttcttagggcaaagttggcctgtagtcgtctctatgaaaggctgggtacataagatgctgagaaagatgatgaggagtcagctgaatggagcacagcatggaggtttactatggatcacacagcaagcaaaatttggactctgattattttatcttttactttccagcagcattttggctgccttcctgtttgtggttcacatattaacacaaagcttacttaagacaagaaggtatt

SEQ ID NO: 196915 - DNA, 601 bp, Human
tcttgcttccactaaagatgagggcacagaattcacaatttctctgctctctctgtttcatccatgaaaacatgttttgtatactactaattatgataacattaacattatggtgtttgcgtagcacttcagggtttaaaagttgctttcacatgtgttgtctacctttgatattgattatatcattgatgttcataaccctctgaggtacacagaggaaacattactattaccacttttcagatgaagaaaatatgacttaaggagcttaagtgattttcctttgctgaagttaatctcktcattctagttggaataactaaaagttatgaccatagctcctttatcacatgagaaaaaaatcttgtgcagcattgtaaaaatgcataaataataaacatgaacagataaaaatagaattataaatatctcaggaccattaggtattttctctttatataatgcagaagagattaatcaacattgatttggctgaatggctgtgtccatctatggcatgggcattttctctaaatgaaaatgtagctgttgagctaatcatgatcatttcctttttagagagctgtaagagtgtggcaga

SEQ ID NO: 196916 - DNA, 601 bp, Human
tagccaatattgctaaaaagatgaacatggcaaaatattattatcttaatgatcacctaaagcttcaaaatggagttaaatatgggttacaccctttacaagggcgttctacttctacctgcccctcaccttcagccgagtgaaaccgatcacatcctccttagactctctactgaaccttgtacattctgtcatcatagaacctgtaacaagttattgtgcttctttaaagagtctaccccttgtgaaactattgctggcctcttgaaataagggacaatgacttaatcctgttaggtgktaggtttatagaggtttatttcattatgcttcacaactcacatatatatagatgcataactacttttatgtatattaaatgtcacacaatacataaaacaaaacaattggaaaaagatacatcaaaatgttaaaatgcttttctgttataaaactgtgttaacattctttgtctttttggtcatactctttaatttttctgtaaacatgtaatgtttaattggaaaaaacaaatgttaaaaataggacttttttgaattaagataataattttcagtctgtatcactcctagaagaaact

SEQ ID NO: 196917 - DNA, 601 bp, Human
agccacagccagttctgtgatacatccttgtgagagtccctgagctaaagacccaattaagtcatgcctggattcctgattcatacatactgtgagagaatacacgtgttgttttaatccactgagttttggggcaatttgctacctatttgacagagttttccagagaatcagaaccaacaggatgtgtatctgtctgcctgcctgcctatctctctatctgtctgtccatccatctatttaatgagagaaagagatttattctaaggaagaggctcatgggtttatggaggcttgacarggctgaaatctgcaaggtaggccaacaggctggagaggtaagatgagttgcagctccagtctaacgacagtataatgacagacttcttagtcacagaggtcagtctttgttctattaaggccttcaactgattggatgaagcccacacacgctatgaaggttaaactgctttactcagagcccaccaatttaaatgttaatctcatccaaaaagcaccttcacggaaacatccaaaacaatgtttgatcaaacatctgagcaccgtggcactgccaagttgacacataattaaccatctc

SEQ ID NO: 196918 - DNA, 601 bp, Human
cttacaagtgcttccttccccagtcaaaccttgagataagactgtagccacagccagttctgtgatacatccttgtgagagtccctgagctaaagacccaattaagtcatgcctggattcctgattcatacatactgtgagagaatacacgtgttgttttaatccactgagttttggggcaatttgctacctatttgacagagttttccagagaatcagaaccaacaggatgtgtatctgtctgcctgcctgcctatctctctatctgtctgtccatccatctatttaatgagagaaagasatttattctaaggaagaggctcatgggtttatggaggcttgacagggctgaaatctgcaaggtaggccaacaggctggagaggtaagatgagttgcagctccagtctaacgacagtataatgacagacttcttagtcacagaggtcagtctttgttctattaaggccttcaactgattggatgaagcccacacacgctatgaaggttaaactgctttactcagagcccaccaatttaaatgttaatctcatccaaaaagcaccttcacggaaacatccaaaacaatgtttgatcaaacat

SEQ ID NO: 196919 - DNA, 601 bp, Human
aacagggggtgaccaccagccaacaaccagagaggaaccgaggccctcatccaacagcctgtgaggagctgaatcctgctaacagccactgagtgagcttacaagtgcttccttccccagtcaaaccttgagataagactgtagccacagccagttctgtgatacatccttgtgagagtccctgagctaaagacccaattaagtcatgcctggattcctgattcatacatactgtgagagaatacacgtgttgttttaatccactgagttttggggcaatttgctacctatttgacagagwtttccagagaatcagaaccaacaggatgtgtatctgtctgcctgcctgcctatctctctatctgtctgtccatccatctatttaatgagagaaagagatttattctaaggaagaggctcatgggtttatggaggcttgacagggctgaaatctgcaaggtaggccaacaggctggagaggtaagatgagttgcagctccagtctaacgacagtataatgacagacttcttagtcacagaggtcagtctttgttctattaaggccttcaactgattggatgaagcccacacacgctatgaa

SEQ ID NO: 196920 - DNA, 601 bp, Human
atgcccttatgcaagcccctccctttgaatatgggctggatgtagggatttgctttaaataatacaatctgtcaaaagtggtgggctgtcacttctgagaggaatgcacacaaaaaaactgtgactcctcgttttattctctctggctcctctcaatggcctcttctgatgaagcaagctgctgtggtgtgagttgccctctggagaaccccacatggcaaggaacagggggtgaccaccagccaacaaccagagaggaaccgaggccctcatccaacagcctgtgaggagctgaatcctrctaacagccactgagtgagcttacaagtgcttccttccccagtcaaaccttgagataagactgtagccacagccagttctgtgatacatccttgtgagagtccctgagctaaagacccaattaagtcatgcctggattcctgattcatacatactgtgagagaatacacgtgttgttttaatccactgagttttggggcaatttgctacctatttgacagagttttccagagaatcagaaccaacaggatgtgtatctgtctgcctgcctgcctatctctctatctgtctgtccatccat

SEQ ID NO: 196921 - DNA, 601 bp, Human
gctctccaaggctaagggctattctcatgcagggactcagctgagaacattcagctgtccataatttagaggtagcgaatgattgctgcgggcctgcttgaggatctgggctgctcatcacagcttcactacaccctggatgggaagactgggggcttgggcttgtgggtgggaagtgctgacaggcttcaggacacagaagccaggaggagtcaagtgagtatagggccccaggactaagcccaccagagtggctttactctggggcaggtagagcctgctgcaggcagaggagagaagygctgactctgagggctgcaggagtgccgggaccttgctgaggggcaatgggcctccgcaccatctggatgattcttttaggccattcgatgctcccactttgtgccatgctcacagaccaccctctcattgctgattcctgtggagggttcccctcggctcttcgaggttgcagctggcatcgtggagaaggtgggccccagagtcagactgagcttctcgtcaaccagtgatgtgtatttactcgttgtgtgtgattggctgtcttctcagatggttcccagtgatcctcacatcctgc

SEQ ID NO: 196922 - DNA, 601 bp, Human
tactttctgcatagctctgaatactctaggtcacctgtgctcttggtttatctcactagttatgtatcttgctgttggttcttctcaagtgcgtggagatccttggtcatgcattcacaacattagaatgaagctagtaagtaaagacggctggaggagtgccagctgcagctgtgcagatacaggcctttcttggatggtaggctgaggcctgtgagtggaggttttgtgtacaggagcttcatttaggagtgctgtcaggatcaacacctgtggagacctgagggacccaggattgggmagagggaggacttgaactcaatgcagtcccaacaaaggtctctgcagattcaaggtggcaatgaggggaggggtacccttcacaggcacccccagttcaggatcttatgttcccctctcctctcatggagcagtcacaggtcgagagctatccctggggagggagcatggccctgggaggtgatgccagctctccaaggctaagggctattctcatgcagggactcagctgagaacattcagctgtccataatttagaggtagcgaatgattgctgcgggcctgcttgaggatctgggct

SEQ ID NO: 196923 - DNA, 601 bp, Human
ttgtcttttgactctgtattctcagaattcctttcacattatttttcagatcattaacttattcttcagttaggtccattcaactcttctgctaaattttccaataaattttgccagcacagggacgcttattttgttatatctctctttttcacagcagctgtgttcttgtgttacagctgtcatagcctgttaaatctttctgcgaatattaaatagatctcttttttaaaaaagatcttgtctactttctgcatagctctgaatactctaggtcacctgtgctcttggtttatctcaytagttatgtatcttgctgttggttcttctcaagtgcgtggagatccttggtcatgcattcacaacattagaatgaagctagtaagtaaagacggctggaggagtgccagctgcagctgtgcagatacaggcctttcttggatggtaggctgaggcctgtgagtggaggttttgtgtacaggagcttcatttaggagtgctgtcaggatcaacacctgtggagacctgagggacccaggattgggcagagggaggacttgaactcaatgcagtcccaacaaaggtctctgcagattcaagg

SEQ ID NO: 196924 - DNA, 601 bp, Human
ttcctaaatgcatttctactggtgttgaagagagcagacataagccattatctcattggtaactccacaaaattgaacttccaggttcctaattctatcatttgtgttattatagcaaatgtgttctttaataaagtcattcatcatagaaccctctgagttggtgtctcactttcaatggatcgggtttttcacctgctgtataatggtcataactggatttctcttcatctaaatctggggttatttcagctgtttcatgtatctcatatcttcctctttcttggagtaacattttacrttgtgtgagaaaacatctttgagtaggccctctcctcccatgatagtgacaggtgataaacatttcaagtcattgactggccaaatacgtgtgtatcacactagactgatagtttgacttagaacataatccaggttaagaatcacttcaattttccccagaatatgactccattggtttttagccaactgtgttatagaagacaagtgagatcctggccttgttttgtctttggaagctttacagaatttccctaattttggagttcagaacttttagtaaaatgtgactagatgtgtg

SEQ ID NO: 196925 - DNA, 601 bp, Human
aacagttagtgactctcttaattccaactctaagtttcttgacctgtgggagtttggatttgctgtttcagaaaacaccattttattcacttcattaacggcacaaatttttactcgcttcattaaacaatcatgtctgtctcatttttttcctcctaaaattcctaaatgcatttctactggtgttgaagagagcagacataagccattatctcattggtaactccacaaaattgaacttccaggttcctaattctatcatttgtgttattatagcaaatgtgttctttaataaagtcaytcatcatagaaccctctgagttggtgtctcactttcaatggatcgggtttttcacctgctgtataatggtcataactggatttctcttcatctaaatctggggttatttcagctgtttcatgtatctcatatcttcctctttcttggagtaacattttacattgtgtgagaaaacatctttgagtaggccctctcctcccatgatagtgacaggtgataaacatttcaagtcattgactggccaaatacgtgtgtatcacactagactgatagtttgacttagaacataatccaggttaa

SEQ ID NO: 196926 - DNA, 601 bp, Human
cagcagattccctgatctcactcaattgtaactacttttcccacagggtcccagtgatcaagctttgtctccagcatcattttaccctttattcttggaagggacactggaggcgactgattccaacccctcgacttgaaagttgaaagatgcaaagcacagagcaggggatgacatgctcaaggccccatcaccagtcggaggcagacctgcatagaacttgggacataaatgtaggcacacacaaaacccagagacattccaccgacatttaaaatcaagaatcctccctgatatagtwtgaccttgtaaatgatgcaaagggtttgaacaattcaaaacaaacaaacaaacaaaaaaacaggtctaggataagttttttcaaaatcatcaaatataaatttcaacccaattttttaatttcataaaaccaaggttaaaagaggttgagtgattagttaaaagttatgggcaagtgatggtaacgtcaagcctctaattcatatatttgccaagctctagctttgaatgatattgtaactcgaaaggaataatgttgttctttttagaaaataacatggtcatggtagaccacttggaa

SEQ ID NO: 196927 - DNA, 601 bp, Human
tcctcaggctttgcgtcatggatataagcagcagattccctgatctcactcaattgtaactacttttcccacagggtcccagtgatcaagctttgtctccagcatcattttaccctttattcttggaagggacactggaggcgactgattccaacccctcgacttgaaagttgaaagatgcaaagcacagagcaggggatgacatgctcaaggccccatcaccagtcggaggcagacctgcatagaacttgggacataaatgtaggcacacacaaaacccagagacattccaccgacatttaaaatcaagaatcctccctgatatagtatgaccttgtaaatgatgcaaagggtttgaacaattcaaaacaaacaaacaaacaaaaaaacaggtctaggataagttttttcaaaatcatcaaatataaatttcaacccaattttttaatttcataaaaccaaggttaaaagaggttgagtgattagttaaaagttatgggcaagtgatggtaacgtcaagcctctaattcatatatttgccaagctctagctttgaatgatattgtaactcgaaaggaataatgttgttctttttagaaaa

SEQ ID NO: 196928 - DNA, 601 bp, Human
tcaggtcacaagtctctagacctactaatttagaatctttatctcagcaagaccccccagataatcagtagcccattgaagtttaagaggtaccagtttagaagacatgggttggaccatttaagacctaagcacttcctgactctgaataaactgatttatacaattgtgctactgagaattaccagtactgttcttgggtgttaatagttttcagctctttgcattaattaatgcattaacgcttgtagactggtttgttcttacaatcacgacattgtttttcctttgattattatcrtgttatctgcacgttctttattttgactgagttttctccccactacaaagagggaacacattgggtaggtgggacactgttggaagttctcatgaacaagtgaagaagagaatgtgcagagacattcaaatagtacaagctttgacctgagctgattggtaatgtgacccccaatctgcctaggagtatccccggaagaatttatttctgctgttttgtgttgcctaatcctggtacatttaagatgaagcagtacatccatgagaatgagaccatcctcaggctttgcgtcatggatat

SEQ ID NO: 196929 - DNA, 601 bp, Human
acaggcgatttaaaatttaatccattcattttgccatttggcaagtgatcaaagtaagcttttcaaaagcagcagggtatcctttaacttatttttcccatgaaattaaaatggcatttgcattcttttaagatgcagatataaggaacttcttatgattcaatcattaaatttagaaagtgtgcagcttgttatactcctaatctcttttcctcctctccatctcaccttttctatttgttttcctctgttctttatgtaatgacatagaaaagaatgtatattaatgatgaaaccttayataaaattaaatctctcatgttcaaattccttaagatttgaaacaaaaatgattgtttcaacccatcacagattcaggacacaagagacctgaaggaaagcatttccaaattgaaacatgacagtctacatctatcatggctgaagtggatttactagaaacaaaaccgactcttcggctatggctaacactgcccaaaatttgggaatgcaactttgcacagtggttacattttcatgtgggaatttattagatatgacttaggttaaaatgctttctatatgccaagtccacactagg

SEQ ID NO: 196930 - DNA, 601 bp, Human
tgcttcactgaatacattccatttgagttctaaatgatgggtcatgagcctgctgatgcagataggcaaactgctcaccagcttggagcctctttaaaaaattacccctttgcagaatgctacccggtgttgtagctgaaagaagtagaaaatgtacttctaaaaacaagcagtgttctaccttctcaacattgaggtggaggctctgttttaaaatcgagctgtcaataattgatgaggacatttttagtaagtttaatgttaaattaaagggctaaatcctaaatatgttccatatcaygtcctttgaagacaggcgatttaaaatttaatccattcattttgccatttggcaagtgatcaaagtaagcttttcaaaagcagcagggtatcctttaacttatttttcccatgaaattaaaatggcatttgcattcttttaagatgcagatataaggaacttcttatgattcaatcattaaatttagaaagtgtgcagcttgttatactcctaatctcttttcctcctctccatctcaccttttctatttgttttcctctgttctttatgtaatgacatagaaaagaatgtatattaatg

SEQ ID NO: 196931 - DNA, 601 bp, Human
tgccttcaatccttccctttggggatcctgcaccattagctggagctcagagagacagtgagcaaaggataaagatgccagtgactattgaaaacatcagaagctcacacacagagtaggtaagcccctcctatctggttcctttctcctcttctcccaacacacctctactgtcttttagacaaacccatttccagacctccacgccccatattcaattgttttgctgagatttccaataggtgtctttgatgtaatggccctgaagccattttttttttaagctggggcctctaaatcwgccactcatcctatcacaacaaatggccccctctacccagttgcttaagcaggcaacctaaatgttatcctgatctcttctttctccctcacttccacatcccactactcaacaagcactatgttctctggacctttcagtacgtctcccatcagccccctgttcaccctgccatcaattttgtggcttaccctatgactgcacttggtctccctggtctctgtctggccacccaaaaatcaaccttggaagcctgctgctagagaggtctttctaaaagagaaaattctgggctggatg

SEQ ID NO: 196932 - DNA, 601 bp, Human
tgtaaagaccaattataggaatgtcagcaaaatgtctcctatgaaatcaactctaattaaactaacttgattttattgatgttattatctactgaaaatgtagagcccaaattagccacaaaatttcttttttgtctgtaaaggtttaatcatgtcctttacaaaacaacatgataaattaaataattctaaggaggaaatcaactgggtaattgccttcaatccttccctttggggatcctgcaccattagctggagctcagagagacagtgagcaaaggataaagatgccagtgactaytgaaaacatcagaagctcacacacagagtaggtaagcccctcctatctggttcctttctcctcttctcccaacacacctctactgtcttttagacaaacccatttccagacctccacgccccatattcaattgttttgctgagatttccaataggtgtctttgatgtaatggccctgaagccattttttttttaagctggggcctctaaatctgccactcatcctatcacaacaaatggccccctctacccagttgcttaagcaggcaacctaaatgttatcctgatctcttctttctcc

SEQ ID NO: 196933 - DNA, 601 bp, Human
gacaggaattttactttaaatttgtttaaatattcatttatctataagatacaggtaagaagaggcagtataaagttatgttactagcaaactctagagctagactacctagtttaaatgctggtcccagctgtgcaaccttgaacaatgtacttacccattgatgcctcagtttccttactataaaatagaaataatgacagtatctacctcataggggtatcctggctgttaagtaaattagtatatttatatcactttaaaaggttgctgagcacagtaagtgtgtgtgagctattaytaatcccagattggaagataaacattttgtttatatgcctgtatttggcttattagctgtacatccaaatatccctatatccggaaccaagtatattatatctatgtctacatctatctatatatttatatctatactcgtacctgtatataatcttcaaagattgtaaagaccaattataggaatgtcagcaaaatgtctcctatgaaatcaactctaattaaactaacttgattttattgatgttattatctactgaaaatgtagagcccaaattagccacaaaatttcttttttgtc

SEQ ID NO: 196934 - DNA, 601 bp, Human
caggggttcttggaactgtgtaccaggaaacagggaggaagacaaaaaatatatttcttattatattcaaaatattatactcttagctgataagggtcaattccctaaaaggtttaaacaccagaacgagccaagagacttgaatccgcaaagtttaagtcaacgcaccctattatagatggctgagtacatcctttccttgcctaaatccactttgtaagtacccaaagtggagactgaggaagaggagcaagtgaggggattgcttggaacctgtcctggaagctgtccaataagtagkggcaggtgacaagagaggaaccgaaaggcagcatagtttgcatgcctagggctcttgttgttctgactccatgcagtgactgtccatcctttgggtgagtgggaccctctcattacgtgaacccagggcttgttctggtggggcactcaccagaggctatggagcccggctatgccaagcaaggtaccatttgtggatggctgcaagtctcttgcctgcaccaggacacttctaagtctcccaatgggtctatgaaaatgtaagaggtagcagaaaggagctctcccacatgtccccagg

SEQ ID NO: 196935 - DNA, 601 bp, Human
aaagttctaaccccatcctgaggccacccagggcccctagtgttctcattagcatacaaaaagacacttatcactgaggagattttccaggggttcttggaactgtgtaccaggaaacagggaggaagacaaaaaatatatttcttattatattcaaaatattatactcttagctgataagggtcaattccctaaaaggtttaaacaccagaacgagccaagagacttgaatccgcaaagtttaagtcaacgcaccctattatagatggctgagtacatcctttccttgcctaaatccacyttgtaagtacccaaagtggagactgaggaagaggagcaagtgaggggattgcttggaacctgtcctggaagctgtccaataagtaggggcaggtgacaagagaggaaccgaaaggcagcatagtttgcatgcctagggctcttgttgttctgactccatgcagtgactgtccatcctttgggtgagtgggaccctctcattacgtgaacccagggcttgttctggtggggcactcaccagaggctatggagcccggctatgccaagcaaggtaccatttgtggatggctgcaagtctctt

SEQ ID NO: 196936 - DNA, 601 bp, Human
tggaaactccctgaatgctgtcctttgggtttttatgaaggcgtccttacacaggcagaattgatcacatcattgccaattggtgatcaactctaacttcagcatctctccccttcccagaggtcagacagtaggctgaaaagctgaaagttctaaccccatcctgaggccacccagggcccctagtgttctcattagcatacaaaaagacacttatcactgaggagattttccaggggttcttggaactgtgtaccaggaaacagggaggaagacaaaaaatatatttcttattatattmaaaatattatactcttagctgataagggtcaattccctaaaaggtttaaacaccagaacgagccaagagacttgaatccgcaaagtttaagtcaacgcaccctattatagatggctgagtacatcctttccttgcctaaatccactttgtaagtacccaaagtggagactgaggaagaggagcaagtgaggggattgcttggaacctgtcctggaagctgtccaataagtaggggcaggtgacaagagaggaaccgaaaggcagcatagtttgcatgcctagggctcttgttgttctgac

SEQ ID NO: 196937 - DNA, 601 bp, Human
attatgtaacctgaagatttcacaccttggggagccttctttaagcaaaataatagaaaactaagcacagatataaaaaattagcctggcacagtggtgcgcacctgtggactcagccactctggaggctgaggtgggaggatcacttgaacctgggaggtggaggttgcagtgagccaagatcatgccactgcactccagcctgggtgaccgagtgagaccctgtctcaaaacaaaaacaaaaacaaaacacaaaaaaagcaactaaacataaacattggaggtttgttttttaagaatragaacaaaaataagaaataacttttgcaaattttgcaaaaatatataaccacatgaatacaatgctagggctctattaagtcttggtaaagaccaatgcaaatgaggggctctaaagcttcatttaacccctgggaaatatgcccaagagagtgtgaagtatgtactgtgcagtcacaaaataatctggagtccaggttttcagaacagctaaaacaagtacagtgtttctatcactgtactgtacagaaagaaaaccaaaacattggtttttctatactctcacattacttcatttctg

SEQ ID NO: 196938 - DNA, 601 bp, Human
caaatcccatgttgaagaaccactctggatgtgatgggcgtctcaggaggacctcctggacaggatgcagactccttatgtgacgggcataactggcgtgcatgtgagagttcccacagctggactttaacctatcaggatttcttaggccagccaaacttgtatgaaattatgctttgttccatttgtggtcctgatgctacctaaataaaaatcattgtgaaaagaggaactgcaatctttcttcactaacaagagaagcagacagacattgtgtcatataactgcttcaagaaaagayagcttgctggtaaaggtatagaagcctttatcctttctccctggagttcttgtgagaggcaaagatctaatactcagcctcaaactctagaagaagccactttgttctaaaacctcatggactcatcacacacctctctcagtggagcaagttccatgatccatgttccagtctattatttctttcccagtagcggtcctaaagttcactgtggctgaataacattgctattcaaaagtatatttttagttttctttagttaaggaaatttccatttctctgattcttcttagtcatcat

SEQ ID NO: 196939 - DNA, 601 bp, Human
gagggaataagcattgctcagagcaattaaagacttggtaaggagaggatatggagtgattattgtagagcacaaatggtactctgagaaaatcaataatggactctagagaagaaagtgggagaggttagaataggggttggaggctgggcacggtagctcacgcctgtaatcccagcactttgggaggccgaggcaggaggatcgcctggggtcaggagttcaagaccagactagctgacatggtgaaaccctgtctctactaaaaatataaaaattagctgggcgtggtggcacatgyctgcaatccctactacttgggaggctcaggcaggagaatcacttgaactcaggaggtagaggttgcagtgagccaagactgtgccactgcactccagcctgggtgacagagcgagattctgtctcaaaaaagaaaaataaataaaataaaataaaataaaataaaatatgttccaggtagaatgtctgaagatgtgcatgtgctgcttaccaaataacaaacacagatccaggccgaactcaggccatatttgaaataaaatgattatatagtgtcaaatatgaacatttgtggatgtta

SEQ ID NO: 196940 - DNA, 601 bp, Human
agggaactggagaataatctgcctagcaatgtgtaattgcgagggaataagcattgctcagagcaattaaagacttggtaaggagaggatatggagtgattattgtagagcacaaatggtactctgagaaaatcaataatggactctagagaagaaagtgggagaggttagaataggggttggaggctgggcacggtagctcacgcctgtaatcccagcactttgggaggccgaggcaggaggatcgcctggggtcaggagttcaagaccagactagctgacatggtgaaaccctgtctcyactaaaaatataaaaattagctgggcgtggtggcacatgcctgcaatccctactacttgggaggctcaggcaggagaatcacttgaactcaggaggtagaggttgcagtgagccaagactgtgccactgcactccagcctgggtgacagagcgagattctgtctcaaaaaagaaaaataaataaaataaaataaaataaaataaaatatgttccaggtagaatgtctgaagatgtgcatgtgctgcttaccaaataacaaacacagatccaggccgaactcaggccatatttgaaataaa

SEQ ID NO: 196941 - DNA, 601 bp, Human
tttaactaccattgcttttgcaccatgggtataaatgtcaacacaatttaaaaggtaaatgatacctttgtattactatgaaaatagttttgacaacataggaactggtattgggatccctcatgagtctataaaccacacactgaacactgctgtacaacaggatctcagaagtaaggatccagttggcttggggaaagacaggaggtctagtgagacccttaagggtacaacataatggtcagaaaagagctgcccttcaaggaagtgtgataatactggtattgaatgctgcaggaargtcaaatagggtgaagatggagatgacaccactggatttgacaaatgggctgatgctgatgaccttactgagagagctgtttgaacagatgtgtaatagattaattacagatggaggagtgaagggcagagaaaaagctggaaaaagagtttggcaatgaaaaccagggagctgggctaactatgtgggcagtcacggtcacaagcagatttttggtagtgtggggaaacacttattggctgaagaaatgaaactaacaaagagggagagagaagagatagtaaggatatgttgaagtct

SEQ ID NO: 196942 - DNA, 601 bp, Human
ttcatctgtagatctgttgccaggtgcaaaacatgcctgaatgatttataatcttggtccaaggttctctagaggaccagtgaatagcattcaaagtatatgaaacaaatgggaaattacgcaaaatgttgagtatttctgtagaggagagggatcataatgatcattagattctcaaagaagttcattatctccaaaatactggagctactgagtaaagcatatggtaaatattgtgattaccaatcttgggggcacttttctttttctttctttctttcttttttttttttttttttttagacagagtcttgctctgttgcccaggctggagtgcagtggcatgatcttggctcactgcaacccccgcctcctggattcaagtgattctcctgcctcagcctcctgagtagctgggattacaggcatgtgccaccacacccagctaatttttgtattttttagtagagatggggtttcaccatgctggccaggctggtctcgaactccggacctcaagtgatccacctgtctcagcctcccaaagtgctgagattacaggcatgagccaccatgccaggcctagggaggggtgggcact

SEQ ID NO: 196943 - DNA, 601 bp, Human
agcctaaagaaacttttggacaagtgcatagagatgtacaagaatgttaactgttactttgattgtaatagcaaaaaacctggaaataatctaaatgtccatcaacaggagagtggctaaataaagtgtggtggtagattcatattttagaatgctatactgcgtgagaatgagtgaatcagagctacatatgccaacatcagaacaaagtgactaagatttttttaaagttagaggctgctgtgactgacttcttaggaacttggaggttcactttggcaggcaggttttcttgtaacarggggttcctgagtgtgtactagcactgtgacagcaataaaactgggttgcacagcatagatgcctccttccagctggtagggttcattttgtctgttctgaggaaacaatttcctcctgggatagagttaaatcccacaagaattaggtagtgctgttggatcttaaaatatctgcattgcaatccagaagcttcatggacttgacaccattttagtacaggttcctgagttgctttttgaacgggtgcaaagtctgatgctgcattctcatccatcattccctctcattgtccacacag

SEQ ID NO: 196944 - DNA, 601 bp, Human
aggttccgttaccagctatcacgcttcttagaattgccatcattcttccagccttctaggtgcaaatccttagagtcagtcatccttgaattttctctctctttcatcatttgtaatcagtcaccaagcactattgaacattgcttgtcaaaccttctctgcatgctccttccctacacaccccttgttataaccctatccatgactaaccctcccacccaaaatactctttgctggtttccccacgacaggaactaacttccgtgccagaataagccacctaagacaacagttggagagwtcaccttatcacatatgagtaatgtgactctgagaaagttatataacatttctgaatctcagttttcctcatcaatgagaacaacactcatatcactgggatactaggaaacagacatatgtgtcaaatacttgataaagccctctcccaagatgcatgctatgattatttagggcgatattattttggccactgttgcccccaagtaatttctggtttccagtatgattaactaatctgattacatcacacaatagtcaaagaattaagcagctgaacaattgcaaagagcttttcctc

SEQ ID NO: 196945 - DNA, 601 bp, Human; identical to SEQ ID NO: 33242

SEQ ID NO: 196946 - DNA, 601 bp, Human; identical to SEQ ID NO: 33243

SEQ ID NO: 196947 - DNA, 601 bp, Human; identical to SEQ ID NO: 124769

SEQ ID NO: 196948 - DNA, 601 bp, Human
ggactcttagaagcactgctatcaagaacctggttttctgccaaaacgtctgcttcagtcttgatgggagtttcttctggctcactctctgaccccgaaagactgccatagctactcattagtgagcatagggctggtgtcacttccttgggtatcacagaatgttgtggtttctcctccttatcagactcagaatcactgtttatcaaaacaccaagaggatctgcatttgcctcaggtggaccttctggcttcaaatcacacaagtgattgcctgatccagtgactgctctctgtctakaattgttttttcatttctgattctcgccaggacttctgatatttgccatttgtgaatgtctggacatccccttcatcttgccatattgtgttgttgtcagtactgctcatctcttctccttttcaagttttaacttcttcttcctttcaatattggccagagttggctagtttttccttctttctcccctccaccgtgcaatttcctctggagtgtctaacttgatcttcttcatgccaggagcatgcatatttctccaatggaactggacaatcttcttgtgtgcagtaaaagagcaat

SEQ ID NO: 196949 - DNA, 601 bp, Human; identical to SEQ ID NO: 25795

SEQ ID NO: 196950 - DNA, 601 bp, Human; identical to SEQ ID NO: 25796

SEQ ID NO: 196951 - DNA, 601 bp, Human; identical to SEQ ID NO: 25797

SEQ ID NO: 196952 - DNA, 601 bp, Human; identical to SEQ ID NO: 25798

SEQ ID NO: 196953 - DNA, 601 bp, Human; identical to SEQ ID NO: 25799

SEQ ID NO: 196954 - DNA, 601 bp, Human; identical to SEQ ID NO: 25800

SEQ ID NO: 196955 - DNA, 601 bp, Human; identical to SEQ ID NO: 25801

SEQ ID NO: 196956 - DNA, 601 bp, Human; identical to SEQ ID NO: 25802

SEQ ID NO: 196957 - DNA, 601 bp, Human; identical to SEQ ID NO: 25803

SEQ ID NO: 196958 - DNA, 601 bp, Human; identical to SEQ ID NO: 25804

SEQ ID NO: 196959 - DNA, 601 bp, Human; identical to SEQ ID NO: 25805

SEQ ID NO: 196960 - DNA, 601 bp, Human; identical to SEQ ID NO: 25806

SEQ ID NO: 196961 - DNA, 601 bp, Human; identical to SEQ ID NO: 29504

SEQ ID NO: 196962 - DNA, 601 bp, Human; identical to SEQ ID NO: 29505

SEQ ID NO: 196963 - DNA, 601 bp, Human; identical to SEQ ID NO: 29506

SEQ ID NO: 196964 - DNA, 601 bp, Human; identical to SEQ ID NO: 29507

SEQ ID NO: 196965 - DNA, 601 bp, Human; identical to SEQ ID NO: 29508

SEQ ID NO: 196966 - DNA, 601 bp, Human; identical to SEQ ID NO: 29509

SEQ ID NO: 196967 - DNA, 601 bp, Human; identical to SEQ ID NO: 29510

SEQ ID NO: 196968 - DNA, 601 bp, Human; identical to SEQ ID NO: 29511

SEQ ID NO: 196969 - DNA, 601 bp, Human
tctgcccttgggccacactggccctcttccaggtacccagaagtgtcaggctcctcactgcctctgggactcccccaagctgctcctttgcctagaatgcctgtccctcctgtaccccttaatctagccaacttctctttctccctcaggtctctgattatgtttcttccttggagaagccacacacacccccttcccctgcccttgtgctgacacatttagctccttgcattttatttcctggcactcaccatgtcaccaactgtcacctaactgctgtaattgtgtcattgtctatgaratgggtctttcctgccaaattgtaaagccctgtgaaggcagggactgtgttggtcttatttactttgtaatttcattggaggtgcacaagaaatatcctacagccagagttaaatctctgtgggactgaaatctcttggttgcttatctatgcctgaaaacaccagggcttcagagatgtgggggttgggagtagggggagaggatgtttggaggaagaggaggggagagttgcaaatacagacccctctctggcttccacgggccaggcttccctggcctaccagcctgaagaggaagg

SEQ ID NO: 196970 - DNA, 601 bp, Human
ggcggttcccttttcctttgttctctcctagtttctttacagtgtttcctttcatgcttcaggcttcttcctcatctcctcccactgccctgatctgtggtttcctcgcacctccccttgctttcctgttgcctgccatctcttcctgactcctccacctctgtccaacctcagtccccccacagatcacttgctgaattattctccatctcattatgccccagccattttcttgccccggaccccctactcacaggtgtgggtcttctttgcagccagcagctctgtaaagacaagagarggggttgacgtcaaaggttgaagatcatgaggggctgagacactttccccactcctaggatcccactgccgcactccttccctcagagcctggcgtctgaagggcaggcaggccaccccctgcagtgcccctctctcctcctctgcccttgggccacactggccctcttccaggtacccagaagtgtcaggctcctcactgcctctgggactcccccaagctgctcctttgcctagaatgcctgtccctcctgtaccccttaatctagccaacttctctttctccctcaggtctctgatt

SEQ ID NO: 196971 - DNA, 601 bp, Human
cctgggaggtggaggttgcagtgagccgagattgtgccatcgtactccagcccaggcgacagtgtgagactctgtctcaaaaaaaaaaaaaagcctggtgcaggctccctgtctcccttggcagcagcgctgagttcctgagttcctgaggccaccccgcctccgcacacccccctacctctatctccttccttccccggcctggcagtcggccccaccccctcccatctccctgcctctgtccagcatttctcctcgccttttttcacaaggcggttcccttttcctttgttctctcctrgtttctttacagtgtttcctttcatgcttcaggcttcttcctcatctcctcccactgccctgatctgtggtttcctcgcacctccccttgctttcctgttgcctgccatctcttcctgactcctccacctctgtccaacctcagtccccccacagatcacttgctgaattattctccatctcattatgccccagccattttcttgccccggaccccctactcacaggtgtgggtcttctttgcagccagcagctctgtaaagacaagagagggggttgacgtcaaaggttgaagatcatg

SEQ ID NO: 196972 - DNA, 601 bp, Human
ggcctcccttctgtggcttgtgggaagaccccaggttgaagctggggctgcttcaggcctcagccacaggggcatggggcttcccttttcctccttcaccttgtgctctgagagcttctctggcttccctggcttcccttcacaacaaatacaggggacttcctgaggttgcccacccttgctctgctggaaggcacaggaaccccagacatctgcccaccaactgttggcccagggctccaagccaggaaaagggtgaggccgaggtctttccaatcccatctccattgccttgcttccycggtcaaatgggtgactgaccctggagaaccacacacacacatacacacacaccccacacacacacgcacacacacacatgcacacacacgcaggcatgtgcccgggtgcaccctgactggattccacatagtcctcatgtccctggattgggcagaaagcctggtggctttgaggcctggacgcggggattctgtgccctgctgcctgccaacctcagttgactctcgctgtcctgttgcttcagagcacagcaactgctctggcctccttttactcacaagcaggctggaggcacaga

SEQ ID NO: 196973 - DNA, 601 bp, Human
caaccacacctccagctggacattactctctccctaggtgttccagaaactcgccctctgagttgggcctctgcatctctccttatttcttgatttgtttctgctccttttgtcgggcccttggtctctgggtgtgtcacagtcccaagccccatgtgctttgacttttgccatcggcggttggaggggctggtggtggttggcactcattggggtcagataacttggggctatgagatacctgtaaatgtccaagtgagaaggaccagtggcactgaccccctcgttggaggaggccctstctcctacttccccgcctgggtggggctgtgtgtgtgtggtgggggtgggaataatggagagctggccaagtgtctccctcagcccctcctggggactcctgccccgctgctgggctagaagcacacctagtcatttcatcccagggttgatttgctcattaggggccatctctgggaagaccagtctgccagcgtttgctgctaatagagagaagctagaagggaaacggaagctccaaggggccctttcctctgtgtagaagctgttggctcttctctccagccctccttatccaccc

SEQ ID NO: 196974 - DNA, 601 bp, Human
gtggcagatctggcatttgaacctagatctctgtaattctgcagccagtgccctcaagccttaagctatatactttatgaggataagacgcccaaatgcacaccggagacctgggtagaggacatggttatttggctgtaggggtaaaagtgtgaggtgattgtggtggtctaggaacagaattcacagaggaaacccacagaactaaagccaggactcctgtttgtataaagatcccaagagatattattccctctgtcccaactcttcctctgaggtcccagcctcctcctgcccttamccctttctctaaggccaagtgggatgacttatatatcaacaacagggttcccggggactcctcaggaacaccacagcccctttagggtatagactaggtttccatacatcttggtatgcctccctttgcagaatgaatgaatgagtgagaaagaggaatgcatctctttccttagcttgagctcctcctctccccacagccagaactctctgtctcgatccccaccgagaccacagctccggtcaggggtcacttgcacaccccaacctgtcaccagcctccctcctttctcagctctca

SEQ ID NO: 196975 - DNA, 601 bp, Human
taatcacaggattactcaaactgttgccctggagccaggcctgccaggaacttaccatctaagggcctgccagtgccaggaactagagccaagcaaaggtcaggaacctcgaaccagcccctgcaccactgctcccatggcagccctaactctaccctcgcctgctgtcttggaaagatctttgcatctcacctgcagctctctcactgtagctctctcctgagagagagctttctccaaaagaaaactccaattccacatcttccaaaaggagagacaaatgcccaaatgcacccgccakctccttaagtcatctaatgactgaatgactatggctttctgcatctcaaacaagattacctggggatctgaggtgggactcaagattctgcactttggtcagctcttagttggtgcctaagcttactggtcttcagcttatactttgagtagcaagaacttagtccctattcctgcctttttgccaggctgctccttccagggagtggggctggggttggcgatcttttcctgagctcattcttgcatcttttctgccatccagtgtgacctctaagacttcattctgagacaatactag

SEQ ID NO: 196976 - DNA, 601 bp, Human
tgcggaaacactgaaacacagaaaatccacgcttgtatcctggcctttgcccaacccatggccccctcagcacttcaggccctctagtcctgctcccccctccttcccctgccacctgcactcccttcaatgccatccacccaaacctcagaaagaaagtaccagtgctgtgtacatgagggtgtgtgttacttgtagagaaggggtgggggagaacgggaagggggctggtagacttgggggttggtgagaggagctgaaaacacctctgatgataactcaccttcaaaagctacccctrggagacacgtccctgaagcagcaggtggtgggaactcagattggggagaaggagctgagtaatcacaggattactcaaactgttgccctggagccaggcctgccaggaacttaccatctaagggcctgccagtgccaggaactagagccaagcaaaggtcaggaacctcgaaccagcccctgcaccactgctcccatggcagccctaactctaccctcgcctgctgtcttggaaagatctttgcatctcacctgcagctctctcactgtagctctctcctgagagagagctttctccaaa

SEQ ID NO: 196977 - DNA, 601 bp, Human
aacgtgggccacccaaaaaagtaagcgggagggagattaggccaagccgcagtgggaactcgggctctggcccagcagtcaaccacaggcctccctgcctcttcccttctccaagagccacatccgcgtgcgtgtgtgtgctgaccacatggtgaccccagacacatctccctgccccatgcttgacccactgcttctcctggccctaggaacctcacaacagtgtcaccaagaccttgaccttctcataggaagatgcggccagtcaaggacccccttcgcaaatacccatgtttgggcracaccaaagccttggactccagccacctggtcagcccatcctccatcctcccagtccaagacagaagtacccagtgagacagacacacaaggccaaagactctgagctagaatgtcagaccccctagcctcactgagctggagagaccaagaggtttgggtccaggaaaaacagagacatagatctagggatggagagacggctgcggaaacactgaaacacagaaaatccacgcttgtatcctggcctttgcccaacccatggccccctcagcacttcaggccctctagtcctgctccc

SEQ ID NO: 196978 - DNA, 601 bp, Human
ctcttcatttaccgatgaaggactaagccagatgaggcaaagcggttgggccagggtcataggctagtttgcctgagagctggatctacatcccagttcccctgagctttccattatgctgttctgtgtacctgtcttttcgggtacacatttcagtgggcatgtttgaaggtgtgcttgtgggtgtgcatatgcaagaaaagtatgtgtcatttgtgagcctacgacatatctggttgctcctgcgtccacacgtgcatatttgtatgttagtgtctgctcatggggcactaggaccccrggttctctctcccactgaactcactgtaacctgtacctgcttccctacccctgtggtttgctgctggccctaggctcatctctgctttgccctgttcctgtcaatgcccacgactctctgctgagcttcatgggaccacaggaggccttctcccagctcttccttgaaaggtagctgggcaaagcttgggatccctggttactgtaggtgtttttagcatttcccagagcacatgggtctcttttccaccatcactgacctgctgcctcccctctgagtggggagccctggggcgggaca

SEQ ID NO: 196979 - DNA, 601 bp, Human
ggaggcagagaaagcagctgcagaggggccacctgctcagcccttcgagttgaaaagctccagttgcctccctcccgccttgggacataggactcctcacggcctcacaacacctgcttcccgccgaaggggcttcctctgtgcctccctccctcgctggggctcagctcccatgggcaaagtgtagggtatagcaggaagatgtggtacacaaggggtgggggataggcagagatgccagtccttcccagccagacagtgaaggctcagggaggtgctatacagagacagggtgaggggrtggcagggaggaacccaggaaacggggcctcaacaccccagctctgctggatgcctgagagcctagggaaagaattagccagggctcttaggctcttggccccagagcagagagagggtggctttgtgtacatccgtgtgtctgagtgtgaacacttatgtttgtacaaaggcatctgtatccatttgtgtgaacatgaatcatcaatgttaaaaatggctgagactagagaccatctcattcaacctcttcatttaccgatgaaggactaagccagatgaggcaaagcggttgggccag

SEQ ID NO: 196980 - DNA, 601 bp, Human
acaagctctggcagcttttctacatcccacgacctgtcagttttctctctcctccatctatttgtgtaattgcaatttatcctgtagtcatttccccagcttaagacagggccctgccagtgttgagggccctgcaggaaggcgctactcaggcattttcctggctgcccaggagatcatccctggagtcagaacaaaggccattaacccccttgtttatctctaaggagacactgtgtgtgtgtgtgtgtgtgtgtgtgtgtgtgcgcgcgcgcttgtgtatgcacacgcacacatgcakgcatacacatgcctatgactcaccttgcacccctcacaggtgataaccccgtagtggatcccagacgacttgtccccacagattttgcaagggatcacttcaatttgtgctggaagagagaaagagaagtaggtcagcccaggaggcttttctgcattcaaccaccatgtacctgggctgcagatacaggtacctggtgcttccactacttctccaaccagctccagcttgctgtttccctcttgcaaaatggaaggggaagtgaaatgccaaatgcttctcagcaaagggtgtgaggaa

SEQ ID NO: 196981 - DNA, 601 bp, Human
ccacgaccaccctctggttgttctcaggccaattctgtttccattcctggctatagtcctgtgtccaagtatgggaatgggggattagaaaaggagatagagctagaactacaacaacagggtagcaggggaaggtgccagagctgcatgggagctgggccagagggcagcagagtgaggagaattcgttccaagtaagaagagatgaagaggtatgggaccttggaaagaggatgtttgttctagcaaagcctaaagttggggactccaaagaactttgatgggggtgacccatccatcsctggaggggaggagacaaggggttgtaacggggaggaatggagaggagaccagaggatgggccgtcttgcaggttaagccttgtctagctcagcaggccaggctgcccctctggagacaccaggaaaaccccagggggctgtcgacttggcctcaccatctcgggacatgcccagcgccaggcatttctgcaggcggcagtgctggcatcggtttcggctggtgcggtcgatggggcagttctgctgacgggtgcaggagtaggccgcgttacagcgctggctccggcggaagaagccct

SEQ ID NO: 196982 - DNA, 601 bp, Human
atctggtcattctggcagagctccataaagcctgagagcctcttggcgaactccaccacgtactgaatggcctcggtgaggtggtgggcacaccgttcccacatctcccacatggactgcagggagggaggagggtcccgctgtagcgctctgtgtggccctgtgatcctcctgagccctggagccccacctaataaactgcaaggggtaggctctgaactcctatgttctcaactagcattttcaaaagcctggtcttagcacaaatgcacagattcctgccagtgagtcccacacactragcacctaccggctgctgacaccgagttagctgttgtgagggaatccaaaaagtatgagatacagctttgccctccaacaaggtatatctcgttgaggtgaacaggacatacagctgccccttcccccacaaaggttatgcccaaggtctcaataacctggagaagcaaatgtgaagtgccaaacgagtgtgtttagagcaggtggtatgagagtgtgatcgaaaaggcagcataaactttggagcctgatgaatctgaatttgactttggttccaccactttgtgactttgaggaaacc

SEQ ID NO: 196983 - DNA, 601 bp, Human
tgatgagttgacttactattttttgattttatgttggtgagaaagccacttgcattcagtagaaaccatactttgaatacccatgcaaccatcctgctgttcacttttagaaccatattcaataaattacatgagctattcaacactttattataaaataggctttgtgttatatgcttttgccagactgtaggctaatgtaagcattctgagcacatttaaggtaggctaggctaagctatggtgttcagtaagttaggcgtgttaaatgcaatttcaacttaccatattttcaacttaygataggtttattgggacataaccccatcataagtcatggagcacatgtacactggaatctctggaagtgggacccaggcagcaatagtttttaaagctccccaggtgattctgatgtgtgctacaatgaaatcactgccatagactaacaatcagacacatttctgtcaggaaagtggctcatttcctctcaacctcatttctccccacttcccacaaccccaccttatgctgctcttgtccctctctgagagtcctctgaatctttattttaactcattttattttatagcaatactga

SEQ ID NO: 196984 - DNA, 601 bp, Human
ccatgtacgaaaagggctcctgataggaggtggccttcctgaaggtgcccaggcctgcaccagggggcttgcagcaatctgtgactaacttttgccctgattctataaaatatccagaagtcatctttaaagtttttatcttctagtttgaagggcatatttaggtgtccactcactggcagagccagaagactgatagtctcgatctgcaaactcaggttagcagcttgacccacttccctaggttctctgaatatttagtattcatctggctcagcccagctactccatgccaggggartggataggatatccagagtcttcctattataggcatacagccttaaaattagttcacacagagcagtgattcttaatcttggtggcctgggggtggctgttaaaattcagtgcaccccttatcaattacagatggtcccagtcttatgatgagttgacttactattttttgattttatgttggtgagaaagccacttgcattcagtagaaaccatactttgaatacccatgcaaccatcctgctgttcacttttagaaccatattcaataaattacatgagctattcaacactttattat

SEQ ID NO: 196985 - DNA, 601 bp, Human
tgttaattgcattattattatatcacataccacattctactctatgttagagttagtgatacacagatctcttcttcataccagattaaaatctcttggtgggggcagcgaccaaatctctgtgtctttccacagtgccttgtacaagcaggtgctgggtaagtgctggctatattaaactgaattgttccctggaggtccctcccaatcccaggccctctaactttccagtctttatgcacgtggaagtagctgttcattcccttagttcccactgctgatgcaagctctctaacagagmgtggtactcccgcactccctcctctgtacccacagaccccggccctcgcaaactctgatgttacagagctagcgatgggcctggcctcttctaccccagggactgctcctacctttgccaggatgctttggcgatgagtcttgcagagatgatgatgaaaggccagctccagattgtactgcagctgttctactttccttttctcttggagccctggccgatctggaggagggggtgggaccgtaatgagaacaagaaagaacatggacattaactcccaacaaaagggtgtatctttgt

SEQ ID NO: 196986 - DNA, 601 bp, Human
ctgtgcccggctgctacacagggagatttgaacacctgtcctattgactgggttgccatgaggatgagaaagcatgtcagcaaaagcactctgttaattgcattattattatatcacataccacattctactctatgttagagttagtgatacacagatctcttcttcataccagattaaaatctcttggtgggggcagcgaccaaatctctgtgtctttccacagtgccttgtacaagcaggtgctgggtaagtgctggctatattaaactgaattgttccctggaggtccctcccaatyccaggccctctaactttccagtctttatgcacgtggaagtagctgttcattcccttagttcccactgctgatgcaagctctctaacagagagtggtactcccgcactccctcctctgtacccacagaccccggccctcgcaaactctgatgttacagagctagcgatgggcctggcctcttctaccccagggactgctcctacctttgccaggatgctttggcgatgagtcttgcagagatgatgatgaaaggccagctccagattgtactgcagctgttctactttccttttctcttgg

SEQ ID NO: 196987 - DNA, 601 bp, Human
tttgaaagcagatccaaccggatttgctttccaattgctctcccagattcctgtctctcctccttcaaatccatcctgtagcagattaaagttcaagttcttgagagcacagaccgtgtaagtcattgctgtatccttaacacccagccctgtgcctggcacatagcaaaggcctgcttgaataattacataaatggttcctttatactggttccaaagtaaattgcctaaatgacagctctgattgtgtcatttttctagcctttggagctccctgtggcctagaaataaagctttaackcttatatggcattgaaagtcctctctgatttgcccctgacctaattttcaggctgatcatctggtgctcttctgccccaccagtctatcccagctcctgattttacactttagtgaggatgtaccatgagtgattctccacatacacactattttgcctccttatttttctcctgttgttcttggtcttcattgtaccctagtcccacacccaaatcccataaaacaattatccccagcctctcatactcatctcatccatttttttggttaaacctcaggaaaaggattttttttcatt

SEQ ID NO: 196988 - DNA, 601 bp, Human
ctcttaaagtccaagtgaaagctgagagctggtaggggccagggtggtggtaatagtagggaaggtgatgtattttgaaagcagatccaaccggatttgctttccaattgctctcccagattcctgtctctcctccttcaaatccatcctgtagcagattaaagttcaagttcttgagagcacagaccgtgtaagtcattgctgtatccttaacacccagccctgtgcctggcacatagcaaaggcctgcttgaataattacataaatggttcctttatactggttccaaagtaaattgcstaaatgacagctctgattgtgtcatttttctagcctttggagctccctgtggcctagaaataaagctttaactcttatatggcattgaaagtcctctctgatttgcccctgacctaattttcaggctgatcatctggtgctcttctgccccaccagtctatcccagctcctgattttacactttagtgaggatgtaccatgagtgattctccacatacacactattttgcctccttatttttctcctgttgttcttggtcttcattgtaccctagtcccacacccaaatcccataaaaca

SEQ ID NO: 196989 - DNA, 601 bp, Human
actgcactccagcctgggcgacagagcaagtctgcctcaaaacaaacaaacagaacaaacaaacaacaacaacaaaaacaagaaaaaaaccacaggagtagggcatgatgagattgcatttttaaaagggctaccgtgggtgcggagtaggtgtggttgctacagggcagatgagggtggaacaggggctcagttaggaggcctctcttaaagtccaagtgaaagctgagagctggtaggggccagggtggtggtaatagtagggaaggtgatgtattttgaaagcagatccaaccggatktgctttccaattgctctcccagattcctgtctctcctccttcaaatccatcctgtagcagattaaagttcaagttcttgagagcacagaccgtgtaagtcattgctgtatccttaacacccagccctgtgcctggcacatagcaaaggcctgcttgaataattacataaatggttcctttatactggttccaaagtaaattgcctaaatgacagctctgattgtgtcatttttctagcctttggagctccctgtggcctagaaataaagctttaactcttatatggcattgaaagtcctc

SEQ ID NO: 196990 - DNA, 601 bp, Human
aacctgggaggtggaggttgcagtgagccgagatcacaccactgcactccagcctgggcgacagagcaagtctgcctcaaaacaaacaaacagaacaaacaaacaacaacaacaaaaacaagaaaaaaaccacaggagtagggcatgatgagattgcatttttaaaagggctaccgtgggtgcggagtaggtgtggttgctacagggcagatgagggtggaacaggggctcagttaggaggcctctcttaaagtccaagtgaaagctgagagctggtaggggccagggtggtggtaatagyagggaaggtgatgtattttgaaagcagatccaaccggatttgctttccaattgctctcccagattcctgtctctcctccttcaaatccatcctgtagcagattaaagttcaagttcttgagagcacagaccgtgtaagtcattgctgtatccttaacacccagccctgtgcctggcacatagcaaaggcctgcttgaataattacataaatggttcctttatactggttccaaagtaaattgcctaaatgacagctctgattgtgtcatttttctagcctttggagctccctgtggccta

SEQ ID NO: 196991 - DNA, 601 bp, Human
ttcgaggaatagcaaggaagcaagtgtggctgcaatgggtgtttgaaggggcagtggaagatcaagtgagaaaagaaggcagggatcatgttatgagccacttgaccatgacgcagactctagatttgattctcggcatcacaggcagctacaggagggctgagaacaggagtcaaggccaggtgtggtggttcacgcctgtaatcccaacactttgggaggccaaggtgggcagatcacctgaggtcaggagttcgagaccagcctggccaacatggtgaaaccctgtctctactaaaaatacaaaaattagccgggcgtgtaatccctgtaatccaagctactcaggaggctgaggcaggacaatcgcttgaacctgggaggtggaggttgcagtgagccgagatcacaccactgcactccagcctgggcgacagagcaagtctgcctcaaaacaaacaaacagaacaaacaaacaacaacaacaaaaacaagaaaaaaaccacaggagtagggcatgatgagattgcatttttaaaagggctaccgtgggtgcggagtaggtgtggttgctacagggcagatgagggtggaacagggg

SEQ ID NO: 196992 - DNA, 601 bp, Human
tctcttcctcaccactgctttattctgagcttttttgggctatggcaatagcttccttcattcattcaacaaatatttgttgagaacacatctggatctgagctaggcactgtgatggcctctagtgatatatcagatatatcagtcaataaagtataatctgtaccttgattaaatttacattctggtgaggggcccagaaaataaatatgtagtgtatcagataataagttctttaaagaaaactaaagctttttgtatggggttactggtcaggaaaaacctctcccgaatgaagagrtggggtaagccatttggaaaactgggggaagaaccctccaggtgactacaatagcaggtacaaaagccctgcgactgggtttgatgtgttcgaggaatagcaaggaagcaagtgtggctgcaatgggtgtttgaaggggcagtggaagatcaagtgagaaaagaaggcagggatcatgttatgagccacttgaccatgacgcagactctagatttgattctcggcatcacaggcagctacaggagggctgagaacaggagtcaaggccaggtgtggtggttcacgcctgtaatcccaaca

SEQ ID NO: 196993 - DNA, 601 bp, Human
ttgttgtatgctgtcacatgcctctgcctttgtgcatgttgttcccctcttcccattactaatccttaccctctagtgtcacctctcctaagactatttccctaactgcctcccatctggattaagggcccttcttttgggctttcctctgtgtagcacttactacattgcaggaaaatggtccaatttgtctgccttcccaccctagatttcagctccttggctgaggtctctctttccctgtctcctctgtacctatcataatgcttagcacatggcacatgcttaataactctttgawctaaacagactttctaagcaggcacctaacactgcaagtagcaaaccaatgctgccagcactcagccaaaggggagatgaaaaaggcacagaaaccagtgagcagacggaggcagggagacctcactggagcaaggctgaaagaacaatttatctcttgcagtctcctctacaaccaagaggcttaaaaatgtctcttgcctgccattgcctccctcccccagcttagtttccttggaaagaggcagtcagagaaaagcaggcagcagggtgtgatcccttcatatctcctagattctct

SEQ ID NO: 196994 - DNA, 601 bp, Human
atgtgcacttcctgcttttataagagtgattgtctgtgactcttgttgtatgctgtcacatgcctctgcctttgtgcatgttgttcccctcttcccattactaatccttaccctctagtgtcacctctcctaagactatttccctaactgcctcccatctggattaagggcccttcttttgggctttcctctgtgtagcacttactacattgcaggaaaatggtccaatttgtctgccttcccaccctagatttcagctccttggctgaggtctctctttccctgtctcctctgtacctawcataatgcttagcacatggcacatgcttaataactctttgaactaaacagactttctaagcaggcacctaacactgcaagtagcaaaccaatgctgccagcactcagccaaaggggagatgaaaaaggcacagaaaccagtgagcagacggaggcagggagacctcactggagcaaggctgaaagaacaatttatctcttgcagtctcctctacaaccaagaggcttaaaaatgtctcttgcctgccattgcctccctcccccagcttagtttccttggaaagaggcagtcagagaaaag

SEQ ID NO: 196995 - DNA, 601 bp, Human
aatacttctagaatgaaccttgtcaaagactctaatgtgcacttcctgcttttataagagtgattgtctgtgactcttgttgtatgctgtcacatgcctctgcctttgtgcatgttgttcccctcttcccattactaatccttaccctctagtgtcacctctcctaagactatttccctaactgcctcccatctggattaagggcccttcttttgggctttcctctgtgtagcacttactacattgcaggaaaatggtccaatttgtctgccttcccaccctagatttcagctccttggcygaggtctctctttccctgtctcctctgtacctatcataatgcttagcacatggcacatgcttaataactctttgaactaaacagactttctaagcaggcacctaacactgcaagtagcaaaccaatgctgccagcactcagccaaaggggagatgaaaaaggcacagaaaccagtgagcagacggaggcagggagacctcactggagcaaggctgaaagaacaatttatctcttgcagtctcctctacaaccaagaggcttaaaaatgtctcttgcctgccattgcctccctcccccagc

SEQ ID NO: 196996 - DNA, 601 bp, Human
tgagggtggaacggggtccagggaggtgggccagcaggccatagggagaggcaaggagtccctcttccaggtcacttggacagccccacaggtgactcggtttcagtgctgaagagctccttgtagagtggagggaaagcggcttggaccacgatggggtggaggtgctggaagatctgcagcctttccacatgctggctacacaggctccgaagcttccccttgggtggcagctggatatgggttaatggggaagggagggtcaatacttcagctctcctcagagcaaagaagtccgctyattcttcctgggctaggacaaaccctccttgccttccccttatgtacttggcactttggcaccagccaaatcccactggtagaagtacgtgtgtgttcaggacactggagggaagtgagagtgggtggggcacaggtgaatgttttctgggtgaagccctcaatttatgttcccaatacttctagaatgaaccttgtcaaagactctaatgtgcacttcctgcttttataagagtgattgtctgtgactcttgttgtatgctgtcacatgcctctgcctttgtgcatgttgttcccctct

SEQ ID NO: 196997 - DNA, 601 bp, Human
aataacaagcctggttgtaaccatggcattttaaatagaagaatttagagaaaacccatataatgaaaaaagtggaaattattagtgagaaaggaagcacattataaagctttgtttaaatcctaagctctctgatgtaaacatttctaagttcctaaatggttattgtactcctgggttgaagtcaacaggcagtaatactgcctcagctggattgtttgatataaaggagaactccacaataggcataggctattagttcctgggactaagggatattattgcatctttaagatcttgrctccaattctcccaggctctccccatcaatgcccaccttgcttcaacggacacaccccaatctgcctgaggtctgatttgaagactagaggagcatttttactccttttccaggctgggaacttgacggtgctggctactgaccccctgctccaccaggacccagtacagttagactttcacttccgccttacctcccagacctctgcccattggcacggccttctctgtgaccgtcgactcttcctggatatcccatatcaggccttggatcaaggcaaccgggaaaggtgactgagcc

SEQ ID NO: 196998 - DNA, 601 bp, Human
gcggctgaccgggcgggggctgccccccacctccctcctggacggggcggctgaccgggcgggggctgccccccacctccctcccagacggggcggctgaccgggcgggggctgcccccacctcccggacgggcagctgcgggcggagacgcccctcacttcccagacgaggcggctgccgggcggaggggctcctcacttctcagacagggcggacgggcagagatgctcctcacctcccagatggggtcgcggctgggcagagacactcctcagttcccagacagggtcgtggccgggyagaggcgctccccacatcccagacgatgggcggctgggcggagacgctcctcacttcctagacgggatgacggccgggcagaggcgctcctcacatcccagacgatgggcggccaggcagagacgctcctcacttcccagacggggtggtggccgggcagaggctgcaatctcggcactttgggaggccaaggcaggcggctgggaggtggaggttgtagcgagccgagatcacgccactgcactccagcctgggcaacactgagcactgagtgaacgaggctccgtctgcaatcccggc

SEQ ID NO: 196999 - DNA, 601 bp, Human
gcgggggctgcccccacctcccggacgggcagctgcgggcggagacgcccctcacttcccagacgaggcggctgccgggcggaggggctcctcacttctcagacagggcggacgggcagagatgctcctcacctcccagatggggtcgcggctgggcagagacactcctcagttcccagacagggtcgtggccgggtagaggcgctccccacatcccagacgatgggcggctgggcggagacgctcctcacttcctagacgggatgacggccgggcagaggcgctcctcacatcccagacratgggcggccaggcagagacgctcctcacttcccagacggggtggtggccgggcagaggctgcaatctcggcactttgggaggccaaggcaggcggctgggaggtggaggttgtagcgagccgagatcacgccactgcactccagcctgggcaacactgagcactgagtgaacgaggctccgtctgcaatcccggcacctcaggaggccgaggctggcagatcactcgcggttaggagctggagaccagcccggccaacacagcgaaaccccgtctccaccaaaatacgaaaaccagtca

SEQ ID NO: 197000 - DNA, 601 bp, Human
ggctgggcggagacgctcctcacttcctagacgggatgacggccgggcagaggcgctcctcacatcccagacgatgggcggccaggcagagacgctcctcacttcccagacggggtggtggccgggcagaggctgcaatctcggcactttgggaggccaaggcaggcggctgggaggtggaggttgtagcgagccgagatcacgccactgcactccagcctgggcaacactgagcactgagtgaacgaggctccgtctgcaatcccggcacctcaggaggccgaggctggcagatcactcrcggttaggagctggagaccagcccggccaacacagcgaaaccccgtctccaccaaaatacgaaaaccagtcaggcatggcggcacgcgcctgcaatcccaggcactcagcaggctgaggcaggagaatcaggcagggaggttgcagtgagccgagatggcagcagtacagtccagcttcggctttcacaactttggtggcatcagagggagaccgtggagagagagggagagggagaccatggggagacggagacggagagggagagggagagggagcggccaaacattttaactgtttt

SEQ ID NO: 197001 - DNA, 601 bp, Human
gcaggcggctgggaggtggaggttgtagcgagccgagatcacgccactgcactccagcctgggcaacactgagcactgagtgaacgaggctccgtctgcaatcccggcacctcaggaggccgaggctggcagatcactcgcggttaggagctggagaccagcccggccaacacagcgaaaccccgtctccaccaaaatacgaaaaccagtcaggcatggcggcacgcgcctgcaatcccaggcactcagcaggctgaggcaggagaatcaggcagggaggttgcagtgagccgagatggcrgcagtacagtccagcttcggctttcacaactttggtggcatcagagggagaccgtggagagagagggagagggagaccatggggagacggagacggagagggagagggagagggagcggccaaacattttaactgtttttctgtggctcctagtttgactgcaaccctggagtacgtggaagagaagacaaatgtggactctgtgtttgtgaacttccagaatgatcggaacgacagaggtggggatctgctgttcttccttgcttttcgcgctgaggcagctggataactccttttcct

SEQ ID NO: 197002 - DNA, 601 bp, Human
gggcaacactgagcactgagtgaacgaggctccgtctgcaatcccggcacctcaggaggccgaggctggcagatcactcgcggttaggagctggagaccagcccggccaacacagcgaaaccccgtctccaccaaaatacgaaaaccagtcaggcatggcggcacgcgcctgcaatcccaggcactcagcaggctgaggcaggagaatcaggcagggaggttgcagtgagccgagatggcagcagtacagtccagcttcggctttcacaactttggtggcatcagagggagaccgtggagagagagggagagggagaccatggggagacggagacggagagggagagggagagggagcggccaaacattttaactgtttttctgtggctcctagtttgactgcaaccctggagtacgtggaagagaagacaaatgtggactctgtgtttgtgaacttccagaatgatcggaacgacagaggtggggatctgctgttcttccttgcttttcgcgctgaggcagctggataactccttttcctttacaggagaccctcttcccctgtctttaaaaatgcaccctcaggcatttcagggattct

SEQ ID NO: 197003 - DNA, 601 bp, Human
gcaacactgagcactgagtgaacgaggctccgtctgcaatcccggcacctcaggaggccgaggctggcagatcactcgcggttaggagctggagaccagcccggccaacacagcgaaaccccgtctccaccaaaatacgaaaaccagtcaggcatggcggcacgcgcctgcaatcccaggcactcagcaggctgaggcaggagaatcaggcagggaggttgcagtgagccgagatggcagcagtacagtccagcttcggctttcacaactttggtggcatcagagggagaccgtggagagagagggagagggagaccatggggagacggagacggagagggagagggagagggagcggccaaacattttaactgtttttctgtggctcctagtttgactgcaaccctggagtacgtggaagagaagacaaatgtggactctgtgtttgtgaacttccagaatgatcggaacgacagaggtggggatctgctgttcttccttgcttttcgcgctgaggcagctggataactccttttcctttacaggagaccctcttcccctgtctttaaaaatgcaccctcaggcatttcagggattcttt

SEQ ID NO: 197004 - DNA, 601 bp, Human
cctggagtacgtggaagagaagacaaatgtggactctgtgtttgtgaacttccagaatgatcggaacgacagaggtggggatctgctgttcttccttgcttttcgcgctgaggcagctggataactccttttcctttacaggagaccctcttcccctgtctttaaaaatgcaccctcaggcatttcagggattcttttcttcccacctaccacgaaggtgggaagttgtaacttgttccatcaagttacaactggactctgaggaagcccctgcaggtggtgttaggggccagactgaagragcactggtgaaattacacagaatccattcaagggatgtggccagcaggacaaaatggatctcaaacatatggagcacctacaatgtgaaagggtcagacataaggccaagggaacggggacatatttaaccggatgcctggagcatatgttacagaaactatagcctcttgcctcaaggagctcaaactctgttggatataagggatggtgaataaccattcataagtgatagatactatttcagagcttactatgccatcattgtattagtatataggtagacctcactaatctctag

SEQ ID NO: 197005 - DNA, 601 bp, Human
ttcagggattcttttcttcccacctaccacgaaggtgggaagttgtaacttgttccatcaagttacaactggactctgaggaagcccctgcaggtggtgttaggggccagactgaaggagcactggtgaaattacacagaatccattcaagggatgtggccagcaggacaaaatggatctcaaacatatggagcacctacaatgtgaaagggtcagacataaggccaagggaacggggacatatttaaccggatgcctggagcatatgttacagaaactatagcctcttgcctcaaggagytcaaactctgttggatataagggatggtgaataaccattcataagtgatagatactatttcagagcttactatgccatcattgtattagtatataggtagacctcactaatctctagtgttaagcacttcatgaacatctcatttcatcttaaattctgtgaggaggaaggttctatgatttataaatggaaaattctatagatggaaactgaagttctgcaggactaactcacagaacaagtgttaaaaccagagttagagcctaggtctgttggactaaagcacatcctatatgcctg

SEQ ID NO: 197006 - DNA, 601 bp, Human
tacacagaatccattcaagggatgtggccagcaggacaaaatggatctcaaacatatggagcacctacaatgtgaaagggtcagacataaggccaagggaacggggacatatttaaccggatgcctggagcatatgttacagaaactatagcctcttgcctcaaggagctcaaactctgttggatataagggatggtgaataaccattcataagtgatagatactatttcagagcttactatgccatcattgtattagtatataggtagacctcactaatctctagtgttaagcacttcakgaacatctcatttcatcttaaattctgtgaggaggaaggttctatgatttataaatggaaaattctatagatggaaactgaagttctgcaggactaactcacagaacaagtgttaaaaccagagttagagcctaggtctgttggactaaagcacatcctatatgcctgcactacactgcttcccagggccactccctagtggaagaaatcaaatctgggggcatacatgtattgagttttaaagcatgttctaatcatttgttctatcctttcacaggtgccctgctgcgggccttcagc

SEQ ID NO: 197007 - DNA, 601 bp, Human
aggccaagggaacggggacatatttaaccggatgcctggagcatatgttacagaaactatagcctcttgcctcaaggagctcaaactctgttggatataagggatggtgaataaccattcataagtgatagatactatttcagagcttactatgccatcattgtattagtatataggtagacctcactaatctctagtgttaagcacttcatgaacatctcatttcatcttaaattctgtgaggaggaaggttctatgatttataaatggaaaattctatagatggaaactgaagttctgmaggactaactcacagaacaagtgttaaaaccagagttagagcctaggtctgttggactaaagcacatcctatatgcctgcactacactgcttcccagggccactccctagtggaagaaatcaaatctgggggcatacatgtattgagttttaaagcatgttctaatcatttgttctatcctttcacaggtgccctgctgcgggccttcagctacatgggctttgaggtggtcagaccagatcaccctgccctccctcccttggacaatgtcatctttatggtgtatccccttgaaaggga

SEQ ID NO: 197008 - DNA, 601 bp, Human
tcttatataacccagctcataatgggcagctctggccacacagtcacatcatgtcccatggtcagatgtactatctctacaggactcagcagcaatgtcaacaatgtagatggcgtgacttgctccagaaccctacaggcttaccttgtaattctccaactggggcttgccataaactccatgccacatgtaaacaatagggcctgctgggtcatatggcccaagtggcagggatgcttgtggtaaagtctggagttctgctgagcccctccccattctgggcctaatgaaagctggtgtwttcatgtcacacagtaaatgggtaggaatagtactgcaagtatggaatatgctgcctctggagcctgagggcgccttttgggtactgtgcttccttcttaatgcttttcctagtatacagccatacctatgactttatcttgaaagaacttccatcagccttccaataatccattttttaaaattcttaatagagacgaggtatctctatgttgcccaggatggtctgaaactcctgaactcaagcaactctcccaccttggccttcaaaattgctgggattataggcatgagccactat

SEQ ID NO: 197009 - DNA, 601 bp, Human
gctgactgctttggtttctttaaattatgcaatgcacttgttggctgcctatgtaacttgcctttagggtgggggtgccagatttagcaagtaaaaatataagatgtccaggtaaatttgaacttcagatgaacaatgaataatttttaaatataagtatgttccatcccatttaatatttggaatatgcatatacaaaaaagtcttgcccatttgaatttcaaatgtaactgagcatcctgtatgttgcctgaaaactctagggatttcctgtctaattaaccatctctgcaaagcatckctgtgggttatgctctttggataccactcattttgataacagtgcccacttcacttctgaagttagtactaccatgtagcctctattattttaaaattccatcattcctagtttttaaaataaggacaggatctcactatgttgcccaggctggtcttgaactcctaggctcaagcaatcctcctgtcttggtctcctgaagtgctgatgttagaggtctgagccaccacacctggcccctaattttttagtaaacctagtttttcaacatctcccacagtctgccttgtctacagagga

SEQ ID NO: 197010 - DNA, 601 bp, Human
ttttaaaattccatcattcctagtttttaaaataaggacaggatctcactatgttgcccaggctggtcttgaactcctaggctcaagcaatcctcctgtcttggtctcctgaagtgctgatgttagaggtctgagccaccacacctggcccctaattttttagtaaacctagtttttcaacatctcccacagtctgccttgtctacagaggacagccgtaattgagctcaacaactctggtgtttttgttgctaaagcactgctgtctctttgataaaaggagtgttctctgggccctgckgcaaaacatagatcatccgtggatttccagccttacatagtatatctactatagtgggctcccttctctgagcttcctgagccctcttttgaccatctgccatggtatttctggaatgtctacttcatgtatgtggatgtcactttttccaagatttcaagagttatgctggcagtgtgttagcactgtttcctgaggtgttaagtcacgtatcagaagatggtgtttccatatcaataaactctcctttatccaacttgaaattccaccttcctcttgatgctgcaccccaagatccac

SEQ ID NO: 197011 - DNA, 601 bp, Human
agtgctggatcatttctgctgatttaccttcttccttctacctaattccttcttgctatgtccgatatgctactgatgcgtccatttaattttagatatcttatcagatttttgtttgcttgtttgttttgtttatagaattgctgtgtttggttctttcctaaatcttctagggcacttttcatagtttcctgtcctctacagagattttcaagtttatttctttgtttttaaatttaattttcttttttttttattttaatagagatgggggtcttcttctgtcacccaggctggactrcagtggtgcaatcgtagctcactgaagatctcacctcctgggctcaagcaatcctcctgcctctgcctctcgagtagccaggactacagacaggtgtacatcaccatgcctggataattttttaatttttgtttttattttattattttattgtaagacagggtcttactatattgcccaggccagtctcaaacccctagcatcaagcaattctgcatcagccttccaaagtgctgagattataggcatgagccaccatgcccagcctcaagcttatttctttaatcaaaacaatcatag

SEQ ID NO: 197012 - DNA, 601 bp, Human
cttctacctaattccttcttgctatgtccgatatgctactgatgcgtccatttaattttagatatcttatcagatttttgtttgcttgtttgttttgtttatagaattgctgtgtttggttctttcctaaatcttctagggcacttttcatagtttcctgtcctctacagagattttcaagtttatttctttgtttttaaatttaattttcttttttttttattttaatagagatgggggtcttcttctgtcacccaggctggactgcagtggtgcaatcgtagctcactgaagatctcamctcctgggctcaagcaatcctcctgcctctgcctctcgagtagccaggactacagacaggtgtacatcaccatgcctggataattttttaatttttgtttttattttattattttattgtaagacagggtcttactatattgcccaggccagtctcaaacccctagcatcaagcaattctgcatcagccttccaaagtgctgagattataggcatgagccaccatgcccagcctcaagcttatttctttaatcaaaacaatcatagttattttaacttttgactaataattccaattttt

SEQ ID NO: 197013 - DNA, 601 bp, Human
ctgtgtttggttctttcctaaatcttctagggcacttttcatagtttcctgtcctctacagagattttcaagtttatttctttgtttttaaatttaattttcttttttttttattttaatagagatgggggtcttcttctgtcacccaggctggactgcagtggtgcaatcgtagctcactgaagatctcacctcctgggctcaagcaatcctcctgcctctgcctctcgagtagccaggactacagacaggtgtacatcaccatgcctggataattttttaatttttgtttttattttaytattttattgtaagacagggtcttactatattgcccaggccagtctcaaacccctagcatcaagcaattctgcatcagccttccaaagtgctgagattataggcatgagccaccatgcccagcctcaagcttatttctttaatcaaaacaatcatagttattttaacttttgactaataattccaatttttcattgtggtattactctgtgactgaattatttcacttagtataatgttctccaggttcatccatgttgtgtactgcagaatttccttcttttttgaggctgaataatat

SEQ ID NO: 197014 - DNA, 601 bp, Human
cctttcagttttttgataatagtcatcctaatgggtgtgaggtgttatttcattgtagttttgatttgcatttcccagatgaatagtgatattgatatttatatacctattggccatttgtatgtcttctttggagaaatgtctactcaagtcctttgtcaactttttaatcaggttaggtttttctttggggttttttgttttgttttgttttgtttgtttttgcttctttgctattgagttgtagaagttccttttaattatatcttggatattaaccccttgtgagatatacggtttrcaaatattttcttctattccataagttgccttttaactctgttgagtgtttccttttctgtgcagaggctttttagcttgatgtagtaccaacaacctatttttgcttttgtttcttatgcttttggtgtcatatccaagaaatcatcacctatcccaatgtcatgatgctttttcccttatgtttccttctaggagctttacagtttctggtcttaaaaatctttaatccattttgagttgactttttgtgtatggtgtaagatacaggtccaatttcactctgatgacagttccaata

SEQ ID NO: 197015 - DNA, 601 bp, Human
tccttttaattatatcttggatattaaccccttgtgagatatacggtttgcaaatattttcttctattccataagttgccttttaactctgttgagtgtttccttttctgtgcagaggctttttagcttgatgtagtaccaacaacctatttttgcttttgtttcttatgcttttggtgtcatatccaagaaatcatcacctatcccaatgtcatgatgctttttcccttatgtttccttctaggagctttacagtttctggtcttaaaaatctttaatccattttgagttgactttttgygtatggtgtaagatacaggtccaatttcactctgatgacagttccaatattaggatctatggttctgtttaggctctcagttgtttctaccagtcttcctttatggaactttgttttctggggtacctgaattcttcagctgtgtgcaggttaatactacttttaaaaaagtatttgtgagcgagcatcaagggtgaaaaacaagtattttctttcagacaacatttgtgtgtgtttgctccaggttccctggaggcattgctacccagtgacgatgtgaaactggtcagcagactccag

SEQ ID NO: 197016 - DNA, 601 bp, Human
ggccgggtgcagtggctcacgcctgtaatcccaacactttgggaggctgaggcgggcagatcacaaggtcaagagatcgagaccatcctggccaacatggtgaaaccccgtctctactgaaaatacaaaaattagctgggcttggtggcacacacctgcagtcccagctgctcggaaggctgaggtaggagaatcgcttgaacccgggaggcagaggtagcagtgagctgagatcatgccactgcactccagcctggtgacagagtgagactccgtctcaaaaaaaaaaaaaaaaaaaaaagaattacaaagtgtggtcctcatgtccacagtcccaactagttcctccatactgatgagaattaagtacaaaatagtaatacatctcactgctgcttctgccttctgagggacaatatttttcagcaagtatataaatataaacatataaataaataagtaaatagtagatatccagtaagtaaatatccagcttttagaagagactccctggtgatagctgaataattgaagattttcactactataacttgcttctgtgccataatccttattaaatgagtcatcatccaaatataca

SEQ ID NO: 197017 - DNA, 601 bp, Human
tttgaaaattatatttgatgagactagatgtttgtcttcagagaaatctcattgctgtttctcattaagaaaaaatgtaactaaaagaaacacattcgtatatttaaatgccatcataactgaggcatagggaattatgtggaatctgaaaaatggtgtcttactctattttgtgctgctgtaacagaatgcctgagactggataactgataaagaacagaggtttattctcttacagttctggaggccgcaaagtccaagatcaagatgccggcaggttagggcccagtctctcacttcmaagggtgtaccttgattgctgcattctctggagaggagaaacactattactcacatgacagaagagggagcacccactctcacaagccctttttatggtgacattaatcctaaacacctcccattaggccctacctcccaacactgtttgtcaaattggagattaggtttcaacatgagttttggaggggacaaaaataatcaaaccatagcaaatgaaaaatcagtgttcagggaacaggatatgctcattcttatgtttaacgtgagttaataaaatgaacaaacctgtagctaccaa

SEQ ID NO: 197018 - DNA, 601 bp, Human
tttgtttacccaaccttttgatttataatttagccttcttcaatcagcttgtgccctcctgtaaaaaggcttccatgaattctcttgtcacaggaaatattgatcaaatcacatttttgatgccacgaagctgagggcagacctgggacagatggtgtctcccactgagggagcggaggcccctgggaggtcagtttctcctgctgctgaacaccatcttccaatcacaacagcaaggaattgggaatgtgtcattttagctgtaaaggaatgtacatgcaaaatgtcctgattaatgatkattaaaggaaagaccatttctcttttccccaaacccaacctctttgtcacttcagacccctaagggagcctgtgcaacatcggtgaaggttgctattgacacagggtaccgacatattgatggggcctacatctaccaaaatgaacacgaagttggggaggccatcagggagaagatagcagaaggaaaggtgcggagggaagatatcttctactgtggaaaggtgagatcttgccttcagcctccactggggacagtgagaaggtttcagttgttcattttattattcatcttccgtgt

SEQ ID NO: 197019 - DNA, 601 bp, Human; identical to SEQ ID NO: 33708

SEQ ID NO: 197020 - DNA, 601 bp, Human; identical to SEQ ID NO: 33709

SEQ ID NO: 197021 - DNA, 601 bp, Human; identical to SEQ ID NO: 33710

SEQ ID NO: 197022 - DNA, 601 bp, Human; identical to SEQ ID NO: 33711

SEQ ID NO: 197023 - DNA, 601 bp, Human; identical to SEQ ID NO: 33712

SEQ ID NO: 197024 - DNA, 601 bp, Human; identical to SEQ ID NO: 33713

SEQ ID NO: 197025 - DNA, 601 bp, Human; identical to SEQ ID NO: 33714

SEQ ID NO: 197026 - DNA, 601 bp, Human; identical to SEQ ID NO: 33715

SEQ ID NO: 197027 - DNA, 601 bp, Human; identical to SEQ ID NO: 33716

SEQ ID NO: 197028 - DNA, 601 bp, Human; identical to SEQ ID NO: 33717

SEQ ID NO: 197029 - DNA, 601 bp, Human; identical to SEQ ID NO: 33718

SEQ ID NO: 197030 - DNA, 601 bp, Human; identical to SEQ ID NO: 33719

SEQ ID NO: 197031 - DNA, 601 bp, Human; identical to SEQ ID NO: 33720

SEQ ID NO: 197032 - DNA, 601 bp, Human; identical to SEQ ID NO: 33721

SEQ ID NO: 197033 - DNA, 601 bp, Human; identical to SEQ ID NO: 33722

SEQ ID NO: 197034 - DNA, 601 bp, Human; identical to SEQ ID NO: 33723

SEQ ID NO: 197035 - DNA, 601 bp, Human; identical to SEQ ID NO: 33724

SEQ ID NO: 197036 - DNA, 601 bp, Human; identical to SEQ ID NO: 33725

SEQ ID NO: 197037 - DNA, 601 bp, Human; identical to SEQ ID NO: 33726

SEQ ID NO: 197038 - DNA, 601 bp, Human; identical to SEQ ID NO: 33727

SEQ ID NO: 197039 - DNA, 601 bp, Human; identical to SEQ ID NO: 33728

SEQ ID NO: 197040 - DNA, 601 bp, Human; identical to SEQ ID NO: 33729

SEQ ID NO: 197041 - DNA, 601 bp, Human; identical to SEQ ID NO: 33730

SEQ ID NO: 197042 - DNA, 601 bp, Human; identical to SEQ ID NO: 33731

SEQ ID NO: 197043 - DNA, 601 bp, Human; identical to SEQ ID NO: 33732

SEQ ID NO: 197044 - DNA, 601 bp, Human; identical to SEQ ID NO: 33733

SEQ ID NO: 197045 - DNA, 601 bp, Human; identical to SEQ ID NO: 33734

SEQ ID NO: 197046 - DNA, 601 bp, Human; identical to SEQ ID NO: 33735

SEQ ID NO: 197047 - DNA, 601 bp, Human; identical to SEQ ID NO: 33736

SEQ ID NO: 197048 - DNA, 601 bp, Human; identical to SEQ ID NO: 33737

SEQ ID NO: 197049 - DNA, 601 bp, Human; identical to SEQ ID NO: 33738

SEQ ID NO: 197050 - DNA, 601 bp, Human; identical to SEQ ID NO: 33739

SEQ ID NO: 197051 - DNA, 601 bp, Human; identical to SEQ ID NO: 33740

SEQ ID NO: 197052 - DNA, 601 bp, Human; identical to SEQ ID NO: 33741

SEQ ID NO: 197053 - DNA, 601 bp, Human; identical to SEQ ID NO: 33742

SEQ ID NO: 197054 - DNA, 601 bp, Human; identical to SEQ ID NO: 33743

SEQ ID NO: 197055 - DNA, 601 bp, Human; identical to SEQ ID NO: 33744

SEQ ID NO: 197056 - DNA, 601 bp, Human; identical to SEQ ID NO: 33745

SEQ ID NO: 197057 - DNA, 601 bp, Human; identical to SEQ ID NO: 33746

SEQ ID NO: 197058 - DNA, 601 bp, Human; identical to SEQ ID NO: 33747

SEQ ID NO: 197059 - DNA, 601 bp, Human; identical to SEQ ID NO: 33748

SEQ ID NO: 197060 - DNA, 601 bp, Human; identical to SEQ ID NO: 33749

SEQ ID NO: 197061 - DNA, 601 bp, Human; identical to SEQ ID NO: 33750

SEQ ID NO: 197062 - DNA, 601 bp, Human; identical to SEQ ID NO: 33751

SEQ ID NO: 197063 - DNA, 601 bp, Human; identical to SEQ ID NO: 33752

SEQ ID NO: 197064 - DNA, 601 bp, Human; identical to SEQ ID NO: 33753

SEQ ID NO: 197065 - DNA, 601 bp, Human; identical to SEQ ID NO: 33754

SEQ ID NO: 197066 - DNA, 601 bp, Human; identical to SEQ ID NO: 33755

SEQ ID NO: 197067 - DNA, 601 bp, Human; identical to SEQ ID NO: 33756

SEQ ID NO: 197068 - DNA, 601 bp, Human; identical to SEQ ID NO: 33757

SEQ ID NO: 197069 - DNA, 601 bp, Human
ttacttacccttcattccatttccaggcacccctcccccaaaccacctcccttttcttgaaattttcaggatgcttctggccctaggttccctgtcctcactcctgtggccctagtcccgggcagcctcgggttacttggggttttcccggtggcgagaggctctctacccccgccctttcgcagcagggctgaggcacgcgcttgcgcggggtccgggaaaccggcgcgtgccaggagacagaggctggggaaggggggaggtgagaggaaagagggtggaaaggagaggatagagagasaagagcggaggaccaggaaccagagagagagagagagaaaagagagaggagagacagagcgcttgggggcgaaaggagagagggagggaagggtgggtaaggaggagagagcggtctgctgcaaaccccaggaggagagcttggagcccaagccagaactcgagccctagccggagccgttcacagggaggcggctgccgggaccgtcagccctgcatgatgcatctccggctcttctgcatcctgctcgccgcggtctcaggagccgagggctggggctactgtgagtgttgggcttgg

SEQ ID NO: 197070 - DNA, 601 bp, Human; identical to SEQ ID NO: 28154

SEQ ID NO: 197071 - DNA, 601 bp, Human; identical to SEQ ID NO: 28155

SEQ ID NO: 197072 - DNA, 601 bp, Human; identical to SEQ ID NO: 28156

SEQ ID NO: 197073 - DNA, 601 bp, Human; identical to SEQ ID NO: 28157

SEQ ID NO: 197074 - DNA, 601 bp, Human; identical to SEQ ID NO: 28158

SEQ ID NO: 197075 - DNA, 601 bp, Human; identical to SEQ ID NO: 28159

SEQ ID NO: 197076 - DNA, 601 bp, Human; identical to SEQ ID NO: 28160

SEQ ID NO: 197077 - DNA, 601 bp, Human; identical to SEQ ID NO: 28161

SEQ ID NO: 197078 - DNA, 601 bp, Human; identical to SEQ ID NO: 28162

SEQ ID NO: 197079 - DNA, 601 bp, Human; identical to SEQ ID NO: 28163

SEQ ID NO: 197080 - DNA, 601 bp, Human; identical to SEQ ID NO: 28164

SEQ ID NO: 197081 - DNA, 601 bp, Human
aattcattcgcttttttaaaataagtgagataacacattgaaggacctggtacaattcttactatgttaagtgcacaatacatgttagttgttattagacacttggggccttggaaatacccatttatacccagttgaagtataagagaggtggtgctgccaccctgaatgcaggctcaagtgagattaaaattacagtaagttggccgggtgcagtggctcacgcctgtaaccccagcgctttgggaggccgaggcgggcggatcacgaggtcaggagatcgagaccatcctggctaacrtggtgaaaccccatctgtactaaaaataaaaaaaattagccgggtgtggtggcaggcgcctgtagtcccagctactcaggtggctgaggcaggagaatggcatgaacctgggaggcggaggttgcagtcagccgagatcgcgccattgcactccagcctgagcgatagagcaagaccgtgtctcaaaaaaaaaaaaaaaaaaaaatacagtaagtcttcacttaatgttgtccataggttcttagaaactgcgactttaaaaatgatgtatatcaaaaccaagtttttttttcattaaca

SEQ ID NO: 197082 - DNA, 601 bp, Human
gccgggtgcagtggctcacgcctgtaaccccagcgctttgggaggccgaggcgggcggatcacgaggtcaggagatcgagaccatcctggctaacatggtgaaaccccatctgtactaaaaataaaaaaaattagccgggtgtggtggcaggcgcctgtagtcccagctactcaggtggctgaggcaggagaatggcatgaacctgggaggcggaggttgcagtcagccgagatcgcgccattgcactccagcctgagcgatagagcaagaccgtgtctcaaaaaaaaaaaaaaaaaaaaatacagtaagtcttcacttaatgttgtccataggttcttagaaactgcgactttaaaaatgatgtatatcaaaaccaagtttttttttcattaacattgtaacaaaatgacatcgaacaaaatgatgttatttgaaaccaggttatttgaggaccttctgtacttgatttgcttacctgctgtactttaatttccttcaagtcgcagttgctaagaacctattgatgacattaaggacttaccgtatgcagatgattgcttggggatttgtgaaggggtctctcattttcttgatgaggta

SEQ ID NO: 197083 - DNA, 601 bp, Human
ggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtgagtggcgggcagtcagagaggaggggggcagtgagagtgggaaaggagtgttggcggacactcagctcacactgtaggtgaggggagagctctctcaggaaggcttttcttttccttttttttttttttttttgagatggagttttgctctgttgcccaggccggagtgcagtggagcaatctcactgcatcctccgcctcccagtttcaagcgattctcctgcctcagcctccccagtagctgggattacaggtgcacgccaccacacatggctaatttttgtatttttagtagagatagggtttcaccatgttggccaggctggtctcgaactcctgacctcatgatccaccctccttggtctcccaaagtgctgtgattacaggcatgagccacaatgcctggccaaaggtttttctagttatccaaaga

SEQ ID NO: 197084 - DNA, 601 bp, Human
cgctacctgtacctggccagcaaccacagcaacaagtggggtcacccccggggctaccgcatccagatgctcagctttgctggagagccgctgccccaaaacagctccatggcgagaggcttcagctgggagaggtgagtggcgggcagtcagagaggaggggggcagtgagagtgggaaaggagtgttggcggacactcagctcacactgtaggtgaggggagagctctctcaggaaggcttttcttttccttttttttttttttttttgagatggagttttgctctgttgcccaggccrgagtgcagtggagcaatctcactgcatcctccgcctcccagtttcaagcgattctcctgcctcagcctccccagtagctgggattacaggtgcacgccaccacacatggctaatttttgtatttttagtagagatagggtttcaccatgttggccaggctggtctcgaactcctgacctcatgatccaccctccttggtctcccaaagtgctgtgattacaggcatgagccacaatgcctggccaaaggtttttctagttatccaaagaaaccatgatgggcacattttccccttggagg

SEQ ID NO: 197085 - DNA, 601 bp, Human
gcggaggaggttgcagtgagtcaagatcatgccactgcactccagcctgggcaacagagtaagaccctgtctcaaaaaaaaaaaaaagatagatgatgtatgctgtatgaaaaaaggaaacacacagatgattcaacagcctgttttgtggggtaatgaaaagtcaccctgggaactgggctccagccctcgttctgccacccaccaactacatgtccttggcaagtcatatcaattatctgagtttctgttttataatctacaaataggttatctctggcagcttaataataatcagggttaacatttattaaacagtgtgtgccagtccatgtgctatgtgcttttctgtgaggtagttactgctatttacagaaacagtagatgcagagaccaaggtgctgagttaaatgattaggccaacaaggttagtacatgccgagccaggatggaagcccaggtaggcaggctggcttccgcggcaatgctcttatgaactatgttacgtccagtgctgataaactgactctctggggagcaggggaaagccctgagtttagcatttgccaatttctatcacgtaaacattcccattctggcc

SEQ ID NO: 197086 - DNA, 601 bp, Human; identical to SEQ ID NO: 18059

SEQ ID NO: 197087 - DNA, 601 bp, Human; identical to SEQ ID NO: 18060

SEQ ID NO: 197088 - DNA, 601 bp, Human; identical to SEQ ID NO: 18061

SEQ ID NO: 197089 - DNA, 601 bp, Human; identical to SEQ ID NO: 18062

SEQ ID NO: 197090 - DNA, 601 bp, Human; identical to SEQ ID NO: 18063

SEQ ID NO: 197091 - DNA, 601 bp, Human; identical to SEQ ID NO: 18064

SEQ ID NO: 197092 - DNA, 601 bp, Human
taattatatagtataccatacattatcattcaaaacaaccatcctgctcataacatctttgaaaagaaaaatatatatgtgcagtattttattaaagcaacattttatttaagaataaagtcttgttaattactatattttagatgcaatgtgatctgaagtttctaattctggcccaactaaatttctagctctgtttccctaaacaaataatttggtttctctgtgcctgcattttccctttggagaagaaaagtgctctctcttgagttgaccgagagtcccattagggatagggagwcttaaatgcatccacaggggcacaggcagagttgagcacataaacggaggcccaaaatcagcatagaaccagaaagattcagagttggccaagaatgaacattggctaccagaccacaagtcagcatgagttgctctatggcatcaaattgcaacttgagagtagatgggcagggtcactatcaaattaagcaatcagggcacacaagttgcagtaacacaacaagactaggccagctctggaatccagtaactcagtgtcagcaaggttttgggttatagttcaagaaagtctaaacag

SEQ ID NO: 197093 - DNA, 601 bp, Human
atagtataccatacattatcattcaaaacaaccatcctgctcataacatctttgaaaagaaaaatatatatgtgcagtattttattaaagcaacattttatttaagaataaagtcttgttaattactatattttagatgcaatgtgatctgaagtttctaattctggcccaactaaatttctagctctgtttccctaaacaaataatttggtttctctgtgcctgcattttccctttggagaagaaaagtgctctctcttgagttgaccgagagtcccattagggatagggagacttaaawgcatccacaggggcacaggcagagttgagcacataaacggaggcccaaaatcagcatagaaccagaaagattcagagttggccaagaatgaacattggctaccagaccacaagtcagcatgagttgctctatggcatcaaattgcaacttgagagtagatgggcagggtcactatcaaattaagcaatcagggcacacaagttgcagtaacacaacaagactaggccagctctggaatccagtaactcagtgtcagcaaggttttgggttatagttcaagaaagtctaaacagagccagt

SEQ ID NO: 197094 - DNA, 601 bp, Human
cttctctgctcttccaactccttggcagtgggagtcccagatggaggggatgggatgggaagcctgatcctggagctcaggaaagccctgtggcctcctctccaggccccagtttccatgacaaaagccaggggtgaatggacagaagtcagctagggcagccccagttcccaggtgggggaggggagggtgggataaatttgttcccaggagagagtatgggaaaggcgagtgggaatgggaagtttccaggctggcagacccttcatagccactgagggagaagagtccacaggcccaygccagccctctcctccccgctgcttctctctcaccccatcctgctctcaaaccaagcctagcattctcacctccttcctcatgtgggagagtcctgagggatacatggtttctgcgtgcttgaggaagagagggcacactgctggcatggcacaaaggctcacgctgtgcctccctccacccctccacaattctcttttcttctcctacatagtggcaaggagagactcaagagttctgccccaatgccaaggttgtgctggttggctgtaaactggacatgcggactgacctggccaca

SEQ ID NO: 197095 - DNA, 601 bp, Human
gcatctctatcacctggctccaggtctcgattcctggatttaattaaaattctactagcctttggcaaggaatgggggctgagaagtagtaggcacctggctggggggatgaatctgcgagagacaccatcctggcgaggagtttcaataaatggctcctgggaaagaaataagagggcattacaactctggcagcttagaggtagagttcatctcccaaacagcctcagaactatatggctttagtcttgataaccacaagacttgataaaccacagagacttaaaaaatgggtattatygaagcaatccttgtgtatgtggactaagaaaggacccacgatacagacaaaccttaagtcccatttgattttttttttgtggggaacagcatttcctaactatgttacactctatgtatggttaaatttgcatttctcaacacttagcagtcaggggcagaggacagaatgccctaaatcatagtacaaggaaaaagccagatcagactgcaatgaagtctgccacagtacaaagtagaaaatttatatgttttcagtattttgagattactcatatgtgaccaaaatctcacagcatct

SEQ ID NO: 197096 - DNA, 601 bp, Human
ccgtaaggaacaagtcggtatctaaaatagagatacaaacagagatggatacaggactcctcccaaagtgattattgggaagttacaacccaatgatttcactcttcattctggccaagggcttcttttattatgctcaactccctctcccacctccccattgaatccatgtttaaaagattttgtttaatgaacaaactacatttattatataattgcctgggggccttccatgaacaaatgttatgttttggtttaaatttaagaaacaaaaactgaaaatatcctgaggaacactaargctctggggactgtaggctgggaactatgctatagtcacgcaactcagtgactgtgtgatcagtggagagagccctgtgatgaggggaaaatcagatgctgacagctcttcagccacagaaaactcccagtctgtgggcagcaagggctcctgacatggtggacagcagtaccaggttggagatacaaattatatcaatgcacatcactccccaagaaagggctacacttcctacctctgaaatttcagacccatcttattggccagagcatggagcagcaacacagtctggccccaagc

SEQ ID NO: 197097 - DNA, 601 bp, Human; identical to SEQ ID NO: 35779

SEQ ID NO: 197098 - DNA, 601 bp, Human; identical to SEQ ID NO: 35780

SEQ ID NO: 197099 - DNA, 601 bp, Human; identical to SEQ ID NO: 35781

SEQ ID NO: 197100 - DNA, 601 bp, Human; identical to SEQ ID NO: 35782

SEQ ID NO: 197101 - DNA, 601 bp, Human; identical to SEQ ID NO: 35783

SEQ ID NO: 197102 - DNA, 601 bp, Human; identical to SEQ ID NO: 35784

SEQ ID NO: 197103 - DNA, 601 bp, Human; identical to SEQ ID NO: 35785

SEQ ID NO: 197104 - DNA, 601 bp, Human; identical to SEQ ID NO: 35786

SEQ ID NO: 197105 - DNA, 601 bp, Human; identical to SEQ ID NO: 35787

SEQ ID NO: 197106 - DNA, 601 bp, Human; identical to SEQ ID NO: 35788

SEQ ID NO: 197107 - DNA, 601 bp, Human; identical to SEQ ID NO: 35789

SEQ ID NO: 197108 - DNA, 601 bp, Human; identical to SEQ ID NO: 35790

SEQ ID NO: 197109 - DNA, 601 bp, Human; identical to SEQ ID NO: 35791

SEQ ID NO: 197110 - DNA, 601 bp, Human; identical to SEQ ID NO: 35792

SEQ ID NO: 197111 - DNA, 601 bp, Human; identical to SEQ ID NO: 35793

SEQ ID NO: 197112 - DNA, 601 bp, Human; identical to SEQ ID NO: 35794

SEQ ID NO: 197113 - DNA, 601 bp, Human; identical to SEQ ID NO: 35795

SEQ ID NO: 197114 - DNA, 601 bp, Human; identical to SEQ ID NO: 35796

SEQ ID NO: 197115 - DNA, 601 bp, Human; identical to SEQ ID NO: 35797

SEQ ID NO: 197116 - DNA, 601 bp, Human; identical to SEQ ID NO: 35798

SEQ ID NO: 197117 - DNA, 601 bp, Human; identical to SEQ ID NO: 35799

SEQ ID NO: 197118 - DNA, 601 bp, Human; identical to SEQ ID NO: 35800

SEQ ID NO: 197119 - DNA, 601 bp, Human; identical to SEQ ID NO: 35801

SEQ ID NO: 197120 - DNA, 601 bp, Human; identical to SEQ ID NO: 35802

SEQ ID NO: 197121 - DNA, 601 bp, Human; identical to SEQ ID NO: 35803

SEQ ID NO: 197122 - DNA, 601 bp, Human; identical to SEQ ID NO: 35804

SEQ ID NO: 197123 - DNA, 601 bp, Human; identical to SEQ ID NO: 35805

SEQ ID NO: 197124 - DNA, 601 bp, Human; identical to SEQ ID NO: 35806

SEQ ID NO: 197125 - DNA, 601 bp, Human; identical to SEQ ID NO: 35807

SEQ ID NO: 197126 - DNA, 601 bp, Human; identical to SEQ ID NO: 35808

SEQ ID NO: 197127 - DNA, 601 bp, Human; identical to SEQ ID NO: 35809

SEQ ID NO: 197128 - DNA, 601 bp, Human; identical to SEQ ID NO: 35810

SEQ ID NO: 197129 - DNA, 601 bp, Human; identical to SEQ ID NO: 35811

SEQ ID NO: 197130 - DNA, 601 bp, Human; identical to SEQ ID NO: 35812

SEQ ID NO: 197131 - DNA, 601 bp, Human; identical to SEQ ID NO: 35813

SEQ ID NO: 197132 - DNA, 601 bp, Human; identical to SEQ ID NO: 35814

SEQ ID NO: 197133 - DNA, 601 bp, Human; identical to SEQ ID NO: 35815

SEQ ID NO: 197134 - DNA, 601 bp, Human; identical to SEQ ID NO: 35816

SEQ ID NO: 197135 - DNA, 601 bp, Human; identical to SEQ ID NO: 35817

SEQ ID NO: 197136 - DNA, 601 bp, Human; identical to SEQ ID NO: 35818

SEQ ID NO: 197137 - DNA, 601 bp, Human; identical to SEQ ID NO: 35819

SEQ ID NO: 197138 - DNA, 601 bp, Human; identical to SEQ ID NO: 35820

SEQ ID NO: 197139 - DNA, 601 bp, Human; identical to SEQ ID NO: 35821

SEQ ID NO: 197140 - DNA, 601 bp, Human; identical to SEQ ID NO: 35822

SEQ ID NO: 197141 - DNA, 601 bp, Human; identical to SEQ ID NO: 35823

SEQ ID NO: 197142 - DNA, 601 bp, Human; identical to SEQ ID NO: 35824

SEQ ID NO: 197143 - DNA, 601 bp, Human; identical to SEQ ID NO: 35825

SEQ ID NO: 197144 - DNA, 601 bp, Human; identical to SEQ ID NO: 35826

SEQ ID NO: 197145 - DNA, 601 bp, Human; identical to SEQ ID NO: 35827

SEQ ID NO: 197146 - DNA, 601 bp, Human; identical to SEQ ID NO: 35983

SEQ ID NO: 197147 - DNA, 601 bp, Human; identical to SEQ ID NO: 35984

SEQ ID NO: 197148 - DNA, 601 bp, Human; identical to SEQ ID NO: 35985

SEQ ID NO: 197149 - DNA, 601 bp, Human; identical to SEQ ID NO: 35986

SEQ ID NO: 197150 - DNA, 601 bp, Human; identical to SEQ ID NO: 35987

SEQ ID NO: 197151 - DNA, 601 bp, Human; identical to SEQ ID NO: 35988

SEQ ID NO: 197152 - DNA, 601 bp, Human; identical to SEQ ID NO: 35989

SEQ ID NO: 197153 - DNA, 601 bp, Human; identical to SEQ ID NO: 35990

SEQ ID NO: 197154 - DNA, 601 bp, Human; identical to SEQ ID NO: 35991

SEQ ID NO: 197155 - DNA, 601 bp, Human; identical to SEQ ID NO: 36079

SEQ ID NO: 197156 - DNA, 601 bp, Human; identical to SEQ ID NO: 36080

SEQ ID NO: 197157 - DNA, 601 bp, Human; identical to SEQ ID NO: 36081

SEQ ID NO: 197158 - DNA, 601 bp, Human; identical to SEQ ID NO: 36082

SEQ ID NO: 197159 - DNA, 601 bp, Human; identical to SEQ ID NO: 36083

SEQ ID NO: 197160 - DNA, 601 bp, Human; identical to SEQ ID NO: 36084

SEQ ID NO: 197161 - DNA, 601 bp, Human; identical to SEQ ID NO: 36085

SEQ ID NO: 197162 - DNA, 601 bp, Human; identical to SEQ ID NO: 36086

SEQ ID NO: 197163 - DNA, 601 bp, Human; identical to SEQ ID NO: 36087

SEQ ID NO: 197164 - DNA, 601 bp, Human; identical to SEQ ID NO: 36088

SEQ ID NO: 197165 - DNA, 601 bp, Human; identical to SEQ ID NO: 36089

SEQ ID NO: 197166 - DNA, 601 bp, Human; identical to SEQ ID NO: 36090

SEQ ID NO: 197167 - DNA, 601 bp, Human; identical to SEQ ID NO: 36091

SEQ ID NO: 197168 - DNA, 601 bp, Human; identical to SEQ ID NO: 36092

SEQ ID NO: 197169 - DNA, 601 bp, Human; identical to SEQ ID NO: 36093

SEQ ID NO: 197170 - DNA, 601 bp, Human; identical to SEQ ID NO: 36094

SEQ ID NO: 197171 - DNA, 601 bp, Human; identical to SEQ ID NO: 36095

SEQ ID NO: 197172 - DNA, 601 bp, Human; identical to SEQ ID NO: 36096

SEQ ID NO: 197173 - DNA, 601 bp, Human; identical to SEQ ID NO: 36097

SEQ ID NO: 197174 - DNA, 601 bp, Human; identical to SEQ ID NO: 36098

SEQ ID NO: 197175 - DNA, 601 bp, Human; identical to SEQ ID NO: 36099

SEQ ID NO: 197176 - DNA, 601 bp, Human; identical to SEQ ID NO: 36100

SEQ ID NO: 197177 - DNA, 601 bp, Human; identical to SEQ ID NO: 36101

SEQ ID NO: 197178 - DNA, 601 bp, Human; identical to SEQ ID NO: 36102

SEQ ID NO: 197179 - DNA, 601 bp, Human; identical to SEQ ID NO: 36103

SEQ ID NO: 197180 - DNA, 601 bp, Human; identical to SEQ ID NO: 36104

SEQ ID NO: 197181 - DNA, 601 bp, Human; identical to SEQ ID NO: 36105

SEQ ID NO: 197182 - DNA, 601 bp, Human; identical to SEQ ID NO: 36106

SEQ ID NO: 197183 - DNA, 601 bp, Human; identical to SEQ ID NO: 36107

SEQ ID NO: 197184 - DNA, 601 bp, Human; identical to SEQ ID NO: 36108

SEQ ID NO: 197185 - DNA, 601 bp, Human; identical to SEQ ID NO: 36109

SEQ ID NO: 197186 - DNA, 601 bp, Human; identical to SEQ ID NO: 36110

SEQ ID NO: 197187 - DNA, 601 bp, Human; identical to SEQ ID NO: 35828

SEQ ID NO: 197188 - DNA, 601 bp, Human; identical to SEQ ID NO: 35829

SEQ ID NO: 197189 - DNA, 601 bp, Human; identical to SEQ ID NO: 35830

SEQ ID NO: 197190 - DNA, 601 bp, Human; identical to SEQ ID NO: 35831

SEQ ID NO: 197191 - DNA, 601 bp, Human; identical to SEQ ID NO: 35832

SEQ ID NO: 197192 - DNA, 601 bp, Human; identical to SEQ ID NO: 35833

SEQ ID NO: 197193 - DNA, 601 bp, Human; identical to SEQ ID NO: 35834

SEQ ID NO: 197194 - DNA, 601 bp, Human; identical to SEQ ID NO: 35835

SEQ ID NO: 197195 - DNA, 601 bp, Human; identical to SEQ ID NO: 35836

SEQ ID NO: 197196 - DNA, 601 bp, Human; identical to SEQ ID NO: 35837

SEQ ID NO: 197197 - DNA, 601 bp, Human; identical to SEQ ID NO: 35838

SEQ ID NO: 197198 - DNA, 601 bp, Human; identical to SEQ ID NO: 35839

SEQ ID NO: 197199 - DNA, 601 bp, Human; identical to SEQ ID NO: 35840

SEQ ID NO: 197200 - DNA, 601 bp, Human; identical to SEQ ID NO: 35841

SEQ ID NO: 197201 - DNA, 601 bp, Human; identical to SEQ ID NO: 35842

SEQ ID NO: 197202 - DNA, 601 bp, Human; identical to SEQ ID NO: 35843

SEQ ID NO: 197203 - DNA, 601 bp, Human; identical to SEQ ID NO: 35844

SEQ ID NO: 197204 - DNA, 601 bp, Human; identical to SEQ ID NO: 35845

SEQ ID NO: 197205 - DNA, 601 bp, Human; identical to SEQ ID NO: 35846

SEQ ID NO: 197206 - DNA, 601 bp, Human; identical to SEQ ID NO: 35847

SEQ ID NO: 197207 - DNA, 601 bp, Human; identical to SEQ ID NO: 35848

SEQ ID NO: 197208 - DNA, 601 bp, Human; identical to SEQ ID NO: 35849

SEQ ID NO: 197209 - DNA, 601 bp, Human; identical to SEQ ID NO: 35850

SEQ ID NO: 197210 - DNA, 601 bp, Human; identical to SEQ ID NO: 35851

SEQ ID NO: 197211 - DNA, 601 bp, Human; identical to SEQ ID NO: 35852

SEQ ID NO: 197212 - DNA, 601 bp, Human; identical to SEQ ID NO: 35853

SEQ ID NO: 197213 - DNA, 601 bp, Human; identical to SEQ ID NO: 35854

SEQ ID NO: 197214 - DNA, 601 bp, Human; identical to SEQ ID NO: 35855

SEQ ID NO: 197215 - DNA, 601 bp, Human; identical to SEQ ID NO: 35779

SEQ ID NO: 197216 - DNA, 601 bp, Human; identical to SEQ ID NO: 35780

SEQ ID NO: 197217 - DNA, 601 bp, Human; identical to SEQ ID NO: 35781

SEQ ID NO: 197218 - DNA, 601 bp, Human; identical to SEQ ID NO: 35782

SEQ ID NO: 197219 - DNA, 601 bp, Human; identical to SEQ ID NO: 35783

SEQ ID NO: 197220 - DNA, 601 bp, Human; identical to SEQ ID NO: 35784

SEQ ID NO: 197221 - DNA, 601 bp, Human; identical to SEQ ID NO: 35785

SEQ ID NO: 197222 - DNA, 601 bp, Human; identical to SEQ ID NO: 35786

SEQ ID NO: 197223 - DNA, 601 bp, Human; identical to SEQ ID NO: 35787

SEQ ID NO: 197224 - DNA, 601 bp, Human; identical to SEQ ID NO: 35788

SEQ ID NO: 197225 - DNA, 601 bp, Human; identical to SEQ ID NO: 35789

SEQ ID NO: 197226 - DNA, 601 bp, Human; identical to SEQ ID NO: 35790

SEQ ID NO: 197227 - DNA, 601 bp, Human; identical to SEQ ID NO: 35791

SEQ ID NO: 197228 - DNA, 601 bp, Human; identical to SEQ ID NO: 35792

SEQ ID NO: 197229 - DNA, 601 bp, Human; identical to SEQ ID NO: 35793

SEQ ID NO: 197230 - DNA, 601 bp, Human; identical to SEQ ID NO: 35794

SEQ ID NO: 197231 - DNA, 601 bp, Human; identical to SEQ ID NO: 35795

SEQ ID NO: 197232 - DNA, 601 bp, Human; identical to SEQ ID NO: 35796

SEQ ID NO: 197233 - DNA, 601 bp, Human; identical to SEQ ID NO: 35797

SEQ ID NO: 197234 - DNA, 601 bp, Human; identical to SEQ ID NO: 35798

SEQ ID NO: 197235 - DNA, 601 bp, Human; identical to SEQ ID NO: 35799

SEQ ID NO: 197236 - DNA, 601 bp, Human; identical to SEQ ID NO: 35800

SEQ ID NO: 197237 - DNA, 601 bp, Human; identical to SEQ ID NO: 35801

SEQ ID NO: 197238 - DNA, 601 bp, Human; identical to SEQ ID NO: 35802

SEQ ID NO: 197239 - DNA, 601 bp, Human; identical to SEQ ID NO: 35803

SEQ ID NO: 197240 - DNA, 601 bp, Human; identical to SEQ ID NO: 35804

SEQ ID NO: 197241 - DNA, 601 bp, Human; identical to SEQ ID NO: 35805

SEQ ID NO: 197242 - DNA, 601 bp, Human; identical to SEQ ID NO: 35806

SEQ ID NO: 197243 - DNA, 601 bp, Human; identical to SEQ ID NO: 35807

SEQ ID NO: 197244 - DNA, 601 bp, Human; identical to SEQ ID NO: 35808

SEQ ID NO: 197245 - DNA, 601 bp, Human; identical to SEQ ID NO: 35809

SEQ ID NO: 197246 - DNA, 601 bp, Human; identical to SEQ ID NO: 35810

SEQ ID NO: 197247 - DNA, 601 bp, Human; identical to SEQ ID NO: 35811

SEQ ID NO: 197248 - DNA, 601 bp, Human; identical to SEQ ID NO: 35812

SEQ ID NO: 197249 - DNA, 601 bp, Human; identical to SEQ ID NO: 35813

SEQ ID NO: 197250 - DNA, 601 bp, Human; identical to SEQ ID NO: 35814

SEQ ID NO: 197251 - DNA, 601 bp, Human; identical to SEQ ID NO: 35815

SEQ ID NO: 197252 - DNA, 601 bp, Human; identical to SEQ ID NO: 35816

SEQ ID NO: 197253 - DNA, 601 bp, Human; identical to SEQ ID NO: 35817

SEQ ID NO: 197254 - DNA, 601 bp, Human; identical to SEQ ID NO: 35818

SEQ ID NO: 197255 - DNA, 601 bp, Human; identical to SEQ ID NO: 35819

SEQ ID NO: 197256 - DNA, 601 bp, Human; identical to SEQ ID NO: 35820

SEQ ID NO: 197257 - DNA, 601 bp, Human; identical to SEQ ID NO: 35821

SEQ ID NO: 197258 - DNA, 601 bp, Human; identical to SEQ ID NO: 35822

SEQ ID NO: 197259 - DNA, 601 bp, Human; identical to SEQ ID NO: 35823

SEQ ID NO: 197260 - DNA, 601 bp, Human; identical to SEQ ID NO: 35824

SEQ ID NO: 197261 - DNA, 601 bp, Human; identical to SEQ ID NO: 35825

SEQ ID NO: 197262 - DNA, 601 bp, Human; identical to SEQ ID NO: 35826

SEQ ID NO: 197263 - DNA, 601 bp, Human; identical to SEQ ID NO: 35827

SEQ ID NO: 197264 - DNA, 601 bp, Human; identical to SEQ ID NO: 35983

SEQ ID NO: 197265 - DNA, 601 bp, Human; identical to SEQ ID NO: 35984

SEQ ID NO: 197266 - DNA, 601 bp, Human; identical to SEQ ID NO: 35985

SEQ ID NO: 197267 - DNA, 601 bp, Human; identical to SEQ ID NO: 35986

SEQ ID NO: 197268 - DNA, 601 bp, Human; identical to SEQ ID NO: 35987

SEQ ID NO: 197269 - DNA, 601 bp, Human; identical to SEQ ID NO: 35988

SEQ ID NO: 197270 - DNA, 601 bp, Human; identical to SEQ ID NO: 35989

SEQ ID NO: 197271 - DNA, 601 bp, Human; identical to SEQ ID NO: 35990

SEQ ID NO: 197272 - DNA, 601 bp, Human; identical to SEQ ID NO: 35991

SEQ ID NO: 197273 - DNA, 601 bp, Human; identical to SEQ ID NO: 36079

SEQ ID NO: 197274 - DNA, 601 bp, Human; identical to SEQ ID NO: 36080

SEQ ID NO: 197275 - DNA, 601 bp, Human; identical to SEQ ID NO: 36081

SEQ ID NO: 197276 - DNA, 601 bp, Human; identical to SEQ ID NO: 36082

SEQ ID NO: 197277 - DNA, 601 bp, Human; identical to SEQ ID NO: 36083

SEQ ID NO: 197278 - DNA, 601 bp, Human; identical to SEQ ID NO: 36084

SEQ ID NO: 197279 - DNA, 601 bp, Human; identical to SEQ ID NO: 36085

SEQ ID NO: 197280 - DNA, 601 bp, Human; identical to SEQ ID NO: 36086

SEQ ID NO: 197281 - DNA, 601 bp, Human; identical to SEQ ID NO: 36087

SEQ ID NO: 197282 - DNA, 601 bp, Human; identical to SEQ ID NO: 36088

SEQ ID NO: 197283 - DNA, 601 bp, Human; identical to SEQ ID NO: 36089

SEQ ID NO: 197284 - DNA, 601 bp, Human; identical to SEQ ID NO: 36090

SEQ ID NO: 197285 - DNA, 601 bp, Human; identical to SEQ ID NO: 36091

SEQ ID NO: 197286 - DNA, 601 bp, Human; identical to SEQ ID NO: 36092

SEQ ID NO: 197287 - DNA, 601 bp, Human; identical to SEQ ID NO: 36093

SEQ ID NO: 197288 - DNA, 601 bp, Human; identical to SEQ ID NO: 36094

SEQ ID NO: 197289 - DNA, 601 bp, Human; identical to SEQ ID NO: 36095

SEQ ID NO: 197290 - DNA, 601 bp, Human; identical to SEQ ID NO: 36096

SEQ ID NO: 197291 - DNA, 601 bp, Human; identical to SEQ ID NO: 36097

SEQ ID NO: 197292 - DNA, 601 bp, Human; identical to SEQ ID NO: 36098

SEQ ID NO: 197293 - DNA, 601 bp, Human; identical to SEQ ID NO: 36099

SEQ ID NO: 197294 - DNA, 601 bp, Human; identical to SEQ ID NO: 36100

SEQ ID NO: 197295 - DNA, 601 bp, Human; identical to SEQ ID NO: 36101

SEQ ID NO: 197296 - DNA, 601 bp, Human; identical to SEQ ID NO: 36102

SEQ ID NO: 197297 - DNA, 601 bp, Human; identical to SEQ ID NO: 36103

SEQ ID NO: 197298 - DNA, 601 bp, Human; identical to SEQ ID NO: 36104

SEQ ID NO: 197299 - DNA, 601 bp, Human; identical to SEQ ID NO: 36105

SEQ ID NO: 197300 - DNA, 601 bp, Human; identical to SEQ ID NO: 36106

SEQ ID NO: 197301 - DNA, 601 bp, Human; identical to SEQ ID NO: 36107

SEQ ID NO: 197302 - DNA, 601 bp, Human; identical to SEQ ID NO: 36108

SEQ ID NO: 197303 - DNA, 601 bp, Human; identical to SEQ ID NO: 36109

SEQ ID NO: 197304 - DNA, 601 bp, Human; identical to SEQ ID NO: 36110

SEQ ID NO: 197305 - DNA, 601 bp, Human; identical to SEQ ID NO: 35828

SEQ ID NO: 197306 - DNA, 601 bp, Human; identical to SEQ ID NO: 35829

SEQ ID NO: 197307 - DNA, 601 bp, Human; identical to SEQ ID NO: 35830

SEQ ID NO: 197308 - DNA, 601 bp, Human; identical to SEQ ID NO: 35831

SEQ ID NO: 197309 - DNA, 601 bp, Human; identical to SEQ ID NO: 35832

SEQ ID NO: 197310 - DNA, 601 bp, Human; identical to SEQ ID NO: 35833

SEQ ID NO: 197311 - DNA, 601 bp, Human; identical to SEQ ID NO: 35834

SEQ ID NO: 197312 - DNA, 601 bp, Human; identical to SEQ ID NO: 35835

SEQ ID NO: 197313 - DNA, 601 bp, Human; identical to SEQ ID NO: 35836

SEQ ID NO: 197314 - DNA, 601 bp, Human; identical to SEQ ID NO: 35837

SEQ ID NO: 197315 - DNA, 601 bp, Human; identical to SEQ ID NO: 35838

SEQ ID NO: 197316 - DNA, 601 bp, Human; identical to SEQ ID NO: 35839

SEQ ID NO: 197317 - DNA, 601 bp, Human; identical to SEQ ID NO: 35840

SEQ ID NO: 197318 - DNA, 601 bp, Human; identical to SEQ ID NO: 35841

SEQ ID NO: 197319 - DNA, 601 bp, Human; identical to SEQ ID NO: 35842

SEQ ID NO: 197320 - DNA, 601 bp, Human; identical to SEQ ID NO: 35843

SEQ ID NO: 197321 - DNA, 601 bp, Human; identical to SEQ ID NO: 35844

SEQ ID NO: 197322 - DNA, 601 bp, Human; identical to SEQ ID NO: 35845

SEQ ID NO: 197323 - DNA, 601 bp, Human; identical to SEQ ID NO: 35846

SEQ ID NO: 197324 - DNA, 601 bp, Human; identical to SEQ ID NO: 35847

SEQ ID NO: 197325 - DNA, 601 bp, Human; identical to SEQ ID NO: 35848

SEQ ID NO: 197326 - DNA, 601 bp, Human; identical to SEQ ID NO: 35849

SEQ ID NO: 197327 - DNA, 601 bp, Human; identical to SEQ ID NO: 35850

SEQ ID NO: 197328 - DNA, 601 bp, Human; identical to SEQ ID NO: 35851

SEQ ID NO: 197329 - DNA, 601 bp, Human; identical to SEQ ID NO: 35852

SEQ ID NO: 197330 - DNA, 601 bp, Human; identical to SEQ ID NO: 35853

SEQ ID NO: 197331 - DNA, 601 bp, Human; identical to SEQ ID NO: 35854

SEQ ID NO: 197332 - DNA, 601 bp, Human; identical to SEQ ID NO: 35855

SEQ ID NO: 197333 - DNA, 601 bp, Human; identical to SEQ ID NO: 35779

SEQ ID NO: 197334 - DNA, 601 bp, Human; identical to SEQ ID NO: 35780

SEQ ID NO: 197335 - DNA, 601 bp, Human; identical to SEQ ID NO: 35781

SEQ ID NO: 197336 - DNA, 601 bp, Human; identical to SEQ ID NO: 35782

SEQ ID NO: 197337 - DNA, 601 bp, Human; identical to SEQ ID NO: 35783

SEQ ID NO: 197338 - DNA, 601 bp, Human; identical to SEQ ID NO: 35784

SEQ ID NO: 197339 - DNA, 601 bp, Human; identical to SEQ ID NO: 35785

SEQ ID NO: 197340 - DNA, 601 bp, Human; identical to SEQ ID NO: 35786

SEQ ID NO: 197341 - DNA, 601 bp, Human; identical to SEQ ID NO: 35787

SEQ ID NO: 197342 - DNA, 601 bp, Human; identical to SEQ ID NO: 35788

SEQ ID NO: 197343 - DNA, 601 bp, Human; identical to SEQ ID NO: 35789

SEQ ID NO: 197344 - DNA, 601 bp, Human; identical to SEQ ID NO: 35790

SEQ ID NO: 197345 - DNA, 601 bp, Human; identical to SEQ ID NO: 35791

SEQ ID NO: 197346 - DNA, 601 bp, Human; identical to SEQ ID NO: 35792

SEQ ID NO: 197347 - DNA, 601 bp, Human; identical to SEQ ID NO: 35793

SEQ ID NO: 197348 - DNA, 601 bp, Human; identical to SEQ ID NO: 35794

SEQ ID NO: 197349 - DNA, 601 bp, Human; identical to SEQ ID NO: 35795

SEQ ID NO: 197350 - DNA, 601 bp, Human; identical to SEQ ID NO: 35796

SEQ ID NO: 197351 - DNA, 601 bp, Human; identical to SEQ ID NO: 35797

SEQ ID NO: 197352 - DNA, 601 bp, Human; identical to SEQ ID NO: 35798

SEQ ID NO: 197353 - DNA, 601 bp, Human; identical to SEQ ID NO: 35799

SEQ ID NO: 197354 - DNA, 601 bp, Human; identical to SEQ ID NO: 35800

SEQ ID NO: 197355 - DNA, 601 bp, Human; identical to SEQ ID NO: 35801

SEQ ID NO: 197356 - DNA, 601 bp, Human; identical to SEQ ID NO: 35802

SEQ ID NO: 197357 - DNA, 601 bp, Human; identical to SEQ ID NO: 35803

SEQ ID NO: 197358 - DNA, 601 bp, Human; identical to SEQ ID NO: 35804

SEQ ID NO: 197359 - DNA, 601 bp, Human; identical to SEQ ID NO: 35805

SEQ ID NO: 197360 - DNA, 601 bp, Human; identical to SEQ ID NO: 35806

SEQ ID NO: 197361 - DNA, 601 bp, Human; identical to SEQ ID NO: 35807

SEQ ID NO: 197362 - DNA, 601 bp, Human; identical to SEQ ID NO: 35808

SEQ ID NO: 197363 - DNA, 601 bp, Human; identical to SEQ ID NO: 35809

SEQ ID NO: 197364 - DNA, 601 bp, Human; identical to SEQ ID NO: 35810

SEQ ID NO: 197365 - DNA, 601 bp, Human; identical to SEQ ID NO: 35811

SEQ ID NO: 197366 - DNA, 601 bp, Human; identical to SEQ ID NO: 35812

SEQ ID NO: 197367 - DNA, 601 bp, Human; identical to SEQ ID NO: 35813

SEQ ID NO: 197368 - DNA, 601 bp, Human; identical to SEQ ID NO: 35814

SEQ ID NO: 197369 - DNA, 601 bp, Human; identical to SEQ ID NO: 35815

SEQ ID NO: 197370 - DNA, 601 bp, Human; identical to SEQ ID NO: 35816

SEQ ID NO: 197371 - DNA, 601 bp, Human; identical to SEQ ID NO: 35817

SEQ ID NO: 197372 - DNA, 601 bp, Human; identical to SEQ ID NO: 35818

SEQ ID NO: 197373 - DNA, 601 bp, Human; identical to SEQ ID NO: 35819

SEQ ID NO: 197374 - DNA, 601 bp, Human; identical to SEQ ID NO: 35820

SEQ ID NO: 197375 - DNA, 601 bp, Human; identical to SEQ ID NO: 35821

SEQ ID NO: 197376 - DNA, 601 bp, Human; identical to SEQ ID NO: 35822

SEQ ID NO: 197377 - DNA, 601 bp, Human; identical to SEQ ID NO: 35823

SEQ ID NO: 197378 - DNA, 601 bp, Human; identical to SEQ ID NO: 35824

SEQ ID NO: 197379 - DNA, 601 bp, Human; identical to SEQ ID NO: 35825

SEQ ID NO: 197380 - DNA, 601 bp, Human; identical to SEQ ID NO: 35826

SEQ ID NO: 197381 - DNA, 601 bp, Human; identical to SEQ ID NO: 35827

SEQ ID NO: 197382 - DNA, 601 bp, Human; identical to SEQ ID NO: 35983

SEQ ID NO: 197383 - DNA, 601 bp, Human; identical to SEQ ID NO: 35984

SEQ ID NO: 197384 - DNA, 601 bp, Human; identical to SEQ ID NO: 35985

SEQ ID NO: 197385 - DNA, 601 bp, Human; identical to SEQ ID NO: 35986

SEQ ID NO: 197386 - DNA, 601 bp, Human; identical to SEQ ID NO: 35987

SEQ ID NO: 197387 - DNA, 601 bp, Human; identical to SEQ ID NO: 35988

SEQ ID NO: 197388 - DNA, 601 bp, Human; identical to SEQ ID NO: 35989

SEQ ID NO: 197389 - DNA, 601 bp, Human; identical to SEQ ID NO: 35990

SEQ ID NO: 197390 - DNA, 601 bp, Human; identical to SEQ ID NO: 35991

SEQ ID NO: 197391 - DNA, 601 bp, Human; identical to SEQ ID NO: 36079

SEQ ID NO: 197392 - DNA, 601 bp, Human; identical to SEQ ID NO: 36080

SEQ ID NO: 197393 - DNA, 601 bp, Human; identical to SEQ ID NO: 36081

SEQ ID NO: 197394 - DNA, 601 bp, Human; identical to SEQ ID NO: 36082

SEQ ID NO: 197395 - DNA, 601 bp, Human; identical to SEQ ID NO: 36083

SEQ ID NO: 197396 - DNA, 601 bp, Human; identical to SEQ ID NO: 36084

SEQ ID NO: 197397 - DNA, 601 bp, Human; identical to SEQ ID NO: 36085

SEQ ID NO: 197398 - DNA, 601 bp, Human; identical to SEQ ID NO: 36086

SEQ ID NO: 197399 - DNA, 601 bp, Human; identical to SEQ ID NO: 36087

SEQ ID NO: 197400 - DNA, 601 bp, Human; identical to SEQ ID NO: 36088

SEQ ID NO: 197401 - DNA, 601 bp, Human; identical to SEQ ID NO: 36089

SEQ ID NO: 197402 - DNA, 601 bp, Human; identical to SEQ ID NO: 36090

SEQ ID NO: 197403 - DNA, 601 bp, Human; identical to SEQ ID NO: 36091

SEQ ID NO: 197404 - DNA, 601 bp, Human; identical to SEQ ID NO: 36092

SEQ ID NO: 197405 - DNA, 601 bp, Human; identical to SEQ ID NO: 36093

SEQ ID NO: 197406 - DNA, 601 bp, Human; identical to SEQ ID NO: 36094

SEQ ID NO: 197407 - DNA, 601 bp, Human; identical to SEQ ID NO: 36095

SEQ ID NO: 197408 - DNA, 601 bp, Human; identical to SEQ ID NO: 36096

SEQ ID NO: 197409 - DNA, 601 bp, Human; identical to SEQ ID NO: 36097

SEQ ID NO: 197410 - DNA, 601 bp, Human; identical to SEQ ID NO: 36098

SEQ ID NO: 197411 - DNA, 601 bp, Human; identical to SEQ ID NO: 36099

SEQ ID NO: 197412 - DNA, 601 bp, Human; identical to SEQ ID NO: 36100

SEQ ID NO: 197413 - DNA, 601 bp, Human; identical to SEQ ID NO: 36101

SEQ ID NO: 197414 - DNA, 601 bp, Human; identical to SEQ ID NO: 36102

SEQ ID NO: 197415 - DNA, 601 bp, Human; identical to SEQ ID NO: 36103

SEQ ID NO: 197416 - DNA, 601 bp, Human; identical to SEQ ID NO: 36104

SEQ ID NO: 197417 - DNA, 601 bp, Human; identical to SEQ ID NO: 36105

SEQ ID NO: 197418 - DNA, 601 bp, Human; identical to SEQ ID NO: 36106

SEQ ID NO: 197419 - DNA, 601 bp, Human; identical to SEQ ID NO: 36107

SEQ ID NO: 197420 - DNA, 601 bp, Human; identical to SEQ ID NO: 36108

SEQ ID NO: 197421 - DNA, 601 bp, Human; identical to SEQ ID NO: 36109

SEQ ID NO: 197422 - DNA, 601 bp, Human; identical to SEQ ID NO: 36110

SEQ ID NO: 197423 - DNA, 601 bp, Human; identical to SEQ ID NO: 35828

SEQ ID NO: 197424 - DNA, 601 bp, Human; identical to SEQ ID NO: 35829

SEQ ID NO: 197425 - DNA, 601 bp, Human; identical to SEQ ID NO: 35830

SEQ ID NO: 197426 - DNA, 601 bp, Human; identical to SEQ ID NO: 35831

SEQ ID NO: 197427 - DNA, 601 bp, Human; identical to SEQ ID NO: 35832

SEQ ID NO: 197428 - DNA, 601 bp, Human; identical to SEQ ID NO: 35833

SEQ ID NO: 197429 - DNA, 601 bp, Human; identical to SEQ ID NO: 35834

SEQ ID NO: 197430 - DNA, 601 bp, Human; identical to SEQ ID NO: 35835

SEQ ID NO: 197431 - DNA, 601 bp, Human; identical to SEQ ID NO: 35836

SEQ ID NO: 197432 - DNA, 601 bp, Human; identical to SEQ ID NO: 35837

SEQ ID NO: 197433 - DNA, 601 bp, Human; identical to SEQ ID NO: 35838

SEQ ID NO: 197434 - DNA, 601 bp, Human; identical to SEQ ID NO: 35839

SEQ ID NO: 197435 - DNA, 601 bp, Human; identical to SEQ ID NO: 35840

SEQ ID NO: 197436 - DNA, 601 bp, Human; identical to SEQ ID NO: 35841

SEQ ID NO: 197437 - DNA, 601 bp, Human; identical to SEQ ID NO: 35842

SEQ ID NO: 197438 - DNA, 601 bp, Human; identical to SEQ ID NO: 35843

SEQ ID NO: 197439 - DNA, 601 bp, Human; identical to SEQ ID NO: 35844

SEQ ID NO: 197440 - DNA, 601 bp, Human; identical to SEQ ID NO: 35845

SEQ ID NO: 197441 - DNA, 601 bp, Human; identical to SEQ ID NO: 35846

SEQ ID NO: 197442 - DNA, 601 bp, Human; identical to SEQ ID NO: 35847

SEQ ID NO: 197443 - DNA, 601 bp, Human; identical to SEQ ID NO: 35848

SEQ ID NO: 197444 - DNA, 601 bp, Human; identical to SEQ ID NO: 35849

SEQ ID NO: 197445 - DNA, 601 bp, Human; identical to SEQ ID NO: 35850

SEQ ID NO: 197446 - DNA, 601 bp, Human; identical to SEQ ID NO: 35851

SEQ ID NO: 197447 - DNA, 601 bp, Human; identical to SEQ ID NO: 35852

SEQ ID NO: 197448 - DNA, 601 bp, Human; identical to SEQ ID NO: 35853

SEQ ID NO: 197449 - DNA, 601 bp, Human; identical to SEQ ID NO: 35854

SEQ ID NO: 197450 - DNA, 601 bp, Human; identical to SEQ ID NO: 35855

SEQ ID NO: 197451 - DNA, 601 bp, Human; identical to SEQ ID NO: 35779

SEQ ID NO: 197452 - DNA, 601 bp, Human; identical to SEQ ID NO: 35780

SEQ ID NO: 197453 - DNA, 601 bp, Human; identical to SEQ ID NO: 35781

SEQ ID NO: 197454 - DNA, 601 bp, Human; identical to SEQ ID NO: 35782

SEQ ID NO: 197455 - DNA, 601 bp, Human; identical to SEQ ID NO: 35783

SEQ ID NO: 197456 - DNA, 601 bp, Human; identical to SEQ ID NO: 35784

SEQ ID NO: 197457 - DNA, 601 bp, Human; identical to SEQ ID NO: 35785

SEQ ID NO: 197458 - DNA, 601 bp, Human; identical to SEQ ID NO: 35786

SEQ ID NO: 197459 - DNA, 601 bp, Human; identical to SEQ ID NO: 35787

SEQ ID NO: 197460 - DNA, 601 bp, Human; identical to SEQ ID NO: 35788

SEQ ID NO: 197461 - DNA, 601 bp, Human; identical to SEQ ID NO: 35789

SEQ ID NO: 197462 - DNA, 601 bp, Human; identical to SEQ ID NO: 35790

SEQ ID NO: 197463 - DNA, 601 bp, Human; identical to SEQ ID NO: 35791

SEQ ID NO: 197464 - DNA, 601 bp, Human; identical to SEQ ID NO: 35792

SEQ ID NO: 197465 - DNA, 601 bp, Human; identical to SEQ ID NO: 35793

SEQ ID NO: 197466 - DNA, 601 bp, Human; identical to SEQ ID NO: 35794

SEQ ID NO: 197467 - DNA, 601 bp, Human; identical to SEQ ID NO: 35795

SEQ ID NO: 197468 - DNA, 601 bp, Human; identical to SEQ ID NO: 35796

SEQ ID NO: 197469 - DNA, 601 bp, Human; identical to SEQ ID NO: 35797

SEQ ID NO: 197470 - DNA, 601 bp, Human; identical to SEQ ID NO: 35798

SEQ ID NO: 197471 - DNA, 601 bp, Human; identical to SEQ ID NO: 35799

SEQ ID NO: 197472 - DNA, 601 bp, Human; identical to SEQ ID NO: 35800

SEQ ID NO: 197473 - DNA, 601 bp, Human; identical to SEQ ID NO: 35801

SEQ ID NO: 197474 - DNA, 601 bp, Human; identical to SEQ ID NO: 35802

SEQ ID NO: 197475 - DNA, 601 bp, Human; identical to SEQ ID NO: 35803

SEQ ID NO: 197476 - DNA, 601 bp, Human; identical to SEQ ID NO: 35804

SEQ ID NO: 197477 - DNA, 601 bp, Human; identical to SEQ ID NO: 35805

SEQ ID NO: 197478 - DNA, 601 bp, Human; identical to SEQ ID NO: 35806

SEQ ID NO: 197479 - DNA, 601 bp, Human; identical to SEQ ID NO: 35807

SEQ ID NO: 197480 - DNA, 601 bp, Human; identical to SEQ ID NO: 35808

SEQ ID NO: 197481 - DNA, 601 bp, Human; identical to SEQ ID NO: 35809

SEQ ID NO: 197482 - DNA, 601 bp, Human; identical to SEQ ID NO: 35810

SEQ ID NO: 197483 - DNA, 601 bp, Human; identical to SEQ ID NO: 35811

SEQ ID NO: 197484 - DNA, 601 bp, Human; identical to SEQ ID NO: 35812

SEQ ID NO: 197485 - DNA, 601 bp, Human; identical to SEQ ID NO: 35813

SEQ ID NO: 197486 - DNA, 601 bp, Human; identical to SEQ ID NO: 35814

SEQ ID NO: 197487 - DNA, 601 bp, Human; identical to SEQ ID NO: 35815

SEQ ID NO: 197488 - DNA, 601 bp, Human; identical to SEQ ID NO: 35816

SEQ ID NO: 197489 - DNA, 601 bp, Human; identical to SEQ ID NO: 35817

SEQ ID NO: 197490 - DNA, 601 bp, Human; identical to SEQ ID NO: 35818

SEQ ID NO: 197491 - DNA, 601 bp, Human; identical to SEQ ID NO: 35819

SEQ ID NO: 197492 - DNA, 601 bp, Human; identical to SEQ ID NO: 35820

SEQ ID NO: 197493 - DNA, 601 bp, Human; identical to SEQ ID NO: 35821

SEQ ID NO: 197494 - DNA, 601 bp, Human; identical to SEQ ID NO: 35822

SEQ ID NO: 197495 - DNA, 601 bp, Human; identical to SEQ ID NO: 35823

SEQ ID NO: 197496 - DNA, 601 bp, Human; identical to SEQ ID NO: 35824

SEQ ID NO: 197497 - DNA, 601 bp, Human; identical to SEQ ID NO: 35825

SEQ ID NO: 197498 - DNA, 601 bp, Human; identical to SEQ ID NO: 35826

SEQ ID NO: 197499 - DNA, 601 bp, Human; identical to SEQ ID NO: 35827

SEQ ID NO: 197500 - DNA, 601 bp, Human; identical to SEQ ID NO: 35983

SEQ ID NO: 197501 - DNA, 601 bp, Human; identical to SEQ ID NO: 35984

SEQ ID NO: 197502 - DNA, 601 bp, Human; identical to SEQ ID NO: 35985

SEQ ID NO: 197503 - DNA, 601 bp, Human; identical to SEQ ID NO: 35986

SEQ ID NO: 197504 - DNA, 601 bp, Human; identical to SEQ ID NO: 35987

SEQ ID NO: 197505 - DNA, 601 bp, Human; identical to SEQ ID NO: 35988

SEQ ID NO: 197506 - DNA, 601 bp, Human; identical to SEQ ID NO: 35989

SEQ ID NO: 197507 - DNA, 601 bp, Human; identical to SEQ ID NO: 35990

SEQ ID NO: 197508 - DNA, 601 bp, Human; identical to SEQ ID NO: 35991

SEQ ID NO: 197509 - DNA, 601 bp, Human; identical to SEQ ID NO: 36079

SEQ ID NO: 197510 - DNA, 601 bp, Human; identical to SEQ ID NO: 36080

SEQ ID NO: 197511 - DNA, 601 bp, Human; identical to SEQ ID NO: 36081

SEQ ID NO: 197512 - DNA, 601 bp, Human; identical to SEQ ID NO: 36082

SEQ ID NO: 197513 - DNA, 601 bp, Human; identical to SEQ ID NO: 36083

SEQ ID NO: 197514 - DNA, 601 bp, Human; identical to SEQ ID NO: 36084

SEQ ID NO: 197515 - DNA, 601 bp, Human; identical to SEQ ID NO: 36085

SEQ ID NO: 197516 - DNA, 601 bp, Human; identical to SEQ ID NO: 36086

SEQ ID NO: 197517 - DNA, 601 bp, Human; identical to SEQ ID NO: 36087

SEQ ID NO: 197518 - DNA, 601 bp, Human; identical to SEQ ID NO: 36088

SEQ ID NO: 197519 - DNA, 601 bp, Human; identical to SEQ ID NO: 36089

SEQ ID NO: 197520 - DNA, 601 bp, Human; identical to SEQ ID NO: 36090

SEQ ID NO: 197521 - DNA, 601 bp, Human; identical to SEQ ID NO: 36091

SEQ ID NO: 197522 - DNA, 601 bp, Human; identical to SEQ ID NO: 36092

SEQ ID NO: 197523 - DNA, 601 bp, Human; identical to SEQ ID NO: 36093

SEQ ID NO: 197524 - DNA, 601 bp, Human; identical to SEQ ID NO: 36094

SEQ ID NO: 197525 - DNA, 601 bp, Human; identical to SEQ ID NO: 36095

SEQ ID NO: 197526 - DNA, 601 bp, Human; identical to SEQ ID NO: 36096

SEQ ID NO: 197527 - DNA, 601 bp, Human; identical to SEQ ID NO: 36097

SEQ ID NO: 197528 - DNA, 601 bp, Human; identical to SEQ ID NO: 36098

SEQ ID NO: 197529 - DNA, 601 bp, Human; identical to SEQ ID NO: 36099

SEQ ID NO: 197530 - DNA, 601 bp, Human; identical to SEQ ID NO: 36100

SEQ ID NO: 197531 - DNA, 601 bp, Human; identical to SEQ ID NO: 36101

SEQ ID NO: 197532 - DNA, 601 bp, Human; identical to SEQ ID NO: 36102

SEQ ID NO: 197533 - DNA, 601 bp, Human; identical to SEQ ID NO: 36103

SEQ ID NO: 197534 - DNA, 601 bp, Human; identical to SEQ ID NO: 36104

SEQ ID NO: 197535 - DNA, 601 bp, Human; identical to SEQ ID NO: 36105

SEQ ID NO: 197536 - DNA, 601 bp, Human; identical to SEQ ID NO: 36106

SEQ ID NO: 197537 - DNA, 601 bp, Human; identical to SEQ ID NO: 36107

SEQ ID NO: 197538 - DNA, 601 bp, Human; identical to SEQ ID NO: 36108

SEQ ID NO: 197539 - DNA, 601 bp, Human; identical to SEQ ID NO: 36109

SEQ ID NO: 197540 - DNA, 601 bp, Human; identical to SEQ ID NO: 36110

SEQ ID NO: 197541 - DNA, 601 bp, Human; identical to SEQ ID NO: 35828

SEQ ID NO: 197542 - DNA, 601 bp, Human; identical to SEQ ID NO: 35829

SEQ ID NO: 197543 - DNA, 601 bp, Human; identical to SEQ ID NO: 35830

SEQ ID NO: 197544 - DNA, 601 bp, Human; identical to SEQ ID NO: 35831

SEQ ID NO: 197545 - DNA, 601 bp, Human; identical to SEQ ID NO: 35832

SEQ ID NO: 197546 - DNA, 601 bp, Human; identical to SEQ ID NO: 35833

SEQ ID NO: 197547 - DNA, 601 bp, Human; identical to SEQ ID NO: 35834

SEQ ID NO: 197548 - DNA, 601 bp, Human; identical to SEQ ID NO: 35835

SEQ ID NO: 197549 - DNA, 601 bp, Human; identical to SEQ ID NO: 35836

SEQ ID NO: 197550 - DNA, 601 bp, Human; identical to SEQ ID NO: 35837

SEQ ID NO: 197551 - DNA, 601 bp, Human; identical to SEQ ID NO: 35838

SEQ ID NO: 197552 - DNA, 601 bp, Human; identical to SEQ ID NO: 35839

SEQ ID NO: 197553 - DNA, 601 bp, Human; identical to SEQ ID NO: 35840

SEQ ID NO: 197554 - DNA, 601 bp, Human; identical to SEQ ID NO: 35841

SEQ ID NO: 197555 - DNA, 601 bp, Human; identical to SEQ ID NO: 35842

SEQ ID NO: 197556 - DNA, 601 bp, Human; identical to SEQ ID NO: 35843

SEQ ID NO: 197557 - DNA, 601 bp, Human; identical to SEQ ID NO: 35844

SEQ ID NO: 197558 - DNA, 601 bp, Human; identical to SEQ ID NO: 35845

SEQ ID NO: 197559 - DNA, 601 bp, Human; identical to SEQ ID NO: 35846

SEQ ID NO: 197560 - DNA, 601 bp, Human; identical to SEQ ID NO: 35847

SEQ ID NO: 197561 - DNA, 601 bp, Human; identical to SEQ ID NO: 35848

SEQ ID NO: 197562 - DNA, 601 bp, Human; identical to SEQ ID NO: 35849

SEQ ID NO: 197563 - DNA, 601 bp, Human; identical to SEQ ID NO: 35850

SEQ ID NO: 197564 - DNA, 601 bp, Human; identical to SEQ ID NO: 35851

SEQ ID NO: 197565 - DNA, 601 bp, Human; identical to SEQ ID NO: 35852

SEQ ID NO: 197566 - DNA, 601 bp, Human; identical to SEQ ID NO: 35853

SEQ ID NO: 197567 - DNA, 601 bp, Human; identical to SEQ ID NO: 35854

SEQ ID NO: 197568 - DNA, 601 bp, Human; identical to SEQ ID NO: 35855

SEQ ID NO: 197569 - DNA, 601 bp, Human; identical to SEQ ID NO: 83424

SEQ ID NO: 197570 - DNA, 601 bp, Human; identical to SEQ ID NO: 83425

SEQ ID NO: 197571 - DNA, 601 bp, Human; identical to SEQ ID NO: 83426

SEQ ID NO: 197572 - DNA, 601 bp, Human; identical to SEQ ID NO: 83427

SEQ ID NO: 197573 - DNA, 601 bp, Human; identical to SEQ ID NO: 83428

SEQ ID NO: 197574 - DNA, 601 bp, Human; identical to SEQ ID NO: 83429

SEQ ID NO: 197575 - DNA, 601 bp, Human; identical to SEQ ID NO: 83430

SEQ ID NO: 197576 - DNA, 601 bp, Human; identical to SEQ ID NO: 83431

SEQ ID NO: 197577 - DNA, 601 bp, Human; identical to SEQ ID NO: 83432

SEQ ID NO: 197578 - DNA, 601 bp, Human; identical to SEQ ID NO: 83433

SEQ ID NO: 197579 - DNA, 601 bp, Human; identical to SEQ ID NO: 83434

SEQ ID NO: 197580 - DNA, 601 bp, Human; identical to SEQ ID NO: 83435

SEQ ID NO: 197581 - DNA, 601 bp, Human; identical to SEQ ID NO: 83436

SEQ ID NO: 197582 - DNA, 601 bp, Human; identical to SEQ ID NO: 83437

SEQ ID NO: 197583 - DNA, 601 bp, Human; identical to SEQ ID NO: 83438

SEQ ID NO: 197584 - DNA, 601 bp, Human; identical to SEQ ID NO: 83439

SEQ ID NO: 197585 - DNA, 601 bp, Human; identical to SEQ ID NO: 83440

SEQ ID NO: 197586 - DNA, 601 bp, Human; identical to SEQ ID NO: 83441

SEQ ID NO: 197587 - DNA, 601 bp, Human; identical to SEQ ID NO: 83442

SEQ ID NO: 197588 - DNA, 601 bp, Human; identical to SEQ ID NO: 83443

SEQ ID NO: 197589 - DNA, 601 bp, Human; identical to SEQ ID NO: 83444

SEQ ID NO: 197590 - DNA, 601 bp, Human; identical to SEQ ID NO: 83445

SEQ ID NO: 197591 - DNA, 601 bp, Human; identical to SEQ ID NO: 83446

SEQ ID NO: 197592 - DNA, 601 bp, Human; identical to SEQ ID NO: 83447

SEQ ID NO: 197593 - DNA, 601 bp, Human; identical to SEQ ID NO: 83448

SEQ ID NO: 197594 - DNA, 601 bp, Human; identical to SEQ ID NO: 83449

SEQ ID NO: 197595 - DNA, 601 bp, Human; identical to SEQ ID NO: 83450

SEQ ID NO: 197596 - DNA, 601 bp, Human; identical to SEQ ID NO: 83451

SEQ ID NO: 197597 - DNA, 601 bp, Human; identical to SEQ ID NO: 83452

SEQ ID NO: 197598 - DNA, 601 bp, Human; identical to SEQ ID NO: 83453

SEQ ID NO: 197599 - DNA, 601 bp, Human; identical to SEQ ID NO: 83454

SEQ ID NO: 197600 - DNA, 601 bp, Human; identical to SEQ ID NO: 83455

SEQ ID NO: 197601 - DNA, 601 bp, Human; identical to SEQ ID NO: 83456

SEQ ID NO: 197602 - DNA, 601 bp, Human; identical to SEQ ID NO: 83457

SEQ ID NO: 197603 - DNA, 601 bp, Human; identical to SEQ ID NO: 83458

SEQ ID NO: 197604 - DNA, 601 bp, Human; identical to SEQ ID NO: 83424

SEQ ID NO: 197605 - DNA, 601 bp, Human; identical to SEQ ID NO: 83425

SEQ ID NO: 197606 - DNA, 601 bp, Human; identical to SEQ ID NO: 83426

SEQ ID NO: 197607 - DNA, 601 bp, Human; identical to SEQ ID NO: 83427

SEQ ID NO: 197608 - DNA, 601 bp, Human; identical to SEQ ID NO: 83428

SEQ ID NO: 197609 - DNA, 601 bp, Human; identical to SEQ ID NO: 83429

SEQ ID NO: 197610 - DNA, 601 bp, Human; identical to SEQ ID NO: 83430

SEQ ID NO: 197611 - DNA, 601 bp, Human; identical to SEQ ID NO: 83431

SEQ ID NO: 197612 - DNA, 601 bp, Human; identical to SEQ ID NO: 83432

SEQ ID NO: 197613 - DNA, 601 bp, Human; identical to SEQ ID NO: 83433

SEQ ID NO: 197614 - DNA, 601 bp, Human; identical to SEQ ID NO: 83434

SEQ ID NO: 197615 - DNA, 601 bp, Human; identical to SEQ ID NO: 83435

SEQ ID NO: 197616 - DNA, 601 bp, Human; identical to SEQ ID NO: 83436

SEQ ID NO: 197617 - DNA, 601 bp, Human; identical to SEQ ID NO: 83437

SEQ ID NO: 197618 - DNA, 601 bp, Human; identical to SEQ ID NO: 83438

SEQ ID NO: 197619 - DNA, 601 bp, Human; identical to SEQ ID NO: 83439

SEQ ID NO: 197620 - DNA, 601 bp, Human; identical to SEQ ID NO: 83440

SEQ ID NO: 197621 - DNA, 601 bp, Human; identical to SEQ ID NO: 83441

SEQ ID NO: 197622 - DNA, 601 bp, Human; identical to SEQ ID NO: 83442

SEQ ID NO: 197623 - DNA, 601 bp, Human; identical to SEQ ID NO: 83443

SEQ ID NO: 197624 - DNA, 601 bp, Human; identical to SEQ ID NO: 83444

SEQ ID NO: 197625 - DNA, 601 bp, Human; identical to SEQ ID NO: 83445

SEQ ID NO: 197626 - DNA, 601 bp, Human; identical to SEQ ID NO: 83446

SEQ ID NO: 197627 - DNA, 601 bp, Human; identical to SEQ ID NO: 83447

SEQ ID NO: 197628 - DNA, 601 bp, Human; identical to SEQ ID NO: 83448

SEQ ID NO: 197629 - DNA, 601 bp, Human; identical to SEQ ID NO: 83449

SEQ ID NO: 197630 - DNA, 601 bp, Human; identical to SEQ ID NO: 83450

SEQ ID NO: 197631 - DNA, 601 bp, Human; identical to SEQ ID NO: 83451

SEQ ID NO: 197632 - DNA, 601 bp, Human; identical to SEQ ID NO: 83452

SEQ ID NO: 197633 - DNA, 601 bp, Human; identical to SEQ ID NO: 83453

SEQ ID NO: 197634 - DNA, 601 bp, Human; identical to SEQ ID NO: 83454

SEQ ID NO: 197635 - DNA, 601 bp, Human; identical to SEQ ID NO: 83455

SEQ ID NO: 197636 - DNA, 601 bp, Human; identical to SEQ ID NO: 83456

SEQ ID NO: 197637 - DNA, 601 bp, Human; identical to SEQ ID NO: 83457

SEQ ID NO: 197638 - DNA, 601 bp, Human; identical to SEQ ID NO: 83458

SEQ ID NO: 197639 - DNA, 601 bp, Human; identical to SEQ ID NO: 26644

SEQ ID NO: 197640 - DNA, 601 bp, Human; identical to SEQ ID NO: 26645

SEQ ID NO: 197641 - DNA, 601 bp, Human; identical to SEQ ID NO: 26646

SEQ ID NO: 197642 - DNA, 601 bp, Human; identical to SEQ ID NO: 26647

SEQ ID NO: 197643 - DNA, 601 bp, Human; identical to SEQ ID NO: 26648

SEQ ID NO: 197644 - DNA, 601 bp, Human; identical to SEQ ID NO: 26644

SEQ ID NO: 197645 - DNA, 601 bp, Human; identical to SEQ ID NO: 26645

SEQ ID NO: 197646 - DNA, 601 bp, Human; identical to SEQ ID NO: 26646

SEQ ID NO: 197647 - DNA, 601 bp, Human; identical to SEQ ID NO: 26647

SEQ ID NO: 197648 - DNA, 601 bp, Human; identical to SEQ ID NO: 26648

SEQ ID NO: 197649 - DNA, 601 bp, Human; identical to SEQ ID NO: 26644

SEQ ID NO: 197650 - DNA, 601 bp, Human; identical to SEQ ID NO: 26645

SEQ ID NO: 197651 - DNA, 601 bp, Human; identical to SEQ ID NO: 26646

SEQ ID NO: 197652 - DNA, 601 bp, Human; identical to SEQ ID NO: 26647

SEQ ID NO: 197653 - DNA, 601 bp, Human; identical to SEQ ID NO: 26648

SEQ ID NO: 197654 - DNA, 601 bp, Human; identical to SEQ ID NO: 26644

SEQ ID NO: 197655 - DNA, 601 bp, Human; identical to SEQ ID NO: 26645

SEQ ID NO: 197656 - DNA, 601 bp, Human; identical to SEQ ID NO: 26646

SEQ ID NO: 197657 - DNA, 601 bp, Human; identical to SEQ ID NO: 26647

SEQ ID NO: 197658 - DNA, 601 bp, Human; identical to SEQ ID NO: 26648

SEQ ID NO: 197659 - DNA, 601 bp, Human
tctctttggttattaatccattattgttccctgtacactggtatgagtggatgggggaagtatttagccaagtttttgagacctgtactcggagctaaaatgcattgtcttcctatagtgcgggaccccacaactgtggaggagccgcaggggatactgggtagtacgcagacattatgcactaaatgacaatggctcacatagtgaaaagttattcttttttatttttttttttgagagggagtcttgctctgtcgcctagcctggagtgcagtggcgcgatctcagctcactgatatckccgcctcccgggttcaggtgattctcgtgtctcagcctcctgagtagctgggattacaggcacctgcttccatgcctggctaatttttttttttgtatttttagtagagatgggggggtctcaccatgttggccaggctggtctcaaacttctggccccaagtgatctacccaccttggcctcccaaagtgctgggattacaggcctgagccactgcacccggctgatttcacatttttagataatatgaccacattataaaaatttatgtatttttatataatgtgaccactagatgaa

SEQ ID NO: 197660 - DNA, 601 bp, Human
cacttgcacacactccccgcaagaatgcatgctggtttgtaaagtcattaatttactggtgcatcagtggatggctctgtgtcttctggctttatcttggcccagaaagacaggaattaacgttgagcctagtagtctttggcctttgtgccaaagcagtctgtgggccagccttgtgtagtgatcaagcagtatgtttagatgtcaggcatgacacgggttaaaaagccagctaggggaaaaatgggaagtggcattttgcgatctcatcaaacaatcttgatataaacttagagaacarcctcttggcaaatggagagcagctgtaggtttctgactgaatgtgcaagaagaacgtgaatgaaagagatatactaggtgggagcagtcagggtagacttcctggaggaagtggacagtgttgtgtggattcacactttggagatatcaaagaggaagagtattccaagtgggggtaacaaataacaagggaggcaaaaaagaaaagtatgagggaacaacaggatgttgtcaggaaactaaggctgagctgaaatccaggtgacccagagaagccttgagaaggcttgtggcatcttgt

SEQ ID NO: 197661 - DNA, 601 bp, Human
gaagagaagagagagctcagaaataaatccatgcatatacagtgccttagtccattcagcctgctaaaacaaaataccatagactggtggcttataaaacacagaaatttatttttcacagttctggaggctaggaaattcaagatcaagtagctagcagatttgctatctagtgagggcctgcttcttggttcataaatggccatcttctccatgtgtcctcatggaattagggtgatggagcgctctgggatttcttttataaggcactagtcccattcataagtgctctaccttcatsacctaatcacctcccaaaggtcccatctccaaataccaacacataggggattaggtttcaacatatgaattttaggggaaacaaacatcagtctattgcatatactacctaaagcaatctacaaatttggtgtgatctctattaacatcccaatggattttttttttacagaaaaaaacctctgaagtataaaaaggaccacaaatagctaaatcagttttgaggaagaacaaagctagaagcaccatacttcctgatttctaaatatattatactcccatggtcatagcagcactattt

SEQ ID NO: 197662 - DNA, 601 bp, Human
tgttttggagggcctggccaatttaacaagttaggtgatttgataagttagtttaatacgcataacagcatggctgtcccgaggcatacaggaggcgatgggctgagtcctgactgcagctcccccaaggacctgccacgcatggattatacacaaagtctgttcaagtctgttgagggagtgaagggtcggggggcagcaatcccctgtttggcctgccaggtaaagcctttgtaattgctaatggctgggcctgacagattacacataggattttggcctggagcccaaataattcctmaactccatcctttgatttttcagagcccaagcgagaaacataggctaccccatcatggacctgaatgggttggattttgagggtctctgttaggagccaggttattagtctgcagttacaataaatagaccatggtcaggatcaagatcacttccagcatcgtgtacagattaatatgcctggggtagcttaggtaccagaaaaatccatgtttacagaaatgtttgtttgcagcattcagtggcacaggaacaaaatatttatttgtggggatacatccagcattttgtcaaattcact

SEQ ID NO: 197663 - DNA, 601 bp, Human
cagggtatttaggtgtccttagaggggagaagcagggaaaagtgaatctatgccatcgtgtctcggaactggaagtccacccccatccccacacacactagaattgcagaagaaaaataagatgagaacttgagtgaaaaaaacatattattatgcaatcatcaaatgtttggacagaaagtgttcttagacaacctctagtctaatttctcacatttggaaatctggaagttggactaagacctgaatcgaccaccctcacccccagttcagctgactgactccccagcctgtattctcrccattccacaccaggatctgtcctgaggctttgaaaaaatgtgaactgcatgtcctgctcagatcccaaccctcccacaccactttgctaagagtctgttctgtctgcaaaaatcccaaaagttgtgtcaactggaacgcaaaatgttcttcatttgactttcattgttttttggaattttggggggccagggaggagcaagaaaggagctgcaattgcccttgggtaagatttgcttagaattttaggaagaagttgtctgggcacagtggcttactcctgtaatcccagcactttggg

SEQ ID NO: 197664 - DNA, 601 bp, Human
ctgggattacaggcgtgagccactgcgcccggccaacttttgtatttttagtagagatgggggtctcactatgtttgtcaggctggtcttggactcctggcctcaagtgatccacctgcctcagcctcccaaattggtaggattacaggtgtgagtcactgtgcctggacagcaccacctattagtgaatgacagccttgacttttgaggctaaaactttccacttctttagtatagtaattaaatctctcgctttttctactatttcggtaattaagcaggtaaagaaaaatatccagamcaatataatagggagtagggcaagaaaatcctgaggaaccacgacctgtgggtggatcgagtgcaggggtccttgagtgtagctggttgcaggaaggccccagcagaagggggctttgatgagcatccaccttgtgtaccgagtgaatgtccgtccagatgaggtgcggatgcagctgacaatggaggcgactgtaatggactatcccaagtagcaacatcatcaatttaggttttcagcctgagtgagactttcagttaatactcaactgaaaacaagatgcaaattttccttcagaaa

SEQ ID NO: 197665 - DNA, 601 bp, Human
aattttccttcagaaatttgttgaaagtgttttcactttggtactattgatctattaaagggctgagatgcagaggagacaccattgtgtaatttctagtggccgctctttttgtccgttatctgttcactgttctatccatgctgttctgccacacccctttttcacttaccaacacatgttggagattgctctctatcatagcatttcctctcctattctctagcctgcctcttcactctcttaatggtatcatttttctgaaaagaagctcttaattctaaaatggtcctgttggtgkttttttccccttatggtcagcactttttgtgtcctttttgagtttttgtctactccaatatcataaagacattctcttaggatttctcataaagttttactgcttccttcttttttgagagagtcttactctgttgcccaggctggagtgcagtgctgcgatcttggctcactacaacctctgcctcctgggttcaagcaattctcatgactcagcctcctgagtagctgggactacaggtgccccccaccatgcccagccaatttttgtatttttagtagaggtgggggtcttgccatg

SEQ ID NO: 197666 - DNA, 601 bp, Human
ttaatcagattggcttcgggaggctaaggcgagaggatcgcttgagcgcgggaggcggaggttgcagtgagttgagatcacaccactgcactctagcctaggtgacagagagagaccctgtctcagaaagaaaaaaaaagaaagagcagaaagtagagagttcccatataccctctgcctcctacacttctcccctccccacactttcccgttattaacatcttgcattagtgtggtacatttgttacaagtgatgaaccaatattgatattgtaggggagggcaaatctgttttccttcyacccttctaagttcatggctgagaaccctataacagaagacagattaataagagaaaagtgcataaacatatttaagttttatgtgacatggaagcctttataaggaaatgaagactccaagaagcagttacagtttgatgtaggtttgataaagggtggacagttgtggaggatatgatagagcaaagagtttgaagtaagtgtagtccgctggcagaagcttatcaaggcccgtttgtttagttagattcctctctgtgtccctttgtcttcacagataccaccaggtatagggaggg

SEQ ID NO: 197667 - DNA, 601 bp, Human
aaagagcagaaagtagagagttcccatataccctctgcctcctacacttctcccctccccacactttcccgttattaacatcttgcattagtgtggtacatttgttacaagtgatgaaccaatattgatattgtaggggagggcaaatctgttttccttctacccttctaagttcatggctgagaaccctataacagaagacagattaataagagaaaagtgcataaacatatttaagttttatgtgacatggaagcctttataaggaaatgaagactccaagaagcagttacagtttgaygtaggtttgataaagggtggacagttgtggaggatatgatagagcaaagagtttgaagtaagtgtagtccgctggcagaagcttatcaaggcccgtttgtttagttagattcctctctgtgtccctttgtcttcacagataccaccaggtatagggagggcatctctcacctgagggtcttatgacctggcttcaggagaaggtcagaaaacccttcctgcacatgctgcttttgcaaattccttcaccttaaaatattcaatatgtcattgtgttagtctgttcttgcattgctctaaa

SEQ ID NO: 197668 - DNA, 601 bp, Human
tcaataaattattctgaactaaagttccatagtttccattagggttcacttttggtgtacatcctaccggttttgccaaatgaataatgccatgtagaaccgttacaatattgtacagaataatttcactcccctaaaaatcccctgtgctgaacctattcacacttcctcccctgagtccctggcaaccactgtctctatagttttaatcagaatgtcacatagttggaatcatacagtatgtagcctctccagattgccttctttcacatagtaacattcaattaaggctcttccatgyctttgcgtggtttgatagctcatttctttttattgctgaataataatctatggtatggatgtgccacagtttatccattcatttattgagggacatcttggttgcttccaacttttggcagttatgaattatgaataaagctggtataaacattcatgtgcaggtttttgcatggacataaatgttcaatttgggtaaatatctagaaacgtgattgctggatcttgcggtaagcatatgctttggccaggcgcggtggctcatgactgtgatcccagcactttgggaggctgaggtggg

SEQ ID NO: 197669 - DNA, 601 bp, Human
aaattattctgaactaaagttccatagtttccattagggttcacttttggtgtacatcctaccggttttgccaaatgaataatgccatgtagaaccgttacaatattgtacagaataatttcactcccctaaaaatcccctgtgctgaacctattcacacttcctcccctgagtccctggcaaccactgtctctatagttttaatcagaatgtcacatagttggaatcatacagtatgtagcctctccagattgccttctttcacatagtaacattcaattaaggctcttccatgcctttkcgtggtttgatagctcatttctttttattgctgaataataatctatggtatggatgtgccacagtttatccattcatttattgagggacatcttggttgcttccaacttttggcagttatgaattatgaataaagctggtataaacattcatgtgcaggtttttgcatggacataaatgttcaatttgggtaaatatctagaaacgtgattgctggatcttgcggtaagcatatgctttggccaggcgcggtggctcatgactgtgatcccagcactttgggaggctgaggtgggatcac

SEQ ID NO: 197670 - DNA, 601 bp, Human
gcggtaagcatatgctttggccaggcgcggtggctcatgactgtgatcccagcactttgggaggctgaggtgggatcacctgagatcagcagtttaagaccagtctggctaacacagtgaaacctcatctctactaaaaaaaatacaaaaattagctgggcgtggtggcgtgtgcctgtaatcccagttactcaggaagctgaggcaggagaatcgcttgaacctgggaggtggaggttgcattgagccaagatggcgccactgcactccagcctgggcaatagagtgagactctgtgtcaaaaaaaaaaaaaaagaaaaaaaaatggccaggcgcagtggctcacacctgtaatctcagcactttgggaggcggaggcaggtgtattatttgaagtcaggagtttaacaccagcccgaccaacatggtgaaaccctgtctctactaaaaatacaaaaattagctgggcgtggtggtcatgccggtaatcccagcaacttgggaggctgaggcaggagaatcgcttgaacccagaggcagaggctgtagtgagccaagatcacacttgccgttgcactccagcctgggagacagagtgaga

SEQ ID NO: 197671 - DNA, 601 bp, Human
gagtatgcagattgaggtcagtaactgtaaatgccccatgactgtctgatcattttaataccaaaagaaaaacttaaaatcccagttgctaaaatctttgtcttagacaactctttgagcctctccctacaaggcccagaaaggaatgagatagatgtgaatggaatctgttttcccttcccttgccacgctctggaggaggagtctagggcagtagccaaggccagctgccagtcaaggaaaggggagcggccccgttgaatccacaaaccacaccatcctggcccatgggttatatacmaactcccacattggcaacaaacaaagggcatgcacattcaggggattttgctttcactgtgagtgtttatctttgaagggtgtcacatcaagatgaatgggaagggtgtgttgcagttgagctgaggtttggtctttcttggcttttttagggacacttacaggtccaaatctgctttcagccggctggtggacatggtaggagacacagtagtctcaggaccaggcctccaggtgggagctgagattctagagggtggaaaccacttggagattgagtcaaagcagacctgtcctcatt

SEQ ID NO: 197672 - DNA, 601 bp, Human
tagtctcaggaccaggcctccaggtgggagctgagattctagagggtggaaaccacttggagattgagtcaaagcagacctgtcctcattctgtgctgggcaggagccagctctccatgtccctgcagctccagcaacacctccggatctttcagcttccctgggactaaggaccatgcacattattaattctgatataaacagtcacacaggcacatgtctcaagatgagggtgagaagttggttacagcaaatgaagtaataatgatctttgtgcttcacaataggaattcaaccaacytgaggcttataattcacttattaacactttttatttttgttgagacggagtgtccctctgtcactcacgctggagtgcaatggtgtcatctcggctcactgcaacctccgcctcctgggctcaagtgagtctcgtgccttgagtggctgagactacaggcacatgccaccatgcccaactaatttttttgtatttttagtagagatggggttttgccatgttggctaggctggtctcaaactcctggcttcaagtgatccgcctacctcaatctcttcaagcgctgggattacaggggta

SEQ ID NO: 197673 - DNA, 601 bp, Human
caggaccaggcctccaggtgggagctgagattctagagggtggaaaccacttggagattgagtcaaagcagacctgtcctcattctgtgctgggcaggagccagctctccatgtccctgcagctccagcaacacctccggatctttcagcttccctgggactaaggaccatgcacattattaattctgatataaacagtcacacaggcacatgtctcaagatgagggtgagaagttggttacagcaaatgaagtaataatgatctttgtgcttcacaataggaattcaaccaacctgaggyttataattcacttattaacactttttatttttgttgagacggagtgtccctctgtcactcacgctggagtgcaatggtgtcatctcggctcactgcaacctccgcctcctgggctcaagtgagtctcgtgccttgagtggctgagactacaggcacatgccaccatgcccaactaatttttttgtatttttagtagagatggggttttgccatgttggctaggctggtctcaaactcctggcttcaagtgatccgcctacctcaatctcttcaagcgctgggattacaggggtaagccac

SEQ ID NO: 197674 - DNA, 601 bp, Human
attctagagggtggaaaccacttggagattgagtcaaagcagacctgtcctcattctgtgctgggcaggagccagctctccatgtccctgcagctccagcaacacctccggatctttcagcttccctgggactaaggaccatgcacattattaattctgatataaacagtcacacaggcacatgtctcaagatgagggtgagaagttggttacagcaaatgaagtaataatgatctttgtgcttcacaataggaattcaaccaacctgaggcttataattcacttattaacactttttatktttgttgagacggagtgtccctctgtcactcacgctggagtgcaatggtgtcatctcggctcactgcaacctccgcctcctgggctcaagtgagtctcgtgccttgagtggctgagactacaggcacatgccaccatgcccaactaatttttttgtatttttagtagagatggggttttgccatgttggctaggctggtctcaaactcctggcttcaagtgatccgcctacctcaatctcttcaagcgctgggattacaggggtaagccactgtgcctggccataattcatttatcagtc

SEQ ID NO: 197675 - DNA, 601 bp, Human
ttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagwgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccag

SEQ ID NO: 197676 - DNA, 601 bp, Human
cattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctaytaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaata

SEQ ID NO: 197677 - DNA, 601 bp, Human
agtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagaccyggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgt

SEQ ID NO: 197678 - DNA, 601 bp, Human
aaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcatacctycctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaa

SEQ ID NO: 197679 - DNA, 601 bp, Human
taaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagraaaaatagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtg

SEQ ID NO: 197680 - DNA, 601 bp, Human
aaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaayagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcc

SEQ ID NO: 197681 - DNA, 601 bp, Human
aagcactgctttggcccttagtggccttgaaagcaaccacctctctacacttgactcactccaactaccgcacagaaacgtgtgaacttacatttgaataaataacaccctgcaaacacatctgttacataaatgtcattgggttggggtaagataacaagcaacttctaggagctaatgtgggcaaacttctgaaaagtgtggcgtgtttcaaatacgtcttaggcaacgtcctatagtgcaggccggtcgctctcagactgtctcctcttcaatattcggaagagactgtgggtgaagstgcagtacagaaccacaacacccctatttaacgtaaaaacggccttttggccctcaatccaaacacgaaaaaacaaatattggaacaggtcgcaagactaccgaaacgtctgcctccaggatctggaagacagtttaactacaatacctctccaaacaaggactgcaagatggacacttgagactcgcgacaaagcaccacgttttccaagtggggcattctggcaggcaccaccgcagaggccagtgcagccagcccacaggacccttgcacaagacggagcctctcccgagtctggcg

SEQ ID NO: 197682 - DNA, 601 bp, Human
ttctggaaaagccagtaaatttttaaacctgaagcactgctttggcccttagtggccttgaaagcaaccacctctctacacttgactcactccaactaccgcacagaaacgtgtgaacttacatttgaataaataacaccctgcaaacacatctgttacataaatgtcattgggttggggtaagataacaagcaacttctaggagctaatgtgggcaaacttctgaaaagtgtggcgtgtttcaaatacgtcttaggcaacgtcctatagtgcaggccggtcgctctcagactgtctcctsttcaatattcggaagagactgtgggtgaagctgcagtacagaaccacaacacccctatttaacgtaaaaacggccttttggccctcaatccaaacacgaaaaaacaaatattggaacaggtcgcaagactaccgaaacgtctgcctccaggatctggaagacagtttaactacaatacctctccaaacaaggactgcaagatggacacttgagactcgcgacaaagcaccacgttttccaagtggggcattctggcaggcaccaccgcagaggccagtgcagccagcccacaggaccctt

SEQ ID NO: 197683 - DNA, 601 bp, Human
tgttacaattctggaaaagccagtaaatttttaaacctgaagcactgctttggcccttagtggccttgaaagcaaccacctctctacacttgactcactccaactaccgcacagaaacgtgtgaacttacatttgaataaataacaccctgcaaacacatctgttacataaatgtcattgggttggggtaagataacaagcaacttctaggagctaatgtgggcaaacttctgaaaagtgtggcgtgtttcaaatacgtcttaggcaacgtcctatagtgcaggccggtcgctctcagacwgtctcctcttcaatattcggaagagactgtgggtgaagctgcagtacagaaccacaacacccctatttaacgtaaaaacggccttttggccctcaatccaaacacgaaaaaacaaatattggaacaggtcgcaagactaccgaaacgtctgcctccaggatctggaagacagtttaactacaatacctctccaaacaaggactgcaagatggacacttgagactcgcgacaaagcaccacgttttccaagtggggcattctggcaggcaccaccgcagaggccagtgcagccagcccaca

SEQ ID NO: 197684 - DNA, 601 bp, Human
cttctggactgttacaattctggaaaagccagtaaatttttaaacctgaagcactgctttggcccttagtggccttgaaagcaaccacctctctacacttgactcactccaactaccgcacagaaacgtgtgaacttacatttgaataaataacaccctgcaaacacatctgttacataaatgtcattgggttggggtaagataacaagcaacttctaggagctaatgtgggcaaacttctgaaaagtgtggcgtgtttcaaatacgtcttaggcaacgtcctatagtgcaggccggtcgytctcagactgtctcctcttcaatattcggaagagactgtgggtgaagctgcagtacagaaccacaacacccctatttaacgtaaaaacggccttttggccctcaatccaaacacgaaaaaacaaatattggaacaggtcgcaagactaccgaaacgtctgcctccaggatctggaagacagtttaactacaatacctctccaaacaaggactgcaagatggacacttgagactcgcgacaaagcaccacgttttccaagtggggcattctggcaggcaccaccgcagaggccagtgcagc

SEQ ID NO: 197685 - DNA, 601 bp, Human
gtgatctcataagattataataccctattttcactgtaccttttctatgtttagatacttttagatgcagacttatcactgtgttacaactgcctacagtattcagtatagtagcaccgctgtagaggtttatagcctaggaggaacaggctacaccatacagcctaggtgtatagcaggctacaccatctaggtttgtgtaaatacactttctgatattcacagggattaaattgcctaacgatgcatttctcaggacgtatccccctcactaagtggcagcaacgcatgactgtacttmaaaaagcaaaccagaagatgggggtatgagtatgaccctgaattctcattcactctcttcgcaggtaagatccaagtttgattaattccaattctgattgagtctgaatcaaaaagcacatcaaagaccaccagaaaatagtcaaaaataggttaaattttgaattggtgaacgctaccctctgcctattgaaaggactccctacgtatctatgttcatccagacaagacaaactcctctctagggcatcctgtgaactatcagttaaggagaaaagtttaccctagacctcttctggac

SEQ ID NO: 197686 - DNA, 601 bp, Human
acattcaaagatggaccacatatacaacagtgatctcataagattataataccctattttcactgtaccttttctatgtttagatacttttagatgcagacttatcactgtgttacaactgcctacagtattcagtatagtagcaccgctgtagaggtttatagcctaggaggaacaggctacaccatacagcctaggtgtatagcaggctacaccatctaggtttgtgtaaatacactttctgatattcacagggattaaattgcctaacgatgcatttctcaggacgtatccccctcaytaagtggcagcaacgcatgactgtacttaaaaaagcaaaccagaagatgggggtatgagtatgaccctgaattctcattcactctcttcgcaggtaagatccaagtttgattaattccaattctgattgagtctgaatcaaaaagcacatcaaagaccaccagaaaatagtcaaaaataggttaaattttgaattggtgaacgctaccctctgcctattgaaaggactccctacgtatctatgttcatccagacaagacaaactcctctctagggcatcctgtgaactatcagttaagga

SEQ ID NO: 197687 - DNA, 601 bp, Human
gcagagaacataatcaagaaaatgctccagtaataatataactataattgaaagcagtataaatagaaaattaattgaagatgcagttgttgacctctaacttccctaaataatgcacccctttagacagagggtagtacttttccactaatgcttcacaggccacctcaaattgccatgcaatatttctagttggatgaaagtacagtcacgtgtacattcaaagatggaccacatatacaacagtgatctcataagattataataccctattttcactgtaccttttctatgtttagayacttttagatgcagacttatcactgtgttacaactgcctacagtattcagtatagtagcaccgctgtagaggtttatagcctaggaggaacaggctacaccatacagcctaggtgtatagcaggctacaccatctaggtttgtgtaaatacactttctgatattcacagggattaaattgcctaacgatgcatttctcaggacgtatccccctcactaagtggcagcaacgcatgactgtacttaaaaaagcaaaccagaagatgggggtatgagtatgaccctgaattctcattcactc

SEQ ID NO: 197688 - DNA, 601 bp, Human
ggatggagaagccaatggaaagaaccagcaggagactaagggagaatggtgggagagaagtttggatattgatttccttgactcccaccatgacccctcagtggccctagcttggcagtggatactcttctaccaaagatcaagttggacagcccctcttctaaggctacacctcttgtttggttccaataacagctcctttctatggtcccttcaggcctggaggtggtaaaggccctggtgtaccatcatcccttagtgattcccataaaatttccattataaaactgtcccttcattwaactcacttcaattatttctttcagcttgccatttctttcttatggaaattcaaagcaaatttgtattttcctataaagaattcttataaagaaatcagccaggcatggtggatcatgtctgtaatcccaaggctttgggtcaggagttccagaccagcctgggcaacatagcgagaccctgtcactattaaaaaaaaaaaaaaaagaaaagaaatctaagcatatttgaatgttaaaaatcttaataggaatttcacacttataactttaatataatatccttgaataaacgtttacta

SEQ ID NO: 197689 - DNA, 601 bp, Human
gcccactcttgcatcagtgggctggatgtgaggcatggagccacagaggtcgagctgcatgaggctgtgggagcccactcttgcatcagtgggctggatgtgaggcatggagtcaaaggagatcattttggaactttaaagtttaatgactgccttattggattgcagactttcttggggcctacagcccctttgtttgggccaatttctcccatttgaaaaggctgtatttacccattgcctgtatctccattgtatctagaaagtaactaacttacttttgattttataggctcatagrtggaagggacttgccttatctcagatgagactttggacttggacttttgggctaattaagctggaatgagttaagactttgggggactattgggaagccacagttgactttgaaatgtgaaaccgacatgagatttgggagaggccaagtgtggaatggtgtggtcaggctttgtgtccccatccaaatctcatcttaacttgtaatctccataatctccatgtgtcaagggagagaccaggtggaggtaaatgaatcttgggggtggttcccccatgctgttcttgtgatagtgagctc

SEQ ID NO: 197690 - DNA, 601 bp, Human
atgtacagaaatgcctggatgtccaggcagaagttggctgtaggtgcagggccctcatggagaacctctactagggcagtacagaaggggaatgtggggttggaccccccctacagagtccccactggggcactgcctagtggagctatgagaagagggccaccatcctccagaccccagaatggcagattcaacagcttgcactgtgtgcatggaaaagccacagatactcaacgccagcctgtgaaaacagcagagagggcaactgtaccccgcaaagccacagaggtggagctgcacraggccatgggagcccactcttgcatcagtgggctggatgtgaggcatggagccacagaggtcgagctgcatgaggctgtgggagcccactcttgcatcagtgggctggatgtgaggcatggagtcaaaggagatcattttggaactttaaagtttaatgactgccttattggattgcagactttcttggggcctacagcccctttgtttgggccaatttctcccatttgaaaaggctgtatttacccattgcctgtatctccattgtatctagaaagtaactaacttacttttgatttta

SEQ ID NO: 197691 - DNA, 601 bp, Human
ataaaccatatttagaaaacctaatcaaggagctcattcgtttgcaaactgtcacacatccaagctggagtgcagtggcataatcacagctcactgtggcctcaacctcctaggcataagtgatcctcctatacctctcaagtagctgaggcatgtgccaccatgcccagctaaattctgtatcttttataaagacaggatctctgtatgttgcccaggctggtcttgaactcctggactcaagcgatcctcctgcctcagcctctcaaagtgctggaattataggcattagccatcataytggatctgattttttaagaatctctgaatttatttctagaggggtaaaatagcatgccctaatcacattcctaataacaaattattgaattgtttttgctataaaaatatgattatctaaaagcattttataaaatcagtttaaatatattgagaggcttaaaagaagaagatatttattgggcagaaagattttaaattggtaatgttctcatctattcatctgataagtactttcagtatacatgatatccaccatattttaaacttccctttacttagataaatacttaacataaaa

SEQ ID NO: 197692 - DNA, 601 bp, Human
aaaatcttaatcggagcagtatttccatttggatttttctttcaaatacatccccccagagttctaacctataacaaattatttgcatattaataaaccatatttagaaaacctaatcaaggagctcattcgtttgcaaactgtcacacatccaagctggagtgcagtggcataatcacagctcactgtggcctcaacctcctaggcataagtgatcctcctatacctctcaagtagctgaggcatgtgccaccatgcccagctaaattctgtatcttttataaagacaggatctctgtaygttgcccaggctggtcttgaactcctggactcaagcgatcctcctgcctcagcctctcaaagtgctggaattataggcattagccatcatattggatctgattttttaagaatctctgaatttatttctagaggggtaaaatagcatgccctaatcacattcctaataacaaattattgaattgtttttgctataaaaatatgattatctaaaagcattttataaaatcagtttaaatatattgagaggcttaaaagaagaagatatttattgggcagaaagattttaaattggtaatgt

SEQ ID NO: 197693 - DNA, 601 bp, Human
aggtttataataatagttgaggttttataattaatatagtattacatggtttataataaatatagaagtaaaatgtaagacaacagcagtacaaatgttcttaggtaggaaactgtaagtcactgaaatttcagattgttatcagaacataacttaatctatccaaactgacacaataactaaaccaaaaacctaatcaaatgcattataatctctctaaagaaaaaatatccatcattgaaagatgagtagtctgcatgaggtaaagaccagaaaacgacttccaaactgggctcctagmcataactgctaagaggagagcggtccttaaaatcagacaccatattcctgaaaaggacatgtttcaagttattacgacaaggtaacactaatcacttagataatctctttgccctggttccacacttaaccataatttcaacttatcaattaatattccccttctgaatggctttttgtctgactacagtgtttttgcttaaaaaaaaaaaaaacaaaactgaatatgtaaaaccccctaaaatttaataatcagaatttaacttggctccattattatatactttgcaaaaatctatta

SEQ ID NO: 197694 - DNA, 601 bp, Human
ttctagtttatttttcttcctattaagtaaatcaactaggaagaaaaaggggatagtacataaactgccaacaaactagaaaatgctcttcatgttttataaaatgaaaagaattaatctttttttacaataatcatcacctgatcctagtccttactttgttattcccccttgtataaaacgtattttctccctacaactttgatatctttactctacttctattatatctcagactctttataaaataccacattaagagtcctaaccttatactttatcctgctggaaataatcataattttagaaacacagtaaaatttaaagggaaacaaccatatattattcaaaatttcccagtcataatacaggaatcaattagtcattcattccttattgtaagatcctctgacttcttggtgcaatgctctccttagacttcttagttaagagctctttgcatatgactacaactttaaacctagttccagagggctcaagttttttgcaaaaattacaaggaaaaactcttccaggatattctaatcatgtcaatttccttttgtttaaggttcccagtaagttagtatttttagccagg

SEQ ID NO: 197695 - DNA, 601 bp, Human
aaaagaatatttttcaggtgatttaataaactttcaagaaatatgccacttacaaactttgaaacaaacacaaacaacactatctgaagaaaaaaaagaaaatgaatatctttattcttccatgttctatatatagagaaaactaagaacattgtgctatttttctctaatgtttaaggatccttttctctattattaccaatagtagtataagacttaaaccatactacacatttatgaatattatttttaaaaaagctgtaacctcaccctaaataaaatcattccacagtgaaactcraagaactttaaaaaataccacatttaaatatatatttctctctttacattttattttcccataaatattttccctaaatttttccttcttgtactttataatctactttgaaatggctgtcagcacagattcccacaggattcgagtgctaaagagtggtaactgcaagttactttccaggaaagaccgaggaggattatctgctcctaagtccatctcactcaggtgcgttttcctgaccctctcctctctgtaagtctcttgtgttatcatttccctcagaagccagggatcccaaga

SEQ ID NO: 197696 - DNA, 601 bp, Human
aaatacagaaatatcaattcataaagcatctttccagaaaagatccctgaaaagaatatttttcaggtgatttaataaactttcaagaaatatgccacttacaaactttgaaacaaacacaaacaacactatctgaagaaaaaaaagaaaatgaatatctttattcttccatgttctatatatagagaaaactaagaacattgtgctatttttctctaatgtttaaggatccttttctctattattaccaatagtagtataagacttaaaccatactacacatttatgaatattatttttwaaaaagctgtaacctcaccctaaataaaatcattccacagtgaaactcaaagaactttaaaaaataccacatttaaatatatatttctctctttacattttattttcccataaatattttccctaaatttttccttcttgtactttataatctactttgaaatggctgtcagcacagattcccacaggattcgagtgctaaagagtggtaactgcaagttactttccaggaaagaccgaggaggattatctgctcctaagtccatctcactcaggtgcgttttcctgaccctctcctctc

SEQ ID NO: 197697 - DNA, 601 bp, Human
attaaattaaaattaaaaaataaatttgtatgccttttttttcccgttaatctattattagtttgttttatagattcaaattatcaaaactgcagggtaaaaatgtgaacttccctacagtaacaaagcataatttgttcttttaggttatatttatgtcacatagaaccataaaacatataatgaaaaacctcaagcacaaataattaactgttgttttctaaggtctgaacattctcataaactaaacatcattgagtttcgtatgactcaaagtatttggattggcagcactacctgygattgttataaatgcaagttcttggcaccatctcaggcataccaaatcagaatctctgaggatgagacccaggaatctatgtttaacgatctctctagaaactctatgtattctaaagtttgaggagtactaattaactaattataactacttagtagttttccatgaatcaacactggaattctactgaacagcagtttaagcaaactggttaaaaacatactaattccatttatttaaaaaaaatatatatatattagtttgttcccaagtatttcatatcaaaataattcaataagg

SEQ ID NO: 197698 - DNA, 601 bp, Human
tttcttcaaatgaggttcaatatttctccacagtttgcgagtatcacgttcacttgctaccccaaagggaagaaaatttcagtaatttatatcttgtaaaaacctttctcaaaataaatattaatgagtaaaattacacagttaccttctcctttaaccacgggttcacaatatttaggaaaattaagtactgcctgtaagtaaagaaaaaaaaagagaagaaaaaaagcactgatcgatcacaattagaaatttatttttcaagtaaaatctgtattgcagttcaggaaattttacttaacacatttgctcaagtcaaatgtaattatacgcagtggcatgtgcctgtaatcccagctactcaggaggctgaggcagggggattgcttgagcccaggagatcaagcctgtagtgtgctgtgactgcacctgtgaacagccactgcactccagcctggacaacatggcaagaccctgcttctttctaaaaaaaaatgtaattgtagcttattactataataacaaaacagcaaaaatactaataatgacagcacaacataaaatattccttaattggctaaattctgcctaatacattagc

SEQ ID NO: 197699 - DNA, 601 bp, Human
tagctttcttcaaatgaggttcaatatttctccacagtttgcgagtatcacgttcacttgctaccccaaagggaagaaaatttcagtaatttatatcttgtaaaaacctttctcaaaataaatattaatgagtaaaattacacagttaccttctcctttaaccacgggttcacaatatttaggaaaattaagtactgcctgtaagtaaagaaaaaaaaagagaagaaaaaaagcactgatcgatcacaattagaaatttatttttcaagtaaaatctgtattgcagttcaggaaattttayttaacacatttgctcaagtcaaatgtaattatacgcagtggcatgtgcctgtaatcccagctactcaggaggctgaggcagggggattgcttgagcccaggagatcaagcctgtagtgtgctgtgactgcacctgtgaacagccactgcactccagcctggacaacatggcaagaccctgcttctttctaaaaaaaaatgtaattgtagcttattactataataacaaaacagcaaaaatactaataatgacagcacaacataaaatattccttaattggctaaattctgcctaatacat

SEQ ID NO: 197700 - DNA, 601 bp, Human
caatgctggcccaagcactttgcaatgatagccaacacctatggaacacacaaaattaacttaacaacggactctaggtagactcagccactcccttcaaacctcccttgtggctaaaagagttctgacactgactcctagccaccattcactcccttcgacatgtgaacagacaacaacccaggacagctccgttctggcaccaagggacaataaaaatctaactacaggatgactgatcagcaatgattttggagaaaaatcttgattaaaagaaaaaagttgtcagaatcaaaatggrgtcacatgtgttaaaaatcctgacaaacagagccaagaaaggccatgaaggaagggttcacatgcataatgtctgataaaaagaactattacaaaagacaggaaaaaacataaccttgtataaaggctaatgcaatcttccacaaaaaatacctccatgaggacatctgccaggcaaatccctgtccagctctgaactggcgccatccttgtaattgatccttgtagcaaagaataattatctcaaaacaattatgtaattctcttcattcttcctttaaaaaccttgtcttcctttacc

SEQ ID NO: 197701 - DNA, 601 bp, Human
tacaattagcagcttctgctggtaagttgacagaacctgacctaaaagattctttagtccatctagtgggcaactttggcaacatccttaatacaattgttgctcactctgctttgtttcaactcagtcatgtaatactagatgataaacggattggttacataaggaaatgtcggtgttaccgctaataccacaagctgtacccgaataaattcctctggaaaaggtgagacccatatataccaaataagaaaataggccacatggttagaagtctcacctaactctctgtggtcatttsatttattcagtaggttccctttaagcggaggttcacagttcaaaagcactatacaaactgagattgtcatattactatacattttactttgtattttcctttgtaaactttgtacttgttgcctgtcaaatttctgcagtgaccgggtgtggtggctcacacctgtaatcccagcactttgggaggccaaggcaggtggatcacctgaggtcaggagttcgagaccagcctggccaacatgttgaaaccccgtctctactaaaaatacaaaaattagtcgggcatggtggtgcgtgcctg

SEQ ID NO: 197702 - DNA, 601 bp, Human
aaattcaagtactgttttcactgggttcaacttccaggttatctaaatgggcttcccataaggagaagcaatcatactgcaagaggtttttctttacttttttggtaactgtcccaagaaacaaatattttgcattttatcaagataactttctgtgttttcttactagttttttattttttattactcaggaaaatagctttgaaagggttaacgttttttaaatccaggtaactttctatattgcttttgaagtcctctgattatcattctggttaaatgaatgactatcatttcacartgacctgtgatcctgttttgatcaggtgttttaaaccttttcacatctttgatagacctccctccccaatatcaaaattctaaattaaatatttttgacctagaactaacttttggattttctagctaggcccctggaaagcctcaaaagacatatttttcatattgtaaagatattaaatgattaaatttattttgtaaattgtgtaagaagcattgccaaatggtaagtaatactggatcttctttcagttatatttataggtatgtgtttaatatcagtgtaaaattacataaaact

SEQ ID NO: 197703 - DNA, 601 bp, Human
acttccctgctcaaggtactagttttctgtttacactcatagtgtgttctcacaagcttgaccacacattcttcctgtgtctgattaaattcaagtactgttttcactgggttcaacttccaggttatctaaatgggcttcccataaggagaagcaatcatactgcaagaggtttttctttacttttttggtaactgtcccaagaaacaaatattttgcattttatcaagataactttctgtgttttcttactagttttttattttttattactcaggaaaatagctttgaaagggttaaygttttttaaatccaggtaactttctatattgcttttgaagtcctctgattatcattctggttaaatgaatgactatcatttcacaatgacctgtgatcctgttttgatcaggtgttttaaaccttttcacatctttgatagacctccctccccaatatcaaaattctaaattaaatatttttgacctagaactaacttttggattttctagctaggcccctggaaagcctcaaaagacatatttttcatattgtaaagatattaaatgattaaatttattttgtaaattgtgtaagaagc

SEQ ID NO: 197704 - DNA, 601 bp, Human
tatatttgtctctactagacaagaggttttaataaggtataagggtttgacacagaagtacaaaactataaactcagcctaaatacagaacaatctttgtttgtgtaactctttgataaataagaccaattgaatattgttggtttaataaaaacagctgtgtctccaaagtaatcagcaaaatacccacaactttaagattctcacttaggtgaacacctgatattcataggctataaaaatgattaacatggaaatagcttgaactaatgactagccttgcctaatgcctcagttttcrtaagaaatctacttatacttgttaaaaataaataaattagatgaatgtaggtggcataaacatttacaaatagttgaattaaataatactcattaaatgtctgaatcacttccaaataagaaaaaatactgaaatataaattactaaacataagtttgttcttggcttcttaaagtctaagaaaagactatatttgggactatcactacacataaaagttaggttataaacatatttataaaattacaaaattgctcatatctataaaaaactgacatgtgacaaaatttcttgcttcct

SEQ ID NO: 197705 - DNA, 601 bp, Human
caaaatatgtcaaagaaatattttgcggtaaaatactttgatttctttcggtgtctgctatctgtcatgtgattctatatcagagtccagttggaatttggtttcttattgacacaaagagtctgttttgtcagtcttacgatctctctgctttaatgttaatgatggtcagttgtgcctaagctctaaaagggaggggctataatggacgtgtctagcctcccttttcctcatggctaggaatagtttttcaggtttttgtgaggtcccctttgccaagcagtccatttagttgttggggagctcaggattttattttttgtgtacagtagttcaatacttttttaaatataaaaataaataagcaagctggttttaaacttgttgataaaataaaaatagaaatgtcttcagaattgtcggcataaacttttgccgggatttatgggccgggcagttttatatttgtctctactagacaagaggttttaataaggtataagggtttgacacagaagtacaaaactataaactcagcctaaatacagaacaatctttgtttgtgtaactctttgataaataagaccaattgaatattgtt

SEQ ID NO: 197706 - DNA, 601 bp, Human
gacagggaaagcctggttgcattaaaaaggctttacagggccatttcaaaatatgtcaaagaaatattttgcggtaaaatactttgatttctttcggtgtctgctatctgtcatgtgattctatatcagagtccagttggaatttggtttcttattgacacaaagagtctgttttgtcagtcttacgatctctctgctttaatgttaatgatggtcagttgtgcctaagctctaaaagggaggggctataatggacgtgtctagcctcccttttcctcatggctaggaatagtttttcaggtttttgtgaggtcccctttgccaagcagtccatttagttgttggggagctcaggattttattttttgtgtacagtagttcaatacttttttaaatataaaaataaataagcaagctggttttaaacttgttgataaaataaaaatagaaatgtcttcagaattgtcggcataaacttttgccgggatttatgggccgggcagttttatatttgtctctactagacaagaggttttaataaggtataagggtttgacacagaagtacaaaactataaactcagcctaaatacagaacaatc

SEQ ID NO: 197707 - DNA, 601 bp, Human
attttcactcctgctctaaaacttgcctgtctctccttctgccttgtgcttccttggtagaattatttcttctgggaagaaaagaattgaggttgctgcaggcccaaacggatttgccgctggtaacaaaatgacatcaaggaaaatttggagcacaatggccattatttgaactctttaaacttatttaaaaaaactgcaaccaactaaagaattaaaatatgtagagcattctaatttctctacctctctatttttttcctgcctactttgaatctagtaactttttctgctggtattragataaacttgctgctatggcattccagccaagatagaaacaaagggggaaaaagttttagagtgctttcaaattattgttttacaaattacatcagctccatggcaactgacaacctacacattttctggaaatgtaaatttaggtttgccttactaacaattgctttgagtgatggaacagttaatttaagagttggatgttctaaaagaaaagaagagatcaatgtttataagagttaggctctcagatcaaagaggtcaaaatcttgagctcagagcaataatataacatttctct

SEQ ID NO: 197708 - DNA, 601 bp, Human
ggccagtaaacacactgcacatgctcacctcccaaggactagcaggccactgcacacacatggacagccaaccacaagggaagaatcagagaagggttgtaggaacccagaagtaagccaacatataaaactctaagtaaaaggtcaatggggcacttatctttcaagtcgcctgcttggccttcctccaagtgtactttccttccttttgttcctgttctaaagctatataataaattttcactcctgctctaaaacttgcctgtctctccttctgccttgtgcttccttggtagaattmtttcttctgggaagaaaagaattgaggttgctgcaggcccaaacggatttgccgctggtaacaaaatgacatcaaggaaaatttggagcacaatggccattatttgaactctttaaacttatttaaaaaaactgcaaccaactaaagaattaaaatatgtagagcattctaatttctctacctctctatttttttcctgcctactttgaatctagtaactttttctgctggtattgagataaacttgctgctatggcattccagccaagatagaaacaaagggggaaaaagttttagagt

SEQ ID NO: 197709 - DNA, 601 bp, Human
agctaattaaaagccactacgatggtccccaccatctaaaacactggtccaaatgcctaatactccctgacaagatttatgggattttctttgttcttgagtgattaataagaaacaaaatgggatcctcaaattctaaaggcatgccaaaacaatctacctttggggattccagccagctatattatggactgttcttgggcatattttttaactgatgggcaaattgttacagaaggcagctagtcaggcatgagcaggacaggagaaggctccccctaccccaccaggaacagcaggygaccctagggtgatgggcaagctattgtcacactgtatcgctaataattggtcacagctggcaccatgcaacggcagtctcccaatagatagaaacgcctgaaactggtgatcagcagctttccaataagatctcaggagttgggtaggtaagctcaggcatgtgcagtaagaggcaaaatagaggcatttaactagtatatgaccttccagggacattccactggtaagggaagaatacctccagtgagcatgtgtacaaggccagtaaacacactgcacatgctcacctcccaaggac

SEQ ID NO: 197710 - DNA, 601 bp, Human
aggactgttagaggagaaagccaaagcctagaggttttaggacttgctaagttcacatacggcagacaatggctgagctggaagtcaaaatcatgttcttctcacacactatgtgccaccatgtctctcctgagctgtttcactactaagaaattttaataatagacaaatgtcgatttataacggttcatatatttattttaaaatcaaattttcattatatcattcaaatatctagcataaatatggcaaagctagtactgactttcctatagctttccaggttaaaaaaaaaaaaaaaggctttgttacaaattgtgtaacataatggagtcacatgtgctaaaacccccaacaagtagagccagggagggccacgaagaaagtgttatcacggataatgcttgataaaagaaccatcacaaaaaactgaaaaaaccataaccttgcacaaaggccatcataaccttatacaaaaatcctgtgaggatgtttgcccagcaactgcctgtcaaactccgaactggtaccacctttgttgttgatccttgtagccaagaataattatctcaaaacaattatgtaattctcctcattcttc

SEQ ID NO: 197711 - DNA, 601 bp, Human
catttcttttttatttgggggatgagaggaatctttaatttctatcctttctttccattcttttccttcattaccaactctcaaaggaataccacacccttctgaatcaactacttgtctctcctcaaaacagtactttcccaagactatcatgctaactctggcccccatactcttaaaacaaaaaaaatacaaaaaattagacaggtgtggtggcgcatgcctatagtcccagctactcgggaggctcaggtggtaggatcacctggacctagggaggttgaggctgctatgagctgtsatcttgccactgcactccagcctggacgagacaatgggaccctgtctcaaaaaaacaaaaaaacaaaaaacaaaatgtcactttgattctccagtagccagtgctctaatccttccagcctcagaactgttcaatactttctcactcagggttgaactctctttcttcaagtaatttcatttgtatttcaccactactagtcaacgtatcccttgtcccaacaatcttctcttttcctttcagtctttgtttgacttttcacctcagcatgagctccagagctggccctgttggtttcag

SEQ ID NO: 197712 - DNA, 601 bp, Human
ctcccttctggaaaaataatgaagtcaagtttctttaatatatggtgctattatgaaaaggagggattagcttctgattttgtcatttcttttttatttgggggatgagaggaatctttaatttctatcctttctttccattcttttccttcattaccaactctcaaaggaataccacacccttctgaatcaactacttgtctctcctcaaaacagtactttcccaagactatcatgctaactctggcccccatactcttaaaacaaaaaaaatacaaaaaattagacaggtgtggtggcrcatgcctatagtcccagctactcgggaggctcaggtggtaggatcacctggacctagggaggttgaggctgctatgagctgtgatcttgccactgcactccagcctggacgagacaatgggaccctgtctcaaaaaaacaaaaaaacaaaaaacaaaatgtcactttgattctccagtagccagtgctctaatccttccagcctcagaactgttcaatactttctcactcagggttgaactctctttcttcaagtaatttcatttgtatttcaccactactagtcaacgtatcccttgtc

SEQ ID NO: 197713 - DNA, 601 bp, Human
ttgatcaacttttatttcacatccccctgttctttgtccatttattctaagttattgaatttcaaacttaaagaatgctttccatacctgaaaatgctttttaaacaaacctaaaccaagtaaaggtgtggtattgcagtcttcctctgctttgttttgggtgttaagggggaaatgttcatcaactaaactgttttattcacattttctgtttcttcctaaataatacctttacatggcttttccatgttgtcttttattcattttgaaatacctaatgtttggcttggtcagtaataayaggtgactttatgaatgcaggggtaaggttgcggaatggcacaattacttaattctaaagtgctcccttctggaaaaataatgaagtcaagtttctttaatatatggtgctattatgaaaaggagggattagcttctgattttgtcatttcttttttatttgggggatgagaggaatctttaatttctatcctttctttccattcttttccttcattaccaactctcaaaggaataccacacccttctgaatcaactacttgtctctcctcaaaacagtactttcccaagactatcatgc

SEQ ID NO: 197714 - DNA, 601 bp, Human
atttgttacagtacaatatactagtacagtttcagaattgatcattctggattaattgggaaaatgaactgttttaatgtgtaaagctaggtcttctatttctggaacgttttcttggattataattttagatcttaactccaatccattgttcttttctgtcttcaggagctccaattaaatatatgttaaatcttctttgtctatcatatttgtcacatcctacctgattatttttacctctttttttagttttgttctcttgattattttcagtcctttcctcaatgtctcttactayattctcagttgaatctactttcctttggatatcttattttttcattttcatttctgagataactactattgcctgaactttgctcctgagtttgatcaacttttatttcacatccccctgttctttgtccatttattctaagttattgaatttcaaacttaaagaatgctttccatacctgaaaatgctttttaaacaaacctaaaccaagtaaaggtgtggtattgcagtcttcctctgctttgttttgggtgttaagggggaaatgttcatcaactaaactgttttattcacattttc

SEQ ID NO: 197715 - DNA, 601 bp, Human
ctgttttagacttctgacatacaaaactgtaagacagtaactatgtgttgtcctaaatcactaaatttctgataatttgttacagtacaatatactagtacagtttcagaattgatcattctggattaattgggaaaatgaactgttttaatgtgtaaagctaggtcttctatttctggaacgttttcttggattataattttagatcttaactccaatccattgttcttttctgtcttcaggagctccaattaaatatatgttaaatcttctttgtctatcatatttgtcacatcctacytgattatttttacctctttttttagttttgttctcttgattattttcagtcctttcctcaatgtctcttactatattctcagttgaatctactttcctttggatatcttattttttcattttcatttctgagataactactattgcctgaactttgctcctgagtttgatcaacttttatttcacatccccctgttctttgtccatttattctaagttattgaatttcaaacttaaagaatgctttccatacctgaaaatgctttttaaacaaacctaaaccaagtaaaggtgtggtatt

SEQ ID NO: 197716 - DNA, 601 bp, Human
cagtgagctgagattgtgccactgcactccagcctgggcgagagtgagcctgtctttaaaaaaaacaacaacaaacaaaaaaccaataaatactaccacctaccactcggtaaaactcccaatgttctagttaccgtattagatgcaattgtcatatactatttctaaactctatagcaatccctcaaagtaggtatcacaccagaaaactgaggctcaaagattaagtcacccaaggacatttagccagtcaatactagagctacgagtcgaatccttgtaggatgcttgccttgcagarttcaaggtattttaattgccccatcctggacttatttgcaattaaaactgttaaacaaccaaaacactattaagaatatgaagtgattatgacacgacaaattgaatttataaggcaacacactatagtataatgagtaaagaatgccctacgacagttttagctgcatgacttcgaaaaaatgaatagtttactcataaaaaaaaataaggcagtttgatgcaaaggtgctcaccaactctaaaactctcacagaactcttaaaaatgagctaatttacagggctaatttaaaaataat

SEQ ID NO: 197717 - DNA, 601 bp, Human
ctgagtattcccacataacgtgatgccttatattaacagttaactgtacaggttgagtatactttatctgaaatgcttgggaccagaagtgttttggattttttcagatgttagaatacttgtatatgccagttgaacatccctaaattctgaaaaatcaaagaaaacaagcatttcctctgagcttatgtcagcactcagaaaattttggagcattttctatttggaagttttggattcagaatgcttaacctgtacataaatcataccccttagtaaacaatactatttgttgaaggasctatgtctaatgtttttttgtatccctacactgccttgcacatagaaaataactgatgaatggataaatattaaaacagtagggtcattcaagtagcactgattcttaagggaagggaaggaatctgatatttactgaaaatctactatgtgtcagacactgtgttaggtgctttacttaagcatcactttgaatctttgcagtaatgctaaatattcttcctatctcacaagtgaaaaattgagctgggttcaaggtcaaacagatagaaagtagtgcaaatcaattattacagatttg

SEQ ID NO: 197718 - DNA, 601 bp, Human
tgtgaaataggaaacaataaagaggacctactttaagataggttgtacagggagaactgctttgagaaggcaatatttaaactgaagcatgaagaatgagtagagaaggagctttccagaaagacagaacatacagacaaagaccttaaggtaggaaagagatcagaatgttttgaggaaagaggaaaaaggaaaaagtctaaagtgacaagaacatagtgggtaaagaagaagaaaaaaacaactctaaactgggatttctccaactaatgtatgtacaggagaggctccttcagtgtgmtggataattattcactacagtgagttttagaacaacaaagagttaccgctcttaaaattatttccatcctccacactttaaacaaaaccctatgtattttttaaatctgaattattacctaaggtatacctgatatcctcttttctatgaaactgcctaccttttctcaaatttgaggttgtgacattaatgtaaagcctttaaagaatgagtcctaaatacatatttggcaatcttattctaatctcttccccttagaaatttacaagtgttaagaaatttcaaaatattcctgggatc

SEQ ID NO: 197719 - DNA, 601 bp, Human
atagatgtggtccttgccctctagaaactaaagagggtcaggtacagtggcgcacacctgtaatcctatcactttgggaggccggagtgggaggatgacttgaggccaggaatttgggaccagcctggccaacatggcaaaaccctgtctctaccaaaaacataaaacttagccaggcgtgggggcacacacctgtaatcccagctacttgggaggccgaggctgtagtgagccaagatcacaccactgcactctggcctgggtgagagtgacactctgtctcaaaaaaataaaaaaaaaataaagtcctgaagagtagcacaagacatgacaaaaaaatgaataaatataaattgttgtaagtccaaagaagaaagcaaacatcatgtgaaataggaaacaataaagaggacctactttaagataggttgtacagggagaactgctttgagaaggcaatatttaaactgaagcatgaagaatgagtagagaaggagctttccagaaagacagaacatacagacaaagaccttaaggtaggaaagagatcagaatgttttgaggaaagaggaaaaaggaaaaagtctaaagtgacaagaac

SEQ ID NO: 197720 - DNA, 601 bp, Human
gccaaattagctaagtttgaggcttaggttttagcgttttctctaatctgcttggtcacctcaatatctacctaccatgcaattgcaaattctgggggtctctcatctgcttagtatttatgagtttaccttttttatttgttgtgggtgcttcaaaggggaaagaaaagaggaaaatgcctgtattcaattggctgtatttaactaaataatccagggtaaacttcttcatctactaagtcactaaaaaactttgtcaactcagttttaaactccagcagcagctcacctaaatgtgcaytcaatcactatattcaatataacaaaattctattacagtataacggtaccatatcaacacaaataagttcctatattcaaatgacaaatacaattacagatgtatctatttcctatattatcttcatttcctaagtttcttccattagaaattaaaatgtaaataccttttcgtgtttttttagaaagttggttttcttgatttttccatgatgctgcaattaaggaaaacaaattttaagttgaaaagacagtattccacaaaaccagaaaacgttatttatttaaaacatggcacaca

SEQ ID NO: 197721 - DNA, 601 bp, Human
ctagtcctaaatatgcctcctattttactgttataaccaggtgttaagtaattttgccaaatccaagataataaccaaaccagattcctaagttgtagactagagcttactacttatttctcacaattcctctttgtaccactgccaggaaaattcaacaccagtagctctaaaaagatcaattacagtaagtcgtagcttaacttagaaaactaataaaatattttataaagtaaataagccagcagcctaaaacaatgtaaaatttaaaaaaattttttcaatattgtaaaatgttcayacttgtatacaaactcatatagtataattcatgtcatcagaaacgagacaatgctcaagttccattctattagcagataattttaatagccaataaatatttatttctttttttgagacagagcctcactctgtcacccaggctggagtacagtgacacgatcttggctcactgcaaactccacctcccaggttcaagtgattctcgtatctcagccacccaagtagctgggattacaggcatgcactgccacacatggctaacttttgtatttttagttttgccgtgtaggacaggcta

SEQ ID NO: 197722 - DNA, 601 bp, Human
tttttcttctatccacttgtaccatgtgctaagcattgtttttctggaccatttaagaaatctactgtgactataattttaataatttgttttttcttaaaatgtcaactaaaaaacaaaccttaactacttgttttttttaaagtcatattttctatttttatgctttgctgccacctagtgaaattctgagaacttaattattctagaaaacagcattttttaataaaagcacatctatctgcaaagtacatagatgaggaataagaacattgtagattactctgttacaaaaaaaaawttttcaattttgttttcattaaattacaattcatcaacttggtcatcaagccacttgtttaattagcaagataattatgattatttaattttaaaaattcctttattgaaaaagagccaaattaaattatttgccatgaggttatacttgtaaacatatgtaaatttagtgatacccccaaagattctatatacgtaattttcaattacttaccaaaaacatggttcattatatagttaaaacagtaacatatgttgaacaaaaatctgaatgcctggaattctattgactctactatct

SEQ ID NO: 197723 - DNA, 601 bp, Human
tctcaacctaaaaatgcatagagaaaacaaaatgctcactgcaatatctgacatgactttgcttttaaataaatactagttatatcattttgctttttcttctatccacttgtaccatgtgctaagcattgtttttctggaccatttaagaaatctactgtgactataattttaataatttgttttttcttaaaatgtcaactaaaaaacaaaccttaactacttgttttttttaaagtcatattttctatttttatgctttgctgccacctagtgaaattctgagaacttaattattctrgaaaacagcattttttaataaaagcacatctatctgcaaagtacatagatgaggaataagaacattgtagattactctgttacaaaaaaaaatttttcaattttgttttcattaaattacaattcatcaacttggtcatcaagccacttgtttaattagcaagataattatgattatttaattttaaaaattcctttattgaaaaagagccaaattaaattatttgccatgaggttatacttgtaaacatatgtaaatttagtgatacccccaaagattctatatacgtaattttcaatt

SEQ ID NO: 197724 - DNA, 601 bp, Human
aaacaaaaaattcctatgttgtatgtagaaagctattaataaaaggtaaagttttattaaaatccaatttcagacaaagcttttttagaaaatacatgggaaaaatccctgtaacacaaattaaaactgaattacttttttaaagttatcagcattagtgatctacctacctatctaggtagctatctacctatatagctaactatttatgtagcctagtaactgagtgaactgagtttcttcaagaacacaataaatgtagatacaattttctatacatgctgacttttataaaaactayctaaattcaatgttgagaaaattgagattatatttgttactcaaactcttctctaaatgaaaaattaaaagttaccagcacacattagattacaaagtctgacagctattctggggccagatttattcagtgaattaattaaaacgcaggcattatttacatatttctcaacctaaaaatgcatagagaaaacaaaatgctcactgcaatatctgacatgactttgcttttaaataaatactagttatatcattttgctttttcttctatccacttgtaccatgtgctaagcattgtttt

SEQ ID NO: 197725 - DNA, 601 bp, Human
ctctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaataaacttgtagagaaagccaaaaaaaaaaaaaagtattttcatgtatacattttaatgccctagaataagttataagctcattgaaagaaaaaacatgtactatccttcaytgtgcccctcacacaggtaatttgtgggcacctgagaagtacaatcacatgtgatgcaaacatgtttctgctctgttcaaaagcactgtctgtctcacttccctaggctttaaatctcaaaggtttactcattgcatcatattgtaaaagttgtttaatctctctgacttaatgtaaggctccattgcttataataaagacctgataattcaaaatacctgctaatctagagttactgcaacagtaaacacaaaacaaaaaattcctatgttgtatgtagaaagctattaataaaaggta

SEQ ID NO: 197726 - DNA, 601 bp, Human
ggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaataaacttgtagagaaagccaaaaaaaaaaaaaagtattttcatgtatacattttaatgccctagaataagttataagctcattgaaagaaaaaacatgtactatccttcattgtgcccctcacacaggtaatttgtgggcacctgagaagtacaatcacatgtgatgcaaacatgtttctgctctgttcaaaagcactgtctgtctcacttccctaggctttaaatctcaaaggtttactcattgcatcatattgtaaaagttgtttaatctctctgacttaatgtaaggctccattgcttataataaagacctgataattcaaaatacctgctaatctagagttactgcaacagtaaacacaaaacaaaaaattcctatgttgtatgtagaaagctatt

SEQ ID NO: 197727 - DNA, 601 bp, Human
tccaacaatgatagactggattaagaaaatgtggcacatatacaccatggaatactatgcagccataaaaaatgatgagttcatgtcctctgtagggacatggatgaaatttgaaatcatcattctcagtaaactatcacaaggacaaaaaaccaaacaccgcatgttctcactcataggtgggaattgaacaatgagaacacatggacacaggaaggggaacatcacactctggggactgttgtggggtggggggaggggggagggatagcattaggagatatacctaatgctaaatgaygagttaatgggtgcagcacaccagcatggcacatgtatacatatgtaactaacctgcacattgtgcacatgtaccctaaaacttaaagtataataataataaaataaaataaaataaataaacttgtagagaaagccaaaaaaaaaaaaaagtattttcatgtatacattttaatgccctagaataagttataagctcattgaaagaaaaaacatgtactatccttcattgtgcccctcacacaggtaatttgtgggcacctgagaagtacaatcacatgtgatgcaaacatgtttctgc

SEQ ID NO: 197728 - DNA, 601 bp, Human
gaagagataaagaataaaaagatcagcaactacaattgtcaagtttgaaaaaaatttaacttcgttaacagacaaagatacattttgggccaagttgttttcttaactgtgtaatattactggcactgctataaccacgaagactgcggacattgttcatcatagtcaatggctcagagcagctagtaaatctctaaatcagaagcctcccattgtttttaattgccatatattttccccagaggataaaattgctgaagagtttatttctaaaaacagaaaatgctctacgaatgtaaasaacaatatgtaaggtaccaatagtaaggtgtggcatgtggtggcagtagtgttactatgatgctactattacaatcacaactacaatgacaactaccactacaatataaccccattcaattccaaccaaaccagggtgacagttcacaggtatgccttgcttttcaaacctttcttcagatcatattaacctttctttctgaatctctaaccttaactctatcctttggaaataagatatcaggtgattttaaactattatttctctatttacccatttatacatttctgtataataaac

SEQ ID NO: 197729 - DNA, 601 bp, Human
gaacacaatatatatgttattagattttcttggatactttactgaccaagcaaaagtaaagatcaactccttagaactagttgcatctatctctacctactccccgaccctttgtatacccaatgagaataactaagattgtgttcctaaatgacttgctattaaattcacctaaattcatgtatagcaatactttaaatatacaaatttatcattttgattataaaatgttaattagaagagataaagaataaaaagatcagcaactacaattgtcaagtttgaaaaaaatttaacttcrttaacagacaaagatacattttgggccaagttgttttcttaactgtgtaatattactggcactgctataaccacgaagactgcggacattgttcatcatagtcaatggctcagagcagctagtaaatctctaaatcagaagcctcccattgtttttaattgccatatattttccccagaggataaaattgctgaagagtttatttctaaaaacagaaaatgctctacgaatgtaaacaacaatatgtaaggtaccaatagtaaggtgtggcatgtggtggcagtagtgttactatgatgc

SEQ ID NO: 197730 - DNA, 601 bp, Human
aaatagcatatcactataaaataaattcttaaaacaggtgaatacaaaaataatacatgatcatctcatatagacacattataactaataaaaagcaatttacctccaggtacgaaatataattcattgccaattttatttacattttcataaaagtgtaaatacacacatacatgtttataattacatttttcagcaagtttatttccattcaaatgacccaatatgttaacaaatttctctagatatcacagacagtattaacaggtaaaaggtctgtttgcctggctcatcttaaagmcagaatgcaaaaacattgccatctagtgttcgtaccaaataagcactttgaaaacaaacgtatttctgtttttcacttaaaaaattaagtgtatgtaggttaaatacaaactgccattcccatggttaagagtataattttgatagaagaataaaaggagaaagaagaaaactagaaaaggtcactgggagtcaatgggaagaagaaaatataaggcatgtgggagaaatactctttggatgagattcctgccacattttgttctggaacacaatatatatgttattagattttcttgga

SEQ ID NO: 197731 - DNA, 601 bp, Human
aaaagaattaaaaagcataacttggctttaatatatttctggaaaaaaagacaatactatttctttaaaagctgacaaatggtcttcaaaatcataactgatcaaattaaaaatttagaaagaatacctataaactttacccatttactgcatgtattccattctatcttatgatgagagcagaaaggaaaggagaaaagaatgaaataccagaattaatgctttgtcacccatgaagttcaggcatacatagaagggctacatttatcttactggaatgaaaattttaaaaatgacccagataatgactgcaaaattgtactaaaggtaaaaaccaggtaagactaaaataataatctaaaaaaaaatttaaagtcatatttaagttcaataaatctgaacattaacataaaatgttaaatgtgctactattctcttcacttacttgtgagactaatgaatagaattttatttaaaattcaatagagaatgaagaaattcagaataatgccaactacaatacaatattgctgctagtactattataaatttattattctcaattggaattttaataaactttaaagagtccttgagttac

SEQ ID NO: 197732 - DNA, 601 bp, Human
ttcaagctattttctatgatttacataacttaccttaatagcatcaagcattacagtcaaatattacagaaacactggaatgctggcacaggacaaatgaaatgcagagaaattgcaaaggaagagctcttcacgtttctaataatttagtatccatggaattttaaggaaaactgtcccttttagtcaccaagtttaatgtctataaagataatgcccacactcaaatcaatttatataaatatcttacagctagattttaggatgttactctttatgtctacaaaattcaaattgttayctgatcaataaatggattagatatttttatctactagatttctagtgttatctgactagcgtttaatgaatgtagctactttttgtagaaatataaatattatgtaatatgcaaattaacttttaaggtaaagaaattttatcataaagtcttcataaaatttatttaaagtgcttttggttaaaaatctataaaagcagtttgaaataatgtatattaaaaaaggacatgagtataattttccattatgaagtatttcaaatatagccatgtaactttttaagaaaagccactcagact

SEQ ID NO: 197733 - DNA, 601 bp, Human
cagtaaaataaaatatgctgtgctttttagtatccttggtaataattaatactggtattccttacaacagtagtacagctagtaaaaatcataggttaactttactctttgcaaacatgaaacatcccaaagcagttttttaaaaaatctcctgaagtaggtatctactgcagagtggtctgatggcagaacagtaatatgtccacaccaggggtagtaggagatttgagaatctcatttactgcaccagtggagactgagcatcatggcggtgatgctcttagaatctagaaaagagccrgcctctattaaatagcatccctgctgacctcttcatcagcgaagtaggcattaagtaaggctcctttaccatcttggaatgcaatgtctcacaatctcagttgttgttaagaaaaaaacatagtaagattattaggaaatgttagcattcaagctattttctatgatttacataacttaccttaatagcatcaagcattacagtcaaatattacagaaacactggaatgctggcacaggacaaatgaaatgcagagaaattgcaaaggaagagctcttcacgtttctaataatttagtat

SEQ ID NO: 197734 - DNA, 601 bp, Human
tacaatcacgcaccaccacacgcagctaatttatttattgtagatacagggtctcactatgttgcccaggcaggtctcgaactcctgggtgcaaatgatcctcctaccccagtctctcaaagcgctgggattacaggcatgacccatcatgcccagccagaagtatttttaaatgtaccacacatttccacaacgaagatttttttctaaatcatttatctcctatctgttcttattaaaactcttctcatttaaacaatctagtcattaagttctatctaatgcacaaatttgcctatayagtcactatatattagtagtatggaatctcttaaacatgcatttgcaagcacatatccatacaaacttttttgtgtgttgtcagctaaaaatctgccaagttaaataaaatttattggggtttaatatatttcccccaaaaatgtgaataaaggatatacatttagtaaacttattggaagtaacactaatctttgagaaaggtagttataaaatattgcccacaaaaataaagtaccaatgtattattttatacaaaagtagaaagcataatttatgcaattttttaaatcccttaggc

SEQ ID NO: 197735 - DNA, 601 bp, Human
gtgctacgttagtattataatatgcataaacataattatctgactatagagaagaaaatgaactaaaagggagggaggcaaagtgcagattcactgagaaatgacatttgggagatggaccatgatgcgtaaaaagagagctcgatagttgtaaggggaaagtacatgcaacaatataaaaacatttaaaattagtgtgttttcagagaggaaacagcttattgtgaatggtatatatggtgaatgaaggaagtggtagaaattggggccagattatgaaggaccttgcaataaatgctaytgaatgtagacttggttctgtaaataatgtaactcatcaaaaaaaagtataaccagaaaagaaagaccaaatttatttttcaagatttatgctgatgaccgtatggatgatgaaccagcaagtgcctagtgacaaggagaccagatagaaagctggtgcaactgcctaataaggaagctactgatttaaggtaatgtcagtgagggtggaaaaaaaggagaatgtttaagagacatttgtatttaggaaaaatagactagacttgaccaagtaaatgaaggagagaaaatgagacggttc

SEQ ID NO: 197736 - DNA, 601 bp, Human
ctagtcttcaaatatgctcagataaacaaaaagtagcatgtatgtttatacatagagcaactgaagataaagcctctaatctctggaactttttagcatgcaaactgcctgcaaatctttagcaaccatgaagaccataaatgcctgttaggagaatgggagatcattcaatgaatgactctcatgttcatggatggcattgtgcaagagatacaaaaatgaacagacaacgtctatgccctcaaacatcagggtagttggagacaaacacataaaatggtaatgacaaaatgagtgctaygttagtattataatatgcataaacataattatctgactatagagaagaaaatgaactaaaagggagggaggcaaagtgcagattcactgagaaatgacatttgggagatggaccatgatgcgtaaaaagagagctcgatagttgtaaggggaaagtacatgcaacaatataaaaacatttaaaattagtgtgttttcagagaggaaacagcttattgtgaatggtatatatggtgaatgaaggaagtggtagaaattggggccagattatgaaggaccttgcaataaatgctactgaatg

SEQ ID NO: 197737 - DNA, 601 bp, Human
aggagagtggtttgctagtcttcaaatatgctcagataaacaaaaagtagcatgtatgtttatacatagagcaactgaagataaagcctctaatctctggaactttttagcatgcaaactgcctgcaaatctttagcaaccatgaagaccataaatgcctgttaggagaatgggagatcattcaatgaatgactctcatgttcatggatggcattgtgcaagagatacaaaaatgaacagacaacgtctatgccctcaaacatcagggtagttggagacaaacacataaaatggtaatgaaaaaatgagtgctacgttagtattataatatgcataaacataattatctgactatagagaagaaaatgaactaaaagggagggaggcaaagtgcagattcactgagaaatgacatttgggagatggaccatgatgcgtaaaaagagagctcgatagttgtaaggggaaagtacatgcaacaatataaaaacatttaaaattagtgtgttttcagagaggaaacagcttattgtgaatggtatatatggtgaatgaaggaagtggtagaaattggggccagattatgaaggaccttgcaata

SEQ ID NO: 197738 - DNA, 601 bp, Human
ttacacacacaaagcagaggtggtaaatgcagcacatggcagaaataggcaaatatcatcaaagcagttcaactttaaatcactaccataaattttcatttcaaaaaaaaaaaaaggagagtggtttgctagtcttcaaatatgctcagataaacaaaaagtagcatgtatgtttatacatagagcaactgaagataaagcctctaatctctggaactttttagcatgcaaactgcctgcaaatctttagcaaccatgaagaccataaatgcctgttaggagaatgggagatcattcaatsaatgactctcatgttcatggatggcattgtgcaagagatacaaaaatgaacagacaacgtctatgccctcaaacatcagggtagttggagacaaacacataaaatggtaatgacaaaatgagtgctacgttagtattataatatgcataaacataattatctgactatagagaagaaaatgaactaaaagggagggaggcaaagtgcagattcactgagaaatgacatttgggagatggaccatgatgcgtaaaaagagagctcgatagttgtaaggggaaagtacatgcaacaatataa

SEQ ID NO: 197739 - DNA, 601 bp, Human
tgaacttaacaaatgaaatttcagtgtatgagttccacacaacccaacaagcaccacatttgatctgaattcaggagacttgacggttcatggcatatattgagagttcaactgacatttttacacacacaaagcagaggtggtaaatgcagcacatggcagaaataggcaaatatcatcaaagcagttcaactttaaatcactaccataaattttcatttcaaaaaaaaaaaaaggagagtggtttgctagtcttcaaatatgctcagataaacaaaaagtagcatgtatgtttatacayagagcaactgaagataaagcctctaatctctggaactttttagcatgcaaactgcctgcaaatctttagcaaccatgaagaccataaatgcctgttaggagaatgggagatcattcaatgaatgactctcatgttcatggatggcattgtgcaagagatacaaaaatgaacagacaacgtctatgccctcaaacatcagggtagttggagacaaacacataaaatggtaatgacaaaatgagtgctacgttagtattataatatgcataaacataattatctgactatagagaagaaaat

SEQ ID NO: 197740 - DNA, 601 bp, Human
tgtttaatctttgctctgtgtactgttatgtcctttgttctcatctgtgtaggggatgagctgattatttatgttgtaacaataggagttcatgtaccacagtgaggatttttttttccttaatctgagaggcagctactaacaagcttcagctggaaatgcttgatgtaaaaacagtgtgaacctgtttctcggctaataaactgttatttctgccaacaaaagaaaatcaatttacaactgtaattaatttttaacatgctcattatttttatacgttcataggttgttatatgtccaytgacttaagaaatatcctatcctgcttgtcctggaggagcttcacaatctgaaacatattaaattatttaaataaatgaacttaacaaatgaaatttcagtgtatgagttccacacaacccaacaagcaccacatttgatctgaattcaggagacttgacggttcatggcatatattgagagttcaactgacatttttacacacacaaagcagaggtggtaaatgcagcacatggcagaaataggcaaatatcatcaaagcagttcaactttaaatcactaccataaattttcatttcaa

SEQ ID NO: 197741 - DNA, 601 bp, Human
agctttcatacatcagcagcattctgacactgcttaacatattttatttcaccttagcttaaaataatcaatctatctgactcaaaagccacagtatatattccttttcctttgactaggtcctacgttatgactgaggaattcacaaagaaaaataaaaaaacaaaaatctctttctgtgtacaatatttttagatttacatcctaaatggggttatacaatatttgtttaatctttgctctgtgtactgttatgtcctttgttctcatctgtgtaggggatgagctgattatttatgtygtaacaataggagttcatgtaccacagtgaggatttttttttccttaatctgagaggcagctactaacaagcttcagctggaaatgcttgatgtaaaaacagtgtgaacctgtttctcggctaataaactgttatttctgccaacaaaagaaaatcaatttacaactgtaattaatttttaacatgctcattatttttatacgttcataggttgttatatgtccattgacttaagaaatatcctatcctgcttgtcctggaggagcttcacaatctgaaacatattaaattatttaaata

SEQ ID NO: 197742 - DNA, 601 bp, Human
gcagagactgtgccactgcactcccacctgggcgacagagtaagactccgtctcaaaaaaaaaaaaaaaagtaaatttaaggttgggggaaagcatgatttcttaaatccagaaattattagatgatattgaagatggtatcccaaagcagtttcttacacatttgtggattaaaggtcatttacagaaacattcacaactacaactcataaaatattaaaatacattaaaagaaagggtaatgaaaaggtctttttctgaaacactagaatcatttccaggtaaagtcatcttaattatktaggtaaatataaaaattgtgggaaaattataactccccttctgggtttctacaccctatgaagatatattctattgtcagtaatgttcagattttaggggattatatactgctttccacagctgcttttcttgtccgttttgtcaagctcaaagtcaaatgaataaaactcaaatgaataaaaaagtagcctagggagtaggttctctttttcaaagtcaggattcagatttcatgttagaaaatacagaacaaagttttgtttttgtttttaaaaaactgtattaaaagtcagtggtt

SEQ ID NO: 197743 - DNA, 601 bp, Human
aatattggccaatgttggctcacacctgtaacccccgcacttggggaggccgaggcaggcagatcacttgaggtcaggagttcaagaccagcctggccaacatggtgaaaccccaggtctattaaagatacaaaaattagctgggtgtggtggcgcatgcctgtagccccagctatttgggaggctgaggcaggagaatcgcttgaatctgggaggcagaggttgcagtgagcagagactgtgccactgcactcccacctgggcgacagagtaagactccgtctcaaaaaaaaaaaaaaaagtaaatttaaggttgggggaaagcatgatttcttaaatccagaaattattagatgatattgaagatggtatcccaaagcagtttcttacacatttgtggattaaaggtcatttacagaaacattcacaactacaactcataaaatattaaaatacattaaaagaaagggtaatgaaaaggtctttttctgaaacactagaatcatttccaggtaaagtcatcttaattatgtaggtaaatataaaaattgtgggaaaattataactccccttctgggtttctacaccctatgaagatata

SEQ ID NO: 197744 - DNA, 601 bp, Human
tggtaaaacatatacgccttataaaactaagcaggcaattaccgtattaccctgcaattgcacttatgcatttattccagagaactgcatgttcacataaaaactagtacatgaatgttcctaacagctttaattgtagtagccaaaaaacgggaaagaacccagatgtccttcaacaggtgaatggttaaacaaactgtggtatatgtataccacagaatactcctcagtaattaaaatgaatgaactattaatacatgcaaaaatttggatgaatctgaggaattatcctgactcaaaraagttaattcccaagtgttatatactatatgattatgcttaaacaaattcttgaaatgacaaaattctagaggtagcaattaccagttaacaggaattggggaaggggaggaagagaggaaggtatggtcatcagtgagtatcacggagaatccttgtgataatggaaccggtcttgactgtggtggtgaattaacaaaactatgcacaggataaaatttcatataaccaaatatatatagacatacacaaaagaatacaaatagaagtagggaaatctgaatgagatcagtagattgca

SEQ ID NO: 197745 - DNA, 601 bp, Human
tatatcctcatgagttttctaaatcacatttgattaaacattttaacaccttctgatactcaagacagtatctgaaaaagtgagaaagtaaaaggaatggcagtatggtttccacacttcacttgaagtggtaaaacatatacgccttataaaactaagcaggcaattaccgtattaccctgcaattgcacttatgcatttattccagagaactgcatgttcacataaaaactagtacatgaatgttcctaacagctttaattgtagtagccaaaaaacgggaaagaacccagatgtccttcaacaggtgaatggttaaacaaactgtggtatatgtataccacagaatactcctcagtaattaaaatgaatgaactattaatacatgcaaaaatttggatgaatctgaggaattatcctgactcaaagaagttaattcccaagtgttatatactatatgattatgcttaaacaaattcttgaaatgacaaaattctagaggtagcaattaccagttaacaggaattggggaaggggaggaagagaggaaggtatggtcatcagtgagtatcacggagaatccttgtgataatggaaccgg

SEQ ID NO: 197746 - DNA, 601 bp, Human
agtggaaataaagacatgctcgaacaaggtaaaacggaagaatctgtcactagcagatgaccttcaaagaagagcaaaaggaagttcttcaaacaaaaggaaataataaaagtgaaagaacgaacagtggaaagaggagatttgtggataaatacaagagaatatatcctcatgagttttctaaatcacatttgattaaacattttaacaccttctgatactcaagacagtatctgaaaaagtgagaaagtaaaaggaatggcagtatggtttccacacttcacttgaagtggtaaaacayatacgccttataaaactaagcaggcaattaccgtattaccctgcaattgcacttatgcatttattccagagaactgcatgttcacataaaaactagtacatgaatgttcctaacagctttaattgtagtagccaaaaaacgggaaagaacccagatgtccttcaacaggtgaatggttaaacaaactgtggtatatgtataccacagaatactcctcagtaattaaaatgaatgaactattaatacatgcaaaaatttggatgaatctgaggaattatcctgactcaaagaagttaattc

SEQ ID NO: 197747 - DNA, 601 bp, Human
ttccccacccaagagcgaaaggtgaaccaagcccagcactttccaatccacaactgagcggcaaaaggctacccaggtaggctcattcctcccctggattaaagaagaatcctgacgaaagatctggcaattctatatctagcaaaactatccttcatgaataaagtggaaataaagacatgctcgaacaaggtaaaacggaagaatctgtcactagcagatgaccttcaaagaagagcaaaaggaagttcttcaaacaaaaggaaataataaaagtgaaagaacgaacagtggaaagagsagatttgtggataaatacaagagaatatatcctcatgagttttctaaatcacatttgattaaacattttaacaccttctgatactcaagacagtatctgaaaaagtgagaaagtaaaaggaatggcagtatggtttccacacttcacttgaagtggtaaaacatatacgccttataaaactaagcaggcaattaccgtattaccctgcaattgcacttatgcatttattccagagaactgcatgttcacataaaaactagtacatgaatgttcctaacagctttaattgtagtagccaaa

SEQ ID NO: 197748 - DNA, 601 bp, Human
aggaacacatttcaggaacaaacactaacaaagagcctagacagagggttagaaaaaaaagataaatacagaagaacttcccacccagacaggatgcatagattcatatttgttattcttccctgctaagtacaactataaatcctggaaataatataagaggcgaccaaaagaggactctgaaaggtagaaagaggtaggtgggctgcttagggaccctagggctacagaaacaatatagagggtgcgagtcttagaattccccacccaagagcgaaaggtgaaccaagcccagcacttyccaatccacaactgagcggcaaaaggctacccaggtaggctcattcctcccctggattaaagaagaatcctgacgaaagatctggcaattctatatctagcaaaactatccttcatgaataaagtggaaataaagacatgctcgaacaaggtaaaacggaagaatctgtcactagcagatgaccttcaaagaagagcaaaaggaagttcttcaaacaaaaggaaataataaaagtgaaagaacgaacagtggaaagaggagatttgtggataaatacaagagaatatatcctcatgagtt

SEQ ID NO: 197749 - DNA, 601 bp, Human
ccgagcctttcccatctaactgcctgagacctttactatacaggaaaaagacacagaacaggatgggcaaccaagggatacaggggtctttgggggacagtaaatattgctgaaaaccaagataagacaaatagccttcttagtttggaaacttgtagaaatccataatgagagtaggcctgaaattttaatgaatgggaagatacacagaaaagagttaacatagtcttctatggctaagtatattaacttcgacccttcttattcagtgacacatctgtgacttagagaaaagagatayacaacagtcattcctgttgttaggtccccaaatgcagggggagatttacacaaagtctgtagttccagcatggaataataaattgaaatattttgcagtaaataaattaatgacttagaaggatttaatctctgttggaaaaaaaagctctctaaataataatggtaaaacattctgtaatctttttttagcactaatttacagaaggcttctcattcaattgagctttgaattaccaaggaacacatttcaggaacaaacactaacaaagagcctagacagagggttagaaaaaaaaga

SEQ ID NO: 197750 - DNA, 601 bp, Human
catgcatgtatatgcataaataagggagaggtggggccgagcctttcccatctaactgcctgagacctttactatacaggaaaaagacacagaacaggatgggcaaccaagggatacaggggtctttgggggacagtaaatattgctgaaaaccaagataagacaaatagccttcttagtttggaaacttgtagaaatccataatgagagtaggcctgaaattttaatgaatgggaagatacacagaaaagagttaacatagtcttctatggctaagtatattaacttcgacccttcttawtcagtgacacatctgtgacttagagaaaagagatacacaacagtcattcctgttgttaggtccccaaatgcagggggagatttacacaaagtctgtagttccagcatggaataataaattgaaatattttgcagtaaataaattaatgacttagaaggatttaatctctgttggaaaaaaaagctctctaaataataatggtaaaacattctgtaatctttttttagcactaatttacagaaggcttctcattcaattgagctttgaattaccaaggaacacatttcaggaacaaacact

SEQ ID NO: 197751 - DNA, 601 bp, Human
aattagccggtcgtgatggcatgtgcctgtaatcccagctattctggaggctgaggcaggagaatcgctttaacttgggaggcggagattgcagtgagctgagatcgtgccactgtactccaccctgggcaacagaacgagacaccgtctcacaaataaataaataatgaacaggatcataaaaaatacttatttacttccttgctccactttaaatgttcatgacaatatgaactcagatctccaggctagtattaatacctatgtagtctgatatggtcagtgtggatctgacaaaaastctctagacaatgagtactcagattcatcgtggtgtctcagtttcacatgcatgcatgtatatgcataaataagggagaggtggggccgagcctttcccatctaactgcctgagacctttactatacaggaaaaagacacagaacaggatgggcaaccaagggatacaggggtctttgggggacagtaaatattgctgaaaaccaagataagacaaatagccttcttagtttggaaacttgtagaaatccataatgagagtaggcctgaaattttaatgaatgggaagatacacagaaaa

SEQ ID NO: 197752 - DNA, 601 bp, Human
agagcacaaagcatgcccaccatgtgggatgacttaccccaggcaaatgaggtagggtgcaacaagagtttttttctcttacttattaaggtatctacataatatcctacattttgccttttagcctgcaaagtctaaaatatttactatgtatccctttactgaaaaggtttgctgacctctgcattagaagattgctagattcaaattgttaatttaaccaacattaaaactaagatgtttagtaacttgatcaaagtggtaatgcccagatggtgccagaaactcacctgactaggamttaaatctcctaactccaactccaaaacttttaaaaaacatgcataagctgtgatcacagctaagaaagtgcagatctaacagatgtattatactccggcctgaaaagagtgtgtgctaaaagaattaggatgatctgcaaaatagtcataaagggagcattcaacagaataaacccagcagtatgcctctagcactaagatacaggactctttgcccattaacttagaaatctggtatatgctacaaatttgtattcaccgtagaggtggagctgcctggctgtcacttaaggtattaa

SEQ ID NO: 197753 - DNA, 601 bp, Human
atttgtccctcctttcctttttctcattcctttcttaccttttgttgtaattatattttcttatctctttttactttcactaccttgtaagtagttctatagtccttttaattcgaatgtccattttgatttctttttcggctctcttgctattttggaagtcctcctttatttccaacttacagagtttttccagttttttgttttgtttctgggggatcacagaatgtgatctgcatactagcaatcctctgaaatttgttgaggcagctaggttctctgggaggaaagaagggtgcaygggaacctgggtgtcactgtgacagagtgaaaatgaccatggtggccaccctgcctgttctgcccaccaggccccttcttgctttattccaagaatgtctccagctgatgacaacagagcacaaagcatgcccaccatgtgggatgacttaccccaggcaaatgaggtagggtgcaacaagagtttttttctcttacttattaaggtatctacataatatcctacattttgccttttagcctgcaaagtctaaaatatttactatgtatccctttactgaaaaggtttgctgacctctgc

SEQ ID NO: 197754 - DNA, 601 bp, Human
tgtaacaaagacattatttgtattgttaaatcttatatacaccatttttaaaatctgcctgatcaaaactgagagaggtattaaaattcttttgttatcatagaatctttctgctttgtagtttttaagctatgttactaggtaacatacatacagatttaaaattacgttttgttgacaaaccttttcattataataacccttttattctccagtaatgtcttagcttacagtgtatttttttctaatcttaatatagctatattagcattcctttatgtgctctgcctttttctgttamttttcatgattctactttcaaggttgatgttttctcaatttaaaacagttctcatgtaaataacatatagtgggattttgtttttataatcagtctgacaacttttacctttcattaggaccatagactccatttgtttttaatatatctaatgattttctaaaatttttctttctactgttatattgacctatttgtccctcctttcctttttctcattcctttcttaccttttgttgtaattatattttcttatctctttttactttcactaccttgtaagtagttctatagtccttt

SEQ ID NO: 197755 - DNA, 601 bp, Human
cctagcctcccaaagtgttgggattagaggcgtgagcccccgcacccaaccattgctttaaaacttattgctgatcgtgtactcaggaaaacaccagaaggattattagtaaaagcaaaagtgtattttgataggtcaaaatcaaagtacaaaatcacttaacattcatatggccaactaaaatattaagttctctgaaatctaagaaaggaagctgatccaagagctgaaattctttgagcgcccattgtcttctcctaatttcttatttttgtctcccataagccagcaggaaaaagartcagcaatggcagtaagataaaatttggagacttagttacctgtaactgctcagtggcaatatgaataagagttttaagttaaactatctgtaatacctaatcatgtgtcttaggaattaaaatgctcacttaatttgagactaatactttacaaatgctaagtaaacatcccatgaataataaaaacactaacagcagtagtaatttgcttggtattaagtactctatacacattatctcatgttattcctcattaccttcatgtccacaaggtggacattattatacttttttttata

SEQ ID NO: 197756 - DNA, 601 bp, Human
gggttttgccatgttgtccaggctgctcttgagctcctgggctcaagtgatgcacctgcctagcctcccaaagtgttgggattagaggcgtgagcccccgcacccaaccattgctttaaaacttattgctgatcgtgtactcaggaaaacaccagaaggattattagtaaaagcaaaagtgtattttgataggtcaaaatcaaagtacaaaatcacttaacattcatatggccaactaaaatattaagttctctgaaatctaagaaaggaagctgatccaagagctgaaattctttgagcrcccattgtcttctcctaatttcttatttttgtctcccataagccagcaggaaaaagagtcagcaatggcagtaagataaaatttggagacttagttacctgtaactgctcagtggcaatatgaataagagttttaagttaaactatctgtaatacctaatcatgtgtcttaggaattaaaatgctcacttaatttgagactaatactttacaaatgctaagtaaacatcccatgaataataaaaacactaacagcagtagtaatttgcttggtattaagtactctatacacattatctca

SEQ ID NO: 197757 - DNA, 601 bp, Human
caggggaaaaccaccttcccactccatcctccttcgggctccccaaccatctgctgagagctacttccactattcaataaaaccttgcactcattttccaagcccacatttgatcggatttttcggtacagcaaggcaagaactaaggatacagaaagccctctctccttccaataaggcagagggtctaattgagctaacacaagccacctatagatggcaaaactaaaagagcacactgtaacacgcccactgcggcttcaggagctgtaagcattcatccctagatgcggccgtgagrttggagccccacaacctgcccgtctgcatgctcccattagaggtttgagcagcgggacactgaagaagcaagccactacccctggaagggggacaagggaacttttcctgtttcactgggattactggtgtgagtcactgcactcagcccaaccaagattcctagctcaacaactgattcaaacaatcagtccctaagaattccactagagacagctttgtttcattactcagacacatgaccgctaaacctttaaaagctgcaaataaagcacattcctcctctaaaaattttacagaa

SEQ ID NO: 197758 - DNA, 601 bp, Human
gccaagagcggctagacttcaggggaaaaccaccttcccactccatcctccttcgggctccccaaccatctgctgagagctacttccactattcaataaaaccttgcactcattttccaagcccacatttgatcggatttttcggtacagcaaggcaagaactaaggatacagaaagccctctctccttccaataaggcagagggtctaattgagctaacacaagccacctatagatggcaaaactaaaagagcacactgtaacacgcccactgcggcttcaggagctgtaagcattcatycctagatgcggccgtgagattggagccccacaacctgcccgtctgcatgctcccattagaggtttgagcagcgggacactgaagaagcaagccactacccctggaagggggacaagggaacttttcctgtttcactgggattactggtgtgagtcactgcactcagcccaaccaagattcctagctcaacaactgattcaaacaatcagtccctaagaattccactagagacagctttgtttcattactcagacacatgaccgctaaacctttaaaagctgcaaataaagcacattcctc

SEQ ID NO: 197759 - DNA, 601 bp, Human
gaaacttgtatttttagacagctttcattttgacaaatgtactttcttccccagaacttctaacattctagaattactcagaattagcttcattcattttgcacgacagcccctgaaacacttaagacagttcacatgtccttcctaaggcttttctctcacactctgtccttcagtcagggatgtgacacaattcctcattctaccactctcctcgtgccccttcagtatgtatccatttgtctctctgaaaactctaaacacagcacagcacactagatttgatctgcctgtgacaacrcacagtagaatgattatgtcccctgacctagacactatatttctatcagtgttacctaagtcaggatttttaaagccttgtagtcagctaaaaaatttaggacttaagccagctctctcccatcttatttcaatacaagagagttttctgtagccaactgtccattaaatcttaccttgccactatgggatcatttattccagcctattaaggtttttcagaatcttgatttttgtcctctaacatattagctatttctcccagttttacatcatttgtaaatttgagaaggttcattct

SEQ ID NO: 197760 - DNA, 601 bp, Human
ataatgaagaacaaaatgggaacttccaaatcgtgtgtgtgtgtggtatgggggggtgatcatggtggttgtggtatttgtgagaaggcgtctttaaggagcagacatttaaactgaaatctaaaggttatgtagcagttagctaggtgaaggagaaaagaagctggaaaatgctgtatatacaagcatgggaagcagaatggtgaatataaaaaatggaaaaaagtggttaaagtgcagataccgaggaaagaaggtgtatgtgctagatggggctaggcacaggtaggggccagatcayttgggccttgttagttatttaaaagattctgttatttatcccaagagctatgggaaactactgaatatttttaatgagcagggtgacattaaatttttataaaatcattctggctacagcatggataataaattataagaggataagagcagacagaagatcaattagactgttagagaagagatgatggtggcttgatctagagtggtaaaagtatcatgataacaagtgaatgaaattgagacaaataagaggggctttgtaagctcaataggactaatggttaaatattaggagtgg

SEQ ID NO: 197761 - DNA, 601 bp, Human
tattatctcatttgttctctgccacaggtgtctggaatgaggccagccttccttttctttggtaactatccttgggacttcctctcccatcaagccttgatttggaatgagactgtctctgagctcccttcttgctgtccccaaaaacaaattcatatggttccccttcatctgaatttttactgctaatcactataggaaaacatgcaatatttatttagcacatactaagtttaaagcactgtgctaggtttgaggataaggcagtgatagacataaacacagtctgctttgagcttakgagcttgtattctagaaagaaagatgaactctaattactcaattatttaagtaaaacttgttacatataatgaagaacaaaatgggaacttccaaatcgtgtgtgtgtgtggtatgggggggtgatcatggtggttgtggtatttgtgagaaggcgtctttaaggagcagacatttaaactgaaatctaaaggttatgtagcagttagctaggtgaaggagaaaagaagctggaaaatgctgtatatacaagcatgggaagcagaatggtgaatataaaaaatggaaaaaagtggttaaa

SEQ ID NO: 197762 - DNA, 601 bp, Human
ctgtatctccccaaagcctaccacagtgttttgtttataatgggcaacacaataaatgttaaataaacgaatgaaaaacattatctctctttgctacatctactttctcataaatactacaatatgacttctacttcatcataccactgaaagtgttctggataaagctacaaatgactgctttatcagtaaatcagaggattctgcttgatttcttggtgacaactgacttttgaccattactcctgtcccttacagtttcctagttttcttgtatatgcaactttatatgaactgttayatgcacttaagcttacatcatgagttattttcccaagttactatccttcaaaagtgtgattttcaataactctataaaaatacatgatgctattgattgactgccattttagacatttaggttatatcctgtgatccctattatctcatttgttctctgccacaggtgtctggaatgaggccagccttccttttctttggtaactatccttgggacttcctctcccatcaagccttgatttggaatgagactgtctctgagctcccttcttgctgtccccaaaaacaaattcatatggtt

SEQ ID NO: 197763 - DNA, 601 bp, Human
aatggaattcatcagatcagaactccctcaactttttgccaccaaacctccaaattcagctccatcagaatccatctttttctcttgttataacgcaagaagattccgctctctcatctacagctcttgcaactcaaattctaaaccccatgcttatataacgtttcagtaattttgtgctttaaattaatctttctccattttgtatcattaactctccttctctatctgttctttcctatcagcatttaaatatgctcaaatctttaaaaaataaataataaccctctctcaaccacayaaccccttcagcagttataatcctctctcttggccagacacagtggctgatgcctgtaaacctagcactttgggaggccgaggtgggtggatcacctgaggtcaggggtttgagacaagcctggccaacatggcaaaaccccatctctactaaaaatacaaaaattatttgggcgttgtggcacacgcctgtaatcccagctactcgggaggctgaagcaggagaatcacttgaaccttggagaaagaggctgcagtgagccgagatcgtgccactgcactccagcctgggtgacagagt

SEQ ID NO: 197764 - DNA, 601 bp, Human
aagtctcacagattggtgccattgtaagtaaattcaaggtcaaaaacctcaacactcccaacaaactgctttcctttcaacagtttcttccattccccatggcagctatttcaaatgttccagatttctctaaactgctactatttctgcccttagtctcaattttgtctcctccttctcggagaaaatggaattcatcagatcagaactccctcaactttttgccaccaaacctccaaattcagctccatcagaatccatctttttctcttgttataacgcaagaagattccgctctctsatctacagctcttgcaactcaaattctaaaccccatgcttatataacgtttcagtaattttgtgctttaaattaatctttctccattttgtatcattaactctccttctctatctgttctttcctatcagcatttaaatatgctcaaatctttaaaaaataaataataaccctctctcaaccacacaaccccttcagcagttataatcctctctcttggccagacacagtggctgatgcctgtaaacctagcactttgggaggccgaggtgggtggatcacctgaggtcaggggtttgag

SEQ ID NO: 197765 - DNA, 601 bp, Human
tttaaagtacttgaagacaaacaatcctctttaaagaaaggtataacttacaagagaattgtgtaatttgcatggatgttccctggctttccatggtcacagatgcatattatagtcacgtaagtataattttaaactttgggataactttcaatatactatgggagattctcccacagaacataaatgaattattttctaaagtaaccagctggaaagaaatacagtaaacacgaatagtgtggtggcaattttcctaggagtaattcttaaatcagaatttagaatacgttaatacaasttaattatatggcatatatttaaggatttaattttgcctttatccttttatttcattttgttgattcattaaaatactttttctttctttaggatactattttgtttccttttacttttgtgggcagtttgagtttgagatttttttaattttttttttttctgacaacttgcaaccatacaactttaagttgtaacctctatttatcttatagtgtcttcccactgactgtggaagaaaaacaattgaaaatgtgtaactaccattcacattaagaacaatccaagaacaaaatttagt

SEQ ID NO: 197766 - DNA, 601 bp, Human
ataaaactttcattatattccctttctgtactttgtcagtggtaagtattcatgcaaactgaatcatagtaagagttttagattaaaaaaaatcgatcaggaattgaatataaaatcattcctttaagaaacatttacttcccaagatgtatcactatctctaccattcctccacccccaatataaataggtaacttgccaattgatctcacatatattattttaagacatggcagaatttgttagaataatcacaggggcaacataaaaaactatgccacacatccgaaagataattttstgctttaaagtacttgaagacaaacaatcctctttaaagaaaggtataacttacaagagaattgtgtaatttgcatggatgttccctggctttccatggtcacagatgcatattatagtcacgtaagtataattttaaactttgggataactttcaatatactatgggagattctcccacagaacataaatgaattattttctaaagtaaccagctggaaagaaatacagtaaacacgaatagtgtggtggcaattttcctaggagtaattcttaaatcagaatttagaatacgttaata

SEQ ID NO: 197767 - DNA, 601 bp, Human; identical to SEQ ID NO: 24050

SEQ ID NO: 197768 - DNA, 601 bp, Human; identical to SEQ ID NO: 24051

SEQ ID NO: 197769 - DNA, 601 bp, Human; identical to SEQ ID NO: 24052

SEQ ID NO: 197770 - DNA, 601 bp, Human; identical to SEQ ID NO: 24053

SEQ ID NO: 197771 - DNA, 601 bp, Human; identical to SEQ ID NO: 24054

SEQ ID NO: 197772 - DNA, 601 bp, Human; identical to SEQ ID NO: 24055

SEQ ID NO: 197773 - DNA, 601 bp, Human
ctccacaccctgcctttctcactagggaaggcagggagagcaggagcactaagaatcttcctgaaaggatcctaaggtttccttacgccatccctcctattaagccctaattgcccgcattccagtttcattttcctaacatgagagcacagcctccagtttgcccaagtcacacacaaccacggcgctcagcagcccagccagacgcgcctcttgagggttgtttcttcatgtcctgccccgaattctgcagccgtgttcttccgtcaagttcttactccagccctattctatttgaaaycccaaagtcccttccaacaggctagggatatgttctaagcgtcagatgtaccacgagtgcattcttttggtaacatttgtttgaaaactctcattcctgccagaatctaatccctgtgagaacaggggttctgtgctatatttttccttatggaatcctccaggctgaccacagtgcctaccacagcgtagaaactcaatgtcatttctagaatgatcttccatgtgacgagaggtagacacccaaccgacaccctctcatctgtccctgtgcctatattttgccctgtacctctattta

SEQ ID NO: 197774 - DNA, 601 bp, Human
ttgtctaaaataaaacaaagacctagaatcccataaataacaaaaatgctgactccagccagggctttatgtggaagggcacacactccctctgcggcagtcagcccgggggggtgggggaggccttccatctcttacatctggaagcagtaaatggggggatcttgtgtttcacaatgttcttctgcatatctgctgaatgcgggaaacactgaagggtgactgacttgggtaggggaaagcaagcgaccacagagaaaaccaaagaacaggtgaggagtggaagcaccagtgagcatgyggcctcttcatcttctccacaccctgcctttctcactagggaaggcagggagagcaggagcactaagaatcttcctgaaaggatcctaaggtttccttacgccatccctcctattaagccctaattgcccgcattccagtttcattttcctaacatgagagcacagcctccagtttgcccaagtcacacacaaccacggcgctcagcagcccagccagacgcgcctcttgagggttgtttcttcatgtcctgccccgaattctgcagccgtgttcttccgtcaagttcttactccagccc

SEQ ID NO: 197775 - DNA, 601 bp, Human
ggccaaaccaaaaagtgcggattcttctcattttagtatccgtgtaaactttattggacaaggagggtgataaaaactgtgcatgtgagatgggggtgcagaatgagggtgggaactggcaaaccctgcttacttgttttcaaagtaggaacacagcaacaatattccactccggccaccagccccccgcagcagtgccagatgcacaggctcttcaccggtaccttatgaagtgaatcaagttcctctttccctgccctaggtgtccacaggatgatgctagctatatcaaagcatctgyaattattaagcaccagaattccagagctacttttaaatttaaacttttaacttcttttttaaaaaggcaaagcaagctcagtatctatttctaagccccacaaattctgaaaatcagagctaaatcaatgtctataaacagagaaaaatcaggaagcctctatactgggcagtaaaattatagattttcatttcttgctgcatatctcaagttttaaactgttctagagagaacatatgtaattattttaacaaggcacaatgcctttatgctaagctaaagctttaaaaccacacgtaa

SEQ ID NO: 197776 - DNA, 601 bp, Human
aacctcctctttacaaccctgatttttatttttcttagggacaaggtctcgctctgttgcccaggctggagtgcagtggcacagtcatagctcactgcagtgtccaactcctgggttcaaatgattcgtccacttcagtctcccgagtagctgggactacagccatgagccaccacacccaactaattaaaataaaaaaatttatagagatgaggccttgctatgttgcccatgctggtctcaaactcctggcctcaagcaatcctctcacctcggcctcccaaagtgcagggattacagtatgtgccactgcacccagctctacaatcctgatttttaaaaggaaatttcagaaggtataatttacaaagaacctctgtgctactgccttaaaaatcagtagctgggaaacagccagcgtgggttgtgatgagaagtggccaaaccaaaaagtgcggattcttctcattttagtatccgtgtaaactttattggacaaggagggtgataaaaactgtgcatgtgagatgggggtgcagaatgagggtgggaactggcaaaccctgcttacttgttttcaaagtaggaacacagcaacaat

SEQ ID NO: 197777 - DNA, 601 bp, Human
tgatctggacagatccaaactttctatcctggtttactgcccccttccccaaagccctagttataatatacaactttctactactataatgaaggcagcataacagagttctggaccttctactaactgtatgatataattttacctctttggactcagttttcttgtgtataaaatatgaagattaaaagacaaagggaaaaaagtaacattgctgcatacttattgtgggccaagcagacattgcataactcttcagtcctcttagcaacactgaaggaggaaaggtactgtcacttckgttttccatatgaggaatctgaaggtcagaaaatcctggtgaacttgcccaaggttgcctggtctaagttggagtccagtcccacatctgccccatccctcttttccctggtccctttccgctccaacatgctcctgtactttgcttaactgcaaccacgtgtgtctgggctccgaccaatccgaaaaggtttccagtcactccagtgaagatcgttttcactagggggccatggggcttcaatctcagagaagaggctaaaacatgtagccaggctaaaccggaacactggctaacacc

SEQ ID NO: 197778 - DNA, 601 bp, Human
agcaggtcttgcacacaggacttgcctgcactactacctccttcagcaattacaaaggttctcatctatattcataatggttcatggcctaaatctctcaaactctgataggtggacctgaaaccacatcaacaccaactcctgctctgattccatctatgtctgacctggttcagggatagaggatgagggaaggacagagtcactcaggttttcacagtcctgtgcccccttcatgccagtcctctccattacctgattcttttttttttttttttttttgagatggagtctcgctctsttgcccccgctggagtgcggtggtgcaatctcgggtcactgcaacctccgcctcccaggttcaagcaattcccgtctcagcctcccgagtagctgggattacaggcacacgccaccacgcctggctaatttttgtatttctagtagagacggggtttcactatattggtcaggcaggtcttgaactcctaacctcaggtgatccatccaccttggcctcccaaagtgctaggattacaggcgtcagccactgtgcccagcccactacccgattcttgacaatttctgatcctatacccaa

SEQ ID NO: 197779 - DNA, 601 bp, Human
ttctgtgaatgtcacaggggtccgtactaactgggagcagcaggtcttgcacacaggacttgcctgcactactacctccttcagcaattacaaaggttctcatctatattcataatggttcatggcctaaatctctcaaactctgataggtggacctgaaaccacatcaacaccaactcctgctctgattccatctatgtctgacctggttcagggatagaggatgagggaaggacagagtcactcaggttttcacagtcctgtgcccccttcatgccagtcctctccattacctgattcttttttttttttttttttttgagatggagtctcgctctgttgcccccgctggagtgcggtggtgcaatctcgggtcactgcaacctccgcctcccaggttcaagcaattcccgtctcagcctcccgagtagctgggattacaggcacacgccaccacgcctggctaatttttgtatttctagtagagacggggtttcactatattggtcaggcaggtcttgaactcctaacctcaggtgatccatccaccttggcctcccaaagtgctaggattacaggcgtcagccactgtgcccagccc

SEQ ID NO: 197780 - DNA, 601 bp, Human
tcagacattctgaacttctgtgaatgtcacaggggtccgtactaactgggagcagcaggtcttgcacacaggacttgcctgcactactacctccttcagcaattacaaaggttctcatctatattcataatggttcatggcctaaatctctcaaactctgataggtggacctgaaaccacatcaacaccaactcctgctctgattccatctatgtctgacctggttcagggatagaggatgagggaaggacagagtcactcaggttttcacagtcctgtgcccccttcatgccagtcctcwccattacctgattcttttttttttttttttttttgagatggagtctcgctctgttgcccccgctggagtgcggtggtgcaatctcgggtcactgcaacctccgcctcccaggttcaagcaattcccgtctcagcctcccgagtagctgggattacaggcacacgccaccacgcctggctaatttttgtatttctagtagagacggggtttcactatattggtcaggcaggtcttgaactcctaacctcaggtgatccatccaccttggcctcccaaagtgctaggattacaggcgtcagc

SEQ ID NO: 197781 - DNA, 601 bp, Human
tagcctgcagagcatctcagacattctgaacttctgtgaatgtcacaggggtccgtactaactgggagcagcaggtcttgcacacaggacttgcctgcactactacctccttcagcaattacaaaggttctcatctatattcataatggttcatggcctaaatctctcaaactctgataggtggacctgaaaccacatcaacaccaactcctgctctgattccatctatgtctgacctggttcagggatagaggatgagggaaggacagagtcactcaggttttcacagtcctgtgccccyttcatgccagtcctctccattacctgattcttttttttttttttttttttgagatggagtctcgctctgttgcccccgctggagtgcggtggtgcaatctcgggtcactgcaacctccgcctcccaggttcaagcaattcccgtctcagcctcccgagtagctgggattacaggcacacgccaccacgcctggctaatttttgtatttctagtagagacggggtttcactatattggtcaggcaggtcttgaactcctaacctcaggtgatccatccaccttggcctcccaaagtgctag

SEQ ID NO: 197782 - DNA, 601 bp, Human
tgtgagtcttcataaaaacttatgaatcaacgagctgctctcttctcctgcaaaaattatttctcctagtttgcaagtgggcctttacatgcgtacatgtgtgaagtatggttacgtggaaatgagggattccaccagccacacggggaaatcctacttggtaatatgctccatatacaccctctaaacatggatgaaggatgccagtccttgttgcagtgtgcatgtgagctggaggtctgtggtttgttcatgcaggccatgacactgagaaggcctctggtggagtgtgacttttgarttgtaaaccatgctgttgattgagcgtggctcccacagcctggatatgttgcctttagtttgcttcttccaaatccttacctgagaatgaacccacagctgtagttctatggcatgaaaacaagtcacttgcattgactgctctagtctcaagatggctctcaccctctgccaaggacaaggggtccgagcggtacttcctgctggcctggagctccctgagggcagcagccttctctgccctggtactgtgcacatcatgccagaaaaactcaagtccttgctgagtgaatatagatct

SEQ ID NO: 197783 - DNA, 601 bp, Human
aacagctcccgctcacagcgggccccagccactcaagtccagaagggtgtctcgccgcccttagcgtttccactggcatgatccctataggcccacacttgctttacctccacaagtctggtgtgagtcttcataaaaacttatgaatcaacgagctgctctcttctcctgcaaaaattatttctcctagtttgcaagtgggcctttacatgcgtacatgtgtgaagtatggttacgtggaaatgagggattccaccagccacacggggaaatcctacttggtaatatgctccatatacamcctctaaacatggatgaaggatgccagtccttgttgcagtgtgcatgtgagctggaggtctgtggtttgttcatgcaggccatgacactgagaaggcctctggtggagtgtgacttttgagttgtaaaccatgctgttgattgagcgtggctcccacagcctggatatgttgcctttagtttgcttcttccaaatccttacctgagaatgaacccacagctgtagttctatggcatgaaaacaagtcacttgcattgactgctctagtctcaagatggctctcaccctctgccaaggaca

SEQ ID NO: 197784 - DNA, 601 bp, Human
tttccactaaggcttgtctctaaatgtctgcctcacagacacgtgtaatcctgcccagatcaacaacagctcccgctcacagcgggccccagccactcaagtccagaagggtgtctcgccgcccttagcgtttccactggcatgatccctataggcccacacttgctttacctccacaagtctggtgtgagtcttcataaaaacttatgaatcaacgagctgctctcttctcctgcaaaaattatttctcctagtttgcaagtgggcctttacatgcgtacatgtgtgaagtatggttacttggaaatgagggattccaccagccacacggggaaatcctacttggtaatatgctccatatacaccctctaaacatggatgaaggatgccagtccttgttgcagtgtgcatgtgagctggaggtctgtggtttgttcatgcaggccatgacactgagaaggcctctggtggagtgtgacttttgagttgtaaaccatgctgttgattgagcgtggctcccacagcctggatatgttgcctttagtttgcttcttccaaatccttacctgagaatgaacccacagctgtagttctatggcat

SEQ ID NO: 197785 - DNA, 601 bp, Human
cccttcctgcccactcctggcagtttccactaaggcttgtctctaaatgtctgcctcacagacacgtgtaatcctgcccagatcaacaacagctcccgctcacagcgggccccagccactcaagtccagaagggtgtctcgccgcccttagcgtttccactggcatgatccctataggcccacacttgctttacctccacaagtctggtgtgagtcttcataaaaacttatgaatcaacgagctgctctcttctcctgcaaaaattatttctcctagtttgcaagtgggcctttacatgcrtacatgtgtgaagtatggttacgtggaaatgagggattccaccagccacacggggaaatcctacttggtaatatgctccatatacaccctctaaacatggatgaaggatgccagtccttgttgcagtgtgcatgtgagctggaggtctgtggtttgttcatgcaggccatgacactgagaaggcctctggtggagtgtgacttttgagttgtaaaccatgctgttgattgagcgtggctcccacagcctggatatgttgcctttagtttgcttcttccaaatccttacctgagaatgaac

SEQ ID NO: 197786 - DNA, 601 bp, Human
accccagctgcccttcctggacagctcccttcctgcccactcctggcagtttccactaaggcttgtctctaaatgtctgcctcacagacacgtgtaatcctgcccagatcaacaacagctcccgctcacagcgggccccagccactcaagtccagaagggtgtctcgccgcccttagcgtttccactggcatgatccctataggcccacacttgctttacctccacaagtctggtgtgagtcttcataaaaacttatgaatcaacgagctgctctcttctcctgcaaaaattatttctccyagtttgcaagtgggcctttacatgcgtacatgtgtgaagtatggttacgtggaaatgagggattccaccagccacacggggaaatcctacttggtaatatgctccatatacaccctctaaacatggatgaaggatgccagtccttgttgcagtgtgcatgtgagctggaggtctgtggtttgttcatgcaggccatgacactgagaaggcctctggtggagtgtgacttttgagttgtaaaccatgctgttgattgagcgtggctcccacagcctggatatgttgcctttagtttgcttc

SEQ ID NO: 197787 - DNA, 601 bp, Human
caactcaaccccagctgcccttcctggacagctcccttcctgcccactcctggcagtttccactaaggcttgtctctaaatgtctgcctcacagacacgtgtaatcctgcccagatcaacaacagctcccgctcacagcgggccccagccactcaagtccagaagggtgtctcgccgcccttagcgtttccactggcatgatccctataggcccacacttgctttacctccacaagtctggtgtgagtcttcataaaaacttatgaatcaacgagctgctctcttctcctgcaaaaattayttctcctagtttgcaagtgggcctttacatgcgtacatgtgtgaagtatggttacgtggaaatgagggattccaccagccacacggggaaatcctacttggtaatatgctccatatacaccctctaaacatggatgaaggatgccagtccttgttgcagtgtgcatgtgagctggaggtctgtggtttgttcatgcaggccatgacactgagaaggcctctggtggagtgtgacttttgagttgtaaaccatgctgttgattgagcgtggctcccacagcctggatatgttgcctttagt

SEQ ID NO: 197788 - DNA, 601 bp, Human
ggatgtaaccagagcattggatcaggagattcttctgaagtctcacacaggcttctagttaaatacacatcggataactgatttctgttccaaagcttcccagagatgagaattaggtttacatttacaaatgactgtagaaacagtatttattaggtcatatttacaaatgactgcagaaacaaccagatgctactactgttcctaatacttgtccctgcctctcagcgttcacctgatacctcccacctggttcaaaatcattcatctattgccctgccttgcaactgactgtgacagwccttcttcagacccatcaggctggtgtcagtgagggcgagtgacaccaccatccaactcaaccccagctgcccttcctggacagctcccttcctgcccactcctggcagtttccactaaggcttgtctctaaatgtctgcctcacagacacgtgtaatcctgcccagatcaacaacagctcccgctcacagcgggccccagccactcaagtccagaagggtgtctcgccgcccttagcgtttccactggcatgatccctataggcccacacttgctttacctccacaagtctggtgtgag

SEQ ID NO: 197789 - DNA, 601 bp, Human
ctcctcagtttgcagatggcctactttgggtccttttgatggtgtgagttaatgctccttaataaactcctatatatccatcctattagctctgtccctctagagaaccctgactaatacaccaccccactgccccaactgccaggatcgcttgccgcaaatgtcctcaaatgctggaatacttttcaggaattctctgagcacaacgtcagcaaagttgctaggggtagaattaaaaggggaaatctttgctcccatcttcatttgaccatttgcacaattatgttgctatcaagaccayggaataacaggccatggggaacactgacccggaatctgcaatcacatatggtaataaatggaagttaatgcctaaaaacatcccagatttccataaggatgaaggatagggatgtaaccagagcattggatcaggagattcttctgaagtctcacacaggcttctagttaaatacacatcggataactgatttctgttccaaagcttcccagagatgagaattaggtttacatttacaaatgactgtagaaacagtatttattaggtcatatttacaaatgactgcagaaacaaccagat

SEQ ID NO: 197790 - DNA, 601 bp, Human
caggcaggtcccaaacatgcccacacctccttcgtctgtgtgtggagacatccttcatccttgaggaggcggggtccaggtcacctgtgcctggctgggttttctgatttttcaacacttgctcctaaccctcagaaccttttttcttttcattcctagtccatctccagtttccaacttcccggctccccactatcccagaggatttgctgaagagggacgggggtaggggtaggaggctgacacggtacttcgcaaaacatctcatcaccagaaaaaaaatcagctgaccacaaaccckcctcaatgaaagggaagaaaatttgaagtcacaatgtccaaattcctacaaatacacattgttccagaaaataggactgcccgtagaaatttacatgccaaccatttgaatatacaaggcatctgcttcacttctgcctagttcaaagggagccacattcccatctactacctttggtcagcttttggacaatgggtgctgaaggtgttttgtcaagaaacacagcctacgctggtcatttttcatttggcaccagttggttccatctggctatttttaaacataagtaaatattacagc

SEQ ID NO: 197791 - DNA, 601 bp, Human
tctgtcgcccaggctagagttcagtggcattatcagagctcactgccgtctcaaccgtctgactgagctcaagcaatcctcgcacttagcctcctgagtagctgaaaccacagacacgtgccaccttgcttggctaatctgtttattatttgtagaggcaaggtctcactatgttgcccaggctggtctcaaactcctgggctcaagggatccttccgcctaggcctcccaaagtattgggatgacaggtgtgagccactgcgcctggcccagtgttgctattttttgaacagaaatgctrtatttaaaaaagggtgttagcaaccttagttatatctacacaagcaaggggttgcaagctgagtgctgggaagcaaagctgtaacaattggagtctgaaatgcttgtaggttttacaagacagaatcacttcaaaagctggggacttaaatactatattaggtaagtccacgtagctatttctagggacgcctatttaaatgaaaaatagcttaaatttggcccttacggccttctgacataacctactgatcagcaggcagtgtgtgtgggtcgcttgggctcaagaaacagggcaagc

SEQ ID NO: 197792 - DNA, 601 bp, Human
tgagtcctctggggccaaaggacactgtaaggcatccagacatccacagaaagccaaaaagcagtctttagagactgataaataaaagctcagtgactatgacgttagagcctacctttttttttttttttaatttcagagaggggccttcacttttacaacagtctggaaacccttggagaaattagactgtgatatgataacctctggtaccaagaggagagagctgtccaaaagtggaagagatcgtttctggcttaaggtgtgatgaaacaaaacaggagacaccaaaaagaagtgyggaaaagctaggtctcagagtagggcggcaggctgaggagggccgcgctgaggaggaagtggatgggtgccaggggatgaactcacagggagaccctttagaaggggatgactgcctgatctgtttccatggactcttctatttttattaggattatccatttctcttcctacaagctcttttgctttttgtccacccttaagttataatgtatatactgtttaaaaacatttaagtgatacagaagtatatcaaggaaaaatgatgactattagtagtttggtaaattcctcccagtct

SEQ ID NO: 197793 - DNA, 601 bp, Human
atacttctaaaatgttacctatattctttttgagactatttccactattttatctcctcaccaagcgcaatatcatctgttagaaacttcactttcttgcatagcatctctaacagttaaaatcatcagctacaaaacatatgcatgtgcagacacaggtctttattagttttaggtgcaacatttataggtgtgcagatttgacatcgctgtgcacctttctctaagtcgtcttcatctgttagcttcctgagtatatttgctatgtgcaagaactcctaatgatggataaggcggcagrgcctagcctcccacagtagcagcagtagtctttacaggtagcaggtctccaatgtgagctgctgagtcctctggggccaaaggacactgtaaggcatccagacatccacagaaagccaaaaagcagtctttagagactgataaataaaagctcagtgactatgacgttagagcctacctttttttttttttttaatttcagagaggggccttcacttttacaacagtctggaaacccttggagaaattagactgtgatatgataacctctggtaccaagaggagagagctgtccaaaagt

SEQ ID NO: 197794 - DNA, 601 bp, Human; identical to SEQ ID NO: 23851

SEQ ID NO: 197795 - DNA, 601 bp, Human; identical to SEQ ID NO: 23852

SEQ ID NO: 197796 - DNA, 601 bp, Human; identical to SEQ ID NO: 23853

SEQ ID NO: 197797 - DNA, 601 bp, Human; identical to SEQ ID NO: 23854

SEQ ID NO: 197798 - DNA, 601 bp, Human; identical to SEQ ID NO: 23855

SEQ ID NO: 197799 - DNA, 601 bp, Human; identical to SEQ ID NO: 23856

SEQ ID NO: 197800 - DNA, 601 bp, Human; identical to SEQ ID NO: 23857

SEQ ID NO: 197801 - DNA, 601 bp, Human; identical to SEQ ID NO: 23858

SEQ ID NO: 197802 - DNA, 601 bp, Human; identical to SEQ ID NO: 23859

SEQ ID NO: 197803 - DNA, 601 bp, Human; identical to SEQ ID NO: 23860

SEQ ID NO: 197804 - DNA, 601 bp, Human; identical to SEQ ID NO: 23861

SEQ ID NO: 197805 - DNA, 601 bp, Human; identical to SEQ ID NO: 23862

SEQ ID NO: 197806 - DNA, 601 bp, Human; identical to SEQ ID NO: 23863

SEQ ID NO: 197807 - DNA, 601 bp, Human; identical to SEQ ID NO: 23864

SEQ ID NO: 197808 - DNA, 601 bp, Human; identical to SEQ ID NO: 23865

SEQ ID NO: 197809 - DNA, 601 bp, Human; identical to SEQ ID NO: 23866

SEQ ID NO: 197810 - DNA, 601 bp, Human; identical to SEQ ID NO: 23867

SEQ ID NO: 197811 - DNA, 601 bp, Human; identical to SEQ ID NO: 23868

SEQ ID NO: 197812 - DNA, 601 bp, Human; identical to SEQ ID NO: 23869

SEQ ID NO: 197813 - DNA, 601 bp, Human; identical to SEQ ID NO: 23870

SEQ ID NO: 197814 - DNA, 601 bp, Human; identical to SEQ ID NO: 23871

SEQ ID NO: 197815 - DNA, 601 bp, Human; identical to SEQ ID NO: 23872

SEQ ID NO: 197816 - DNA, 601 bp, Human; identical to SEQ ID NO: 23873

SEQ ID NO: 197817 - DNA, 601 bp, Human; identical to SEQ ID NO: 23874

SEQ ID NO: 197818 - DNA, 601 bp, Human; identical to SEQ ID NO: 23875

SEQ ID NO: 197819 - DNA, 601 bp, Human; identical to SEQ ID NO: 23876

SEQ ID NO: 197820 - DNA, 601 bp, Human; identical to SEQ ID NO: 197773

SEQ ID NO: 197821 - DNA, 601 bp, Human; identical to SEQ ID NO: 197774

SEQ ID NO: 197822 - DNA, 601 bp, Human; identical to SEQ ID NO: 197775

SEQ ID NO: 197823 - DNA, 601 bp, Human; identical to SEQ ID NO: 197776

SEQ ID NO: 197824 - DNA, 601 bp, Human; identical to SEQ ID NO: 197777

SEQ ID NO: 197825 - DNA, 601 bp, Human; identical to SEQ ID NO: 197778

SEQ ID NO: 197826 - DNA, 601 bp, Human; identical to SEQ ID NO: 197779

SEQ ID NO: 197827 - DNA, 601 bp, Human; identical to SEQ ID NO: 197780

SEQ ID NO: 197828 - DNA, 601 bp, Human; identical to SEQ ID NO: 197781

SEQ ID NO: 197829 - DNA, 601 bp, Human; identical to SEQ ID NO: 197782

SEQ ID NO: 197830 - DNA, 601 bp, Human; identical to SEQ ID NO: 197783

SEQ ID NO: 197831 - DNA, 601 bp, Human; identical to SEQ ID NO: 197784

SEQ ID NO: 197832 - DNA, 601 bp, Human; identical to SEQ ID NO: 197785

SEQ ID NO: 197833 - DNA, 601 bp, Human; identical to SEQ ID NO: 197786

SEQ ID NO: 197834 - DNA, 601 bp, Human; identical to SEQ ID NO: 197787

SEQ ID NO: 197835 - DNA, 601 bp, Human; identical to SEQ ID NO: 197788

SEQ ID NO: 197836 - DNA, 601 bp, Human; identical to SEQ ID NO: 197789

SEQ ID NO: 197837 - DNA, 601 bp, Human; identical to SEQ ID NO: 197790

SEQ ID NO: 197838 - DNA, 601 bp, Human; identical to SEQ ID NO: 197791

SEQ ID NO: 197839 - DNA, 601 bp, Human; identical to SEQ ID NO: 197792

SEQ ID NO: 197840 - DNA, 601 bp, Human; identical to SEQ ID NO: 197793

SEQ ID NO: 197841 - DNA, 601 bp, Human; identical to SEQ ID NO: 23851

SEQ ID NO: 197842 - DNA, 601 bp, Human; identical to SEQ ID NO: 23852

SEQ ID NO: 197843 - DNA, 601 bp, Human; identical to SEQ ID NO: 23853

SEQ ID NO: 197844 - DNA, 601 bp, Human; identical to SEQ ID NO: 23854

SEQ ID NO: 197845 - DNA, 601 bp, Human; identical to SEQ ID NO: 23855

SEQ ID NO: 197846 - DNA, 601 bp, Human; identical to SEQ ID NO: 23856

SEQ ID NO: 197847 - DNA, 601 bp, Human; identical to SEQ ID NO: 23857

SEQ ID NO: 197848 - DNA, 601 bp, Human; identical to SEQ ID NO: 23858

SEQ ID NO: 197849 - DNA, 601 bp, Human; identical to SEQ ID NO: 23859

SEQ ID NO: 197850 - DNA, 601 bp, Human; identical to SEQ ID NO: 23860

SEQ ID NO: 197851 - DNA, 601 bp, Human; identical to SEQ ID NO: 23861

SEQ ID NO: 197852 - DNA, 601 bp, Human; identical to SEQ ID NO: 23862

SEQ ID NO: 197853 - DNA, 601 bp, Human; identical to SEQ ID NO: 23863

SEQ ID NO: 197854 - DNA, 601 bp, Human; identical to SEQ ID NO: 23864

SEQ ID NO: 197855 - DNA, 601 bp, Human; identical to SEQ ID NO: 23865

SEQ ID NO: 197856 - DNA, 601 bp, Human; identical to SEQ ID NO: 23866

SEQ ID NO: 197857 - DNA, 601 bp, Human; identical to SEQ ID NO: 23867

SEQ ID NO: 197858 - DNA, 601 bp, Human; identical to SEQ ID NO: 23868

SEQ ID NO: 197859 - DNA, 601 bp, Human; identical to SEQ ID NO: 23869

SEQ ID NO: 197860 - DNA, 601 bp, Human; identical to SEQ ID NO: 23870

SEQ ID NO: 197861 - DNA, 601 bp, Human; identical to SEQ ID NO: 23871

SEQ ID NO: 197862 - DNA, 601 bp, Human; identical to SEQ ID NO: 23872

SEQ ID NO: 197863 - DNA, 601 bp, Human; identical to SEQ ID NO: 23873

SEQ ID NO: 197864 - DNA, 601 bp, Human; identical to SEQ ID NO: 23874

SEQ ID NO: 197865 - DNA, 601 bp, Human; identical to SEQ ID NO: 23875

SEQ ID NO: 197866 - DNA, 601 bp, Human; identical to SEQ ID NO: 23876

SEQ ID NO: 197867 - DNA, 601 bp, Human
ctgaagactgtttctcatctcagcaaacagaatgcttaagatcagatggctagccacaaaccaaaagttagaagccacacaaaaataaacactagcagtcctaaaattttctactttcagtctctaacaaaagcagtaacatcatttttatttgtgatgccctaagttagagccataagctttttcccctgattatactaataaatcaatttaaaatgataattttacatcagattatgtccttcatatactagcatactttaaataaatccattttaccatggtaggttcttcaactcattttttttgtattttttctgtatcattccttaactaccacattatttctccattatttttctaaatattacatctatgaacaaaaaagataaccctgcaaaccctagaaaagataaatcaacatataccttaagtataaaatatcaatattaagtataacctattaggtaaccaagagaaaggtaagcatcaactgtatgcccaggaatctcaatttaagacatcatgtagtatacactattttggtaaacagaactgtatacaatatttgcatatcaaaataggcaactatagccttatt

SEQ ID NO: 197868 - DNA, 601 bp, Human
caggatatagtgttacaagccataaattctttttaaacttcagattcttatttttcaagttcctccaaacaaattaaaaagacaaatgatttgactgttcattaccatatgacttttaataaaaagtaggggcaagggagagtaccttcttgttgtaatatatctacattaacgaaacaacttctatgtttgcaaagtgttgtctgatttataagctacatttatcaaccattaagtcaggacagcataatggccatgaaataataatacataaattaagtaatctctggtaaaactgtgyatgaagttatcagaagcaatagtggctgatttctaaactttaaaatcatgaccacatgcgtcctccctttccttcaaataaccaccagagtgtaggtaagtaaataaataaaatcactaaaatatcttagaatatctttccttacagaatgtattttaaccagaaaacctcatccactcctaatttgtttctcaataatattcatccactctgtccaaccctcaatttatcagtaaagaattcatgatattccaaaaagctaatgtaattattactgtcatctcattaagtgtgctcttc

SEQ ID NO: 197869 - DNA, 601 bp, Human
tgaattatcaaaagataattctatatactgcaggaacaaaatcagttgtggtgaatgataacttttggtttgcttacaatcaagcagtttctcccctgctaaagaaagaagtcagatttcttcaacctttctaccagtagatagatgggaacactgactatatgcaaattccaaatatctctaagatttagagcaccatgcctcaaaccattaacttattttttttttaagtgaaagcaaaaactcttaaaatgtagctggactggtgaacaaggaatttaagaatgtaatgataatgctrcatgatattgtaaggtgttaaattcctggacaggatatagtgttacaagccataaattctttttaaacttcagattcttatttttcaagttcctccaaacaaattaaaaagacaaatgatttgactgttcattaccatatgacttttaataaaaagtaggggcaagggagagtaccttcttgttgtaatatatctacattaacgaaacaacttctatgtttgcaaagtgttgtctgatttataagctacatttatcaaccattaagtcaggacagcataatggccatgaaataataatac

SEQ ID NO: 197870 - DNA, 601 bp, Human
aaaattgaacaaaaacaattcaaccaatactaagctcttgcaagactagcaattcttttaaaaggataaaaatgagatgaaaaattactagaaataatcacatcagggtttttgtatttatattttgtatttagaggtacttttctctacccagttttctgaattatcaaaagataattctatatactgcaggaacaaaatcagttgtggtgaatgataacttttggtttgcttacaatcaagcagtttctcccctgctaaagaaagaagtcagatttcttcaacctttctaccagtagayagatgggaacactgactatatgcaaattccaaatatctctaagatttagagcaccatgcctcaaaccattaacttattttttttttaagtgaaagcaaaaactcttaaaatgtagctggactggtgaacaaggaatttaagaatgtaatgataatgctacatgatattgtaaggtgttaaattcctggacaggatatagtgttacaagccataaattctttttaaacttcagattcttatttttcaagttcctccaaacaaattaaaaagacaaatgatttgactgttcattaccatatg

SEQ ID NO: 197871 - DNA, 601 bp, Human
aaatcccagaagtgctctagctaagaaagggcaaaatgaagaaacgagaacttgaaaacctagtttttttaatcagatattcacatttattactgtaaacaggagtaaacaagggagtaaaaatgtgtctagcaccgactctactatattcaagatgaattcattcattcaacaggcactcaaaaaaaaggaaaatacctgcagtaggatttacccctaaaatctccagagggtactgtcttgcagcaaatatcttcctcgtaactattatatacatcatttttcattcatcattaggcattttttttaaaaaattcattcaatagcattctctgctcttaattttttaaatggttatgctgagtttttttctctctcttcaaaacacaaaaccaaaaaataaactaacgttttgtaaccctgatagttttgatcttaggagtcagccattcagaacagaagtactccataactcccctacaaaatggcactcttcagacttccactgttcctttaaaggtaaaaacataattttagatttcaaggtgttattgagatctattaggataacgtatttcccaatttagccccccaaacaacc

SEQ ID NO: 197872 - DNA, 601 bp, Human
cctttgcatacgaggcaccaaaataagaagagaacaattaaaatacacacacaaaaacagcctgggttccttatggatttgaaatacccttatattggagaagggacaacacacaatctctatcaattctcaccaatcctttttattcggcattggtagaatataggccacagcataaatattactatgacactttttccctctccgcttctctcctctcctgaacaagacagctacagtttgtgaattcagtattggctagctaactgaaatgttaaggatctaggctaggagttcttayctattgagctacaagtataaagactcccttttaaacactaaaatacatcaaaaacccacaaacatgcaaaaagaaattatcctttccgtatctgttccctgagaaaatgcaaacctatatagcactgttgtgagttgttaatttttagttcattgtgaactttatcaattaaaacaacatccactcacactgaacagcagatgtgggcaatgctatgtgtgaatgcagtctcagcttctcagatctcctcatctcacaaactcctcagccctccttgggtttacctaggcagactgggaa

SEQ ID NO: 197873 - DNA, 601 bp, Human
ctactaaaaatacaaaaattagccgggcgtggtggcgcgggcctgtaatcccagctactctggaggctgaggcaggaaaattgcttgaacctgggaggcagaggttgcagtgagctgagatcgctccactttactccagcctgggcaaaagagcaaaactccatttcaaaaaaaaaaaagaaaaagaaatgctcatagcagcactattcctaataaccacaaactgtaagcctcccaaatgctcattaatagaatgaataaactgaggtatattcatgaatactgtacagatatgagactkaattaattacaactacacacaacaatatggatgaacctcacataggtaacctcacataggtaacagaccaaaagcttatccagagggtttctatttatataatgttcaaaacagatacaactgaactgtcatatgcaaaaaattgaatctcaatctttaccttaatactaaaaccccaaatgaatcacagacttaaatgttaagatcctaaaactcctaaaagtcaatctagcagaaaatattagtgaccctaggcttggcaaagatttcttaggcacaacacacacacacacaaaacaa

SEQ ID NO: 197874 - DNA, 601 bp, Human
gagaaatggagggaaaggtaagagaaggaaaaaaatatatacaataccaaattgaaaagaacctggagcatacacagttggtggaagtatagagtggtacattcactttggaaaactgacaatacccactaaaactcagcaactgcactcctaggaatatattaaacaaatgcatgcaagcttcattaaccaaaagacatgtatggaaatgctcacggcagactgggcaaggtggctcacacctgtaatcctagcactttgggaggctgaggtgggtggactgaggtcaggagtttgagaycagcctggccaacaaggcaaaaccccgtgtctactaaaaatacaaaaattagccgggcgtggtggcgcgggcctgtaatcccagctactctggaggctgaggcaggaaaattgcttgaacctgggaggcagaggttgcagtgagctgagatcgctccactttactccagcctgggcaaaagagcaaaactccatttcaaaaaaaaaaaagaaaaagaaatgctcatagcagcactattcctaataaccacaaactgtaagcctcccaaatgctcattaatagaatgaataaactgaggta

SEQ ID NO: 197875 - DNA, 601 bp, Human
atgacacctgcaaatttaacttcccttgtaaacacagagagcatatggctcaggcttggagcctttatcagacaacagaatctagacagggtttaacagtcatttttttttttaaggcaaacaatacaggttctctattgctggtggagacacaaagattcctttttaaagaaaattaagctttaaaaagcattaaaaggttttacatttattttaagaaatttaaaaataaaaaagaatggccgggtgcagtggctcacacctgtaaacccagcacattgggagtccgaggcaggcagakcaagaggtcaggagactgagaccaccctaacacagtgaaaccccgtctctactaaaaatacaaaaagttagccaggcgtggtggcacgcgcctgtagtcccacctactctggagggggaggcaggataattgcttgaacctaggagacagttgcagtgagccgagatcgtgccactgcactccatcctgggtgacagagcaagactccatctccaaaaacaaaaaaaaaaggaaagcatgatatgaggccaggtgcggtggatcacgcctgtaatcccagcacttcgggaggccgaggca

SEQ ID NO: 197876 - DNA, 601 bp, Human
tctactaaaattagtcttaatttcttccagccccagtacataaaagattgttacaaaaggaatctgcactatgactgttgaaagtagagtttttattgttgctattgttattataatagctgctcacatttgttcagaacctccctgataaattcatcataatctacattgctggagcagaagaggatcccaaagagaagaggaagtgccactgctgacatgcaaaattatcttaggtgatacttgaaacctggtattgaattacactgaatcaaatactgaggaagttattccttttccraggttctttcaatctgtctgggtgtatgagaacaactctcactttggtgctaacacatatttatgtccctttatgacacctgcaaatttaacttcccttgtaaacacagagagcatatggctcaggcttggagcctttatcagacaacagaatctagacagggtttaacagtcatttttttttttaaggcaaacaatacaggttctctattgctggtggagacacaaagattcctttttaaagaaaattaagctttaaaaagcattaaaaggttttacatttattttaagaaatttaaaa

SEQ ID NO: 197877 - DNA, 601 bp, Human
ggagttcaagaccagcctggccaacatggtgaaaccctttctctactaaaaatacaaaaattagctggacgtgctggtgggcacctgtaatcccagctactcaggaggttgaggcaggagacttgcttgaacctgggaggcagaggttgcaatgagtcaagattgcactccagcctgggcgatagtgtgagtccatctcaaattgaaaaaaaaaaaaagagagagagcgagaacaagaaaaatgcacatctgtcagggctcttcctattacatacagttaataccttattgaattttgtamtgttattttagtatggctattagagcagtgatctgcagtgtttggcatgcctcaaatgtcagaaaaatccagagacacacctgtgagcatcaagataattttacttccattatttcaatctacagctaatgcttagtaatcacagtatttaaaaatcccctacaataagtctgcacaagtctgtggctcacaaattgagaatcaatgtgctatagcacagaagaaaaatatttaccataggctgaatctgaagaggagatactcttattgttaaggctgttttgagttactgttttgttt

SEQ ID NO: 197878 - DNA, 601 bp, Human
gcacatctaggccaggcacagtgactcttgcctgtaatcccagcactttgggaggctgaggcgggcagatcacctgaggtcaggagttcaagaccagcctggccaacatggtgaaaccctttctctactaaaaatacaaaaattagctggacgtgctggtgggcacctgtaatcccagctactcaggaggttgaggcaggagacttgcttgaacctgggaggcagaggttgcaatgagtcaagattgcactccagcctgggcgatagtgtgagtccatctcaaattgaaaaaaaaaaaaagagagagagcgagaacaagaaaaatgcacatctgtcagggctcttcctattacatacagttaataccttattgaattttgtactgttattttagtatggctattagagcagtgatctgcagtgtttggcatgcctcaaatgtcagaaaaatccagagacacacctgtgagcatcaagataattttacttccattatttcaatctacagctaatgcttagtaatcacagtatttaaaaatcccctacaataagtctgcacaagtctgtggctcacaaattgagaatcaatgtgctatagcac

SEQ ID NO: 197879 - DNA, 601 bp, Human
gactgaatggcaacaacaaactgaggctaaattcagtgtcgtggcttgagggggaagaaggagctgactaccatcataaaccataatttctctactgacctttatctcttttatcagacaacacagagttcgtctatattaatttatctttccctttaaaactgaacatttaagaaactacactccttttactttaaaactgttttatgttagtagaacattaaaaagaggatataacaccaggcaagtaatatgatggcagataactgaatatttttctccttaaatgatgacagaaaaktaagcagctccttaaaataaaaaatgctcaaaataactttatacaaggacaaataactgagtgcagtttcctttaaattactaatttgagttacaatgaaggaaataaactcttgcctgtaaaatataatactgtcaggatagaaagggcaaaagaattttaaaaaaacaaaaacagagtagggtggagcttaggaaacaaagggcaaaaggaagcaatattcatttaggaactaaagaacaataaaggaaacaatcttcatttctaaatttaaaaagaaaggttaaaataacagttcac

SEQ ID NO: 197880 - DNA, 601 bp, Human
acaggacaacgccatagcaataaatacatcaatacaccttttccttcaacaaaaggcaccccaaaaaactgacagccctaaactgaggcaaaggtcacatgtaaaagatctggtgtttcttatatcacaggcacccaagggttcctctagagaagtctttcatttattcaaacacagactgtcaaattataactgatgaatactcagtaagaaaggaggcaagcttttttcttttctttttttagagacagggtctcactatgttacccaggctggtcttgaactcctggggtcaagctaygctcctgccttggcctcccaaagtgctgggattactggtgtgagccactgtaccctgccacaagcattttttatgaaaaagactgggctgaacagcaacaacaaaaattctttcctctaagcttaatcccacaaggcttccttttcaataaatgaatataataacacctaccatcatttaattgtaaaccttccacagctctgcattaaacagaggcttctcctacaggctaaagattgtgctggtcccaggaaaaagatgtcctttttgcatactgggcccaaagagtattttaataat

SEQ ID NO: 197881 - DNA, 601 bp, Human
ccctcccagctactcaggaggctgaggcaggagaatcacttgaacccaggaggcggaggggaggttgcagtgagccgagatggtgccattacactccagcctgggcaacgggagcaaaactctgtctaaacaaacaaacaaacaaacaaacaaacatactttgtaccacatgcccttacatgcaaacaatgcaagaaaaaaaaaacaaaaacctgatgtgttgcatcactggacaaaagttggctgtgttggatttacagaagtatgtcatcagtcactgtaatttcacatttggagatayacaggttttcccttacatgcatgcaaaacactaggccactgactcctaatagggatttttaagttcgaaattacaaaatgtaccaaatcacaccaaggaactaaatggagccttgttcttagaaaaagttaacttcagtagatctactttaaaaacatttaaattggaagaatattttttggaaaatgcttgacttgtactgatctaaaagctcttctccaaattcatcatgaatatctggtccaaagaatcggaaaacctttagtggtccccataaaacctgtaattccattaaacaag

SEQ ID NO: 197882 - DNA, 601 bp, Human
tattcttacgcatatgacctagaatgaggatgacatatgatatgtaaatatttttctcatatgagctcttgttgcccatgtgcctctcaaagcatgaccatttcactgagctaagcgttattctactgttaaaaagtcgtggctactttggccaggcacagtggctcacgcctataatctcagccctatgggagtccgagggaggtggatcacctaaggtcaggagtcaagaccagcctggccaacatggtgaaaccctgactctactaaaaatacaaaaaattagccagacatggtggcrggcacctgtaatccctcccagctactcaggaggctgaggcaggagaatcacttgaacccaggaggcggaggggaggttgcagtgagccgagatggtgccattacactccagcctgggcaacgggagcaaaactctgtctaaacaaacaaacaaacaaacaaacaaacatactttgtaccacatgcccttacatgcaaacaatgcaagaaaaaaaaaacaaaaacctgatgtgttgcatcactggacaaaagttggctgtgttggatttacagaagtatgtcatcagtcactgtaatttca

SEQ ID NO: 197883 - DNA, 601 bp, Human
tgaggcaggagaacggcgtgaacccgggaggcagagcttgcaatgagccgagatcgtgccactgcactccagcctgggtgacagaccgaagctccatctcaaaaaaaaaaaaaaaattcaaaggttaaaccaggctggtctaggagagggtggaaaataacaaaactgtcaattctgtccacgtgtgctagttgtgtctgttctatttgatgaccaaggacatcacacctcgtctctcagccttcttgaggcatataaatggaagtgactggagaaaagacatgaagagcacatcctgttycacacatctgcagcctgatgcgggccaccttgtacatataaacaatggacatctttgttgttcagatattatactctgaggcataggggtttggagctccaaaacatagcttttagagcatctctaatattaactggtatgtgacattcttaagtcatacacttactggtttttttaatctacaaagtgagaataaagccatctacattacttatcaacaaggatttttttaaagaactaaatagtgaacaggaaaatgctctgtaaaatgaaaggcatttaagttatttcttccctggc

SEQ ID NO: 197884 - DNA, 601 bp, Human
gccactgcgcccagtcggccttaacaatcttttaaatcatctccggaaaaggttggtactacttaaaggaagcaaattttatagtcctaaaaagtcagaatcacatttatatttaaacaccagtatcctagcctaagaaatcacacagttctcttcagatagaaaagaactggattaggggtggtggcacaagtacttaattccaatactttcagaggatgaggaaacaagattgtttaagtccaggaatctgagagtagactgagcaacacagcgagatgccatctttacaaaaaatttaaaaaaaaaaaaaaaaaaaaagtcaggcatggtggtgtgcacctatagtctcagctacttgggaggctgttgtgggagaatcatttgagctccagggttgaggctgcagtgagctatgatcataccactacactccagcctggtaacagagcaagaccctacctcttaacaaaaaacaaataaacaaacaaaaaagatttgaaactaaaaattcaaaggttagtccgggcgcgatggctcacgcctgtaatcccagcactttaggaggcccgaggcaggcagatcacgaggtcaggagatt

SEQ ID NO: 197885 - DNA, 601 bp, Human
agccactgcgcccagtcggccttaacaatcttttaaatcatctccggaaaaggttggtactacttaaaggaagcaaattttatagtcctaaaaagtcagaatcacatttatatttaaacaccagtatcctagcctaagaaatcacacagttctcttcagatagaaaagaactggattaggggtggtggcacaagtacttaattccaatactttcagaggatgaggaaacaagattgtttaagtccaggaatctgagagtagactgagcaacacagcgagatgccatctttacaaaaaattwaaaaaaaaaaaaaaaaaaaaagtcaggcatggtggtgtgcacctatagtctcagctacttgggaggctgttgtgggagaatcatttgagctccagggttgaggctgcagtgagctatgatcataccactacactccagcctggtaacagagcaagaccctacctcttaacaaaaaacaaataaacaaacaaaaaagatttgaaactaaaaattcaaaggttagtccgggcgcgatggctcacgcctgtaatcccagcactttaggaggcccgaggcaggcagatcacgaggtcaggagat

SEQ ID NO: 197886 - DNA, 601 bp, Human
aacaaaatgcatcactaaaaagaagaagtttaattcttggtattttaattgactgtattaaccacctattttttttaaaaaaagttttttatttttatagagatggtacctcactatgttgcccaggctggttttgaactcctgggcttaagtgatcctcttgccttgtgactcccaaagtactgggattatagggcatgagctgtcatgcttggccttaacaatcttttttttttttttttgagacagagtttcactcttgttgcccaggctggagtgcaatggtgcaacctccacctcycgggttcaagcgaatctcctgcctcagcctctcgagtagctgggattacaggcatgcaccaccacacccgattaattctgtatttttagtagagaggggtttctccatgctggtcaggctggtctcgaactaccaacctcaggtgatctgcccgcctcggcctcccaaactgctgggattacaggcgtgagccactgcgcccagtcggccttaacaatcttttaaatcatctccggaaaaggttggtactacttaaaggaagcaaattttatagtcctaaaaagtcagaatcacatttat

SEQ ID NO: 197887 - DNA, 601 bp, Human
ctattaactgaacaaaatatgacaattaaatggtacctaacaaaatgcatcactaaaaagaagaagtttaattcttggtattttaattgactgtattaaccacctattttttttaaaaaaagttttttatttttatagagatggtacctcactatgttgcccaggctggttttgaactcctgggcttaagtgatcctcttgccttgtgactcccaaagtactgggattatagggcatgagctgtcatgcttggccttaacaatcttttttttttttttttgagacagagtttcactcttgktgcccaggctggagtgcaatggtgcaacctccacctctcgggttcaagcgaatctcctgcctcagcctctcgagtagctgggattacaggcatgcaccaccacacccgattaattctgtatttttagtagagaggggtttctccatgctggtcaggctggtctcgaactaccaacctcaggtgatctgcccgcctcggcctcccaaactgctgggattacaggcgtgagccactgcgcccagtcggccttaacaatcttttaaatcatctccggaaaaggttggtactacttaaaggaag

SEQ ID NO: 197888 - DNA, 601 bp, Human
aatgacgatgtcctttaagtacatcactgatgatcaaagtgccaataatgcctacacaactacaaataacaccggagtgccatacataccaaaaaacacacacacacataaacacacacacacacacacacacacacacacagaagttataccttttcttggtttttaattgttcaaagtttttaactattaactgaacaaaatatgacaattaaatggtacctaacaaaatgcatcactaaaaagaagaagtttaattcttggtattttaattgactgtattaaccacctattttttttaaaaaaagttttttatttttatagagatggtacctcactatgttgcccaggctggttttgaactcctgggcttaagtgatcctcttgccttgtgactcccaaagtactgggattatagggcatgagctgtcatgcttggccttaacaatcttttttttttttttttgagacagagtttcactcttgttgcccaggctggagtgcaatggtgcaacctccacctctcgggttcaagcgaatctcctgcctcagcctctcgagtagctgggattacaggcatgcaccaccacacccgattaat

SEQ ID NO: 197889 - DNA, 601 bp, Human
caaagagaatgcagatgagaagagcaacagacctacgacagtgacactgaggaagggccaacatttagataaaaccaacaaagaaactgagaggtactgctttgggttcaacttctatctacttcttcactaatcaaagacagaaaccttttctattaaagcatatatattttttttcagtgccaaatactgaagtattggagtactgaagacaatcaactataaattttaacaatttcagtaagttgccagcagttagtgacagcaatctttcactttccctgaactgtcagagagaaawggattccacttaagtgacatttcccaataaaggaagcttttccctttttgtgaacagctcatagctcaaattcttccaagagccaggcaggtgagtgagaagcactaagattcagacagtaaatgctgggtcctagttctactggagtgggcctgtgcctcctaagggcattcacattcagtcttctgtagagaaaacttgagggccctggtacttgcggtaccatgtgacctagaaatccaaaccatgcttccatgggctttttaacgactgcacaaggccacatagtaacaaactttc

SEQ ID NO: 197890 - DNA, 601 bp, Human
gataaagcctgtgggccccactgttgtagaccctggcaattaacaactagcatgagtaggaagcctggcagagagaggataatggctctagcagctgctgcaaaaagaaaagctggaaggttacatcggcaaaaatccttactatttgctagagtaagattagggaacttaattctattcttacatagaccttacaaaatttcttgttgccttctactttctttcaaagatatttatgatgttcatttaaacacagacagaaagttacacacagagtaatttctgtcaccgaccccagagcccctaaggacagccataaaccaaaaggaatatttattccctccccctcaccctgcaacattttacaagaaagaaaactgaatgaagcacaggccatatgatctatctttcattacggtcaggaaagattagacaagataatgagtttggtttagggccagttatatttgagatgtcgacagacatttaggtagtgatgtaaagtagacagctggacatatagatctgtggctcagaatacagagctacagatataaatgtggtagtcaccagcccacaaatggtattaacaccatggaaa

SEQ ID NO: 197891 - DNA, 601 bp, Human
tgttaggtcaccgcgaggcaggataaagcctgtgggccccactgttgtagaccctggcaattaacaactagcatgagtaggaagcctggcagagagaggataatggctctagcagctgctgcaaaaagaaaagctggaaggttacatcggcaaaaatccttactatttgctagagtaagattagggaacttaattctattcttacatagaccttacaaaatttcttgttgccttctactttctttcaaagatatttatgatgttcatttaaacacagacagaaagttacacacagagtaayttctgtcaccgaccccagagcccctaaggacagccataaaccaaaaggaatatttattccctccccctcaccctgcaacattttacaagaaagaaaactgaatgaagcacaggccatatgatctatctttcattacggtcaggaaagattagacaagataatgagtttggtttagggccagttatatttgagatgtcgacagacatttaggtagtgatgtaaagtagacagctggacatatagatctgtggctcagaatacagagctacagatataaatgtggtagtcaccagcccacaa

SEQ ID NO: 197892 - DNA, 601 bp, Human
acaaaatgttaggtcaccgcgaggcaggataaagcctgtgggccccactgttgtagaccctggcaattaacaactagcatgagtaggaagcctggcagagagaggataatggctctagcagctgctgcaaaaagaaaagctggaaggttacatcggcaaaaatccttactatttgctagagtaagattagggaacttaattctattcttacatagaccttacaaaatttcttgttgccttctactttctttcaaagatatttatgatgttcatttaaacacagacagaaagttacacacasagtaatttctgtcaccgaccccagagcccctaaggacagccataaaccaaaaggaatatttattccctccccctcaccctgcaacattttacaagaaagaaaactgaatgaagcacaggccatatgatctatctttcattacggtcaggaaagattagacaagataatgagtttggtttagggccagttatatttgagatgtcgacagacatttaggtagtgatgtaaagtagacagctggacatatagatctgtggctcagaatacagagctacagatataaatgtggtagtcaccagc

SEQ ID NO: 197893 - DNA, 601 bp, Human
ccagagtagccacaactacaggcacacatcatcgcacccagctggagacacttttaaaaattaaatagcagagtgacaaaatgttaggtcaccgcgaggcaggataaagcctgtgggccccactgttgtagaccctggcaattaacaactagcatgagtaggaagcctggcagagagaggataatggctctagcagctgctgcaaaaagaaaagctggaaggttacatcggcaaaaatccttactatttgctagagtaagattagggaacttaattctattcttacatagaccttacaaartttcttgttgccttctactttctttcaaagatatttatgatgttcatttaaacacagacagaaagttacacacagagtaatttctgtcaccgaccccagagcccctaaggacagccataaaccaaaaggaatatttattccctccccctcaccctgcaacattttacaagaaagaaaactgaatgaagcacaggccatatgatctatctttcattacggtcaggaaagattagacaagataatgagtttggtttagggccagttatatttgagatgtcgacagacatttaggtagtgatg

SEQ ID NO: 197894 - DNA, 601 bp, Human
ctccccctaccacacctatagatgaccataaacgatgaagaaaagtaggaggaaatgttcccaccaagaaaaggtcattggggccacttttacagtctgccatattctacctgataatcttactccaacaagcccaaggatcaggtcaaattcaatacatatttaaaataaaaatttaaatattcccattgtcattttgatcttatgtcattatcagctggttgacggcaggcaacatttctaagtctgtgacttcatctataaaatgaatatgatatcaaatgacccttcaaccttagarctctaagttaatctaacatacatcccctcttcctttgcctgcttgtgagaaagcagctgaaaatttggcagggtgcagtggctcatgccagtaatcccagaactttgggaggctgaggcggctggaatgcttgaggtcaagagctcaaggccagcctcgccaacatggtgaaaccccatctctactaaaaattcaaaagttatccgggggtggtggtgcacacctgtattcccagctactcgggaggctgaggcaggagaattgcttgaacctgggaggcagaggttgcagtgagccaag

SEQ ID NO: 197895 - DNA, 601 bp, Human
attaaatatgctcaatttattatgggccttcaatttccacaaataaaatactcgtccagtatgtactgaaatacctatctgctaaatatttataaagtaacctttgtcagtactatgccagttcacagcctgcaatgttttattgttattattctgacttcatttgcctgttttttaaagaatgttccagtatcatttttacaaaattggagggaagggattgaaagcaaaaagatgtaagaactcttaagtgaaagcacagaaatggtgtcagaaaataaaataaattagctttaaaagrggctgcatggtaagaaaaggatgtaaactttttaaatgttgtttctaaggaactctaattttgatgccaaaattagatggtgacatattgaggtatataacaggactgtaaagctaaatttagatgttccttctttaaagcatccgccagctcctagaccacttattgaataggtaacttgtgctaaacagttatgtacattatttcagttaaagctcaaaatgtgtatgcattatagagaaactggactccggagaaggactccggagaaggttacctatttgccctaggtaaacatca

SEQ ID NO: 197896 - DNA, 601 bp, Human
tctacatataaacccttcctggacagaaattagggggcagtggaggaggagaagaaaaggaaaaaaaaaatgtttttttaattttaaagcctaaccatagattgtagtttcagaaagtacaaggagaagtgacaccaaactttgaacctcacttgactctaaaaatgggaagatctacaggtgatgagaaagaattgcactttgaaatggcaacttttaccatcaatttttttctgttatgttgcatattaaatatgctcaatttattatgggccttcaatttccacaaataaaatactcrtccagtatgtactgaaatacctatctgctaaatatttataaagtaacctttgtcagtactatgccagttcacagcctgcaatgttttattgttattattctgacttcatttgcctgttttttaaagaatgttccagtatcatttttacaaaattggagggaagggattgaaagcaaaaagatgtaagaactcttaagtgaaagcacagaaatggtgtcagaaaataaaataaattagctttaaaagaggctgcatggtaagaaaaggatgtaaactttttaaatgttgtttctaaggaac

SEQ ID NO: 197897 - DNA, 601 bp, Human
gttacatctagtccttctcaaccaaaataatacatctttgttttctcctcctgtaagtgggtcagagcccttacaaatgctggaagcagggtaacagcctgaacatcaaaatatattgtttcaaacatactcctaggagctgacaagatgttctgggatgagagcaaaaaaatggagccataattaacaaaatctggttagacggagtctgacttaaaaataatactccacaatataaagcaacaacagaaaccccactaaagtatggaaaatccaagtctagattcaaatacagtgatayatggttgataagaataagaaagccaattctctgagcttaacattgatcctgttaaactaggatcttcgcagcagtgtcagatttggcttcctgcctttctcagaaactacttacctacaggctattttcttacctcttttctcaaaatactctattttaaagatgaatcctgatgaaattccctatctccactgatcaaattctacttacagaagaataacctctggatcaaatacactgggcacaacataaaaggtcttactctgtttaggttgctataacaaaataccaccgagtgac

SEQ ID NO: 197898 - DNA, 601 bp, Human
ttataagcgacctaaaatttttatgaaaaacttctcaaacaaaagctacaatttaacatcagaaagcacaaagtatagatagcattccttccttcctattaagtcagaaaaaaatgtcattacaatttatctttgcataggtcactcaaataaaaatatagagagaacaaaggacatttttcctaaattatcaaggtatcactgaggcagttacatctagtccttctcaaccaaaataatacatctttgttttctcctcctgtaagtgggtcagagcccttacaaatgctggaagcagggwaacagcctgaacatcaaaatatattgtttcaaacatactcctaggagctgacaagatgttctgggatgagagcaaaaaaatggagccataattaacaaaatctggttagacggagtctgacttaaaaataatactccacaatataaagcaacaacagaaaccccactaaagtatggaaaatccaagtctagattcaaatacagtgatacatggttgataagaataagaaagccaattctctgagcttaacattgatcctgttaaactaggatcttcgcagcagtgtcagatttggcttcc

SEQ ID NO: 197899 - DNA, 601 bp, Human
tcattttcagtaggaaattagaaatgaacacaatgaagaaagtaacatcatttataaccccaccacctagaccgaaatacccacgaccactttggagcacactcttctaagctttcttccaaaatggacaacttgacaagagaacaaagcacgaaggcagtaagcaaacttgtggtctacggagtcattaggccggggcagccaggtaaagttatcatccaatacacttctaagaacgaaggggcttcattccacttctcctaataagcaagccaaaaaacatataaatcacagccatccmtggcaaaccagagtgtacaattgcactacatatctgaatagtccagcctcctgattaggaaaccctactctagaaatagtcccattcatcagaagaggcaatgaattataaattcttcctatatagcacaatttaatcagttgttaaaaagggcaacaataaaataaaccttcctatgttataagcgacctaaaatttttatgaaaaacttctcaaacaaaagctacaatttaacatcagaaagcacaaagtatagatagcattccttccttcctattaagtcagaaaaaaatgtcatta

SEQ ID NO: 197900 - DNA, 601 bp, Human
tatttcatttttattaaaattaaataatttctgaaaatttgttctgtgttttgattttaataagaaaatcattttcagtaggaaattagaaatgaacacaatgaagaaagtaacatcatttataaccccaccacctagaccgaaatacccacgaccactttggagcacactcttctaagctttcttccaaaatggacaacttgacaagagaacaaagcacgaaggcagtaagcaaacttgtggtctacggagtcattaggccggggcagccaggtaaagttatcatccaatacacttctargaacgaaggggcttcattccacttctcctaataagcaagccaaaaaacatataaatcacagccatccctggcaaaccagagtgtacaattgcactacatatctgaatagtccagcctcctgattaggaaaccctactctagaaatagtcccattcatcagaagaggcaatgaattataaattcttcctatatagcacaatttaatcagttgttaaaaagggcaacaataaaataaaccttcctatgttataagcgacctaaaatttttatgaaaaacttctcaaacaaaagctacaattt

SEQ ID NO: 197901 - DNA, 601 bp, Human
tattaagtttgacacaactcatgagcaaaataacctagagttaaaggcaaggcatatatctaaatcagctcctctgtcaaaataactattccatactcccccaaccagacaaatgacaaaagcttctaagtaaaggctgaatcgtgcagggtaaacaacagcaaagcagcatcacttgaataaacaactagcaacaaaattaacaatcattttcacttcaaggcagatggcccctgaaaggtgatacttgcctcaaagtcctaactgatcaatagtcaaggtaacaaaatcatcatcgtcrtcatcatcctcatcatcatcatcccttgggtgagaaaagatgctgagaaaagtctggacaggagtcagcataaagcactgcttcccactccaggagcctcaggaggtacagtctgtccttactcccaggcagccaaggcagaggcccacggcctaggctcagtttgtaacatgcccactggtggtgactctccaaagaagtctcgaggtcacaagcggcaaaactacaggggaaaatcactggaaggactcagcttcagtggcaagacacatctagcaccatggcctcaaggctgatcca

SEQ ID NO: 197902 - DNA, 601 bp, Human
aattaactcaagatatttctatttttcctgcttggttataggtgcattataaacatttaagtcttaagactgatttaggggaaaacatttaaatgtttataaacaggcaataaaagcagcagtagagtctgacagagcactaaaaaagccacattattattaagtttgacacaactcatgagcaaaataacctagagttaaaggcaaggcatatatctaaatcagctcctctgtcaaaataactattccatactcccccaaccagacaaatgacaaaagcttctaagtaaaggctgaatcrtgcagggtaaacaacagcaaagcagcatcacttgaataaacaactagcaacaaaattaacaatcattttcacttcaaggcagatggcccctgaaaggtgatacttgcctcaaagtcctaactgatcaatagtcaaggtaacaaaatcatcatcgtcgtcatcatcctcatcatcatcatcccttgggtgagaaaagatgctgagaaaagtctggacaggagtcagcataaagcactgcttcccactccaggagcctcaggaggtacagtctgtccttactcccaggcagccaaggcagag

SEQ ID NO: 197903 - DNA, 601 bp, Human
agaaatttttgacacacaaaacaaacaccattcccctcaatgataccacttataacaacctgtagttcacttgccagagagaagacaagacaagagcataccagtgtaccctaaccaacaacaggagcaaagagaagagtccatgggtaccaggtgtgaaatgccaaatttaagtaatcaagaaaaagtgtctcaagattttcattaaaaaactaaataaatgaaaagacacaatgaaccacctccacaaatatagagatagaatcaaaagactagtttgggaacactgtttcatgcagtrctgagagatgcagaatgtgacataacatctccaaagcaacagacatcagcttaaggatttaaattatagttggtgatactaggaagtcaagtttgtgtaaagacaggcactgggcctggagagtggccagaggccagaatgccatacatgaccagctttctgaaagatgactagaaacccaagatactgcagcagcatcaaatgcaacacctctcaaaagcccacaaacttagcttctgaccaaaccctgtctggaaaggtgtgatgttctaaataccattctgtaggctgccagatgat

SEQ ID NO: 197904 - DNA, 601 bp, Human
acaggtgttaaaatatctttaaaaaaaaaactatttctactagtgaactctaaattacctaaaactaacaaaagattgaaaccatttccatttatgtcatcacaaagaattattagctattcaaaataaagtcattgagatagttccctctaatatgagagatgttgcacagcactattctccgggggataatttcttggggaaaggggaattcatttatattctagcagtacttctatactaacatctataggtacattagaggaaaagcaaaaggaaagaaacttgaaataggcctgamtaagatctgtggttctcaaacttaggtatatgtcagagtctcctcaagaccttgttacagtacagttgctgggttccatccctgtgtttctgattccataggaatggggtagggtctgagaaggtgccttcctaacaagtactcaggtgctgcagatgccacactctgatctagattatgctagacgctgttcatcatacgaaggttgattttatctttcaggagtttaggacagggaaatgacattataggatttgtggtttttaaaatatcactgacagcattatggacagtagtgtt

SEQ ID NO: 197905 - DNA, 601 bp, Human
atgcagcattttcacttctacgttgtctgggattgtgtgtgtgtgtgtgtgtgcatgtgcatgcattttaaatatgtatggtattgccaaaggaagtgttccccaagtcaaaaataactactcattctcgttcatgtcagttagcttttccatttggttttatacacaaacaaatatatcctctctatatcacaatcacttattgttttgctttttcatatgatctataaaaggcatgagaaacattcaacatttgaaactatgagaaataattaacaaaacaggtgttaaaatatctttwaaaaaaaaactatttctactagtgaactctaaattacctaaaactaacaaaagattgaaaccatttccatttatgtcatcacaaagaattattagctattcaaaataaagtcattgagatagttccctctaatatgagagatgttgcacagcactattctccgggggataatttcttggggaaaggggaattcatttatattctagcagtacttctatactaacatctataggtacattagaggaaaagcaaaaggaaagaaacttgaaataggcctgaataagatctgtggttctcaaa

SEQ ID NO: 197906 - DNA, 601 bp, Human
ccatcattgtactcatcagtaaagccatctctttagtctaaagtcagttttctgaaatgcagcattttcacttctacgttgtctgggattgtgtgtgtgtgtgtgtgtgcatgtgcatgcattttaaatatgtatggtattgccaaaggaagtgttccccaagtcaaaaataactactcattctcgttcatgtcagttagcttttccatttggttttatacacaaacaaatatatcctctctatatcacaatcacttattgttttgctttttcatatgatctataaaaggcatgagaaacrttcaacatttgaaactatgagaaataattaacaaaacaggtgttaaaatatctttaaaaaaaaaactatttctactagtgaactctaaattacctaaaactaacaaaagattgaaaccatttccatttatgtcatcacaaagaattattagctattcaaaataaagtcattgagatagttccctctaatatgagagatgttgcacagcactattctccgggggataatttcttggggaaaggggaattcatttatattctagcagtacttctatactaacatctataggtacattagagg

SEQ ID NO: 197907 - DNA, 601 bp, Human
acatgctatatgaagcaggaaaaaaaaaggttcagtgtgggtaagaaaagagggcatcacagacatggagaagatggtaacagaatttcaaagaacacatgaattccacaagaagaaagaggtgttagaccaagcctgtccaataggccacatgcagcccaggacggctttgaatgaggcccaacacaaattcacaaactttcctaaaacatgagttatttctgcaattttttaagctcatcagctatcgttagtgttagcgtatcttatgtgtggcccaagccaattcttcttcttccartgtggcccagagaagccaaaagattagatacctctgtgggagaccatctgaggcagacagggtaatgtaattttttggaaactacaagtattatttggcaacggctcccaccaaaattttgtaaacttgtaggaatagagataaaatagtcaaatgtttgcttataatatttaatgtttaattcaagtacatatgtatttaaattcatgttatagattatttggaaagactgtatttcccattgtcacaaagcaagtttatttcaaatgctttatcacatgcacctttaccatcattgta

SEQ ID NO: 197908 - DNA, 601 bp, Human
tggaaggtgtggaagactttgacagagatggaggctggaacatttcaggtagagggagcagtaacaagaacaaagggcggacaaacagctgcattccaccagctgggcagcagcagggcatacgtccaatataatgaatgtagctgcaaaggtggtggacaccgacactggagaccataaccaccaggctctcacactggcaaaaaagcaagtaagcagtagatagagaatagggagatggcaaaaccatccatgtgctttagaaagattactccagcacacttaagcatgatgaagaaakaaagacaggaaggtaaaaagatttacccagagaccagatttcttttcctataaaggacatgtataccaacgaggtgcccttgcttcaccactcacatttgtcccggtttttaaagacaatcatatacacagataaaggaatgctgaaatggacactcacatgttgacaaacgtcaactgttaaaatagctgggcaatatgcatgaaaaatcttgttgattcttgtcttaggaatgaatatgatctctgtcatatgttgtgattctatcttaggaatttatttctggaaaataaaccaacc

SEQ ID NO: 197909 - DNA, 601 bp, Human
ttaaaacgaccatcctttggccgagcaaggtggctcacgcccgtaataccagcactttgggaggccgtcgcgggcagatcacgaggtcaggagatcgagaccatccttgctaacacggtgaaaccccatctctaataaaaatacaaaaaaattagccgggcatagcggcgggcgcctgtagtcccagctactcaggaggctgaggcagaagaatggcgtgaacccgggaggcggagcttgcagtgagccgagattgcgccactgcactccagcctgggcgacagagcaagactccgtctcaaaaaaaaaaggccatcctttttgtgctaacataaaaaatccagacatctaaatatgtcatttttattatatcaaatacgtagctttgatcttagctatggaggaggtatctctccctctccttccgcagtgcccacaacagatgaagggggagcgcaggaataaaattctagagtcaggttacaggactatcatagagtaggaataagtcttggttagactattcctcagagaactgaggttaagagctgagaaatatcaaacaatcatatacagagcaaaaagatctcaatattctttc

SEQ ID NO: 197910 - DNA, 601 bp, Human
tgctcagcagcaaatcgtttctcattgctggcaccctctagcgcttgtgtgtcaccagattactggaaacattttagcagagagaatggggaccataaaacactgcttggtccttctctccctaaaagttaattctcaaaccaagtaacaaagcaaagaactcttaactcagtaataaaaaaagacaaaagacacaatttttaaaaaactttttccataagttattggggtacaggtagtatatggttacatgagtaagttcgttagtggtgatctgtgagatcctaatgcatccatcacycaagcagtatatgttgcaccatatatgttatcttttatcccttgccccctttccactcttcccctaagtccccaaagtccgttgcatcattcttatgtctttgtgaaaagacacaatttaaaaaagcaaaggatctgaatagatgttcctccaaaaaagacatacaagtagccaaaaagcacatgacaagatggctcaacatcattagccatcagagaaatgcaaatccaaactacaatgaaataccacttcatgtccagtaggataactacaagtaaaaggatgctaacaagtgttggt

SEQ ID NO: 197911 - DNA, 601 bp, Human
gggccaaaattcatgttttaagaagatatccaagccacgcataccaaagacctcccctttaaaagaaggccttttttcaagtgcaggattaaaacaaaagaatatactttcagacttaaggataagacagtgtagatctctggccaggcacgatggctcatacctgtaatcctgggaggccaaggtgggtggatcacttgaggccagggttaaagaccagccatggccaatatggagaaaccccatctctactaaaaatagaaaaattagccaggcttgaacctcggaggcagaggttgckgtaagccgagatcacacaactgcactccagcctgggtgacagagcaagactctgtctccaaaaattccaaataaagagagagcgagcagtgatttctgtcatctgctcagcagcaaatcgtttctcattgctggcaccctctagcgcttgtgtgtcaccagattactggaaacattttagcagagagaatggggaccataaaacactgcttggtccttctctccctaaaagttaattctcaaaccaagtaacaaagcaaagaactcttaactcagtaataaaaaaagacaaaagacacaa

SEQ ID NO: 197912 - DNA, 601 bp, Human
aaaattaacatacaactggtgatttttctgcttgaaaagtagtatttatttttcttcggattaccaaaataatatttgttcattatctgtaaatcacagggctataaacaaactaattctttacagccctagtatccacagataaaccaaaataactccatttatttcctctcaatttttacccagatataatttgagatccctcttttcataaacatcttctcctatcattaaaaacactgtaaaatatcactttagcaggcacttcatcatacacgtctaccaaaactactgaaccatkcctttgtttccagtcttgggaagattgtatatactgtgaaaaacatctttaatcatgcatctttgtctataccttaccaattaaattgttagggcacagtaccagaagtaaaactgccagatcaaagattatacacattttaaaaccaaacataatgccaaactgctttgcaaaattctgtgtagcactctaaacaccaggaagaatctttattggcagttaaactgcttctgatgcccttgcacagactttaatagagagacatcgtaccaacaaaagaattgttcctcacaataactt

SEQ ID NO: 197913 - DNA, 601 bp, Human
aagttactgcatgaatcagttttcaatcacctactacaagtgaagtaaaactaatttttagtgaattctattaaaatataaataatcataccacaatgtatttagagttccaactcagaaaagcatgcctaagggagttataatttaagcatgactggggactgagtgacaccttaaatatgactgataaatcctattcatttttcttttctccttcgtagttgaaaagaaaaagaagaaaaccccaaagaacaaataaaagaaaaaaaatcaaggaacaagaaattcaacaatttttttwaaaaaaataatgagaatagagaagagatgacaactagaaagaacataagcagctataagcaaaagtggccgcagaaatagatactgaccagaaaacagtccaccctgggaccacaagagcttcagcactacaaccaggggcgggggagacattctgggggatgatgctggagacacatagcttcgttggatggagtggtcggcgcatacttcccacactcccacacctccagtgtaaccagatcacaatcttttccaaggcagaagacggaacattttggagacactaggcacaaggata

SEQ ID NO: 197914 - DNA, 601 bp, Human
ttctaggcaggaggacatgatggcctgagcaggagaaggtatggcagcaagaaagggctcatccacttctgccggcacacaaggtacccaaaggagaatattggcagaagtgctagagaaaggttgagaccagattttgacaccctggggtgaagaatttgaagttaatttgctaggaaataaaatgctacacaaagttaaatctatttctttcggaagctataacacaatagttctcaaatagaactatacagcacaaacaagtggaagtttttcaaaatgcaaaagtgagaatcaagarattcttctgactcagtaggtcaggaatgtagcctgggagcatgtcaccaggtgactgatacacacccatggttaagaatcaatgctccaaggaatcattaccatctctaacgggtgtcaactggcaatgcactaacgtgagtttatggtccaaacacaagtaaggaaagtagatacaaatagacgtaggtaaagaaaggcagatagaaataagaatttgcaatggtccaaaaggtttaatgaaaaggacctccacttataataaatgatgtttcctaagaagttactgcatgaatcagtt

SEQ ID NO: 197915 - DNA, 601 bp, Human
gaggtaattttttcaagattcttatcaccccccaaaaactcctttcaggagttcaagaccagtctggccaatatggtgaaaactcatctctatcaaaaaaatacaagtattagcagggcatggtggcacgcgcctgtggtcccaactactcaggaggctgaagcaggagaatcactttaactcgggaggcagaggttggcagtgagccgagatcgcaccactgtactccagcctgggcaacagaatgagaccctgtctccaaaaaaaaaaaaaaagagagagagagagagacaccaccacmacaacaaaataactgttacagtcatggtaaagttgcaactaattatcctagggctggagagtcaagatacaagccacagtccaaatgtacagctttctggtaacaaggctctaggttaggctgaatacctgttccatcacttaccaatccatgagaactcaagccagtgaccatttctctaggcttctgatgcacattagagtgttgtaaatattaaaagagatgacacataaatcccctgccatggtaactgtgtacatggtaggcattcaataaaggttaatcctcacctccccactc

SEQ ID NO: 197916 - DNA, 601 bp, Human
attttagaaaagaaaggagttggtgttctaaaggtattgctgcctgatcacctcactgagttctgagttcaggtttttatcatctatttcctggactaacttttcctcattaatttccttgtttcttgcttttatccttcccattttacacattaattccatatattctttgcaaaaagcaaacctctggttctaaaattgcatttcagcactacatatgtcttatgccactagtactattaatattttataaaacacttgtgggatctgacagaaaatattactactgaaatggagaaaractgacagaaaagttaaaccagtgagtccaaatgcatgtaaaatgacatccactgattctacaactacccagaagcacacagatgcccagcactgaggggtgtacagtctagtgaggaggggaaagtgcatgtaaacacacaaatgtaagcaactgctcctggtatcgttatggaaacagagatggtagtgggccaagtcagagacatctagaggtgatcttacagactggccagaatgaggctgactgcaggaggtccatgtctcagggaaccacatcatcaaaagcacagaggcccaa

SEQ ID NO: 197917 - DNA, 601 bp, Human
ataggaccctacagtctcaatctggatgccggaagcacatctctcccttaagctatcccactaataaaactaccactgaatgcgtgcgctgaagatgacggctgctgtggaaaggttgctctgagggtcagttgcccgacatgtgagtgccattccttggggcatttctgcaacggcagccctcaggcctgctgcgtctagaagaacaagcttgacaaacatattgtggtctggttctggtcaagcaaaattctttagcaccagttcctcacaccatgcacctgctgtcacccagcatgcsccctattttaagggtatagccgttgtcaatgaagagttcaaagacctaagccctagttgttgagagcaggtggaatcttggtgttattgctagatttccttttggaacactgttgctctctgcccagtggaaggccgattctggatcctttctctcctcactgcagcacagcctgcggcatacagtcaaagctcactcttcagccctggaatcttgagaaggtcagggtcttagcaatgcaagctcatctgtagctgccactaagagacaggccaaaggagctgcctcaaccactgcctc

SEQ ID NO: 197918 - DNA, 601 bp, Human
gagaatggttcataatgggattcacttactattcctaaccatgccccagtgcggggaaataggaccctacagtctcaatctggatgccggaagcacatctctcccttaagctatcccactaataaaactaccactgaatgcgtgcgctgaagatgacggctgctgtggaaaggttgctctgagggtcagttgcccgacatgtgagtgccattccttggggcatttctgcaacggcagccctcaggcctgctgcgtctagaagaacaagcttgacaaacatattgtggtctggttctggtcmagcaaaattctttagcaccagttcctcacaccatgcacctgctgtcacccagcatgcgccctattttaagggtatagccgttgtcaatgaagagttcaaagacctaagccctagttgttgagagcaggtggaatcttggtgttattgctagatttccttttggaacactgttgctctctgcccagtggaaggccgattctggatcctttctctcctcactgcagcacagcctgcggcatacagtcaaagctcactcttcagccctggaatcttgagaaggtcagggtcttagcaatgcaa

SEQ ID NO: 197919 - DNA, 601 bp, Human
atgtattctggaagcggtgtgtgtgtgtgtgtttgattgattgagattattccctttcagggctctatgaggagaatggttcataatgggattcacttactattcctaaccatgccccagtgcggggaaataggaccctacagtctcaatctggatgccggaagcacatctctcccttaagctatcccactaataaaactaccactgaatgcgtgcgctgaagatgacggctgctgtggaaaggttgctctgagggtcagttgcccgacatgtgagtgccattccttggggcatttctgcmacggcagccctcaggcctgctgcgtctagaagaacaagcttgacaaacatattgtggtctggttctggtcaagcaaaattctttagcaccagttcctcacaccatgcacctgctgtcacccagcatgcgccctattttaagggtatagccgttgtcaatgaagagttcaaagacctaagccctagttgttgagagcaggtggaatcttggtgttattgctagatttccttttggaacactgttgctctctgcccagtggaaggccgattctggatcctttctctcctcactgcagcacag

SEQ ID NO: 197920 - DNA, 601 bp, Human
tacttctataaggcctgttcgaagttttgaatgtattctggaagcggtgtgtgtgtgtgtgtttgattgattgagattattccctttcagggctctatgaggagaatggttcataatgggattcacttactattcctaaccatgccccagtgcggggaaataggaccctacagtctcaatctggatgccggaagcacatctctcccttaagctatcccactaataaaactaccactgaatgcgtgcgctgaagatgacggctgctgtggaaaggttgctctgagggtcagttgcccgacaygtgagtgccattccttggggcatttctgcaacggcagccctcaggcctgctgcgtctagaagaacaagcttgacaaacatattgtggtctggttctggtcaagcaaaattctttagcaccagttcctcacaccatgcacctgctgtcacccagcatgcgccctattttaagggtatagccgttgtcaatgaagagttcaaagacctaagccctagttgttgagagcaggtggaatcttggtgttattgctagatttccttttggaacactgttgctctctgcccagtggaaggccgattc

SEQ ID NO: 197921 - DNA, 601 bp, Human
tcccaggatctcctcctctggctccgggggtgtggggtctggcaaaggtggcggtggtggtggtggtggcggtggaggaaggaggaactaaaggagctttctgttgaggctccggcctgaaagagcagagagaaaattgctatttacttagaagtacatcttgcattatggatgcatttgagcacttcttaatatgggggaaaaaataaaacttgtcacatactaagaagaaatgtcatttaatgtcacttcacccattttagttgaattcaagtagtgtttcaacatataagtcaggccaaaaaaaaaaaaaatctgcccttattagctaaggaatttttttctgtaggtatcttttcacttagcgcttcaagaactaccaatgttaggaaatttcagtgcgctccactcaactcctaccaattctgggaaatttaagtgaaatgaaagcgtattccatggtatatagccttattggttagaaaacatcacaacgattataaaaagacaggcgcaagcagcactcaacttttgaaagcacttatttcctgttatctgaaaatgagaattcttttcccatagaaataggtggcaatgaggt

SEQ ID NO: 197922 - DNA, 601 bp, Human
cccaatggggaaggcaagccccacaccaccatgcttggcacatcacctttgcagtagtccgcagggtcctcttgctcctcatcatctgatcccaggatctcctcctctggctccgggggtgtggggtctggcaaaggtggcggtggtggtggtggtggcggtggaggaaggaggaactaaaggagctttctgttgaggctccggcctgaaagagcagagagaaaattgctatttacttagaagtacatcttgcattatggatgcatttgagcacttcttaatatgggggaaaaaataaaayttgtcacatactaagaagaaatgtcatttaatgtcacttcacccattttagttgaattcaagtagtgtttcaacatataagtcaggccaaaaaaaaaaaaaatctgcccttattagctaaggaatttttttctgtaggtatcttttcacttagcgcttcaagaactaccaatgttaggaaatttcagtgcgctccactcaactcctaccaattctgggaaatttaagtgaaatgaaagcgtattccatggtatatagccttattggttagaaaacatcacaacgattataaaaagacagg

SEQ ID NO: 197923 - DNA, 601 bp, Human
gcatcactacctcctccccttgtccattcccccaacaaattactacacagcccaatggggaaggcaagccccacaccaccatgcttggcacatcacctttgcagtagtccgcagggtcctcttgctcctcatcatctgatcccaggatctcctcctctggctccgggggtgtggggtctggcaaaggtggcggtggtggtggtggtggcggtggaggaaggaggaactaaaggagctttctgttgaggctccggcctgaaagagcagagagaaaattgctatttacttagaagtacatctygcattatggatgcatttgagcacttcttaatatgggggaaaaaataaaacttgtcacatactaagaagaaatgtcatttaatgtcacttcacccattttagttgaattcaagtagtgtttcaacatataagtcaggccaaaaaaaaaaaaaatctgcccttattagctaaggaatttttttctgtaggtatcttttcacttagcgcttcaagaactaccaatgttaggaaatttcagtgcgctccactcaactcctaccaattctgggaaatttaagtgaaatgaaagcgtattccatgg

SEQ ID NO: 197924 - DNA, 601 bp, Human
aaaagaaaaaacaagaaaagaaaaaagaatggcacctacagatgaacctaatgctgggcctcagcagaaaaatcgaagacagtataagaaatgaagagtaagagggaggatggaaaacaccttcttgtcacctttcaaactggctctatcttttcttttactagactgcatagatctttggggttgtaaccactattcagacaaatgctaagtaagatctacactcttttctaaggaacacactgattctatgtggaagtacgtgcacctatgaaagaatcaggttagagtagattagttyctacacttttgtagtacagtaactttctcttcctcttagcaggtaattaaatgtacactgtttctgaaccaacatacaaatgatctatatctactagataaatgatgaattattaagacatatggaacccaaaattcattaatgctttatgttctgaacatgtctgcattttctgccatttattctaatgctatatagaatctgatttacaatttttaaaatctgtagcaaataaattcatctcaccaactttggctcaggagctccaaattccagaaaattaatgtccaaatcagtaag

SEQ ID NO: 197925 - DNA, 601 bp, Human
atgattccgcttatattgcacgtatagtatgaagggtgccttcatgtggttatatccttggagttttagaaggatgatacatgcagaccttagaatggagcagattttagtgttcaatgtgcagaaaaatcactgatgaatttgttaaatatttggattcctaagtcccactctcaaggattccaattcaggggtttacagtgcagcctaggaatgtttaccaggcaccccctactgcctctgaaaaccccacatgaaacacaaatcttcccacaaaaggaggtttggctgtgacacaggttttttttgctcaaactcatgaaacaagcatgtatgacacaaggcctcccgacagtgtttgtttacaggctgaccctgcccctgatcttggtaatccccagggcttggaagcagaatctgaataaactgcacagcctactgctacagcttgtgcccagacaacagaccagaggtgatatgtaaaaaagataggcagtgctgacagctctctctccagaggttaaggaaacacacccaacatgagacacggtcagggagttaagggagccagcactgatgggtatagacagcatgaagtaca

SEQ ID NO: 197926 - DNA, 601 bp, Human
aggaacataaggtagttcaaagcaatgattccgcttatattgcacgtatagtatgaagggtgccttcatgtggttatatccttggagttttagaaggatgatacatgcagaccttagaatggagcagattttagtgttcaatgtgcagaaaaatcactgatgaatttgttaaatatttggattcctaagtcccactctcaaggattccaattcaggggtttacagtgcagcctaggaatgtttaccaggcaccccctactgcctctgaaaaccccacatgaaacacaaatcttcccacaaraggaggtttggctgtgacacaggttttttttgctcaaactcatgaaacaagcatgtatgacacaaggcctcccgacagtgtttgtttacaggctgaccctgcccctgatcttggtaatccccagggcttggaagcagaatctgaataaactgcacagcctactgctacagcttgtgcccagacaacagaccagaggtgatatgtaaaaaagataggcagtgctgacagctctctctccagaggttaaggaaacacacccaacatgagacacggtcagggagttaagggagccagcactga

SEQ ID NO: 197927 - DNA, 601 bp, Human
aataaaataaaataaatcaaagtcatagactcggagggttggggggcagggagggaaggagaaagggaggagggatgccaatgacagcaaatagccaccaacagtaaattttgtgagttattaaaattcaaccagtctaccgttttcacagatggaaaatagacacacatgggtaaaggcaatttgtgtataggaagaaactcatctgacatgcttctagtgtgtatacttataatattttatgctctattttgaagaaaataatgtccctaagtttttacaggtaagaaatatatgtcamtcaaatgtgtgtgacaggttaagtattccggagaactatggatgattttaagaaaacgtgaggcagaaacaaaggccctatattctgatctgccagtcagcatgccagcctgctcatgccgacatgccttccccagatccacctgaacatcagcactctgcctatcccgtacttgcaacccaacactagagaaaatgcctttatccaaacaaaatacgtactgcattatggatggttcaaatgcagtggagttaacaaactacagggccttgaccaaagggaacctttcagactagagag

SEQ ID NO: 197928 - DNA, 601 bp, Human
gggtcaaaaccgcacccagcgaagaacctctgatgtaacacagccaacattacttggctgtacaaatatttcttttgtttgttattctttttactgtacaaatatcaattctaaagcagctttaaggttctttgcttttttttccttaaaaaacaacacagattgggcacagtggctcacacctgtaatccctgcactttgggaggctgagacaggcggatcacttgaggtcaggagttcgagaccagcatggccaacatggtgaaacctcatctctactaaaaatacaaaaatcagctgrgcatggtggtgcatgcctgtaatccaagctactcgggaggctgaggcaggagaattgtttgtacccgggaggtagaggcagtgagtggagattgcagcattgcactccagcctgggtgacaagagtgaaactccatctcataaaaaataaaataaaataaatcaaagtcatagactcggagggttggggggcagggagggaaggagaaagggaggagggatgccaatgacagcaaatagccaccaacagtaaattttgtgagttattaaaattcaaccagtctaccgttttcacagatgg

SEQ ID NO: 197929 - DNA, 601 bp, Human
ccacgttgaagtgattctcctgcctccgcctcccgaggagctgggactacaggcgcgtgccaccgtgcccggctaattttttgtatctttagtagagacagggcttcgatatgttggccaggatggcctcaatctcctgacctcgtgatctgcccacctcggcctcccaaagtgctgggattacaggcgtgggccaccatgcccggcctgctaaatatgttttgtaaaaagaggagagattataacaccaggattctgtttctactctgctttctttcggttttctgtggggatttttggyaatattttgaagtgatgctttaaagttacttcaccacaaatttctcacactcatctctatcctctacatgatgctcccaaactgcttttaaacctaatcttctaccatcaatttttagtttccccatttgttaggaaaacacaagcagttagggcttcttacaccttgttctgcctccaggatttagtctgagtagtgccccatactctcaacatcatccaaatattctttactgacaaagtccctttcagttttttataacatcttttctgagtcctctattcaaatataacattcttc

SEQ ID NO: 197930 - DNA, 601 bp, Human
tgtctattcttaccacttctattcaacctcatgcataaaagaatgaggcaaaaaagaataataatttataaagaatcataaggaagaagaaaaacctccatttgccctgaaatgatgaaatgattgtgtgtagagaaaacctagagaaatttacacatgcacaaacactaataaataagcaaacagcatagttacaggccacgtggttggtgcataagaatcagttacatttctataacccatcaaaaccacaccaaaaactacaaaacatttctgagaacaataaagacctaaataaacrgacacaataccatgttaatgggttggaagattcaatattattaaggcgtatctaaaatttatatgtataagctgactctgaatttatacaaaatgcaaaggatcgagacaggtcaaaacaatcctggaagagaagcacaaagctggaagactgacactacccattcaaggcatgctatacaaagctatagtaaccagacctttagagcaagcattgaccaaaagagggatggagcagatggagtccacaaacaaacccccatacattctgtctactgatggacaaaggcaagcaactgaa

SEQ ID NO: 197931 - DNA, 601 bp, Human
atttcaccttgtttaaaaagctatttttaattagtaagccataattgtatgtatggggtatgatgtgatgttttaatatatgttacactatttttttctataaggaattgaggcagcttataaaaccacaatataagatacaaaattagaaagaaattggggcacagaaaaaatagcccagaaaaagtaaaacagaataatgctacagtgaagttaggatacagaatgcatgctataaattactgttcacttgttagaggtgggctgcacatttggctcagagctttttcatagccaaacsatatccaatgcaaaaaagaaatgacaaccaccctgagacacatagggagaccccgtctctatcaacatttttaaaatccgccaggcatggtgactcatgcccacaatcctagcactttgggaggcagaaacaggaggagattccttgagctcaggagttcaagaacagcctgggtaacatagcgaatcctgtctctacaaaaaaatttaaacatcagccaggcatggtgatgcagacctgtagtcccagctactcaggaggatagcttgagcctgggaggttgtagtagtagtgagctgt

SEQ ID NO: 197932 - DNA, 601 bp, Human
actttgggctcatttctcggttcttaattatgtttcagataaataaatgtataatatattgaattatgaactgaagaaacataactgatcttagaatgagaaagtcttagctgagtcaaagtagaattcagaaatcagaatccacttaagacatgagatttcttttaaaagaaaaaattaaaaaaagagaaaaagaaataagatttatatctaaaagaaaaaattcttagtaactaaaaaaatttaacaattaaaataactcagaaaacagctctctggctgtttaaaactaaaagccctmattatccacattccaacctcaaaatataactaaaaaattaagttccttccaaaggttaggacctatttcaggctcctgctgttcatggagtgcaagggtatatattatagcacatatccatgtctgactcataactgaagacatgttcccaggtgtatgttacgttctcttgtcaaaaaataataataataatacactgtaaataatctaaattctaaactactctaatgaaattcttaattattctaaaaaatgagaaagagaaaaaaggtcttagagacaaactgactacaaaaagaa

SEQ ID NO: 197933 - DNA, 601 bp, Human
gtggcatgatcccagatcactgcaatctccacctcctaggttcaagccattatcctgcctcagcctccagagtagctaggagtacaggcatgtgccaccacacctggctaatttttttgtatttttagtaaagatggggttttcaccatgttagtcaggctggtctacaattcctgacctcaaatgatctgcccaccttggcctcccaaactgctagggttacaggtgtgagccaccacgccctgcgtggctgtttttaagaggccatgtctagagatttacttgactctgtaatttgggwaacaagctgttttttctcatacacacaaatacaactaagtgttcaacttcgctgaatgtattttaagtatactgataccctgtaaatctcagattccataactaaaaagagttaacgtacactattaccaattttttttttttttttttttttgagatggagtctctctgttgtgcaggctggagtgtagtggcatgatcccagctcactgcaacctccgcctcccaggttcaagccattctcctgcctcagcctccggagtagctgggagtacaggaatgtgccaccacacctggctaa

SEQ ID NO: 197934 - DNA, 601 bp, Human
ccaggaggtcgaagctgcaatgagtagtgatgacaccactgcactccaacctgggagacaaagtaaggccctctctcaaaacaaaacaaaaaaaacaagtaacaacaaaaattacttaagggtaagataaatataaatgaaaacactattttcctcattagtaatttaaaccacaatttaaattacattcaccacagaagaaacactaataataataatactatcaaaaattatgctgtggtgaatgtaaattgtgctttaaattactaataaggaaaatagtgttttctttttataaaayataaaaatataaatggattcagaaaccatttttgcagtgaaatcacacagattaaaggtcagtccgttgattgagcaaccctgaatacctaaaatgttcatgtcaaggccaacacataattctaaacccctgcctactaccaattacttaacagatatttatgcttgaattcagggatgtcgatttgaatatcagcattggcatttactactataacattaagccagttacttaacctgtgtcagcacttgccccagctacctcactcaaaactatacctgggtatatattatgtgccac

SEQ ID NO: 197935 - DNA, 601 bp, Human
gaacatcaatgaaaagcccacagataacatcagatttaactattaaagaccaaatgctttccccctaatatcagaaacaagataaggatgtctgctctccccatttctagtctgctgttttggaagctctaactagtacagtcatgcaaaataaataaaaaggcatcactgctggaaaaaaaagaaataaaatttatctttattcacagacaagccacagagatgtatgtggttttgcatatatgtgtgtgtgtgtgtgtgtgtgtatgtatatatgtgtgtgtgtgtgtgtgtgtatacttgtgtgtatatatatatatatatgcacagtggcatatggttttacatacatatatatagatgtatgcatgtgtgtgtgtacatatatatgtatgtgtatgtgtgtgtgtgtgtgtatgtatgtatgtatgtgtgtatatgtgtgtgtgtgtgtgtgtgtgtatatatatatataccacgcctggctaatttttgtatttttagtagagacagggtttcaccatgttggccaggctgttcttgaactcttgacctcaggtgatccgcctgccccggcctcccaaagtgctgggattacagg

SEQ ID NO: 197936 - DNA, 601 bp, Human
atagaggaacatcaatgaaaagcccacagataacatcagatttaactattaaagaccaaatgctttccccctaatatcagaaacaagataaggatgtctgctctccccatttctagtctgctgttttggaagctctaactagtacagtcatgcaaaataaataaaaaggcatcactgctggaaaaaaaagaaataaaatttatctttattcacagacaagccacagagatgtatgtggttttgcatatatgtgtgtgtgtgtgtgtgtgtgtatgtatatatgtgtgtgtgtgtgtgtgtrtatacgtgtgtgtatatatatatatatatgcacagtggcatatggttttacatacatatatatagatgtatgcatgtgtgtgtgtacatatatatgtatgtgtatgtgtgtgtgtgtgtgtatgtatgtatgtatgtgtgtatatgtgtgtgtgtgtgtgtgtgtgtatatatatatataccacgcctggctaatttttgtatttttagtagagacagggtttcaccatgttggccaggctgttcttgaactcttgacctcaggtgatccgcctgccccggcctcccaaagtgctgggat

SEQ ID NO: 197937 - DNA, 601 bp, Human
caatatgaaacattcattcttgatcacaattctcaatgaagcaggaatagaggaacatcaatgaaaagcccacagataacatcagatttaactattaaagaccaaatgctttccccctaatatcagaaacaagataaggatgtctgctctccccatttctagtctgctgttttggaagctctaactagtacagtcatgcaaaataaataaaaaggcatcactgctggaaaaaaaagaaataaaatttatctttattcacagacaagccacagagatgtatgtggttttgcatatatgtgtstgtgtgtgtgtgtgtgtatgtatatatgtgtgtgtgtgtgtgtgtgtatacgtgtgtgtatatatatatatatatgcacagtggcatatggttttacatacatatatatagatgtatgcatgtgtgtgtgtacatatatatgtatgtgtatgtgtgtgtgtgtgtgtatgtatgtatgtatgtgtgtatatgtgtgtgtgtgtgtgtgtgtgtatatatatatataccacgcctggctaatttttgtatttttagtagagacagggtttcaccatgttggccaggctgttcttgaactct

SEQ ID NO: 197938 - DNA, 601 bp, Human
atgcctataccagaaaagatctcaaaaaagtaatcttagtttccaccttagaaaactaaaaaaatagcaaacttaacccaaagcaaacggaagaatgaaaatataataataatatgaactataaataagtaaaacaaaaaagcataagaacagtcgagaaaatcagtgaaaacaaaagctggttctttaagaaaataaaagcaattaacaaatttcgggccaggcagattgggcagtgagagaaaacacaaattaccatcatgagcaatgagtgaggtaatgtcactatgtatttttgagrtattaaaaagatagaagggaatattatcatgttatacctatacatgtgaaaacttagataaaatggacaaatacctgaaaagtcacaaaccactcaaggtccaaacagaaaaaaaaatctgaaaaaccatgtatctattttaaaaaatgaatttattgttcaaaatcttcccataaaaaatgcattggtatattttatcttgatattatgaaaaaaatactacaaattcctcctaaaaagtaaaaaaagaggaaatacttccagttttgatcctatgaagccagcattttttattccaaa

SEQ ID NO: 197939 - DNA, 601 bp, Human
ctaaaacaatattttactacttttttactttggaaacagatttttcattcttttaacatttgcttttttattgtaaagatgttatttcttttttaatctgcagaattcttacaaattactcaataaagatgtggatggcttgtgcctagtcttaagagctctagagcagttataggaagtatctaaccagatccttcaatatattcccagagggctctcaataatacttcaagaatatatttctgaacatttaaattgtgttggattagtgaagcaggaatctgaccagatactgagttcrtgagattcttacccttctactgcctctgcacttgcttgtcctggatttgaatctcaaggtgtatgacaacattttgggctaaatatatgaactaaatgatagtgaattaggaataaaatgtagcaaattattaaatggcttactacttagaagattaaactaaaattaattaaaagaaatgagctctgagtttataatacagttatttatttatttatttatttatattttttgagaccgagtttcgctgttacccaggctagagtgcactggccatctcggctcactgcaacctccacc

SEQ ID NO: 197940 - DNA, 601 bp, Human
ctgggattataggcatgagccaccacacctggccaaggttctgtatttcaatctaggtgtgtacgttatgcacataccagctcttggtatttaaagactttttttctcctaaacaagttaaattcaaatctttttggatatgtgcaagaaaactgaccaaaataaacaatgtttactctgtataattctgcatacattaatggtttattaataactagaaactgtacaatgatgtcttaatttaccctctaacagggcttgttcctctcatcactcttctgccaactcctaactcctgccyggaaacattcctcacaaatgaagaaatgaggccgggcacggtggctcacacctgtaatcccagcactttgggaggccaaggcgggcagatcacctgaggtctggagttcaagaccagcctggccaacacggtgaaaccccatctctactaaaaatacaaaaaattagtcaggtgtgctggcgaactcctgtaatcccagctactcgggaggctgatgaagaagaattgcttgaacccaggaagcagaggttacagtgagccaagatcaagccactgcactccagcctgggttacagagtg

SEQ ID NO: 197941 - DNA, 601 bp, Human
gtatatacacaaatattccaaaatccaaaacacttctggtctcaaagcatttcagataagggatattcaacttgtaatgagatctatccaatacacagaaacataagctttcctttaaaatagtacttttcaaatggtggggccacattaaatagtagtatgggtcaagacaatctcttttatgttttgttttgttttttccctaattaaaataagactagataaacatcagagttatcacgaatattacacaccaacctaatagtgaaaaccattctcttttaacacttttgtttcagtccacacacacacacacacgcaccaaatgtgtgtgtgtgtgtgtgtgtgtgtgtgtgtgtgtgtatggagtagcaatgaagtttcttactatgggtcatggctttgaaaagttaaaaatgactgatttgaaacgcctatactatacattatgtttgtctgatatggatgaattactagaaaaataatataatcccagtgtaaaacaatttcaatgaattaactttgaaataaagctggaagcaagtaatattttaagatttcaaatgaacttcaaactaaggcagggggcaggaaggaatct

SEQ ID NO: 197942 - DNA, 601 bp, Human
aattcagcaagaaaagatagatggatcaattatggccagaccatgacaattattaaacttgagtgacgaatttacaacaatttactgtagtatgatctctttcttatatgtttgaaatttctcccaataagtttgtaaagaaaaacaataaaggtattttcgatcaagcactggcttatgtcagatttatcaaggagtatagaaaatgcagagtatagaaaatgcatcattttacttttccttaacttttgcaatatagataaccaggaataaaatcaagaaaaccaaaatgtttccataytcacctgacagaaagatgagcctctgcaggacaattatttgaaaggctcagttgtatcattttggaaaaagaatttggcaattattagtactattcagaactaagagcagtcaagcgccaccttgggatgtggacatttacagagcatttttccttttatcttaaccaatgctccattttcacatggtgctttgcagccactggggcacacacagattgtccttatgcactggttttagaaagtttaaaacacaaagaagtggtgctgatgtatgcttttatctaccaccacaaaaaaaa

SEQ ID NO: 197943 - DNA, 601 bp, Human
cagaagtaaaaggacatgacttctaggatttgctctataataattcagcaagaaaagatagatggatcaattatggccagaccatgacaattattaaacttgagtgacgaatttacaacaatttactgtagtatgatctctttcttatatgtttgaaatttctcccaataagtttgtaaagaaaaacaataaaggtattttcgatcaagcactggcttatgtcagatttatcaaggagtatagaaaatgcagagtatagaaaatgcatcattttacttttccttaacttttgcaatatagmtaaccaggaataaaatcaagaaaaccaaaatgtttccatactcacctgacagaaagatgagcctctgcaggacaattatttgaaaggctcagttgtatcattttggaaaaagaatttggcaattattagtactattcagaactaagagcagtcaagcgccaccttgggatgtggacatttacagagcatttttccttttatcttaaccaatgctccattttcacatggtgctttgcagccactggggcacacacagattgtccttatgcactggttttagaaagtttaaaacacaaagaa

SEQ ID NO: 197944 - DNA, 601 bp, Human
tgcataaactggatgtcattttggagtttaaatctgggaaaaagccttatccttaggcttctgacatttgtgaaagtaaaatatcaaaatggtggatctgttccaaacatgatataaagagcaaaaaatctgaaagaagccagaagaccacagctactgacacaacctagcacccatcagtcatgtgcctctgagtaaagtggtccgattttcttgaaccttggaaaatgaaagtactgcctactccaggcacacaaagggctatctcagaggatccaacacccacataaagaaaaagtaytcatgacactgaaggcatcatctcttctcttcatttttgctttcttctctgagctacaggttttgggatactttgctctctgtcacttctccctggagctaccctttgccaactcctcaggtagaggaaggataaggataacatgccaaccctttctacaatcctaattcacttcctcctgagtccccatcaaaaccaacaagcatccacataacttagtagcatggtcaaaactgatattctcaaaaaagaaaggaaagtcaagggacacctttgcttgtcttcttcctagacacactt

SEQ ID NO: 197945 - DNA, 601 bp, Human
cagttttagtagagacagggtttcaccatgttggccaggctggtctcaaactcctaatctcaagtgatccacacaccttggtctcccaaagtgctgggattacaggcatgagccaccacacctggccccaacttaatttttttttaaaataggtatttcagccttcacaactatgatacctccaatttcattatatattcatgtcattcatacaggaagattacaaatggctctgaaaccctttgagaacattttattcatccctggaggcttacatttgactttagaatcaaaaaaagtrgttgatttaatcaactataataactgaatatgctatattaaaacaatattattttaaatatttttagtgaaaaaaagaaaaatctttctatactgtttaagaatgtaagcactacagatttatgcgcagataatctaaagccagaagtttcttactatttcccaggctcattacaaaaacggcagattatttaaggactacatttagcagcaggcatagggcgaggcccaggatatcccaaacataacctaagtcttctcaaagcactggcatatctggatatgatgattacttcgcatt

SEQ ID NO: 197946 - DNA, 601 bp, Human
gtggatgttttatagtagatactgaacaaaaacaatgtaattgtaccatgtcacataccttaaaaaaaaaaacgacaggcaaaaaacgtatgcctgacaattacatgttgttcccttcacaacacaaaatatcattaaatactgacttaataagagttcaaaatgttatgcactgatacatatgtaacatacataacatatatacattatgcactgatacatatgtaatacatatacatatttgtaaacagcattcatgttgaaagcctaaccaattaggtactagggcctaggggctgcygtcaaaagtctcacctgtcgaatgatactcttcacacaacgtactgggaggccttgatagttggatttgatgatccacttgaggagatggtggccaagtacttcgaagaccatgcagacatctgggacacagttaaggatcgtttgtggatgcactgcctggagtgaggcagttattgaaagcagcaccattgtgtcacttgcaaagcacttattactttataaaatacaacatcaaccctatcagtaataccaaaagtgagaaaatgttgtatctcacttaaataacaagaactgacat

SEQ ID NO: 197947 - DNA, 601 bp, Human
aataaacccagtaagttatttcttctaaattacttcctaatgaactaagtggatgttttatagtagatactgaacaaaaacaatgtaattgtaccatgtcacataccttaaaaaaaaaaacgacaggcaaaaaacgtatgcctgacaattacatgttgttcccttcacaacacaaaatatcattaaatactgacttaataagagttcaaaatgttatgcactgatacatatgtaacatacataacatatatacattatgcactgatacatatgtaatacatatacatatttgtaaacagcattcatgttgaaagcctaaccaattaggtactagggcctaggggctgctgtcaaaagtctcacctgtcgaatgatactcttcacacaacgtactgggaggccttgatagttggatttgatgatccacttgaggagatggtggccaagtacttcgaagaccatgcagacatctgggacacagttaaggatcgtttgtggatgcactgcctggagtgaggcagttattgaaagcagcaccattgtgtcacttgcaaagcacttattactttataaaatacaacatcaaccctatcagtaatac

SEQ ID NO: 197948 - DNA, 601 bp, Human
ttttcttctggcagggcaactgaacaaaacacacatctaatacagtaatttctatatgagttaaacatttccatttttttccccagctttactgaggtacaactgacaataaaaactgaatatattagtagtgtacatgtcttgaaatatgtgtacactgtgaaatgattagcacaaaacagctaattaacctaacccagtatgacatatagactctgtgtgtgtgtacatgatgagaacattcaagtctactctgttaacaaattccaagtacacaataatgttaactatagtcatcatrctgtctattagatctgcagaatttaaccacgttataactgaaactttgtacacaactcttcaattatctattatttaatctccatccaaggatacttagtaaataaacccagtaagttatttcttctaaattacttcctaatgaactaagtggatgttttatagtagatactgaacaaaaacaatgtaattgtaccatgtcacataccttaaaaaaaaaaacgacaggcaaaaaacgtatgcctgacaattacatgttgttcccttcacaacacaaaatatcattaaatactgacttaat

SEQ ID NO: 197949 - DNA, 601 bp, Human
cgtgatccacccgccttggccgcccaaagtgctgggattacaagcgtgagccactgcgcctggccaaattcaccttcttacacactaagcctaaagggtggtggtgtggtcagtcacttaaggcaacagcaagcccctctgaaagcatgaggttctgggaaatgatggagcctgcgggaaatacatgcaggcagctatttctgaaattattcagtatttgttagaatgtgtaattcctttaatattttcaagatttatcaaaaataattaggagattcttcccaagttttaacaatatggytttatttttttgtgtttttttgtgtttttttttttttttaaagactttagagttgctgctaaatgttacaaataatacactagtcttatttggggatcaaataattccacttaacatactaatttctgccctcaccacataacctcttctacattaaagttgttcatttgagatatcagcctgtcgaaataatgaataaaaatgctactatttgaaagctaagggcaaacagatacagtactgaacaaaagttagccataaatctaggcccacatgtatacctagcataatactacatag

SEQ ID NO: 197950 - DNA, 601 bp, Human
aataaaaaatcttcctagtactacccgggagaaagaaatactgaaaacataggctgaatcaaaggggttgaagggaaacctcaggtaagtagattattaactggagtatgtaatttcttgaacaacttactacactgaaagttctgcgtaagcttagggggaaaaaatccagattccatgataatatttttcttaaagaaagatgggttcacacacacaaaaccaaaaccaaaccaaaattccattaacactgcatataagaacaaagtgcagaccacatgacacaatcaaattttcagcwtgaatttctctgaactaaagaaataatataagagctctttctaagtttccaccaaaaacagggtacatgaattacagtgaggataacacacgcattggccaggtgtggtataatcctagcaactttgggaggctgagatgggaagactgcttgagtccaggagacaaagagaccagcctgagcaacacagtgagaccccgtctctacaaaaaaataaaaattagctagcacggtggtgcatgcctgcagtcccagctactagggaggctgaggtgggaggatcactagagcccaggaggc

SEQ ID NO: 197951 - DNA, 601 bp, Human
gatgttgcccaggttggtcttgaactcctggtctcaagaaatcctcccacctcaaccttccaaagtgctgggattacaggcatgagccaccacgcctggctggtatcattattttccccacttttattgatgatgaaattgtggtttgcagaagttaggtaacttggccaaagccctttggtgaaagtagggtatatttgatgccaaacccaagctcttaacaactccatatattgcttcatgaaggccaagaacataaagcttcagcaaacaggcaatgggaagccactaaagaattctmaatgggaatatgagtcattaaagcaaggttttacttgcaatagaaaggagaataaactggaaaagggaccgggaattggatgggctgtatgcacagagagccaagaaaagcctgtgaaaaggtactagctggaggtgataagggcctgaactaaagaggacagcaacagaaatacaaagaacatcaagagtaaaagacatggcaaaggagagttcaacaggcgggttcctggggaagcacagcaagtgatagagtaaggagaatgactggaacatggtcggttatccatgactcttaaga

SEQ ID NO: 197952 - DNA, 601 bp, Human
ccccttgggctcaagtgatcctccgacctcagcctcccaggtagctgggaccacaggtgcatgccatcatacctggctaatttttaaattttgtttggtagagacacggtcttgcgatgttgcccaggttggtcttgaactcctggtctcaagaaatcctcccacctcaaccttccaaagtgctgggattacaggcatgagccaccacgcctggctggtatcattattttccccacttttattgatgatgaaattgtggtttgcagaagttaggtaacttggccaaagccctttggtgaawgtagggtatatttgatgccaaacccaagctcttaacaactccatatattgcttcatgaaggccaagaacataaagcttcagcaaacaggcaatgggaagccactaaagaattctcaatgggaatatgagtcattaaagcaaggttttacttgcaatagaaaggagaataaactggaaaagggaccgggaattggatgggctgtatgcacagagagccaagaaaagcctgtgaaaaggtactagctggaggtgataagggcctgaactaaagaggacagcaacagaaatacaaagaacatc

SEQ ID NO: 197953 - DNA, 601 bp, Human
cccaaagtgctgggattacaggtgtgagccaccgcacctggcccacccttattcttgtttgtctgtttgagtcagaatttcgctattgtcacccaggctggagtgcaatggcacgatctcggctcactgcagcctccgcctcccaagtccaagtgattctcttgccgcagcctcccaagtagctggaactatatgtatgtgccaccactcccagctaattttttatatttttagtagagacaaggtttcactatgttggccaggctggtcttgaactcctgacttcaggtgatacacccayctcaacctcccaaagtgcagggattacaggcgtgagccactgcacccagcccccttattcttaatctccacaatcaaactacaaattatgcattactatttcgagtttacaaatgaggaaacagactcacagaggctaagtaactgatcaggagtacaagatagaagtgccaaagctatgatgttaaatcaagtctgtcaccaaagcacaatacaccttacactttctcttatcccagtggttctcagtgagaggaaaactggcaaagttcagagatatttctaattgccacaatcaggg

SEQ ID NO: 197954 - DNA, 601 bp, Human
accacacccagctaatttttgtatttttagtagagatggggtttcaccatattggtcaggctggtctagaactcctgacctcatgatctgcccgccttggcctcccaaagtgctgggattacaggtgtgagccaccgcacctggcccacccttattcttgtttgtctgtttgagtcagaatttcgctattgtcacccaggctggagtgcaatggcacgatctcggctcactgcagcctccgcctcccaagtccaagtgattctcttgccgcagcctcccaagtagctggaactatatgtaygtgccaccactcccagctaattttttatatttttagtagagacaaggtttcactatgttggccaggctggtcttgaactcctgacttcaggtgatacacccacctcaacctcccaaagtgcagggattacaggcgtgagccactgcacccagcccccttattcttaatctccacaatcaaactacaaattatgcattactatttcgagtttacaaatgaggaaacagactcacagaggctaagtaactgatcaggagtacaagatagaagtgccaaagctatgatgttaaatcaagtctg

SEQ ID NO: 197955 - DNA, 601 bp, Human
ataaaatctaatggctatactttttttgtttgtttggagacagagtctgtcacccaggctgaagagcagcagtgacacaatctcggctcactgcaacctccgtatcctgggttcaagcaattcctgcctcagcctcccgagtagctgggactacaagcacgtgccaccacacccagctaatttttgtatttttagtagagatggggtttcaccatattggtcaggctggtctagaactcctgacctcatgatctgcccgccttggcctcccaaagtgctgggattacaggtgtgagccacygcacctggcccacccttattcttgtttgtctgtttgagtcagaatttcgctattgtcacccaggctggagtgcaatggcacgatctcggctcactgcagcctccgcctcccaagtccaagtgattctcttgccgcagcctcccaagtagctggaactatatgtatgtgccaccactcccagctaattttttatatttttagtagagacaaggtttcactatgttggccaggctggtcttgaactcctgacttcaggtgatacacccacctcaacctcccaaagtgcagggattacaggcg

SEQ ID NO: 197956 - DNA, 601 bp, Human
gctgccagggaagctgagatcaacctaagcccagacgagccagggacgtgactctcaatcatcccactcagggagccatttcacacacatgaggaacaagtgccaggtttctctgggtaaagtcagactttgagttcagcagcagtgcggaaaagaaggctaagtctagggctgggagctagaagccccgagtcccattccaaattaactagctacaggttcagagaaagttccttcttttccttgaacctcaaattcatcttcaaaataaggggcttggttaaaatggtctcaaagcttkctttctgtacatcaacatttgtgtcagataccatctattactggtcttcgcaacacaaatctgctcctctccaccacaacttgattgaaataggtcctgtaatcttgtagataagtcggggaacagtcaagcataatgtggagactcctctaaagactgtctccctggccttgctcacagcccagagtgcaaagcttcccccaaaattctgaactgtaaaaagaaatagaatgagagcaactttccaaattatgctctgctactggtgataagcggtggactttcttcctcccacacctg

SEQ ID NO: 197957 - DNA, 601 bp, Human
tagtaagtatattttctcttctttatgattgtcttaacattcttttctctagcttactttgttgtaaaaatatgctatataacacacatacaaaatacatgttaattggtcatgtgatcattaaggattctgatcaacagtaggctagtaattcatgtatcatacaattgacccctttaggtatacaattcaatggattttagatgtgcgactatcattactatttattttttaaattttttatgtatttattttttgagacagagtctcgctctgtcacccaggctggagtgcagtggcrcaatcttggctcactgcaacctccgcctcccaggttcaagcaattctcctgcctcagcctcccaagcagctgggattacaggcgtatgccaccacgcctggctaattttttttgtatttttagtagagacggggttttaccatattggccagtggtctcgaactcctgaccttgtgatccacctgtctcgacctcccaaagtactgggattacaggcgtgagccaccacacacggcaactaccaccactatttaaatgacaacattttcattgctccaaaaagaaacaacatattcatca

SEQ ID NO: 197958 - DNA, 601 bp, Human
acacatcaagatattttccggctttatgtcagtatgaatgatcttgcacttactgtgtaagtaatctaacccttgaaggacctggatatagtaaaatcaagagagaagataagctattaatatctcattatataacttttatttatttgaaaaacatgtaatacaatgccagggtacaaagtttgataaacacaaaaggatatttagtaaaaatctccctcccatgcctacccacattggaatccagctctcctttccataagcaaccagtgtgtataatttcagagattatttatgctcrtggaagcaaatgcatctacatacagttgaaccttgaacaacacaggtttgaactgcatgggttcccttatacacagattgtcttccacctctgccactcctgagacagcaagaccaacccctcagcctactcaacgcgaagataatgaggatgaagacctttatgatcatctacttcatatgatctatccacttaatgaatagtaagtatattttctcttctttatgattgtcttaacattcttttctctagcttactttgttgtaaaaatatgctatataacacacatacaaaatacat

SEQ ID NO: 197959 - DNA, 601 bp, Human
tcaaaagcttaacaggctgggtccatgatctaaacaacaccctgatggcagtaaaggagatgtgaagagagccccaggcagtcccaggagcctcagccctttagtatccatgcttgcctgacaacacacaaaggcacagatcatggtgtcgaagagtgagaagcacagtccacacttcactgcaccacctccccgaccccgccccagaaataaagatatcccaatactcaggtcacttgatcttcttcccccaccatcaggccttttctaactaactccaaatctgttgatacaactcagrttgacatagctatgctaaatggacaacaagaatttatgtacacaaaattgaagccagaaaaatattctgatgactaaaggtcagctacaggaaagctgttactatgttctcctctgcagagaagctggcaacagaaaaaactgttcaaatatagatgaagcagcaactacaaatttaaatggccttttaaagggggacaaaagtaaatacttccaatattaaaatataatgtagctggggcattttccatttcaagggtgcagttatttccagcaattaaacttttccaaaatcttcctt

SEQ ID NO: 197960 - DNA, 601 bp, Human
gatcacttaagaaaatggaaaagaatacatatcacagtcattaaaccaaatttgtttaaaatataatgaaatgaacaatgtagatgtacatcgatatttggaatctattttgcaagctttctataatttaaatcaaatactgcagttggtatgcagcaaatagtctaggaatcacatgattaaacccctacaccagggtcaaaagcttaacaggctgggtccatgatctaaacaacaccctgatggcagtaaaggagatgtgaagagagccccaggcagtcccaggagcctcagccctttcgtatccatgcttgcctgacaacacacaaaggcacagatcatggtgtcgaagagtgagaagcacagtccacacttcactgcaccacctccccgaccccgccccagaaataaagatatcccaatactcaggtcacttgatcttcttcccccaccatcaggccttttctaactaactccaaatctgttgatacaactcagattgacatagctatgctaaatggacaacaagaatttatgtacacaaaattgaagccagaaaaatattctgatgactaaaggtcagctacaggaaagctgttac

SEQ ID NO: 197961 - DNA, 601 bp, Human
gtcttttaatggctatccaacttcaaaaactattaatcagagcttcttaatcacaaggatctagagtaagtttatgccactgaaacaaatgagtgactcctgaagtcacagcagaagttactcatactgagccatttctcttatttatctaaaatgaaatactaatacatctcaaacacagtcaagctcaagcaccaacagatcacttaagaaaatggaaaagaatacatatcacagtcattaaaccaaatttgtttaaaatataatgaaatgaacaatgtagatgtacatcgatatttgraatctattttgcaagctttctataatttaaatcaaatactgcagttggtatgcagcaaatagtctaggaatcacatgattaaacccctacaccagggtcaaaagcttaacaggctgggtccatgatctaaacaacaccctgatggcagtaaaggagatgtgaagagagccccaggcagtcccaggagcctcagccctttagtatccatgcttgcctgacaacacacaaaggcacagatcatggtgtcgaagagtgagaagcacagtccacacttcactgcaccacctccccgaccccgcc

SEQ ID NO: 197962 - DNA, 601 bp, Human
ggagggggaggttgcagtgagccgagatcgcaccacttgcactccagcctgagcaacagagtgaaactcagttttcaaaaaaaaaaaaaaaaaaaattaacaagacattaagtcttacctatttgaggatacacagcttttataaatgtgtctaccctttaaatacacaacttttttataatttgaacaactcaataataaacggtctcttttaacatggtgcatataaagtaatatgcgtaagtacttacaggtttctgctgtggagccgtactcactaaaataaaatcaaacaaaatckgtatttagcagaaaacagacacatgccttcatgtaggtcattcgaattgcaaagtgaaataattattgtcttttaatggctatccaacttcaaaaactattaatcagagcttcttaatcacaaggatctagagtaagtttatgccactgaaacaaatgagtgactcctgaagtcacagcagaagttactcatactgagccatttctcttatttatctaaaatgaaatactaatacatctcaaacacagtcaagctcaagcaccaacagatcacttaagaaaatggaaaagaatacatatc

SEQ ID NO: 197963 - DNA, 601 bp, Human
aataaggacatagtgttttgacaggaccacaaaatagatcagtctctttcttatttaacatccgcatggaaaaaattagaacaacagcttcagaaaaacaggtaacttagcagccaatcagaaataatgtaaagtggttttgaaataaaaatacttcaactccatcacctcacatttcactaaacttggccaccatagtccagaaaatgcataaagaagacaatttttgaaaggctctaactatcccaactctgcacagatcattaaaacttaacaagacaggctgggcgtggtggttcamacctgtaatcccagaaatttgggaggccgaggcaggcagataacttgaggttaagagttcgagaccagtctggccaacatggtgaaacccctctctactaaaaatacaaaaattagttgggtgcggtggcaggtgcctgtaatcccagctactcgggaggctgaggcacaagaatcgtttgaaccagggagggggaggttgcagtgagccgagatcgcaccacttgcactccagcctgagcaacagagtgaaactcagttttcaaaaaaaaaaaaaaaaaaaattaacaagacattaagt

SEQ ID NO: 197964 - DNA, 601 bp, Human
tctccatcaataaaatacattttgaatatgcttatgtaccacctggtaaacacctcttggcttttggggtaaaaccttcaggttttctaaatctcatttttcattcatttagtaattggcctgctcttataagaaaaagttagctttaagggaaaataactctttctaaataaagttgcacttccatttctaccctctataatcttcagaaacagacttgtggtgcattacagttaggtaaaaagttaatgacaaaataaagcaccatcattagcatgatagaaacatggaatttctcaaktattttacatttttaaaaactattttgaaatgttaacatatttctggcatacagttcacaaatgaagtacgaggctatttcccatatttcccaatagggagttggagagaatcatccttgtcatctgcagcagcagcacaaatcagcccccatgttgacctggcagaaccctactaatggagctctgagaaccccatgcagcccaggttccaggccccactgaccattgtcctttgcagtctctgcctcagccgcctcctctaatcctgttgtttttagtttcacctctgggcagtattc

SEQ ID NO: 197965 - DNA, 601 bp, Human
gttgcagtgagccgagatcgcgccactgcactacagcctgggtgacagagcaagactcaatctcataaaaaaaaaaagaaacttcaagtaagagaaaaattgaactgcaacagcaacaataagtctggataaggtacctctcactactgccctttcccagaaattaacctacattctatgtaagcaccttcaaacactccctggaaaggggaacaggagctgaccacgtccagccaagtaaagaaagcaaatccttaggaggattcatcatagccagtgcgtaacaaagccagcttactcrgcgtgcaattccagactgctggaaccaaaggggctgcagaatgtcgggctgtttgcagggctggctcatcaattttactcgctgtgtgttaaacagtcttgtcagtagagggagcagagggaggtttcagagcttttcccccataagccagtatggaaaccagctgtgttacccagttttcacttactagagtcacttggcattcactcccaaaataaggctttgaataagtcaagccttcttaggtagacaagaacacaagagccaatctataatctgtcatcacatttaaatccatgc

SEQ ID NO: 197966 - DNA, 601 bp, Human
gagaaactttagaaagaagccagtgtgaacggtgtagaatgaattagggaaacagagaatgggtctggagcaggcaccaacagagacctgccagggaacacactggagagtttgtcagcttcagtgaaggacaactcagggcatcactactctacatgggaaacacaatggagatcatgttggtgaggcgagggtgggtaagggggaagaagttaagccttaaacagttctctctggactgccagacagagacagactggggagcaaaagctcaagtgataggagcacggaggctgtgttaacagtagcctagcaaggactgacagtggtgtgggtccccatcgagtgacacagaaaggattccagaaatagcccacaggtaagaccaacaaaaccaccctgttccagggcctttgtccttcagatgtgttgagccaagatacacactaaggctctggcagctgatcatctaagagggaccatcctcttctcaaccttcaatggctgccaaattactctaggaaaaaagtgtaccttctttagcctggcatttaggtttcttcaagttcctcaaactggccccagtctttcttctactatg

SEQ ID NO: 197967 - DNA, 601 bp, Human
ttacaggcataagccaccgcacctggcctaaattcaggggtgtttcttgtacttaatatccctcattaaggttcactgaacagaatctctttggtgacatgctgttatcctcctggttcgggtttgtaaacagttacttagcttctgatgcgttccaaatgatgctaggtaatgtatctcaataacttaattgtataaaaacacaacaggaggtaaaagagattttgcttttctttcttttctcagtatgatagttcctgaactaaggtaccagactgctacattcccaagaagtccactgaaacccaactggaatgcttttgtcacacctcctctgactgagtcaccacagtagtgacctgtcacacggtttccttcttacagataatggtgacacaaaggacaaactggagctgtcttccttccaaaatgaaaagcttgcaattgcactctgcttccactaagaggggaatgagtggaaagctttcacttcgggaagaactgggccccttaagtcaccttctgatacgctagtctttgggtgacactgtggtcactcattccacaagaagctatcctaggaactattagatggtagcca

SEQ ID NO: 197968 - DNA, 601 bp, Human
aagacccatcacctcacatttaaatgcagggaatttttttttttttttttgagacagagtctcactctgtcgcctaggctggagtgcagtggcgcgatctcggctcactgcagcctccacctcctagattcaagcaattctcctgcctcagcctcccgagtagctgggattacaggcgcctgaaaccatgcccgattaatttttgtatttttagtagagacggggtttcaccatgttggccaggctggtctcgaactcctgacatcaagtgatctgcccaccttggcctcccaaagtgccrggattacaggcataagccaccgcacctggcctaaattcaggggtgtttcttgtacttaatatccctcattaaggttcactgaacagaatctctttggtgacatgctgttatcctcctggttcgggtttgtaaacagttacttagcttctgatgcgttccaaatgatgctaggtaatgtatctcaataacttaattgtataaaaacacaacaggaggtaaaagagattttgcttttctttcttttctcagtatgatagttcctgaactaaggtaccagactgctacattcccaagaagtcc

SEQ ID NO: 197969 - DNA, 601 bp, Human
gactggcaaatgacttaaactctatgaggcttggtgttcaggaaaagaagaatcggaagggaccaccccttccccaccgaagacactaaaaacccaaacacaggagagtcaggacagcatctgggcgcctggccagacgcaggggcttccctctgctgtgaccagctgaaccatcgtctggggcagaggctcccaactggtcagtgagggaccagagagcagcagcagagggaaggggaggcccaagagcaagttccgcccccacaaacaactcaaatcataggtctaatgagaagagggygaagcccggttagacatattgtggtcctcctgagccacagaacgatgtgatttctttttctccatgagaacagtagccgagttggctgttatctgagggcactcaagtggaaggagatgatctgtaatctgccaccactctgagatgttgtttttaaaaacatttctcaggagctgcttaattcaatcacgctagaagaaatatactttcaaagacccatcacctcacatttaaatgcagggaatttttttttttttttttgagacagagtctcactctgtcgcctaggctggagtgcag

SEQ ID NO: 197970 - DNA, 601 bp, Human
ccagcagcaaaacaggcctgacagatagaagaagaggcttctgccgccctgtggaagccgtcatctcaaccactctgggaacagactctgtcagagggagtgggcgttgctgccactgtttcagaaggggctagacatcctagaataagccagaatatctgctagctcttgctttataagggaagagagattatgcattggcatctggggaaatcccttccagtctggaaaggtgaggaaccctgcatgtctggttgaccaggcagaggcttacctggaggggctcccacctgcccgcctyaggcagtcttcccctggagatgctacctcatcttcctccacagtgtgagtgaagggaaaagctccctataccctgcacattttcagggaccacaagtgaagtcactgtgtcacaacaactgagtctgattcatggggctgtgggctgtgcagggccttaagaagagaccatgtctctctcacaagcccacaaccacaccaaacacccagggcccgcctgaggaggatccttccacttcttaagatgcctgcggcagcaaccttcccctcacccagcccacggtggatgacccttacagtc

SEQ ID NO: 197971 - DNA, 601 bp, Human
cctatttttctggttatatcaccaaacttaataccccaaattagaagcacagcatttcagagttcaaagagtacttagcgcctaattcggggcagccctgctgctagtggccattgtggtctaacctccccacatcctgaaatggcccctgctccccgactcccactcagtgtctccgcagctcccgttacactaactcccacgtctcagtctgcctgctggggtcacacagagagggtcaaatgcctctccacacagcactctctaaattcaaagtgaccatcattggccaccggttctyttaaccgttcttttctatacctagctaaggcagggacttggtttttgatatggaagaactttaatacctttaataatttaaacgttattgtctggtattatccttaagagcaacgagggaatagaaaggcctggtgtttcaggacctatctggccatgtgctgactcagatcatgctgagtcaaagctgaaagacagaaagcaccctctttttctcctatcagctggcactatctgctcaacaatgcttttacttgagcattagaggaggtaaaacacagtaaattcaagaaaattgtta

SEQ ID NO: 197972 - DNA, 601 bp, Human
tgctgggattacaggtgtgcatcacctcgctgggcctaagtataatctttattattatttttaatacctgggaactccggattcttctctacttggctcaatcccctcaaagggctcttccctggacctacttgtttccagattcttgggagaccaactacctctctcctaaaacattctcctatgctgaagtatcccgattctgaacaaataagatcacgtatttgttctgtaatgtgaccagtgccgaagaagtctggtgaagtttgttggaatggcttttcttgtttctatggcactraccaggactcaccatggagttcataaaaagtcctatcagagactctaatacataaatgcagagaaaccaatgcttcagccacaaagaagtttcagattatatgtacttacactggaaggtgtaaagctcaaaaaaaaagtaaaactcaagaaaagtaaaacagatccaaacccaacatacccttgctgtggtccctcattctgttgtgcttctccagctgcagagcctaaagctgtcctccctgacaatagccaatggctaccacccgtcagctctcattcccaacagagtctctgtgag

SEQ ID NO: 197973 - DNA, 601 bp, Human
actgcaagctcacaccattctccttgcctcagcctcctgagtagctgggactacaggcgcccgccaccacgcccggctaattttttgtagagacgggatttcaccatgttagcctgacctcgtgacccgcctgcctcggcctcccaaagtgctgggattacaggcgtgagccaccaagcccggccaaataattttctttttttttaaaggaacaaggaagatgaaggctgtaatgctacccatttttgattctttggagagtggcaagattctcttaacaatacaacatgtacaacagggmaaatgcacattacaatgaaaaaaactctgccttcaactcagttactcccagtataaccttctattgcccaggctgagtgcagcggcacaattttggctcactacaacctctgcctcctgggttcaagcgattctcctgcctcagccacctgagtagctaggactataggcacgtgccaccatgcccagctaatttttgtattttcagtagagatggggttttgccatgttggccaggctggtctcaaactcctggcctcaagtgatctgcctgccttggcctcccaaagtgctgggatta

SEQ ID NO: 197974 - DNA, 601 bp, Human
tgctaactaactcttttaattaattttcaaaatgacttcaatctggttgcatatatttctttttctttcatattttttagagaagggacctcgctatgttgtccaggctggactcaacctcttgggctccagtgatcctctctcagcctccagagaagctgggactacaggcgcactacactgcacccagctttgtacatatttcttactgccaaaatatgtcaggtatgtattctttgaaaaaaatcatcattttgattagcacccacatattcccaagaaaacatgtatagaagccaaycaatgaaataatttttttttgagacggagtctcgctctgtcacccaggctggagtgcagtggcacaatcaatctcagctcactgcaagctcacaccattctccttgcctcagcctcctgagtagctgggactacaggcgcccgccaccacgcccggctaattttttgtagagacgggatttcaccatgttagcctgacctcgtgacccgcctgcctcggcctcccaaagtgctgggattacaggcgtgagccaccaagcccggccaaataattttctttttttttaaaggaacaaggaag

SEQ ID NO: 197975 - DNA, 601 bp, Human
tttaagctagtaacaatatacaaaaatggcaactgctactgctctgctgatcaaagagaatgttttaaaagagaaaaaaagaataagctaaatcccatttctggtttttctcatagctgcttctattctgaacggatcttgctgtcccaaaaggtgctcagaggcccaatcactgatgcctgtggatctgtgactgccctccccattcccgccccaaggagccaatactggggaaacttcactgcatcaacctaccttctttttctttcaatgaccacacagtgctggaaaggcacctttaagggaaggctcacctgcctgggtgaggggccacctctcctggcactgtctttaacaaaccaagagtgagtgcagtcagcccaggaccacatcttttcaccttttttaaaaaaaaagactgcctgtcaatcacttgaaggaaggaaggatggtgacaagatggcttccagctgaccgagcgataagcattaatttatgaactcaggatccctgccctgaacctggcataggtctgagcaagacacggacatgtcacatctcagcatggtgagctggtggtcccagcactgtggatgcacga

SEQ ID NO: 197976 - DNA, 601 bp, Human
aggccaccccagcatcgcaagcaaataagcatggagatggtcaggtttacagatggcattcaagccagaattcctgggttttcaactcagctcccaaacaggacagagaaatgggcagcacatcaatggtcaaaaggaccacatagaggcttcaggtctgtatcatctgtcttctctcagccagctgggttcctgccctgtgcaaggccaggaagagccgctggtgtagggcccctgagggctcgctggagtgctgcctgtgctaggcaggctctgcccattcactgagactgagggggcrtcaaactcaaaggaaaagcatctgaatttggtgtttgaaaaccaaacacatggctctatttcagtacaaaaatacagtactctacagaagttcagggctggcagaagacctagaccgaggtattcagcaggcaccaatactcaccttcgtctctggaatagtcttccccagaatgtggttcaaacaaataatctcccgttgccagctcaaatgcctaggatacaacagacgacatgctaagcacttcagagactggcccccaagtcaacagctttttctccttatagaagagaccgccac

SEQ ID NO: 197977 - DNA, 601 bp, Human
aactcagtgacttcacttgatcattcaaggcctctctttctgtccctctttccttccttcccgctgtgcacagtatggagtcctcgatcccctcaacagacagacgattaacaaagacaaataaatgcacagccaggcgcagtggctcacacctgtaatcccagcaattgggaggccgaggtgggtggatcaccttaggtcaggagttcgagaccagcctggccaacatggtgaaaacctctctctactaaaaatacaaaaattagccgggcgtggtggcaggtgcctgtaatcccggctwcttgtgaagttgaggcaggagaatcacttgaagcctggaggcggaagttgcagtgagccaagattgcgccactgcactccagcctggacaacaagagcaaaactccatctaaaaaaaaaaaaaaaaaaaaaaaatcaatgtggttctccaaatttagctaagtaaggtagacagagcatctgggactttcagaaatttctaaaagtccatgtcctactcacatcaactttaaaagttctttattaagggctgtcacatccaaaaaaaaaatctaacctgaaaaatatgaaggaccaacta

SEQ ID NO: 197978 - DNA, 601 bp, Human
gacaccctccatttgaaattcgttgaagaagttctcctaagggaaaaaaaatgagggatgagggagggtatatgtgatctttccagtgacaatctgcagagtgtgcaggcctctcagaagcttttgctcacctgttccagctcacaccacatgctcactcctccattagccagcttgtcacaaaggatgaagttaagcttatcagggctgatgcggagggtgcaggttttggcaagcttggctatcatgttactgattcctaaagcaggggttaaaataaggaattactaaaatgcacatwatgtatcctagagaccaacttattttgcagaatttcttgttcatcaacttctcggtggaaaaataaccacttaacgttggtatcacactggaaagtactttaatacccctgatgtcacgcaattctcccaacaaactaggggagatgtacagcacacatcatcagtgttcaaataagaaaacaggcacctaccagtcattcattcattcaacatggatttattgactactaggtactgcaatacacagttaaatgcaaggttaggcactgtcagggtggagggacgaatggggccttgaa

SEQ ID NO: 197979 - DNA, 601 bp, Human
agtggggagaaaacatgtcaaaggtgaaaatggatagaaaccatgatttctagacaaggtgacaataccactacaagaaacagagaggctggaagtttcacggcttggaaaaagcagcattctagctgaatgcatatgataacaacacaattttaaaatgaggaggaactgactctaatgcaaaatatagttatggaccagatctttaaatttaaataaaccaaacagctttcaacagtatttattgttaaaaaggctaggctaactatgtctattccttcgaggccaagacttctgtgtyagaaaccctgactctcctactcaccagctccacggagaccgtgaggcagggaaagtgtttattagtcagtttgattttcaaagccctggcattctgggcagtcttcaaggctcgagataagttttccgatgttagctctaaataaatctcattgttttctgcagagacaccctccatttgaaattcgttgaagaagttctcctaagggaaaaaaaatgagggatgagggagggtatatgtgatctttccagtgacaatctgcagagtgtgcaggcctctcagaagcttttgctcacctgt

SEQ ID NO: 197980 - DNA, 601 bp, Human
ttatagcagatgaggcagggtgggagtggggagaaaacatgtcaaaggtgaaaatggatagaaaccatgatttctagacaaggtgacaataccactacaagaaacagagaggctggaagtttcacggcttggaaaaagcagcattctagctgaatgcatatgataacaacacaattttaaaatgaggaggaactgactctaatgcaaaatatagttatggaccagatctttaaatttaaataaaccaaacagctttcaacagtatttattgttaaaaaggctaggctaactatgtctattycttcgaggccaagacttctgtgttagaaaccctgactctcctactcaccagctccacggagaccgtgaggcagggaaagtgtttattagtcagtttgattttcaaagccctggcattctgggcagtcttcaaggctcgagataagttttccgatgttagctctaaataaatctcattgttttctgcagagacaccctccatttgaaattcgttgaagaagttctcctaagggaaaaaaaatgagggatgagggagggtatatgtgatctttccagtgacaatctgcagagtgtgcaggcc

SEQ ID NO: 197981 - DNA, 601 bp, Human
ctgcttgacatagataactgccaagaaaagaatttaaaaatatttttatgttgttaatattaagcaacaacaaaacaaacccgaagacccgggacaaaaaagttgaaataccaaatctaagtggaatgctgtcagtttattcactcaaaagccattcgaccaatattgatggtgccaatatttatggaacagactctgggtacttccaggaactgggaagtgtggtgaataagacaaaaaggtccttagtgttccagtggaacaaacagatcaataaaaatgcaaacaaatgaaactgtakgaaatgctcattatagccgtgagaaagcactccacagagaccagggtgagtgtgggggagtttccttagactgaggaggtgacatttcagataccaccaaaagcaggagaagcagcagccatgggaagacaagaacaaggggacagggtttcaggctggggaaacagcacatgtaaagccgtgaggcagaaagaagcaagcctgctatgttgacgcaaccaagagaaggccattctttgggcataggacactcagagtgctgcagtttctaacagttaaaaggcaaactatatttatttc

SEQ ID NO: 197982 - DNA, 601 bp, Human
cggttcttgtaagtccttccacaatttcctaggaatcacctttatggggatgtcatgggtcacaatgcggctactgcttgacatagataactgccaagaaaagaatttaaaaatatttttatgttgttaatattaagcaacaacaaaacaaacccgaagacccgggacaaaaaagttgaaataccaaatctaagtggaatgctgtcagtttattcactcaaaagccattcgaccaatattgatggtgccaatatttatggaacagactctgggtacttccaggaactgggaagtgtggtgaataagacaaaaaggtccttagtgttccagtggaacaaacagatcaataaaaatgcaaacaaatgaaactgtatgaaatgctcattatagccgtgagaaagcactccacagagaccagggtgagtgtgggggagtttccttagactgaggaggtgacatttcagataccaccaaaagcaggagaagcagcagccatgggaagacaagaacaaggggacagggtttcaggctggggaaacagcacatgtaaagccgtgaggcagaaagaagcaagcctgctatgttgacgcaaccaagagaa

SEQ ID NO: 197983 - DNA, 601 bp, Human
acttccacaaaataaacagaaaataaacagaaatataaaagtgccccctagcttggtgtgaggtgtgcttggaataaaggctgctatggtgtggcatatctttgtccctggctcactgaaagacacttggcacgcagacaggaaactccaaactcactgtcagtcatatcagtgactcacagaaaaatacgggcacgttagcaggtaaaagatacaatgttccagccgggcgcggtggctcacgcctgtaatcccagtactttgggaggcctaggcgggcggaccacgaggtcaggagatsgagaccatcctggctaacacggtgaaaccccgtctgtactaaaaatacgaaaacaaaaaattagccaggcatggtggcaggcgcctgtagtcccagctactcgggaggctgaggtgggagaatggcatgaacccgggaggcggagcttacagtgaggtgagatggcgccattgcactccagcctgggcgacagagtgagactctgtctcaaaaaaaaaaaaaaaaaagaaagatacaatgtttcatacaaaatataagaggaaaaacaggcagattaaaggcaaatataaaagctttcct

SEQ ID NO: 197984 - DNA, 601 bp, Human
cacgagaccttcagagatcttagcaggtgatttaccatgtacactggacagctcagctccatggaggaggagcttccagaggggtggtggggaaaggtctgtgatgaagcatgagaatggctaagtgccttccagggagatggagagaagaagccatgtgtcaaatggcaaagaaactgaacaaaaaagaagaggcattgtgggggaataccagaacccagcctcgttctgcagggagggtgtggcaatacaacagagatgtggctataaaggtggcctggtacactgtcaagatcaaaagtttatgcttcatcaggtggacagtggtttttagaagattcagggacataaccaagggtgttttttggagcaggataggagggagcagggggaggagggaggggcagtgagtgaaggaagaattcacaataaccccaggtatgaatgaggataacctacacatttcccaccactgtcacacactgtaacatttcgagccatgtggccataggagacttccacaaaataaacagaaaataaacagaaatataaaagtgccccctagcttggtgtgaggtgtgcttggaataaaggctgctat

SEQ ID NO: 197985 - DNA, 601 bp, Human
actgagtggcaatcccacactgggcagctgggacacaaagatgattaagatggggtttcctttatcaagaagctggtggttcacgagaccttcagagatcttagcaggtgatttaccatgtacactggacagctcagctccatggaggaggagcttccagaggggtggtggggaaaggtctgtgatgaagcatgagaatggctaagtgccttccagggagatggagagaagaagccatgtgtcaaatggcaaagaaactgaacaaaaaagaagaggcattgtgggggaataccagaacccmgcctcgttctgcagggagggtgtggcaatacaacagagatgtggctataaaggtggcctggtacactgtcaagatcaaaagtttatgcttcatcaggtggacagtggtttttagaagattcagggacataaccaagggtgttttttggagcaggataggagggagcagggggaggagggaggggcagtgagtgaaggaagaattcacaataaccccaggtatgaatgaggataacctacacatttcccaccactgtcacacactgtaacatttcgagccatgtggccataggagacttcc

SEQ ID NO: 197986 - DNA, 601 bp, Human
ctgctgttgggttaccaggactgaggatggctgagccaaactccacacgcccaggctaccagacttctgccatcccctcacataccatcgggcacccctcttctactcctgctcttgctgcccggggactgtctccacaggtcacaagggactcctttcctttgaagctcctctacccaccccaacaaccaatcagttcttttaattggatggaacctagaagtgaagcatatgccacagtatggtttgaggttttgctaacctatcctggtccactcccgcacctacaatgaaatttccycctaaaagaaccagtacctgttatttctctttttgatgttgatatctgcccaatgttaaagcctaggaggtctctggaaagccagtgtgtagtctgctggatagcattttgccatctagtactagaaaagtgccacctagcaactggtcttatttagggccattccatcctcacagtgtcacagaaagaaaacagagaaggcactctgtctgcacggctctgtatcagtgttcatgtttactgaatacaatttagtgttccttgttcttattccttaaaattggtgaactctgaatagtt

SEQ ID NO: 197987 - DNA, 601 bp, Human
ttcggcccacatattgaaaggacacaccacacacctgggaaaactgaccccggatggtcaagacaattggattgaaagaaaaatgggaaaaatccccagggtatttagtccccactttcaaatgaataaatccaagctgtgaaacaaaatcagaatggagtcattctttttgatagcaataatatacaccagcagacaatgcagtgcagtgagccaaactgacattataaacacatgataaccaatgaaatcctattcctgtgagtccttcttgagtgatatgctagagaataggcttttrataaccaaaaaaatcattggagaagttacagcataaacagtgtgagccttattttgacctttagaaccaaaactaaacaacaggaatgaagaggacagaataacgtgtagtaataaaattttatgctctgatgatgtagacataatataaccattacaaaacaggaagggggaaaatgagaagaatgtggaaatcagtgtcttatttttataaaatataaatcaaccatttgtcataaacacacatttaatatgactataaggccttcagaatctcatgagaacatagccatttatttag

SEQ ID NO: 197988 - DNA, 601 bp, Human
acaacataaatcagaattagggaagctcagacatgagatgaccagagagcacgcacataaaacacagctgacagcacaggaagtaattagaaacataaggaaaaatttcagaaacagaaactagtttagaaggaagactagagcaaataggcaccacagagagaatagtaagagaaactgggatggaaaggagaaagataaaatttaccaaacagaaacaaagagttaaaaggatctgacagaaaataataaagacagtggagaagatccaagccctctgagtcccagaagaaaaacaaarcactggaaaagaaatgctatcaactacagctcaaaactttcctgaagtgaatgaagagttcggcccacatattgaaaggacacaccacacacctgggaaaactgaccccggatggtcaagacaattggattgaaagaaaaatgggaaaaatccccagggtatttagtccccactttcaaatgaataaatccaagctgtgaaacaaaatcagaatggagtcattctttttgatagcaataatatacaccagcagacaatgcagtgcagtgagccaaactgacattataaacacatgataac

SEQ ID NO: 197989 - DNA, 601 bp, Human
gggcgcggtggctctcgcttgtaatcccagcactttgggaggccgaggcgggcggatcacgaggtcaggagatcaagaccatcctggctaacacggtgaaaccccgtctctactaaaaatacaaaaaattagccgggcgtggtggcgggcgcctgtagtcccagctactcgggaggctgaggcaggagaatggcatgaacccgggaggtggagcttgcagtgagccgagattgcgccactgcactccagcctgggtgaaagagcgagactctgtctcaaaaaaaaaaaaaaaaaaaaaaargagaaatgaacaataatagacgctatgacacaacaacataaatcagaattagggaagctcagacatgagatgaccagagagcacgcacataaaacacagctgacagcacaggaagtaattagaaacataaggaaaaatttcagaaacagaaactagtttagaaggaagactagagcaaataggcaccacagagagaatagtaagagaaactgggatggaaaggagaaagataaaatttaccaaacagaaacaaagagttaaaaggatctgacagaaaataataaagacagtggagaagat

SEQ ID NO: 197990 - DNA, 601 bp, Human
ttctagagtcattaaattagaaaactattttggtccactttcactcctacaatgaaacttcctcctaaaagaaccagaaaaaccagccgggcgcggtggctctcgcttgtaatcccagcactttgggaggccgaggcgggcggatcacgaggtcaggagatcaagaccatcctggctaacacggtgaaaccccgtctctactaaaaatacaaaaaattagccgggcgtggtggcgggcgcctgtagtcccagctactcgggaggctgaggcaggagaatggcatgaacccgggaggtggarcttgcagtgagccgagattgcgccactgcactccagcctgggtgaaagagcgagactctgtctcaaaaaaaaaaaaaaaaaaaaaaaagagaaatgaacaataatagacgctatgacacaacaacataaatcagaattagggaagctcagacatgagatgaccagagagcacgcacataaaacacagctgacagcacaggaagtaattagaaacataaggaaaaatttcagaaacagaaactagtttagaaggaagactagagcaaataggcaccacagagagaatagtaagagaaactg

SEQ ID NO: 197991 - DNA, 601 bp, Human
agaattctagagtcattaaattagaaaactattttggtccactttcactcctacaatgaaacttcctcctaaaagaaccagaaaaaccagccgggcgcggtggctctcgcttgtaatcccagcactttgggaggccgaggcgggcggatcacgaggtcaggagatcaagaccatcctggctaacacggtgaaaccccgtctctactaaaaatacaaaaaattagccgggcgtggtggcgggcgcctgtagtcccagctactcgggaggctgaggcaggagaatggcatgaacccgggaggyggagcttgcagtgagccgagattgcgccactgcactccagcctgggtgaaagagcgagactctgtctcaaaaaaaaaaaaaaaaaaaaaaaagagaaatgaacaataatagacgctatgacacaacaacataaatcagaattagggaagctcagacatgagatgaccagagagcacgcacataaaacacagctgacagcacaggaagtaattagaaacataaggaaaaatttcagaaacagaaactagtttagaaggaagactagagcaaataggcaccacagagagaatagtaagagaa

SEQ ID NO: 197992 - DNA, 601 bp, Human
tgaatttcaacctttttacatgaagagacctcaacaggtaggttatctgaaacaattaacttatccaaagcaaaatataacccactagaaaacttacctaatggaggatttccaagatctttaaaatgagttgtaacacatactaattcagtttctattttcaaattcaattctccatctaggtttgcttcaataacctgcaaattgagtattttacatagtcttagaaaaggaagccaaaaggaaaaaaactccatgggcaacagctttcacacaaccagatgacaaagtaccctacaawacctcaaaacacctcagagcacactgagacccccgtgctatcagggaaagtgagaagataaggcccaagagccaagaactcagaaatctcccaaaaatctcaaaggggaagtccccctgcctgcctcccggaatgaagaactcagtgaagatgtgaaaacaggtggaactccgagaggacttgccaggagactacagcagcacaagggcagggctctagggagggctgggtggagctgatgagaactccctcacagcaggagagagtcctgcactgagaaggaaccacgggaagtaagag

SEQ ID NO: 197993 - DNA, 601 bp, Human
ctgaatttcaacctttttacatgaagagacctcaacaggtaggttatctgaaacaattaacttatccaaagcaaaatataacccactagaaaacttacctaatggaggatttccaagatctttaaaatgagttgtaacacatactaattcagtttctattttcaaattcaattctccatctaggtttgcttcaataacctgcaaattgagtattttacatagtcttagaaaaggaagccaaaaggaaaaaaactccatgggcaacagctttcacacaaccagatgacaaagtaccctacaraacctcaaaacacctcagagcacactgagacccccgtgctatcagggaaagtgagaagataaggcccaagagccaagaactcagaaatctcccaaaaatctcaaaggggaagtccccctgcctgcctcccggaatgaagaactcagtgaagatgtgaaaacaggtggaactccgagaggacttgccaggagactacagcagcacaagggcagggctctagggagggctgggtggagctgatgagaactccctcacagcaggagagagtcctgcactgagaaggaaccacgggaagtaaga

SEQ ID NO: 197994 - DNA, 601 bp, Human
gtctcaattcctttgttcttcacccaagcatgaaacaaagtcaactgaatttcaacctttttacatgaagagacctcaacaggtaggttatctgaaacaattaacttatccaaagcaaaatataacccactagaaaacttacctaatggaggatttccaagatctttaaaatgagttgtaacacatactaattcagtttctattttcaaattcaattctccatctaggtttgcttcaataacctgcaaattgagtattttacatagtcttagaaaaggaagccaaaaggaaaaaaactccwtgggcaacagctttcacacaaccagatgacaaagtaccctacaaaacctcaaaacacctcagagcacactgagacccccgtgctatcagggaaagtgagaagataaggcccaagagccaagaactcagaaatctcccaaaaatctcaaaggggaagtccccctgcctgcctcccggaatgaagaactcagtgaagatgtgaaaacaggtggaactccgagaggacttgccaggagactacagcagcacaagggcagggctctagggagggctgggtggagctgatgagaactccctcaca

SEQ ID NO: 197995 - DNA, 601 bp, Human
ataagaaatgtgatcaagtgaaacagttttgcatctgctacactaatttcatacatatggaagtaactgaaggaggagaatataagaacaaatgtatctacctttctgaatccatgccaggttgagaaatagaaatctttaggagtaggacaggaattgaatagctggaagggatcttggaggttatgtaacttgatccgaattctacagaggatggagaccctgcacagatctgtcagctacttggtggcacagcttctccccctggtggctaactgccccactacaccacagggatacrtagtccagtctcaattcctttgttcttcacccaagcatgaaacaaagtcaactgaatttcaacctttttacatgaagagacctcaacaggtaggttatctgaaacaattaacttatccaaagcaaaatataacccactagaaaacttacctaatggaggatttccaagatctttaaaatgagttgtaacacatactaattcagtttctattttcaaattcaattctccatctaggtttgcttcaataacctgcaaattgagtattttacatagtcttagaaaaggaagccaaaaggaaaa

SEQ ID NO: 197996 - DNA, 601 bp, Human
gtttctcccctggtcctttacctgctttcctgctcaggcagcccctgctactgtgcagctgccactttccagccatgattctaaccccctcttggcttataactcaccaaactgtccaaccgtcccctctctccccacttgctgaactgactctatcgtcccttattaccttgtatgagataagaaatgtgatcaagtgaaacagttttgcatctgctacactaatttcatacatatggaagtaactgaaggaggagaatataagaacaaatgtatctacctttctgaatccatgccaggttgagaaatagaaatctttaggagtaggacaggaattgaatagctggaagggatcttggaggttatgtaacttgatccgaattctacagaggatggagaccctgcacagatctgtcagctacttggtggcacagcttctccccctggtggctaactgccccactacaccacagggatacgtagtccagtctcaattcctttgttcttcacccaagcatgaaacaaagtcaactgaatttcaacctttttacatgaagagacctcaacaggtaggttatctgaaacaattaacttatccaaa

SEQ ID NO: 197997 - DNA, 601 bp, Human
gtcctcatgggtgctttcagaggctaaaatgataggaatgcatttaaatacaacatcttcccacgtaacaggaaacctggagatactcaatgcattttacttaaataaatgattcactttagcactgattttagcatcctgaagaaatattgcaacttgtaaatgttgtcattcattaagcattaggtcctaactatttaaaatactatgataatttccaaggcatctttatttacaggggacttgaaatataactcaatctccctcttcaggtcaaagaaaattgtatttatttgtactyactatgtattttaagagtgaaaatatatacattaactaatacaaggcctgtcattctgaagtggaattaaaaaaaaaaagaaaacatcctttctacctctgagaaagtaccaaagataagtcccaccttatgtttattaaaagaaacaaaatgagtgacatcagaatgaatcgctttacacaatattatcaaaggcataaccgtatggatttcactctgctggagcaggatgctcttaactagaaagtaaaaattccttccaactctatgctaaaatctgtgtttatattcaagcagact

SEQ ID NO: 197998 - DNA, 601 bp, Human
aagacatcacaagggaaaacttaaatccaagccaaaccgtgtctggcactctgagcaggtcaaattagatgaccatggagaaggtgggatgatctgcacccattctcccgatggcatctccaggtgtgctggccaactgaggcagcacacaacccacctaccaaccagtgtggctgcaggtttcaggccctaacagagtgcccaggggttgtttctctgctgccaccttaggtacttctgaatctaggaaaatttaaaaaaccccactgttctaggaagttaaagtccacataattgagcttttttttttttttttggatttatgagactatatgcaatctgttagactagagttgactgcagtatttagaatatgaaagaatatgaaaaacaaaacagagaagcacactcactgcataaggcctttgtgggatttacttgttgtccagcaagaaactgtaggagcttcctaatatctatgtgcacttcagccatgtgttccacgtttctgtcctcatgggtgctttcagaggctaaaatgataggaatgcatttaaatacaacatcttcccacgtaacaggaaacctggagatactcaat

SEQ ID NO: 197999 - DNA, 601 bp, Human
tatgctacaaaacgtggaacttcaaatccaggatgcagtcgcttttaggttgctgtgatttcagtagtaaggtgacaaaaatgccttgaaaagctcttggcaggtaatgcctttctcatgtgtggtcagtagatgaagagtgctggagcaggtgtgtgacctcacaagatggggcccagccagaatcaagaggcaactgttaacaaccagcagccaagggacagatatggggcagcgaatgcaggccagcatagccacagaaaggaaacaagacatcacaagggaaaacttaaatccaagmcaaaccgtgtctggcactctgagcaggtcaaattagatgaccatggagaaggtgggatgatctgcacccattctcccgatggcatctccaggtgtgctggccaactgaggcagcacacaacccacctaccaaccagtgtggctgcaggtttcaggccctaacagagtgcccaggggttgtttctctgctgccaccttaggtacttctgaatctaggaaaatttaaaaaaccccactgttctaggaagttaaagtccacataattgagcttttttttttttttttggatttatgagactat

SEQ ID NO: 198000 - DNA, 601 bp, Human
cactatgctcagccctagaaatatgacatcgtccatgtcaaagttccttaaaatgcagcacaggtacctcaccccaaaactccccatgatctggcctagtctagcttctccatctctaccctcagagctgcttctctggcgatatctccttctgtgcccatcactccaactgtgtgacaccttccccaattcccaaacacccattgcccctcccatggtctcttctgattctcttcatgtctctcattcaaaagggctggtccttgacattgccacctagaatcttctgttccttctctayagcacactgcagatctgaaggggatgaggtgcagtgttggctcaacctccctctcagctcagcctgggagctatgctacaaaacgtggaacttcaaatccaggatgcagtcgcttttaggttgctgtgatttcagtagtaaggtgacaaaaatgccttgaaaagctcttggcaggtaatgcctttctcatgtgtggtcagtagatgaagagtgctggagcaggtgtgtgacctcacaagatggggcccagccagaatcaagaggcaactgttaacaaccagcagccaagggacagatatg

SEQ ID NO: 198001 - DNA, 601 bp, Human
gttcctcaacagccttggattcagaaggtccccaaaataccaagttcaaagactgatgttgtgcagcgcaggggccccccacaccctgtgtttccacactctgcagacaggaggggtatttcactctctcaccattcacactgtgcttgtcaggaccaagggtctgggcattgtacaggagcttgggagaagtgcagccatgaggcccagcccaaactatgaataaggagtccctttacatgaccttcaggcgatctccatgcacatcgaggttctcagaagcacctttaaggaccctgcrctgccacacagctcccactatgctcagccctagaaatatgacatcgtccatgtcaaagttccttaaaatgcagcacaggtacctcaccccaaaactccccatgatctggcctagtctagcttctccatctctaccctcagagctgcttctctggcgatatctccttctgtgcccatcactccaactgtgtgacaccttccccaattcccaaacacccattgcccctcccatggtctcttctgattctcttcatgtctctcattcaaaagggctggtccttgacattgccacctagaatct

SEQ ID NO: 198002 - DNA, 601 bp, Human
ttagtcaaccacctttgataagaactcttccatgttcctcaacagccttggattcagaaggtccccaaaataccaagttcaaagactgatgttgtgcagcgcaggggccccccacaccctgtgtttccacactctgcagacaggaggggtatttcactctctcaccattcacactgtgcttgtcaggaccaagggtctgggcattgtacaggagcttgggagaagtgcagccatgaggcccagcccaaactatgaataaggagtccctttacatgaccttcaggcgatctccatgcacatygaggttctcagaagcacctttaaggaccctgcactgccacacagctcccactatgctcagccctagaaatatgacatcgtccatgtcaaagttccttaaaatgcagcacaggtacctcaccccaaaactccccatgatctggcctagtctagcttctccatctctaccctcagagctgcttctctggcgatatctccttctgtgcccatcactccaactgtgtgacaccttccccaattcccaaacacccattgcccctcccatggtctcttctgattctcttcatgtctctcattcaaa

SEQ ID NO: 198003 - DNA, 601 bp, Human
tgggaagacacttggcttagtcaaccacctttgataagaactcttccatgttcctcaacagccttggattcagaaggtccccaaaataccaagttcaaagactgatgttgtgcagcgcaggggccccccacaccctgtgtttccacactctgcagacaggaggggtatttcactctctcaccattcacactgtgcttgtcaggaccaagggtctgggcattgtacaggagcttgggagaagtgcagccatgaggcccagcccaaactatgaataaggagtccctttacatgaccttcaggygatctccatgcacatcgaggttctcagaagcacctttaaggaccctgcactgccacacagctcccactatgctcagccctagaaatatgacatcgtccatgtcaaagttccttaaaatgcagcacaggtacctcaccccaaaactccccatgatctggcctagtctagcttctccatctctaccctcagagctgcttctctggcgatatctccttctgtgcccatcactccaactgtgtgacaccttccccaattcccaaacacccattgcccctcccatggtctcttctgattctcttc

SEQ ID NO: 198004 - DNA, 601 bp, Human
tgcaagggcacaggagaggcagagactgagggtggcaggacctagctagaggaggggacaattgagccgacacctgaaggagactaacagagacagaaaaggggctttgggaagttaagaaggtatgagaagttcaacccacggtgttttaaaaaaaatttttgctacatcacaatttgctggtcttcctttctctgctacacgtggagacaccaaagtgaatgttgggaagacacttggcttagtcaaccacctttgataagaactcttccatgttcctcaacagccttggattcagaargtccccaaaataccaagttcaaagactgatgttgtgcagcgcaggggccccccacaccctgtgtttccacactctgcagacaggaggggtatttcactctctcaccattcacactgtgcttgtcaggaccaagggtctgggcattgtacaggagcttgggagaagtgcagccatgaggcccagcccaaactatgaataaggagtccctttacatgaccttcaggcgatctccatgcacatcgaggttctcagaagcacctttaaggaccctgcactgccacacagctcccactatgctca

SEQ ID NO: 198005 - DNA, 601 bp, Human
agagagggacaaataagtacagtgtgtcgatgtgcggtgctgtgagggcacagaccagtgatcagaacacaacacctgcggcctctcccatcctgacaaagtctctgcatgccaactccagcgacagggtgctaggacagcgcagggatgaaatactgaagggacacgtcttcatgaagcagatcaaaatgcaccatcttgttattcacaatatctgggaagagaaaagccatgattttagagacctagtgcagcacacacattttgatctctactttttcagaacagccttcccagcctrcacctcctgttttaggcatctgtcttccctgaggcagctgcagagaccacagtctctcactctcactgccacagctgaggctacatcacggccccagcactggcggctccctgtgcgaggagaggaagagtgaagcggcccaagcccttggcaaaacacccagcaggctggcttcctggcaaaccacattcacccacatgagcatccttctgcagcgaagagcagctcctcaccagtgagtggaggaactgtgctgagaagagccaagagccaggatcccccaacacctggggcaggctg

SEQ ID NO: 198006 - DNA, 601 bp, Human
tttcacaacatcaatgagaaattgttctttaaagtctgaataaataaattctagcttttcttttcagtgtcttaaaaacaaagcaaaacagacatgagcaacatgaagtgatatgtttatccaactgtgtgttgttgaatcaacttttagttaaaatgttagagagggacaaataagtacagtgtgtcgatgtgcggtgctgtgagggcacagaccagtgatcagaacacaacacctgcggcctctcccatcctgacaaagtctctgcatgccaactccagcgacagggtgctaggacagygcagggatgaaatactgaagggacacgtcttcatgaagcagatcaaaatgcaccatcttgttattcacaatatctgggaagagaaaagccatgattttagagacctagtgcagcacacacattttgatctctactttttcagaacagccttcccagcctgcacctcctgttttaggcatctgtcttccctgaggcagctgcagagaccacagtctctcactctcactgccacagctgaggctacatcacggccccagcactggcggctccctgtgcgaggagaggaagagtgaagcggcc

SEQ ID NO: 198007 - DNA, 601 bp, Human
gacagatccgatacactgtggaagaaagaaatataaggaattacaacctaaacccaaaactggccccaggaagaaactagttggaatggcagaaggagctcccagctaagagctgtgttggctgggccagctctctaggcatcaagaggggagtggactcaggtgggcttgagtcctcagcaagagagagactccaaatgctgcagctgtgacaccccacagtgctctgagtaaccaaggcagtggcggcggggtgacagaggctgttctttctgtcactgggctccaaggggcaggagcagcggggtgaacacactgaaatgcaagactgactgtgcgctacaggccgtgctgagctagagcctctgcctggagggaaagtaccaagctcccaggcaacagctttacgaattctggctactacaccaagtctaaatacatgacgattttcacaacatcaatgagaaattgttctttaaagtctgaataaataaattctagcttttcttttcagtgtcttaaaaacaaagcaaaacagacatgagcaacatgaagtgatatgtttatccaactgtgtgttgttgaatcaacttttagttaa

SEQ ID NO: 198008 - DNA, 601 bp, Human
tggtaacagattgaataaatgagttcctcaatgcctatgcctcagggagataacgaatggtgactctaatcaatatccgtataagtaaaaggagagggtaatccattggacccatccatcttcccaacacacttcatctgatgtcaatctcactggcaataccattcattcattcactcattcacttactcaacaaatcctattgcatacctgtaaagttccatttgatgtgctgggggaagggaatatggcagtgaggaagccgtgttgtttgagatttaccaggaccaaataagagaayaggtgtcatcgtgtagggatcagtgccctaatgttttcataatatgcatgtacatgggaccatgagaaccataagcagggagttattggctctgtaggctatttttttttttttttttgagcagttttaggttcacagcaaaattaaggggaaggtacagagatttcctctatattcttgccccagtacacacatgcctggccaattttttattatttatttatttatttatttatttattttactgttctgaaggtatatcagcatgccaactttttagaccttttactatttggaact

SEQ ID NO: 198009 - DNA, 601 bp, Human
atcttcccaacacacttcatctgatgtcaatctcactggcaataccattcattcattcactcattcacttactcaacaaatcctattgcatacctgtaaagttccatttgatgtgctgggggaagggaatatggcagtgaggaagccgtgttgtttgagatttaccaggaccaaataagagaataggtgtcatcgtgtagggatcagtgccctaatgttttcataatatgcatgtacatgggaccatgagaaccataagcagggagttattggctctgtaggctatttttttttttttttttgagcagttttaggttcacagcaaaattaaggggaaggtacagagatttcctctatattcttgccccagtacacacatgcctggccaattttttattatttatttatttatttatttatttattttactgttctgaaggtatatcagcatgccaactttttagaccttttactatttggaactgaatctgtttataagttagtagtgggtgttaattgtatttgagattctcatatctactctgatacccagcacttgtgtagcatctactatgtgtaggtatcacatgatgtttactga

SEQ ID NO: 198010 - DNA, 601 bp, Human
tatttattttactgttctgaaggtatatcagcatgccaactttttagaccttttactatttggaactgaatctgtttataagttagtagtgggtgttaattgtatttgagattctcatatctactctgatacccagcacttgtgtagcatctactatgtgtaggtatcacatgatgtttactgatttagtaggaagaagagtcaatggggaagaatgttaaagatgcccctagaaaatgtgatttttgggtcaccactaaggcctgggtacgtgcctttttagtaagcattcaccccccaraggtacagttaggtagacagtatgcagactacacaatgagcaatgctgacctaaacaatccataaatgaataatccagattatttgtgatgtgaggtaaagaaatgtggagagtgataaatttatggtaccaaaagtgaaagcattaaaaaggcacaagattaggcaagtttaatttgtgaaggaagtaactagtcactaaaactttaatagcaagttgtatgacaggttacctagtcattaactgagtccctcttaaggagcctgagtagaagggtcctaggacaggtaagtattgata

SEQ ID NO: 198011 - DNA, 601 bp, Human
tctgatacccagcacttgtgtagcatctactatgtgtaggtatcacatgatgtttactgatttagtaggaagaagagtcaatggggaagaatgttaaagatgcccctagaaaatgtgatttttgggtcaccactaaggcctgggtacgtgcctttttagtaagcattcaccccccaaaggtacagttaggtagacagtatgcagactacacaatgagcaatgctgacctaaacaatccataaatgaataatccagattatttgtgatgtgaggtaaagaaatgtggagagtgataaatttrtggtaccaaaagtgaaagcattaaaaaggcacaagattaggcaagtttaatttgtgaaggaagtaactagtcactaaaactttaatagcaagttgtatgacaggttacctagtcattaactgagtccctcttaaggagcctgagtagaagggtcctaggacaggtaagtattgatatatggaaatagttagaaaatgtatgaaacagaggaaattaattgtataaaaggcatgccacctatagtggtggctttgggtggctggagttcaatcaggacatggaaaggagttagaagacaat

SEQ ID NO: 198012 - DNA, 601 bp, Human
cctgggtacgtgcctttttagtaagcattcaccccccaaaggtacagttaggtagacagtatgcagactacacaatgagcaatgctgacctaaacaatccataaatgaataatccagattatttgtgatgtgaggtaaagaaatgtggagagtgataaatttatggtaccaaaagtgaaagcattaaaaaggcacaagattaggcaagtttaatttgtgaaggaagtaactagtcactaaaactttaatagcaagttgtatgacaggttacctagtcattaactgagtccctcttaaggascctgagtagaagggtcctaggacaggtaagtattgatatatggaaatagttagaaaatgtatgaaacagaggaaattaattgtataaaaggcatgccacctatagtggtggctttgggtggctggagttcaatcaggacatggaaaggagttagaagacaatgaaagcaaacttcaccatacccacagatttgtctggacctaaccttgatcagtgtattcacctaaattcaggagataccctagtgttggtgtgctttgactctgtcagttaactaatttcagtgggtatcagagaagg

SEQ ID NO: 198013 - DNA, 601 bp, Human
tttaatttgtgaaggaagtaactagtcactaaaactttaatagcaagttgtatgacaggttacctagtcattaactgagtccctcttaaggagcctgagtagaagggtcctaggacaggtaagtattgatatatggaaatagttagaaaatgtatgaaacagaggaaattaattgtataaaaggcatgccacctatagtggtggctttgggtggctggagttcaatcaggacatggaaaggagttagaagacaatgaaagcaaacttcaccatacccacagatttgtctggacctaacctkgatcagtgtattcacctaaattcaggagataccctagtgttggtgtgctttgactctgtcagttaactaatttcagtgggtatcagagaaggtgcctccacaggccgttattacctcctcagccattgtcccttacctgggaacagaggatctgaaagtcttcattcgtaatgtcccatgacttcacttatgcactgtcttgagtcctatttgagatattcatttttccttcttagattcccaaaggtcttcaggtaatatattggagccacttcttcatcatattgtctattcctttta

SEQ ID NO: 198014 - DNA, 601 bp, Human
ggttacctagtcattaactgagtccctcttaaggagcctgagtagaagggtcctaggacaggtaagtattgatatatggaaatagttagaaaatgtatgaaacagaggaaattaattgtataaaaggcatgccacctatagtggtggctttgggtggctggagttcaatcaggacatggaaaggagttagaagacaatgaaagcaaacttcaccatacccacagatttgtctggacctaaccttgatcagtgtattcacctaaattcaggagataccctagtgttggtgtgctttgactcygtcagttaactaatttcagtgggtatcagagaaggtgcctccacaggccgttattacctcctcagccattgtcccttacctgggaacagaggatctgaaagtcttcattcgtaatgtcccatgacttcacttatgcactgtcttgagtcctatttgagatattcatttttccttcttagattcccaaaggtcttcaggtaatatattggagccacttcttcatcatattgtctattccttttattgatactgattgactattttgaatcaaaggagtgggaggcaggttgatgtgatggg

SEQ ID NO: 198015 - DNA, 601 bp, Human
gttacctagtcattaactgagtccctcttaaggagcctgagtagaagggtcctaggacaggtaagtattgatatatggaaatagttagaaaatgtatgaaacagaggaaattaattgtataaaaggcatgccacctatagtggtggctttgggtggctggagttcaatcaggacatggaaaggagttagaagacaatgaaagcaaacttcaccatacccacagatttgtctggacctaaccttgatcagtgtattcacctaaattcaggagataccctagtgttggtgtgctttgactctstcagttaactaatttcagtgggtatcagagaaggtgcctccacaggccgttattacctcctcagccattgtcccttacctgggaacagaggatctgaaagtcttcattcgtaatgtcccatgacttcacttatgcactgtcttgagtcctatttgagatattcatttttccttcttagattcccaaaggtcttcaggtaatatattggagccacttcttcatcatattgtctattccttttattgatactgattgactattttgaatcaaaggagtgggaggcaggttgatgtgatggga

SEQ ID NO: 198016 - DNA, 601 bp, Human
aaaaggcatgccacctatagtggtggctttgggtggctggagttcaatcaggacatggaaaggagttagaagacaatgaaagcaaacttcaccatacccacagatttgtctggacctaaccttgatcagtgtattcacctaaattcaggagataccctagtgttggtgtgctttgactctgtcagttaactaatttcagtgggtatcagagaaggtgcctccacaggccgttattacctcctcagccattgtcccttacctgggaacagaggatctgaaagtcttcattcgtaatgtcccmtgacttcacttatgcactgtcttgagtcctatttgagatattcatttttccttcttagattcccaaaggtcttcaggtaatatattggagccacttcttcatcatattgtctattccttttattgatactgattgactattttgaatcaaaggagtgggaggcaggttgatgtgatgggaaatatttgctcttaagcagagctactaacttgcacatgaagaaagggtaaaaaagattttctgaagctaacttgctttctgaaacagtgctatttctgaggtattgcttttagaggttaa
